United States Patent 11,882,838 (BACTERIAL INOCULANTS) - sequence listing, part 7

SEQ ID NO: 2628 - DNA, 25820 bp, Unknown
  Kingdom: Bacteria, Phylum: Firmicutes, Class: Bacilli, Order: Bacillales, Family: Paenibacillaceae, Genus: Paenibacillus
cggatcatcaacgcatacggcgtgacggaagcggcgatcgactccagcttctacgacgagccgctggcgaagctgccgcagacaggtaatgtgccgatcggcaaagcgtggctgaatgcgaaattctacatcgtggatgcgcatctgaacccggtgccggtcggggtgctgggcgagctggtcatcggcggagtcggagtggcgcgcgggtacttgaaccgtccggagctgacggaagagaagttcgtagacagcccgttcgccgcgggcgagcggctgtaccgcacgggagacttggcgcggtggatggaggacggcaacgtggacttcatcggccggatcgacaaccaggcgaaaatccgggggtaccggatcgagacgggcgagatcgagtcgcagctgctgcgggtggaaggcgtgcgcgaagtggtggtgctggttcgaagtgacgcgaacgggcagaaggcgctatgcgcgtattacacgccggataccggagcggaactggcggtgaacgatttgcgcagcgcgctggcgcaggagctgccggggtacatgatcccgtcgtacttcgtggagctggagcgtctgcctctgacgccgaacggaaagattgaccggaaggcgctgccggcgccagaaggggaagcgggaagcggaacggagtacgtcgcaccgcgcaatgagctggaaacgaagctggcggcgatttggcaggaggtgctggggcttgcgaaggagattggcgttcacgacaacttcttcgacatcggcggccactccctgcgggcgacgacgctggtcagcaagattcataaagagttgaacgtggatctgccgctgcgcgacgtgttccgccattccacgatcgagagcatggcggtcgccatctcccggctggatgagcagacattcgttgccattccagtggcggatgaccaagaggtgtacccgcaatcttttgctcaaaaacgtctctttatcctgaatcaactggaaggcgcggagcttagctacaacatgccggaagcgatgttgctggagggtgctttggaccgggcaaggttcgaagaagcgttccgtaagctcatggcgcggcatgaaacgctgcgcaccgggttcgaaatggtggatggcgaagcatcgcagcggatttaccaggacgtgaattttgccgtggagttctatcgagcggatgagcaagaggccgaagagacggttcgccgtttcgtccgtccgtttgacttggcgaagcctccgctgctgagggtaggccttgttgagctggctccggaacgccatattctaatgtacgacatgcatcatattatttccgacggcgtctcgatggaaatctttgttgaagaattcgtccgcttgtacggcggcgagcaactggagcctctgcgcattcagtacaaagactacaccgtttggcagcattcgcaggagcagaaggaacggcttcagcgtcaggaggcgtactggctggacatgttccaaggcgagcttccggtgctggaaatgccgaccgactatccgcgtccggccatgcagagctacgaaggccaaacgctggagtttttctttgacgcttcgaaaaccgacggcctgaagcagctggcctcggaaacgggcacgacgctgtttatggtgctgcttgcggcgtataacgtccttctgcataaatattcaggtcaggaagacgtgatcgtcggtacgccgattgccggaaggaatcatggagatgtgcagccgttgatcgggattttcttaaacacgctggctatccgcagttatccggcttcggagaagacattcctgtcatacctgaacgaagtcaaagaaacgaccctccacgccttcgagcatcaaaactatccgttcgaagaattggtggacaaggtgcaagtcacccgtgatttaagccgcaatccgctcttcgacacgctgtttacgatgcagaatacggagaacgaggaatttgagctggaagggcttcgcctgaaaccttatccgagcgcactggataccgcgaagtttgatatcagcttggatgtgggcgaggagaacgggggcttggattacagcttcgaatatgcgacggctctctacaaaagggagacgatcgaacggctggcgaaacattacgagcagctgctcgtaacgatcgtaagccgtccagatgcgaagatcgccgagttgaacttactgacggcagaggaaaaagaacaaattctcggcgcgttcaacccgacgcagccggaagcggctcctgcggccgcgttccaccggctgttcgaggaacaggcggagcgcacgccggaagcggcggccgtcgtgtacgaaaacgaccggctgacgtatgcggagctgaacgagcgggcgaaccgcttggcggccacgctgcgtgcaagcggcatcggccgggagacgatcgtcggcattctcgccgagcgttcggtggacttgctggtggccgtgctggccgtctggaaagcgggcggggcgtatgtgccgctcgacccggattacccggcggagcgcgtgcggttcatgctcgaagacagcggagcgaaggtgctgctgacgcaaacgccgctgcgagagcgtgccgaagcctggctcggcgaagaggagctggcgctggcggcggtgctgtacctcgacgacgaagcgtcgtacagcgacgagcaggcgaatgcgccgattgtctccggcaagctgacggatgctgtggacgacggcgatgagagccatcagaatgttggcaccgacagcttccatgaagcccgtccggaggatctggcgtacgtgatctatacgtcgggaacgacgggcaagccgaagggcgtgatgatcgagcaccgcagcctggtgaacacagcggcgggctaccggcgggaataccggttggatcagttcccggtgcggctgctgcagctcgcaagcttctcgtttgacgtgttcgtgggagatatcgcgcggacgctgtacaacggaggcacgatggtgattgtgccgaaggacgaccggatcgatccgtctcgtctgcaccactggatggagcgggagcgggtcaccatcttcgaatcgacgccggcgctgatcgtgccgttcctggagtacgtgcacgagcaggggctggatatgagctggatggagctgttgatcacgagctcggacagctgcagcgtggcggattaccggaccttgcaggaacgcttcggctcgttgttccggatcatcaacgcatacggtgtgacggaagcggcgatcgactcaagtttctacgacgaggagctggcgaagctgccgcagacaggcaatgtgccgatcggcaaagcgtggctgaatgcgaaattctacatcgtggatgcgcatctgaacccggtgccggtcggggtgctgggcgagctggtcatcggcggagtcggagtggcgcgcgggtacttgaaccgtccggagctgacggaagagaagttcgtagacagcccgttcgccgcggacgagcggctgtaccgcacaggagacttggcgcggtggatgggagacggcaacgtggacttcatcggccggatcgacaaccaggcgaaaatccgggggtaccggatcgagacgggcgagatcgagtcgcagctgctgcgggtggaaggcgtgcgcgaagtggtggtgctggttcgaagtgacgcgaacgggcagaaggcgctatgcgcgtattacacgccggataccggagcggagctggcggtgaacgatttgcgcagcgcgctagcgcaggagctgccggggtacatgatcccgtcgtacttcgtggagctggagcacctgcctctgacgccgaacggaaagattgaccggaaggcgctgccggcgccggaagggaaagcgggaagtggaacggagtacgtcgcaccgcgcaatgagctggaaacgaagctggcggcgatttggcaggaggtgctggggcttgcgaaggaggttggcgttcacgacaacttcttcgacatcggcggccactccctgcgagcgacgacgctggcgggcaaggtatttaaggaattaaacgtcaacctgccactgcgcgacgtattccgtcactcgacgattgcggcgatggccgaggcgatcgcccggatggaacggcgggagcatgaggccattcctcaagcggaggagagagagtactaccctctgtcctccgcgcagaaacggctgttcattcagcacacgctggatggagcggatcagctttacaacatgccggagctggtgcaggtggaaggcgagtttgatttagaccggttggaagccgccttgcggaaattgataacacggcatgaatcgctgcgcaccggttttgaaatcgtgaaggccgaagcggttcagcggatttacccgcaggtcgattttgctatcgagcatcatcaagcggataaagaggatgcggctcaaatcgagcagatcgtccgtagcttcgttcgtccgtttgatctcggcaagccgccgctgctgcgcgccggggtcatcgagctggagccgaacctgcatattctcctttttgacatgcatcatatggtgtccgacggcgtatcgatggcgattgtgatcgatgagttctcgaatttctacgccggggaagaactgccgccactgcgcattcaatacaaggattatgccgtttggcagcagtcgaaggcccaccgagagcggatcgggcggcaggaagcgtactggctgcaaaccttcgaaggcgagctgccgacggcggatctgccgatggactacgaacggtctgcggctcgcagctacgaaggcgcgcatctggagttcgacgtcgaagcttctctctctgcgcagctgcgcgaattggcggccgagcgtgaaagcacgctgttcatggtgctgcttgcggcttataccgtgctgctgtccaagtacagcgggcaggaggacttggtcgtgggtaccccggtggcgggaagaacgaacgccgatttggaaccggtcatcgggatgtttgtcaatacgctggcgatccgcaatcgtccgtcgggcgacaaaacgttcttgtcctacctggaagaagtgaaggaaacggctttgggtgctttcgagaaccaggattatccattcgaggagctcgtggagcgtttgaatgtgaagcgggagccgggccgcttcccgctgttcgatgccgttttcgacttgcaaaatatcgaagaacgagacgcagagctggaaggggtcagcctgaagacttacgagcttgaccatttggaagaagcgaagttcgatctgacgctgtttatgtatgaaaacaacggggcgctgagcgggggcttcttctacgctaccaagctgttcaaagaagcgatgatccgcaccttgaccgaggattacctgcgggtactgtctcaaattgcggaaaatccgcaactcgagctaagccggattgaatgtcataaacgggcggcaggcgcaaagagtgccgtcgatacaatcgaattcgcgttctaatcctacaagcgcgcctccgccgtcaagcgaaagcggcgcgcatcccaaggaagacggcgaacaacgtccaagcccgtaaacgcgcaggccgaaagcaagctttttcggacctgcgccggggcatgcggtcacttcatttttaggggaggtacaaatgaaatctttgtttgaaaaggaagaacagtactggagcggcaagtttgacgccgatgacagcctgagcttccttccctacagtcaatcctccaaattatccgccgacggggaagctgcggccgagccgggcttgcttcaccgtactctgccgagtgaactctcggagagaatcatttgcctcgccaacggttcggatttggctttgtacatgattgttttggcaggagtaaaaagcctgctgttcaaatataccgggcgggaccaattgctggtcggcatgccttcttatagcgcagaccccgacgggactccgccgccgcatgacatcttggtgatcaagacgtccgtaagccgccagactacgctgaaaacgctgctcgggggcatcaaagcctccatcggcgaggcgctggagcatcagcacctgccttttcggaaaatggtggagccgctccatctgaactatacgggggacggcctcccggtcgtcaacaccgtcgcatccttcgccccgattcatccggaaccgctgggtaaccgggtggcggccgatacggtttttcgcttcgaccgtcaaaaccactccatcgagatggaaataagctttgacaagcagcggtacgagcgggcatttgtggaacaggcggctgaccatcttgttcgggtgctgtccgtgcttttatttcagccggatctggagctcggacaagctgatgtgctgtccccagacgagagggagacgctgctgaagcgatttaatgacaccgaaaccgggttcgagcgggggaaaacgatttacggcttgttcgaagaacaggcggagctttacccggacaacgtggccgccgtcatgaacgagcggcagctgacctaccgcgagctgaacgagcgatccaaccgccttgcgcggaagctgcgggagacgggagtagaagcggaccagctggtagcgattctggccgaacgctcgctcgatatggttgtcggcattctggcgattctcaaagcgggcggagcatacgtgcctgtcgatcccgactacccggaggagcgcatccgcttcatgatcgaggattcgggcgcgccgttattgctgattcaaaagcatctgcacgagaagacttacttcgcaggaacgcgccttgaattggacgatttcgtttggggcgacagaggggcggactccgccgatgcgctggacgcttcgaacctggagccgatttccgggccagtcaacctggcttatgtcatctacacgtcgggaacgaccggcagaccgaaaggaacgctgatcgagcataagaacgtcgtgcgccttctgttcaacgacaagaacctgttcgacttcgggccgtccgacacgtggacgctgttccactcgttctgcttcgatttctccgtctgggaaatgtacggagcgctgctgtatggaggcaagctggtcatcgtaccgccactcacggcgaaaaatccggccgatttcctggcgctgctgggccgcgaacaggtcacgattttgaaccagacgccaacgtacttctaccagctgctgcgtaaggtcttggcggaccacccgtacgatctgcggattcgcaacgtcatcttcgggggcgaagcgctgagtccgctgctgctcaagggcttcaagacgaagtacccggagacgaagctgatcaatatgtacggcattaccgagacgacggttcacgttacgtataaggaaattacgtgggtcgagattgaggcggcgaagagcaatatcggcaagccgatcccgacgctgagcgtatacgtccttgatgaaaaccgccgccctgtgccgatcggcgtagcgggcgaaatgtacgtggccggggaaggccttgcgagaggatacctgaaccgtccggatctgacggcggagaagttcgtcgattccccgtttgcggagggagagaaactgtaccgctcgggcgacttggcggcttggctgccggacggcaacatcgaatacctaggccggatcgatcatcaggtgaaaatccgcgggtaccggatcgagctggacgaaatcgagacgcagctgctgaagatcgccgccgtgcaagaagccaaagtgctcgaccgcgacgacgcgaacggccataagcagcttgtcgcttattacgtcgcggaaacgaggctggcggcgcatgaactcaaggaggagctcgccaagcagcttccggggtatatgattccttcgcacctcgtgcagctttcgcggatgccgctgaccccgaacgggaaaatcgaccgcaaagcgctgcccgcgccggaggaagtcgcggccggaggagcggaatatgtcgcgccgagaacgctgctcgaaatgaagatcgcccgcgtctggcaggatacgcttggcgttccgcaggtcggcgtaaaggataacttttttgagttgggtggcaattcgttaagtctgatgaggctcgttcaagccgtttacgatgaaacgggcctcgagataccgctgaaccgccaattccacaatttaacagttggagccatggctttgggagagggggatctgggcctggataaagggggagactccttcattaagctgaataaagcaggagatctgaacgtgttctgcttccctccgggcagcggcttcggcatcggttaccgagagctcgcaagcaggctcgacggctggttcgtgctctacggcattgattttatcgacgatgtcgtcgattacgaggccatgctgaaccgttatgtggacgagatcgtccgcatccagccggaaggaccttacgtgctgctcggctactgcttcggaggcaacctgacgttcgaggtagccaaaacgatggagaaaagagggtattccgtaacggacgtgctcatggtggactcgtggattaaggacacgctgacgccttccgaaacgtcggagaaagagcttgaagaaacgcttgccgatttcgacgaagaagagaaggaattaatgagcaacccgctcgtgcgggagcgggttcatcggaaggtcaaagcgaccttggcgtacgaagcgcagcttattaattccggcacgatcccggcccggatttacgaaatgattgcgaaggacagcgaagcgttccgcttgaagcaccaattgccttcgtggcggggggcaacgacgcgagcttacgccgattaccggctggagggcgcgcacgaggaattgctggaactcgcgcgcgtggaagaaacggccgtcgtcatccgggacatcttagagcaagtcaagcggcagatcgaagcggaggccggggtactgcatggaagctgaccgccagccgtctgttctagaacaaggcacagcggcgccttccaagcgccaaaccgcttacgccgcctggaaagcgttccgctggctgatgtcctatgtaagccgtcacaaaggctggatgatcgtcggtatcttgtccgcgattgccgccgccgttattgagatatggatgggaagtttgatcgagcagctgaccacccaggccgagaagggggcagggccaatcgttctgcaaatcgtgtacacggtctttgtggtcatcttgatcggtgtgccggcgaagtttttcatgagcttcggcgtggagcgaagcagcgcctctgcggtgcaggatatccgcaaccatgtcatgcgtcatgtcggcaaactcccggtctcctacttggaaaagcagcactccggcgacgtattgtcgcggatcaacaacgacctgcagctgatccagcagtttatgattcgggacctcgcccagtggttttatcatccgctggtgttcatcggctgtttcgcttatttggtctacctccaatgggagctgatgctgtacagcctgctgttatttcccgtagcgctgctggtttcccaatggatcggcaagcagttggagcggttgacggaggaagcccaggcgaacatgggccgaatgaacgtcaacctccaggatacgcttgggggtatgcctattgtaaaaagctacctgctatccggcatgttatctcgctcctaccaagtgctgctgcaattgacggcccaaaaaaagctggcggtgaaaaagcgggaagcctgggtcaacccgctgctttccacgctgatgatcagcccgatcattttcgccgtcagttacggaagctatttgatctacaaagagcagctaggcgcgggagagctgatcgccttcctgtacttgctgaatctgtgtctggagccgctggagcatattcccgagcttatcacgcggacgttcgaaatggccggtgccctgagaagggtctccgaaatcgtcgagcagccgaccgaaacggaaaatggccgttcgcttccgaaagcgagcgccgcccccatcgagtttcagaacgtaaccttcgggtatgaggagagctccccgatcctgcggaatgttagcttctcggtgccggaagggaagacgatcgcgcttgtcggagcgagcggcggagggaagagcacggtgtttaagcttgtatgcggcttttatccgcttccggaggaccagggcgagatccgcgtgttcggcagcctgatccacggcgccgatccggagcagcttcggtcgcatttttccgtggtaacccaggattcatatttgtttagcggcacgatcgctgaaaatatcggctacgggcgggaagtagcgtcgatggacgagattatcgaagccgccaaagccgctcaggcgcattccttcattatgcagctttccgacggctaccagacgtatgtcggagagcgcggaggctttttgtccggcgggcagcgccagcgcattgcaatggcccgggcttttctaaagaatgctcccgttctgctgctggacgagccaacgtcagctcttgatccggagtcggaaagcgcggttcaggaagcgctgggcgtattgatgaagcagagaacgacgatggttattgcccaccggctttctacagtacaaaacgccgacgaaatttgggtcatggaacaggggagtattgttgaaaagggcactcatgaacaattgctgaagatgaagggactgtacgcccagtcgtactatcaggaatttaccgagtctgccgaacgcagggaggtggcgtacacatgaaaaagggcggatggctctcgcaagtgaaagaactcggctacttgctgatgtttatgaaccgcaagcgcaaaacccagtacgccattggcctggccgtgacggcgctcacccagacattgttcctgatcgccttcagcttggtcgtacataacttggttgatttcgccgtgtcccgagatacgtccctgatggtggaagcctttattattttgggcgcggccttgttcctggaaaatgtgatttctccctggttcatttacttataccagcgcagtgtcgagctgactgtgctgaatatccgcgaacgtctttatgacaagctgtgccgggtgcggccgagattcctggagcagacgcaccatggggatttgctgtcgcgggtgaacaacgacgtaacgaccgttgagtttacattctcgcaggtttacttcgttttgctgcttcaagttgtcttttgcatcggctccattgtctccatggtgttgatcgattggcggtttgccggcgtatccttcgtcattctgctgctgtcctccgtggtcagcctgaaatttgcgcgggatattcgcgccttgtccgaacaaggcttgcaaacgctcggtaaaatgaccgaaaaattcaaagattttatgggcggcattcaaattgtgaaactgttccgcatccgcacgatttacggccagtacgaggcgttgaacgaacaaatgacgcagacgcttcggcaaaccgcgcagaagaacggcatgcaggctgcggtgaatcattttatcagctacgtcacgttctgcggcatcatcgtcatcggcagtcttctttatgcctacggactgatgggaatgggaagcgtcgctgccctggcggttctgcaagtaaatctgacgcacgccttgttgaacttggggatggttctgtcgatgacccaaaattcgatcgcgggcgctcaccggattcaagaggtactaagagaggaagaggaaccggagcgtttgggatctcctcacagcgagctcgtgtcggaggctgcggtggagtttcgcgatgtggaattttcctatcaggcggataaaaaggtgcttgtcgacatctccatgcaggtgtttcccggccaggtcgccgctatcgtgggggccagcggcagcggcaaaagtacgctgatcaagctgctgctcggcttttatcctgtggacagcggagaaatcctgctccaaggcaaaccgttcggccattacacgctggacgaaatccgcaggcagattgcatacgttccgcaggagccgttcttgtttaccggcacgattgaggaaaacatccgctacggcaacccggatgcaacggatgaagaagtgatcgaagcggccaaagcggcgtacgctcaccatttcattcaggaacttcctgaacagtataaaacgccggtgggagagagaggagcgtcgttgtcgggcggacaaaggcagcgaattgcgatcgcccgggcgattctcaaaaacgccccgattctgctgctggacgaagcgacttccgcgctggataacgaatcccagcattgggtacagcaggccctgaacgtattgatgaaggggcgcaccaccattctgatcgcccaccgtctcagcaccgtggaacatgcggatttgattaccgtcatgaaccaagggacggtcgttgagcggggccgccatcaggacctgctggcgctcgagggttattacgcccggctgtacggctagacccgctttacggcgggcggcttcctgcttgcgaatgcgacagagtcttttagtaatccaaggtatgactttataaccggtagttaccagaacacgaaaaaggggacagagtccgaaggagccgttccgggaatggctgcgcggttcttctaagagtgactaagtgacatctaggtacaaagcctatctataaagaatctctaaaccgggagtgtgtcgatgtgagagagaataccaacgagcaatatggattaacgcaagcccagcgccgaatatggttcatggaaattatgaatccgggaacgtccatcacgatgctttccgcgacctaccagattacgggcgagatcaacacacagcttctggagcaagcggcggcagagatcgtcaaaacctatgacgttttccgaatccgcattagcggggatttgcaaaatccaacgcagtggttcgaagagccggagaatgtccaagctaggataagccgcctcgaaataggcacaaccgaacaattctatgcttgggtgaaagaagtaagcgaaaaaccggccagcgtgttcgacgaacacctctaccaatttacgattatccattttgcgaacggccaagtatggctcaatttgacggtaaatcatattatcgccgacggcttgtccgtcaatgctttgctgcatgcggtgatggaaaaatacctggaactgcgcaaaggcatctccagcagttaccaggcccctacctatctggattatatttccgcggagcgtgaatatgagcaatcgcagcgttatcaaaaaggcaaggaatactggctgacgaagtacaacactttgcctgaaacgaccggcattaaatcgtatccgccattctcgatcggcagcgaatccaataaactggccatcactttggacggttctcggtatgaacgcattctggccttcagcgaacaatatcaggtcagcttatatacgttatttctgtccgccatgtacgccttattgtacaagctgaccgacagcaccgatgttccggtcggcacggttttcgccaatcgcaccagcaagaaggaaaaagaaacgatcggcatgttcgtcagcaccgtggctacgcggattcgtctgaatccagacgggcacgtgctttccttgatccaaacggtttccaaggaaaatacggcggatctgcggtatcagaaatacccttataatcaattgatccaggatttacgcgaacaacacggccgcaacgatctttcggggctgttccgcacgtctctggaatatctgcctttgaaaatcgtggagtacgaagaaatcaaggtacgcctggaggctcacttcgctagacacgagatggacgatttgctgctgcgcttcgaccatatgctgaatgaaggccatgtaattctccatgcttcctatcgtaccggcctgttcgagacggccgagattgatcggattatggaacagtatgtaaccgttctggaccagtttcttcagactcccgaactaccggtacgcgagatttctctgctgagcgatgaggagagacaccgcattctcaacgtttttaacccgccggtgtcagggctgagcaagggagaagcgtttcatcggtatgttgaaaagtttgcccgggaaattccggatcatccggcagtcgtctacatggacaaacagctgacctacggcgaattgaacgaacgcgccgagcggctggcttctctccttcgcgaacagggcgtgggaagggagacgattacggggatctgggcggagcgttcagtggaactgctggtcggggtgctcgccgtttggaaagccggaggaggctatgtaccgctggaccccgattatccggcggagcggattgagtacatgctcagcgatagcgatgcatcggtgctgcttacgcagcgtcatctgttggagcgggccgggggttggttggccgatgaccggctgaagcttcaagctgtctatgccatggacgatgaacagatttataacggggatgtcttagccgtggaatttgaatctgccggcagcgccccacaagacttggcttatgtgatttacacctcgggtacgacgggacgcccgaaaggcgtcatgatcgagcacggtagtctcgtgaatacggcggatgcgtaccgtcgcgagtaccggttggatcagtttccggtacggctgctgcagctggccagcttctcatttgacgtgttcgtcggagacatcgcgcggacgctgtataacggaggcacgatggtgattgtgccgaaggatgaccggattgatccgaacctcttatacggctggattcgggaccaaaacattacggtattcgaatcgacgcctgcgctcatcctgccgttcatgcagcatatttatgaagaagggctggacgttagctccatgcagttgctgattaccagctcggatgcttgcagtgtcaccgattaccgattgctgcaggaaagattcggcggacaattccgcatcatcaacagctatggcgttaccgaagcagccattgacagcagcttttacggtgagccgctggataagctgccgccgtcgggtcatgtgccgatcggcaaagcttggctgaacgcccggttttacattgtcgataccgcgttaaagccggttcctgtaggggttccgggcgagcttgtcatcggcggcgccggggtggcgcgcgggtactggaaccgtccggacctaaccgccgagaagtttgcggacagcccgtttgtgccgggcgaacgtctgtaccggacaggcgatttggcccgctggctggaagacggcaacgtcgacttcatcggccggatcgactatcaggtgaaaattcgcgggttccggatcgaactcggcgaaattgaaacggccctgctgcgtttcccgggcgtcaagcaggctgtggtgaccgaccgtacggatgagcaggggcaaaagtatttgtgcggctacgtggcggcggatgcttccttgcagctgagcgatctgctgtcccaattgaagcaagagctgccggcccatatggtcccggcccggctggtgtctcttgataagcttccgctcacgccgaacggaaaaattgaccgtaaagcgctgcctgaaccgaccggagaggtagaagtaggccgtgagtacgtggctcctcgcacaacgctggaaacaagacttgctctcatttggcagcaggtgctgggtattgcgcgagttggagtccaagacgatttctttgacttgggcggtcattccttgcgggcctccacgcttgtttccaagattcggaaagagctgcaagtcgaggttccgctgcgggaagttttccgctacaccacgatcgaacagctggcccaaagaatcggcggtttaaggcagcaggagacgtatgagattacaaaggcggctgaggccgagtactatccggtttcatccgagcaaaagcgtctgtacgtcctgcgccagcttgacggggccgagcgcagctacaatatgtcggcggcgcttcttctcgaaggcaagctggaccgcacgcgcgtcgagcatgcgttccggtcgctgattcagcgccatgagacgctgcgtaccgggatcgagcaggttcaaggggagcttgtccagcacatctatgacgaggtggagtttgctgtcgattatttccaggcgggcgagcgggaagtggaccaagtggtggaagcttactatcacccgtttgatctgaccaagccgccacttctccgcatcggcctgatcgaagtcgccgaggatcgccacattctgctgttcgatatgcaccatatcgtctcggacggcatttcgacagcgctgctcttcgacgagttcagccgcttgtatcggggcgaggagctggccccgctgcgcattcaatacaaagattatgccgtttggcagcattccgaagcttacgggcagatgctccagccgcagaaggagtattggctggaacagctgtcgggcgagctgccggtcttggagctaccgacggacttcccgcggcctgcggtgcaaagctttgacggccgaaccgtgaagttttatatcgggaaagagcggacagagaagctgaaagagctgtcggcacggacagggacgaccctgtacatggttctgctgtcggcttacaccatccttatgcataaatattcgggtcaggaagatctgatcgtcggaacgccgattgccggaagaacgcaggaagaagtgcagccgatcgtagggatgtttatcaacacgctggccattcgcagccgtccggagcgttccaagccgtacctttcgtacctggaagaaatcaaggacatcacgctcggggctttcgaacaccaaaattatttgtttgaagacttggtggaaagtcttcacattccgcgcgcgaccggccggaatccgctctttgacacgttcttcgccctgcaaaatacggagaacgagcaaattgtcatcgaggggctggagcaatcgttttatccactggaaaaccaaacatccaagttcgagctgctcctggatatttcggagctggacggtcagctcgaatgccggttggagtacgctacggctttgtataaacaagagaccgcggagcggttcgccagacattatgacaagctgctcgaaaccatcgcagcagcgccggacggggatattgcctcgctggaaatgctcacggaggaggaaatccgcgagttggtgcgcggtttcaacgattcggaggcggactacccgcggcagcagacgattcacggcttgttcgaagagcaggcggagctttacccggacaacgtggccgccgtcatgaacgagcggcagctgacctaccgcgagctgaacgagcgatccaaccgccttgcgcggaagctgcgggagacgggagtagaagcggaccagctggtagcgattctggccgaacgctcgctcgatatggttgtcggcattctggcgattctcaaagcgggcggagcatacgtgcctgtcgatcccgactacccggaggagcgcatccgctttatgatcgaggattcgggcgcgccgttattgctgattcaaaagcatctgcacgagaagaccgactttgcaggaacgcgccttgaattggacgatttcgtttggggcgacagaggggcggactccgccgatgcgctggacgcttcgaacctggagccgatttccgggccgggcaacctggcatatgtcatctacacgtcgggaacgaccggcagaccgaaaggaacgctgatcgagcataagaacgtcgtgcgcctcctgttcaacgacaagaacctgtttgacttcgggccatccgacacgtggacgctgttccactcgttctgcttcgatttctccgtctgggaaatgtacggagcgctgctgtacggaggcaagctggtcatcgtaccaccgctcacggcgaaaaatccggccgatttcctggcgctgctgggccgcgaacaggtcacgattttgaaccagacgccaacgtacttctaccagctgctgcgtgaggtcttggcggaccatccgtacgatctgcggattcgcaacgtcatcttcgggggcgaagcgctgagtccgctgctgctcaagggcttcaagacgaagtacccggagacgaagctgatcaatatgtacggcattaccgagacgacggttcacgttacgtataaggaaataacgtgggtcgaaatggaggcggcgaagagcaatatcggcaagccgatcccgacgctgagcgtatacgtccttgatgaaaaccgccgccctgtgccgatcggcgtagcgggcgaaatgtacgtggccggggaaggccttgcgagaggatacctgaaccgtccggatctgacggcggagaagttcgtcgattccccgtttgcggagggagagaaactgtaccgctcgggcgacttggcggcttggctgccggacggcaacatcgaatacctaggccggatcgatcatcaggtgaaaatccgcgggtaccggatcgagctggacgaaatcgagacgcagctactgaacgtcgagggcgtggaagaagcggtggtgctcgcccgtcaggacggcgggggcgagaaggcgcttgtcgcctactttgtggcggaccggacgctgacggtcagcgaaatgagaacctcgctggcccaggaaatgccggggtacatgatcccgtcgtacttcgtgcagctggagcgcatcccgctgacgtccaacggaaaagtggaccgcaaagcgctgccggagccgcaaggcggcttgcaaacgggcgtcgaatacgtagcgccgcgtaaccggacggagtcccagcttgtgaagatctgggaggaagtgctgggctactccggcattggagtcctggacaatttcttcgagctcggaggccactccttgcgggcgacgaaccttgtcagcaagattcagaaggaaatgaacgtcgaacttccgctgcgcgatgtgttccgctatacgacgatagagtcgatggccggggctattgccagcttggaagaaacgcggcacagctcgattccgaaagcggaagagaaagcgtactatccggtttcctccgcgcaaaaaaggctgtacgtcctgcaccagctggatggctcggagctgaattacaacctcccaagtgccttgcagttggaaggggctttgaacgaggccaaagtggaaaaggcgctgactactttggtggcccggcacgatatgctgcgcaccggttttgaaatcgtgaatggggagccggttcagcgtattcatccgctcgtagctttcaaggtcgagaagcttcaagcaagcgaagatcaggttgcggccattcttgaaggcttcattcagccttttgatttgacccagccgcctttgctgcgcgccctgctgatcgaactggagaaagagaaattcctgctcgcgctggatattcatcatataggttccgacggcctttccatggacgtgctgctgcgcgaattcgtgcggctttacaatggggaagaattgccggagctgcggattcaatacaaggattacgccgtttggcagcaatccgaggagcagcgccagcgcatcaaacggcaggaggaatactggcgcggggtattcagctccgagcttccggttcttgagctgcctctcgacttctcccgcccggccgtccagcagtttgacggtcaaacgctcacgtttacgctggatgcggagaaaagcgaagctctcaaacggcttgccggcgatgcgggggcgacgctgtacatgcttctgctggctgcgtactccgtattgcttcataaatacgcgggacaggaagatatagtggtcggcactccgattgctgcccgttctcacgccgacctgcagccgattatcggcatgttcgtcaatacgctggcccttcgcttgggtccggcggcggagcggacgttcatggattacttgcaggaagtgaaggaaacgacgcttggagcctacgagcaccaggactatccgttcgaggagctggtggaagctcttcaggtgagccgggatttaagccggaatcctctgtttgacaccatgttttctttgcaaaaacacgaaagcttggatttaaccatggaaggcttgcaatggtcgctgttcgacatcgaggaaaagacggcaaagtttgatcttagccttgatatcgtggaagccgataacgagctggtttgcaagatcgagtacgctacctcgttgtttagacgggaaacgatggtacggctggcgggtcattacgagcagctattggcgtcgatcctggctcagccgggtgcgcggatttcggatttggatatcttgacggacagcgaaaagcatgatttgctggtcgggtttgacgtgtcgtcttcggctcttgcgaagcaacccgccgcagagggtacaggtttggaagcggatgagtcgtggagagagagaacgttccacgagctgttcgaggagcaggcggagcgcactccgggggcgctggcggttgtctacgaagacagcaagctgacgtatgcggagctgaacgccaaagcgaatcgtctggcgtatgcactgcgggcgcgcggggtgaagccggagcaggtggtcggcattctggccggccgttcggcggagctgttgatcggggtgctcgccgtatggaaagcgggcggcgcttatgtgccgctagacccggactatccggcggagcggatcgagtatatgctcgcggacagcggggcgtcggtgctgctcacacagacccgcctgctggagcaggcggaagcttggcgcagcgacggagctctagtgctgcaaacggtgcttgcgcttgacgacgccgcgacgtacagcctcggagcggctgtgggcgaagcaggcgcagaggcggaggctttggcgcaagcggaaacggcttctgccgaaacgtccgccacggcagaagccgagaagaacgtactagcggcggatctcgcatcgaatccggcgaatgtgaacaagccgcgcgatttggcttacgtcatctacacctccggtacgacgggcaagccgaagggcgtgatgatcgagcaccgcagcctggtgaacacggcggcgggctaccggcgggaataccgcctggatcagttcccgatccggctgctgcagctcgccagcttctcgttcgacgtgttcgtcggcgacattgcgcggacgctgtacaacggcggcaccatggtcatcgtgccgaaggacgaccggattgatccaacccgcctctacggctggattcgcgactacgccgtgacggtgttcgaatcgactccggcgctgatcgtgccgttcatggagcatgtgcatgccgagggtctggacctcagctcgatgcagctgctgatcacaagctcggatgcgtgcagcgtagcggattaccgcaccttgcaggagcgcttcggctcgcagttccgtattattaacagctacggcgtaacggaagcggcgattgactccagcttctatgacgagccgctggagaagctgccgaagacgggcagcgtgccgatcgggaaagcgtggctgaacgccaagttctacatcgtggatgcgaatctgaagccggtgccgatcggggtgttgggcgagctggttatcggcggagcgggtgtggcccgcggttacttgaaccgcccggatttgacggcggagaaattcgtagacagcccgttcgccgctggggagcggctgtaccggacaggcgacctggcgcgctggatgccggacggcaacgtggacttcatcggccggatcgacaaccaggtgaaaattcgcggctatcggatcgagcttggtgagattgaagcggccatgaaaaattttgccggcgtgcgtcaagcacttgtcatcgaccggacggacgagcgggagcagaaatatttgtgcgggtatgtcgtagcggattccagcttcgatcttgaagggcttgtggccaatctggacgccgcgctgccttcccatatggtgccttcgcgcatcatgcgcctggatcaaatgccgcttacgccgaacgggaagatcgaccgtaaagcgctgcctgtaccggaaggaagcattcgtgccgaggctgcatacacggcgcctcgtactcctgccgagcaagcacttgcgtcggtctggcagtcggtgctgggcgtggatcaggtcggcacgatggacaatttctttgcgctcggcggcgattcgatcaaggccttgcaggtatcgtcccgtcttttgcaaacggggtacaagctggtcatgaaagatttgttccattacccgacgatttccgcccttagtttgcagctgcaaacggcggagagaacggcaagccaggccgaagtgacgggagaggtcatcttgaccccgattcagcgctggttctttgaacaaaatcaggccgacgtgcatcacagcaaccaggcgttcatgcagttctccaagcaaggctttgacgaagaagctttacgccaagcggtgcgtcagcttgtcgtgcatcacgatgctctccgtacggtttaccgccaaaccgagaacagctataccgcctggaaccgcggcgccggggagaacgaagcgctgttcgatctggaagttgtcgatttcaagggagtcggcgacgtgaaggaagcggtagaggctaaggcgaatgacattcaagcgagcatcgatctggaaaacggtccgctggtgaagctcggcttgttccgctgcgacgacggcgaccacctgctcatcgcgatccatcacttggtcgtagacggcgtatcctggcggattctgcttgaggattttgctgccggctatgagcaggcgctgcaagggcagccgatccgtctgccgctcaaaacggattcattccaaacgtgggcgaaacagctcgctgattatgcgaacggtccggcgatggaaagcgagagagagtattggcagcatatcgagcaattgacctatgagccgcttccgaaagattttgaacaaggcagatccaagctgaaggacagcgggctcgtgaccgttcgctggacggcggaggaaaccgaacagctgctgaagcaggcacaccgtgcttaccatacggaaatgaacgatttgctgcttgccgcgcttggcctcgcggtacaagcttggagcggtcgggaacgtgtgctggtgaatctcgaaggccacggccgggaagagattttgccggatgtggacattacgcgcacggtaggttggtttacaagccaattccctgtcgttctggagccgggtcacgcccaggcgctcggtcatcaggtgaaacaggttaaagaaagcttgcgccgcattcctaacaaaggaatcggctacggcatcctgcgttatttgtcggcgccgcgtgacggcgagcgtttcgctttggagccggagatcagctttaactatttgggtcagttcgaccaggattacgaaagcagcggctcgaggccgtctccgttcagcccgggctccgattcaagcccgaatgcagtgatggattatgtcctcgatatcaacggtatggtgtcggaaggagtgcaggaactcacgatccgttatggggaaacccagtataaacgggaaacggtagagcgcctgggcaccctgcttcattcgagcttgcgtgaagtcatcagccattgcgtatcgaaagagcgaccggagcttacgcctagcgacgtactgcttcaagatgtgacgttggaggaactggagcggctggccgaacatacggcgtcgctcggcgaactggagaatgtatacaccctgactccgctgcaaaaagggatgttgttccacagcctgctggatgtcgattcggaagcttacttcgaacaggtgaccttcgatctgtacggaagcctgaatgtcgaagccttcacccaaggattggatacgctggtgcagcggaatgaggcgctgcggaccaactttattaccggctggagagacgagccaattcaagtggtattccgcgagcggaagtgtgaagtgtactttgaagatattcgctcggtaagcgatgaagacccggagaagacgatagccgatttcgtcagcgcggataaagcgaacaagttcgatttggcccgaggctctcttatgcgcgtgacagttttgcgcacgggcgacgagtcctaccatgtgatctggagtcaccatcacattttgatggacggctggtgcatgtccttcatgatcaaggaagtgttcgacacctacttcgcgttccaagagaagcggacgctggagcttcctccggttacctcgtactcccggtatatcgaatggctggaagctcaagatgccgcgaaagcttcgcgttactggtccgagtatttggcgggttacgatcagcagaccaagctgccccaggagaaaacgcagctgaagcagggcgcttttgaagcagctgaaatcgatgtggaactcagcaaggaactgaccgggcaaatcgagcgggtggcgcgccagcagcaggtgacgctcaatacgttcatgcagaccgtatggggactggttctgcaggtatacaacaacagcgaggatgtcgtattcggctccgtcgtatccgggcgtccggcagaaattccgggcatcgaaagcatgatcggcctgtttattaatacgatcccggtccgtattcaaggcaaagccgaggagacggtagccgatatcttgagaaaaacccaggatcaagcgctggcatcgggagcttacgaaacgttcccgctgttcgaaattcagtcgctgagcgagcaaaagcgcgacttgatcaaccatatcatggtctttgaaaattatccgatggaagaacagattgaacaggtcgtcggcggagacaaagaagcgctgaaaatcgctaatatccagtcgccggagcaaacgaactacgacctggacattaccgtcattccggaagagcatattttactgcggtttacgtacaatgggctgacgttcagagaggaagacatcaggctgatccacggtcattttgcccgggcactggagaaggttgcgactaatccgaacatccgcgtgaatcagttggagcttttgacggcggcggaaaaagagcaaattcttggcgcgtttaacccggtgcagccggaagcggctcctgtggccgcgtttcaccggctgttcgaggaacaggcggaacgcacgccggaagcggcagctgtcgtgtacgagaatgaccggctgacgtatgcggagctgaacgagcgggcgaatcgcttggcggccacgctgcgcgcaagcggcatcggccgggagacgatcgtcggcattctcgccgagcgttcggtggacttgctggtagccgtgctggccgtctggaaagcgggcggggcgtatgtgccgctcgacccggattacccggcggagcgcgtgcggttcatgctcgaagacagcggagcgaaggtgctgttgacgcaaacgccgctgcgagagcgtgccgaagcctggctcggcgaagaggagttggcgctggcggcggtgctgtacctcgacgacgaaacttcgtacagggaggagcggacgaatgccgacagcttccatgaagcccgtccggaggatctggcgtacgtgatctatacgtcgggaacgacgggcaagccgaagggcgtgatgatcgagcaccgcagcctggtgaatacggcggcgggctaccggcgggaataccggttggatcagttcccggtgcggctgctgcagctcgcaagcttctcgttcgacgtgttcgtgggagatat

SEQ ID NO: 2629 - DNA, 25995 bp, Unknown
  Kingdom: Bacteria, Phylum: Firmicutes, Class: Bacilli, Order: Bacillales, Family: Paenibacillaceae, Genus: Paenibacillus
ggtcgagggcttatcctaagataaaacgcaaataagtttcggatccagttttcagggtgtaaccttgaaggtagaatttgcacagcaaattcatgtttggtggcgatagcggaggggttccacacgtacccatcccgaacacgaccgttaagccctccagcgccgatggtacttggaccgcagggtcctgggagagtaggacgtcgccaagcagagctttatgattaatattccctgatagctcagttggtagagcactcgactgttaatcgagttgtcacaggttcgagtcctgttcggggagccatttgctctcatagctcagcaggtagagtgcatccatggtaaggatgaggtcaccggttcgaatccggttgagagcttgttataggatggcccgttggtcaaggggttaagacacctccctttcacggaggtaacaggggttcgaatcccctacgggtcataggatagtatggaggcttagctcagctgggagagcatctgccttacaagcagagggtcgggggttcgagcccctcagcctccaccatttttcatcctcttacctggatgaaatcttggggaattgtgaatcatatgcatattggggattagccaagcggtaaggcaacggactttgactccgtcatgcataggttcaaatcctatatccccagccattaagagccattagctcagttggtagagcacctgacttttaatcagggtgtcgaaggttcgagtccttcatggctcaccattgtattacatgcgcgtgtggcggaattggcagacgcactagacttaggatctagcgtctttgacgtgggggttcaagtccctccacgcgcatcttgtttttgcggacgtggctcagcggtagagcatcgccttgccaaggcgagggtcgcgggttcgattcccgtcgtccgctccatatttgcgcccttagctcagctggatagagcgtttgactacgaatcaaaaggccgggagttcgaatctctcagggcgcgccatacttaaaaaaagtataatatcgggatgtagctcagcttggtagagcacctggtttgggaccagggggtcgcatgttcaaatcgtgtcatcccgatactaatttgcgggtgtagttcaatggtagaacttcagccttccaagctgatagcgtgggttcgattcccatcacccgcttaccgattacctagaagccgaaaggcttctttttattttgtccacattacatttacttctatgtatataagctactgcagttatgtctcctgtcatgcacagttggggatgacttgtgcatattgtacataggctcttgttacttatgacatctagatcccgaatttcccctctagcgtaccccttttctcctgcagtaaggctaatttcgtgatcaaatcctttgaatataggaatcctatagctattatggtacgaattcatggtgataactctgcatctgctcttgcgttgtgcacattgccttttatttatgtgggtaaaagcgaagtcttaaagaggaaatgccctagaaacactaagtaaatggctaatttgtgtatatctttgtggatagaaggataatggggttgactttgtcaacaattaataaacatatacacagtatgttgcatgaatttgcacctttaaaaccacactctttataagagactgtgcataatgtttcacgcatcactagtgtatacattcatttctattatttatttcatctttttgcataacaatccaatattttcttaaaagaagtatttcaaaaacatgattttttactgtaaattttgcagcttttcatgcggttttattgtatgatgttaagaaagtgtcaaatttcgtatgtatacgtacctttgctacaactgtatatggtgtggaacagatcagatggggggaaaagcatgactgagcttacgttaaccgctaacaaaaaccaatccaacaatctgctgcggcgggacgttcgttttctagggaatattcttggtgaggttttggttcatcagggtggcaacgaacttttggatatcgtggagaaaatacgtgagacaagtaaatcgttacgtgccgggtatcaaccggagttgtatgagaatttcaaacaaatggtcagcggactggatacggatattcgtcaccaggttattcgcgcgtttgcgatttattttcagttggtgaatatcgctgagcaaaaccatcgtattcgtcgtaagcgggattatgagcattccgctggtgaagatgttcaacctggttccattgaaagttccgttcaggagcttaaacaagggggcttctccgccgaggacgttagcaacttgctgaatgagctctctttggagctggtcatgaccgcacatcctacagaagcgacacgacgagtaatacttgatatccacaagcgcatttccgaggatgtcatgctgctggataatccgatgcttaccttacgtgagcgggaacaggtacgggagaatctgctaaacgaagtaattacgctttggcagacagatgagctgcgtgatcgcaagccaactgtattagatgaagtaagaaatggaatgtattattttcacgagaccttgtttcatgtactgccagatgtgtaccaagaattggaacgatgtttggacaaatattatcccgaacaaaaatggcacatacctacttatctgagatttggttcctggatcggtggagaccgggacggcaatccgtctgtgacagctcatgtgacttgggaaacgttacgtatgcagcgcaagttggctttgagagaatatcagcacacgttaaaggaactcatgggttacttgagtttcagcaccagcattgtgcgagtttccgatgatctgctagcttctattgaagaagaccgtactcatattacacttaaaaagatggaagtatggcataacgaaaaagagccttaccgcattaaactggcatatatgattgctaaagtgaacaacatcctggatgaaagcaaacagggtacccatgagcgttataattctgcggaagagctcattgcagatctaaatgttattgacaacagcctgcgtcatcattttgccgattatgtggcaaacacatatattcaaaagatgattcgccaggtagagttgtttggattccatacagctacgctggatgtacgtcagcatagtcaggaacatgaaaacgcgatgactgaaatactgtctaaaatgaatattgtgtcggattacagtaagctgtcagaagaggaaaaaataaatctgctggaaaagctgctgaatgaacctcgtccgattacttcaccgtatttaaaatatagcgatagcacacaggaatgtcttgacgtatatcgtacgatttatttggctcaggaggaattcggcaagcagtccattacaagctacttgatcagtatgactcagggagccagtgacttactggaggttatggtcttatccaaagaggtaggcctgttccgcatcgagaaagatggcactgttatctgtacgctgcaatccgtccctttgttcgaaacgatagatgatctgcacgctgcacccgatattatgagaagattgatgaacttgcctgtatatcgacaatctgtggctgcgatggaccagcttcaggagattatgttgggatattcggacagtaataaagatggcggtgtggttacagcgaactgggaacttcgggtcgctatgaacagcattacggaagtagttaatgagtttggcgtaaaagtgaagtttttccacggtcgtggaggtgcgctgggtcgtggaggaatgccacttaatcgcagtattttggctcaacctcctcatacgattggaggcggaatcaaaatcacggagcaaggtgaagtactatcatcccgctactcgcttagaggcatcgcgtaccggagcttggagcaggcaacatcggcgctgattacggctgtggcatatcatcgttccgggaagaaggaagtgtttgaggagagctgggaggagattatcgcccgcatttcccaagtttcactggataagtatcaggatttgattttccgagatccggatttcttcaacttcttcaaagaatctacaccgttgcctgaggtgggtgagctgaatattggatctcgtccgtccaagcgtaagaacagcgaacgttttgaggacttacgcgccattccatgggtttttgcatggacacaaagccgttacttgttacctgcatggtatgcggctggaacaggtttgcaaagcttctatcaaaacaatgaggataaccttaaagtgctgcaaacgatgtttagggactctgctttcttccggtcacttattgatacactgcaaatggcaatcgctaaagcggatttactgattgcagaagaatacgctgggatgtcggataacgaagaggcccggcagcgtattttcgggcagatttcagcggagttcaagctgacatctgagttgattttgaaaataaccggacaatccgagattttggacgatgtgccggttattcaggaatctatccggttgcgtaatccttatgtcgatccgttaagttacttgcaggttcaattgctaagtgagctaagggagctgagggatcagaacggtgatgacactgaaatgctgcgtgaggtattgttgacaattaacggaattgcagcaggcttaagaaatacgggctgatatagtacggttgtacgaaaacaggcaatcgggtactcatggggtgcccgattgtgctgtttgtatattgatggtaggcgtgcttgcagttagtaacaaggctacagttgatttctggataaaattaaactacgatgaataatcataaacatgtaataagtaacccatcagcaagtctgggggagtatagagtggataatatggaaagccgcttggtaaggctggtacagaaaggcgatcagcgagcttttgcggagttagtcgagttatataaagatcggatttttcatctttcctaccggatgctaggtaatcgccatgaggcggaggatctggtgcaggaaacttttttgcgtgtgtatcgtaatttggaaaaatatgatcatggacagaagttctcaacctggatttatcgaattgctacaaatctgtgcattgatcgtctgcgaaggagaaaacctacatactcacttgatgctgaaatgaatgatcaggaaggtgtcgatgggtacgccatgctcgccagtgaagagcttacccctgaggggagtacgcttctgtccgaaacgcaggctttgattcatgacgccattgacagccttccagataaatacagaacgattatggttttacggtacttgcaggagctttccttacaggaaatcagcgatgtgctcaatctcccagttaccactattaagacaagagtacacagggggcgggattttctgcgcaaaaaactggagcacaagctatagatcataggcatagattctaggaaaagagtctgcatagatgtttttatgaaacataatgctcgttgtaacgtatgtaagatgagcaaagtttctaagccggagcatgttatgttgagaaacacggaagaatagttagaaaggattggctcatatggattgcaaacaagccgtctcttttatgcatgactatctagatggcgacctgtctgagcaggacaaacatgagttggaacagcacttgttagactgcccggaatgccgcatgcgttttaaagagctggagcggacggatgcgatgctttacggtacacgctatcatcaagtgccgtgtgtatcggatgagctgacatttcgcattatgaatgctttgccgccgcataaaagacagactgcggtgcctatgctgacgtgggtgaaaaggcatcccgctgtaacagccgctgccttcttccttattgttatatgctcaagcatggccagcttttctagcacggaccatcaattggtagtcaaaggaagccaactggatcaagtcgttattcagggtgatactgtgattgtgcctgaagggaaatccattgccggagatttaacagtgcaaaatggtgaagcccgtgtatacggtgatgtggaaggaaatgtaactgtgattgatggttcttattatcaagcgtccaccgcccatattgcaggacaggttaaaagtattgatcaaaccttggattggatttggtacaaggttactgatttattcgggggaccctcttctccataaaagaagcttgaaatggcaaggacaaaatcgagcgcctctttccgctggaaaaggcgtttttttgtatatgaagctggcgaattgtactgtattttactgattttagcggttcttttgtcacacagcttgcaacgtgagcctgatcgttataacctagatagagagagcatactgtgtacatattacacccactcactacagaaaattgcgggggcatgcgcatgttggattattttgcggacctgacttggaaagagtccattaaagatattatcgacattttgatcgtaacctatattatgtatcagcttattttacttgttcgcggaacgcgtgcagttcaattgttgaaagggattctgtttctagttgtcatttgggcggttagcacctggtttgatttgtatacgctcaagtggttgatgaaccagatgttcacctttggtgtggtggctatctttattatttttcagcctgagttgcgtcgtgcactggagcagttggggcgtggcaaattatttgggcgttcgtctgcggatgatgaagagattaacaagttaatcggagaaatgattaaggcgctgaattatctatcacgtaggaaaataggagctttggtcgtatttgagcgcgagacagggctaaacgaatatacggagtctggtatcaagacacaggccgtagtcagttctgaactgctaattaacatcttcattcctaatacgcctttgcatgatggtgcggtgattattcaaaataaacagattgcttctgcggcctgttatttgccattatcggaaaatccgttcatcagcaaggaattgggaacccgtcaccgggctgcgattggggtgagtgaggtaacggatgccgtaactgtagtggtatcggaggaaacagggcaaatttctttggccattaatggacaggtcgtgcgcgacattaaggaagaatccctaatctccaagctgtatgaggagttgcggccaacaccgtccttgaaagaaaaacgcggctcattctggaatcggaggggaggccgtggaaattcatgatggacaaatggattaacaataatacgatttccaagatattggcgcttgcggttgctgtcctgctgtggggaatggtccatctagatacaggtacaccttcatctacgctgaccgtttcttataataataaagtgattgataatgtgggcattcaggctagtggtctggatgattcaaaatatgtattgtctaccatggatactgaccatgttaagatggaggttagaggacagcgctctgtgctgacttcttttttcgcggataattatcaggcaaagctaaacttaaacggcttaggagcaggtactaaaacattgtcactcgaaccggacttgccggatggagtggagttggtgtctatgactcctaaccgtgttacagtgacgattgaggaaaagcaaacgaaatcatttaatgtatctatagttcctaaaggaaacccagatgggggactgcagcttgggaagcctgtaattgctcctcaaaccgtgaaggttaccttgcctaaaagccagttgagtaccgttactgccgttcaaggggctgttaatacggatggtatctcagaaaagtttgaacagaagcgtgtaaaactgaaggcttataacaaaaagggacaggaacttacaggagcggtcattgagccatccactgtgtccgttgaaattccggtaactcagcaggcgaaatctgtgcctgttaagattgtctatgctggagagttgccagacggattggcgctttctaaagtcaatgcaaacgtgaaggaagcggcggtatatgcatcgcaggatgtattgagcagcctcagttcttacgtcacggctacattggatttaagtcaattcacggaagcggggactcgtacagttcaagctaatttggcagccccctcaggttctgataaaatcgagccagggtcaatacaaattcaggtgaccgtcgtcccttccaatgaagtcacagatacggaacggacgctgtcaggcatcccaatcgttttacaaggtgcaggagataaagcgactacgactgttacagcacccgtaggtaagacgatggatgttactgtgaagggcccgcaggatatggtaaacaatttaaccaatgatgatattagtttggtggcagatgtaagtggcctcgcggctggtcaacacgaggttactctgaaagtaggcttgcctaaatatattacgcaagccggaaatgctggccaactaaaggcaacggtcaacattgagagcccttctacgcctgctgtaacgaatccgaatagtgagaatgaatcaaacccctctggtagtggcgaaaaggagcaggagaggccacaggaggggcaaggcagtcaaggtggggattctgacgctaagaccggggacaacgcagctgcggaggataaaacaaatcctcataacggcgcagattcttctgcgaatggaacctcggagaacaatcagccataacatgttatctgtagtaaataatcaagatttattagacaaaaaaagggagtcattttacatggggaaatactttggtacagatggtgtacgaggcgttgctaatcaggaacttacagccgaactggcatatagcattggccgctgcggcggatatgttttagcaggtaatgtagagaaaccgacagttgttattggtatggatacacggatatccggactgatgctggaatcggctcttgtagccggtttgctgtccattggggctaatgtggttcgtctaggtattgtttcgacacctggggtggcatatctcacacgtcaattgaaagctgacgctggtgtaatgatctcagcatcacacaatccagttgaagacaacggcattaagttttttggcggtgacggttttaaattgacagacgaaacggaattgaaaattgaagagctcatggatgcaaaagaagaccaactgcctcgtccgattggcggcggattgggaacggttgttgtagacgagcattctcgctacgattatctggagttcttgaaaacaacaattagccattcttttgaagggttaaaaattgtactggattgtgctaacggagcagcttatgagctggcaccgaagctttttgcagaactgggagctgaggtacacactattggtgccgagccgaacggtctgaacatcaatgatcattgcggctcgactcatcctgaaaagctgaaagaggaagtacgccgcttgaaagcagatattggtttggcctttgacggcgatgccgaccgtctgatcgcgattgatgagaacggggaagaggtagacggcgactatattctctgcatttgcggagatgcaatgaaccgtgcgggaaaactcaaggacagcaccattgtatcgacagtgatgagtaatatcggtttttataaagctactgaaaagctggcactgaagactgcaaaaactgcggtcggggaccgttatgtgatggaagaaatgcgtcggggtggatttaacctaggcggtgagcagtctggtcatgttattttcctggatcacaatacgacaggcgatggcatgctgactgggattcagctggtagataccttgaaagcttccggcaagaaaatgagtgagctaaaatcgctcatgaaacagtatccgcaagtgctcgtaaatgtgcgtgtgcaggacaaacgcaattacgaagggaatcctgccattgcagaagcaattgagcaggtggaacaacaactgggcgataatgggcgtgtattggtccgtgcttcaggcacagaatcacttattcgtgtgatggccgaaggcccggataaggacgaactggagcaatttgtcggtcagatcgtagatgtcgtgaagaaagaattagtttaaaattttgtaaacgtcggttgcctgtgaaaaagaagcaggcaacggcgtttgcggttatttactaacgatttatggccttcatggtgtaattatgaataaagtgtcattgccaaatgatacttagctgaatataatatagggatgctgtgactcagatagagaaagcgagggttgtaaggtaacgtaatacaagcgccagagcttgattttgtgcgggggaacttggtggagaagcaatggattcagttgagataaagttgctcgcaaatcggttcacgacaaaacaagctgacgaggtgaaggtgttcgaaacattcggcggggaccttccggtgaagcatcgagccgtaaaccggcagcggaaaatgaacaggcaactgtttacacaacgcaccggtagatgcctttattattttacaacctaaattataagattcatttcatgaatgtgcggccatcatcattggcgtgcgcggtttgggaatttcgttacattcgtgaagagatgcctgtaaattctatagttatcattgacaacttcatagatgaatgaactttattccacaatctaccgcacacgttagtcctgtgatgagtcgtcttgtgaaatgatgatcgggaggataacgaatatgtgtggcattgtaggatatattggtaatcagaatacgcaagaggtattgattgacggattgaaaaagctggagtatcgcggttatgactctgcgggtattgccgtgtttacagattcaggattgcaagtagccaaggctaaaggtcgtctggcgaatctggaagctaaactggatggtacgccgttggtaggccatgcaggtatcggacatacacgttgggcaacgcatggtaagccttctgatgaaaactcacatccacatttggatgagagccaaaagttctccgtagttcacaacggaattattgagaactatctggagctgaaggagcagctgatcagcgaaggtcatacctttatttccgaaacggacacggaaattatttcccatctggttgcgcgtgaatataaaggggatatcgttaaagcagtacaaaaagcaattacctttatgcgcggtgcttttgcactgggtgtgctgacagagcacgagcctaataagctggttgctgttcgtcaagctagcccgctggttattggtgtgggagaaggcgagaactttatcggttccgacattccggctattctgaaatatacacgcaatgtatttattttgaacgatggcgaaatggctgttttgaccagtgatgctgtcgaattaatgacaatcgaaggccaatttatttctcgggaaatgattcatgtcgaatgggatgctgtaacagcggaaaaaggcggctatgagcatttcatgttgaaagaaattcacgagcagcctaaggcttatcgtgacacaatgttgggccgtatcgataaagatactaaaaaagttgttcttcctgagctgaagctgacagaagaacaaattaaaaatatccgtaacattcaaattgttgcatgtggtacagcttacaatgctggtttgattggtcgtacagttattgaaagtctggctcgtataccggtagaaaatgatgtggcttccgaatatcgttatcgttcacctatcgtaacaccagagacattggtgatcgtggtgagccaatccggtgaaactgctgacacgttggcagccctgcgtgaagcacaagcaaatggcgctcatgtactggcgattacaaacgtagtcggtagctccattgcccgtgatgcagatgatgtgttggttacactggcaggaccggaaattgccgtagcctccactaaagcatattcttcacagttgattgcgttctatctgtttggtttgtatctcgctcaagtgcgtggcacacaaacggatgagcaagtagctcatgtgctggctgctatggaatccctgccagagcaagtggaagagatgctgggtaaagcagatgcgatcaaagcctatgctgagcaaattgcaagccacaagcacctgttctttattggtcgcggtcaggactatgctgtagtacaggaaggctccctgaagctcaaggaaatttcctacattcattccgaggcttatgctgcgggtgaattgaagcatggtacactggcattgattgaagacggcattccggttatcgctttggtaacacaggaatccgtgttggagaaaaccgtgagcaacattaaggaagtcaaggctcgtggtgcagatgttcttgcgattacgtacgaagagcacgcagttgagttgctgaagtccgtggatcaggtatttgccattccgaagacacttccaattctgtctgctgcaatttcagttgtatctctccaactgttggcttactacgcttctcttgcactgggtcatgatgttgacaaaccacgtaacctggcgaaaagtgttactgtagaataagctttaagttgcttttatgacttttgtctggtgataaaaaagtctggaaccagtaaaagatgtatggaaccaataaaaaaagtgtggaaccagtaaaaaaagtctggaactagtcattttacaaacatcaagaaagatcccgatgatatatcgggatcttttttgcttaggagggtaattatgtctacaataggcaacgaatttgaactattagaaaaacaaacaacttgaatcaaataaagtttgcaaatataattggaatttctcaaggaacgttgagtgagctggagtaagataaatacagaccctctcttgatataattatagcaattaaagaaaacttcaattctcatatagagtggttaatctttgaagatacgcctgtatcaaagaacactatttttaatttagccattgaagctcaggaattagaacttatttctttgtttcgagaacttactaaagaagatagagatgaaattattgattttataaaactgaagattgttcggtactaatctttcgcgggagttccttaataatatgtcttagaattactcattttaattttggtacataaaagtcacgaattatccatatgccgattattcctggcatttatgcataaaaaaattaaaaatgtgagaaatggtttgaaagagctttgaaagaaggcggttggaacctcagcattagatataccccaactgatctaaaatcaatttacataagaaatgaatttgaagattatgaagaatgtagatcggtggtaaaagaatcattacaaggtcttaacatagagacctatttacagagtgtgcaactaatgaaacttgcaaaggaaatattgaaagactatccctaaaagtaaaacttcagctaacatatagttaattaaattgtaaaagaaggtgtgaggcgctacttctttaagcgaactaatgggtactaaaattttctatttactatatcttttctttaaaggagagacaaaatgctccattaaaaaggtaatatttttaccgattagattcaaatcttcttgttctaatacctggccatttaattcaattcgaaaaccagagtttagaaatgataaaagatcaaaggattttttgattttctcgttattaaggtccgaatgaattgtatcattgagtccacacagtaggggaacgtcatttgattagcaatacaaagtaaataatcggttgtaacatcaaaaacctctgctaaagatattaaatgattaatttcaggtcgtgctacatttcgctcccaattagaaacaacgtgtttggttaccccgattttattagcaagttcctcttgtgtccatttatggagtagtcttaaatttctacatggctgtcccaaagtattcatgagttcacctctattgagaatatcaaataggttttaacccgacccatctgcttactaattatacctacttatagcccatattatagcttttcataccctactgtactctacgagtagctatgaataggatacaaagtaaaatatagctaaaaaatattgctttgctattgtataaagctgtgagttgttatattctacatttgtattttgaagtaaactaaaatatatcttaggagtagaaaaagataactgaactttactctgatttagtagttctaaaaagaaggtgaataatgaacaaaattcgatcaagtaaatctatagcatctattcaacggaaaatcaaagaaggaagaggtcaaggccacttttcggaatataaaccttggttgactgtacatgatgtaccttcaatagggatagttactcgaattcttggttggaaaagtggtcgacttcaccattatctgtctgaacactttgaattggcacatcattaccaaatggagtggtcagagcaagagattgatattcgcgaacaatttcctttattacccctagataaaaccctctatattgcacaaaagttaggcattaaacatccaactgaccccaagaataagcttcccatcattatgactacagatatgttacttacagtaaaacaagaagaaagtataaaatttattgcacattccgcaacccgtaaagcgccaatatatccccaagaaggatgcggatcgggcatacgagatcattcgaacgataatggaacgtctggagttaacgttacacccgacctaaacgcgagtatccaacggattttccagcagaatatccagctgacatccagtcgcgtttccagccaggcttccagaaattcgtcaggtaatcatgttaagttatcgcaaagcgcaaggatccggagcaccggcagagaatgtttacagggaagatcttccaaatcggccggcaccccgcctgaatgtcgacacgcgtcgaattcctcgattgatggcaaaccattcccagcgtttcttctccattcgctctttttaggcaaaatattaacaccgtgttgaccaaatttaactgaagttttactatacattattggaaattttgatataattctacctaggtcaactttccaattatgatagaaaatagaattggatggtttttatacctatccaagctgtgtgcgagagaccagtccactggctacccagcaagccggcatgcggagaccgacaattgtggaaaatgacagccgagaatatgttgatccatgacgtcagaaggtggggacctgttatattctgaggacggaagagcatatattgatttttttgcaggtgccggggcactgaattacggtcataacaacgattatatcaaggaccgggttctcgattacttgacctccgaccggattatgaacggtctggatatgtatacaatggccaagcgcgaattcttcaagagcttctcggagcggatcctggagccgaagaagctgaattacaagcttcaagtctgcggtccgacggggacgaacgcggtggaagcggaccttaagctcgcacgcaaggcgaagaagagaaccgggatacgcattcatgggcggcttccacggcatgtcgatcggcagcctgtcggcgacaagctccaagtccatgagggaaggggcggggcttcctctgggcggagttacgttcatgccgcacccgaacggggctttcgcagaaatggatacgctcggctatatcgagaatatcctgactgattcgcactctggaatcgacaagccggccgtcaaggcagctctcgagttccgggacagagccgccctggaagcccaggtgaagcagaaggaagagtttgtgcgctcgttctttgacaaagaaatcaagcctctgcatccgtccatcgccatccgcggacttggcctgatctggggcattgacgtctcgggcttcacggatgaaaccggggcggagcgaataacggggatcagcttcgagaacgggctcatcattgaaagagccggcagaggagaccgcgtactaatgatcatccctccgctgaccgtctcgatggagcatctggccgccggctgcgacattatcaagtccagtatgcagtaggtgatctctcatgagacccaggatttgctggtaacgacctaagctcggccaagccggtggccgccccggcaagaggcacggaagtgccttccgggggccgtgcggccctgatgttaagataacgctttcaccctcatgcagcaccatcgtcacatctaatcgtcaggaaaagctcactaccccgcagccggatctttacttatccacaccaggcgggggaatatacaaatcgtacatagagtgtatcaatatcccttaaacataggcttcgacaaaggcagctccggtgccgaatctggaggtacggtcgacttcctgctggccggccggaaccctacagcaagccctacatcgatgggaggaacatcccttgtccacccccaaatccaattccgaacccaatgttaaaccaaagaccgtcttcaggcggcacgtccgcagcaagcatattgaagcagaggagccggaagcagccgcatttcttgcgtagaacgatgctctttgttgtctttcacgcatgggagccgagcgggacaggtgctaggcagaggattgccgcatgcgatcaaccgggcaagcgaagcggtgacctggcgaaagctattgacattgttgtcacatgtttgaaaaggcggcgagcgttgctgcggcatatgctccgccggattgcttttaccgatgaagagaggggaacgatccagatggcttttgaaaaagaaacgttgttttggaacgaaaaattcggtagcgacgattataccttgacgcggctgccttacagcaaagctccaagctccctgacgcccattatgacaaccgtcggcggaacgctttcggaggaagtggcgcagcgcgtccttcaaatgagcaagggcgctccgctggccacttttatgattttgctcgccggtgttcagtcgctcttgcataaatatacaggcgcttctgacattctggtcggcatgccggttgtacggaaaccgacggagacgcgccgatccgttaatcatacgatcattttgaaaaactcgctttcggtgggtgcgacttttaaaacgcttctgagcgagctgaggacttccttgccggaagcgattcagcatcaacatattccgttcttgaaaatgacggagaagctggacctgcaatatgcaggcgggatacccgtcgtccatacgctagtatcccttaaggagctgcatctggacgaaatcgggcaaaacgtggtcacagattgttcctttgaattcagcttaaccggcgggacgatacagctagcgctgtcatataacgagcacttatatgactccgagttcatgactcgggtcgtcggccatctgaatcgcctgctggccgtggggcttcacgagttggagctggacatcgtgcgggcggacatgctgtcggaggacgagaaatttcaattgctgcaaagctttaacgataccgagaaggactatccccgtgatcggacgattcatcagctcgtggaggagcaggtgaagcgggtgcccgaagcgacggcggttgtctttgaggggcggcggctttcgtacgcggagctgaacgaacgggcgaaccggctggcgcggacgctgcgatcggtcggcgtgctgcccaatcagctggtaggcttgatggctaggagatcgctggagacggtcgttggcattctggcggttctgaaagctggcggtgcctacgtgccgatagacccggaatacccggaagaacgcatccgctacattctggagaactcgaacgcgcagctgctgctgactcaaagggagctgcagcagcaggtgtcgttcgaagggaccgtggtggcgctggatgacgagcaggcctacagcgacgatggctcgaacctggagccggccagcggtccgaacgatctggcttatgtcatctatacatcaggtacgacgggcaaacccaaaggggtcatgctggagcatcgcgggctggtcagcctgaaactgacgtttgcccatacgcttcacacgaccgaacaggatcgagtgctgcaattcgccagcctatcgttcgatgcgtcgtgctgggagatgttcaacgctctgtatttcggggcgaccttatatataccgtcaaccgagacgattttggatgatcagctgttcgaacgtttcatgaacgagcatgcaattacgatcgccactttgccgccaacttatgcggcttatttgaattcagaccgcctgccgagtctgagcaggctcatcacggcgggctccgccgtttcagccgaattcgtgcagcagtggaaagacaaggtacagtactataacgcgtacggtccgacggaagcctcgatcgccacatccgtgtgggcggcgtcttcgcatgataccgaacgcagagcgataccgatcggacatccgatctggaaccatcgcttgtatatactgggcgcacagaatcagctggcgcctatcggagtggagggagaattatgcatcgcgggcgtcggcctcgcccgaggatattggaaccggccggatctgacggcggagaaattcatcgaacacccgtttgagcccggagagagactgtaccggacgggcgacttggcccgctggctgccggacggaaatattgagtacttgggccggattgaccatcaggtgaaaatccgtggattccggatcgagatcggcgagattgaagagcagcttctgaagatcgactccgtgcaggagacgatcgtaatcgcgcgggaaggcaaaagcgggcaagaactgtgcgcttacctggtcgcgggccgcccgcttacgctcggcgagctgagaagcgagctggcgcaaaaattgccgaattacatgattccggcgcattttgttcagcttccgcggatgccgctcacgcctaacgacaaaatcgatcgcaaggctttgcccgcaccggaaggaaacgcgctgaccggcggcgcgtacgtagctccccgcaatgaagccgagcggacgcttgccgatgtgtggcaggcggtattgaacgccgatcgcgttggggtaacggatcatttcttcgagctgggcggagactcgatcaagtccattcaagtatcttcgcggcttcatcaagccgggtacaagctggaaatccgggatttgttcaaatatccgactatttcacagctcagcctgcatgtgaaaccgatcggacgtaccatcgatcaaggcgaaataacgggtgaaacggcgctgacgccgattcagcattggtttttcaagagctcctttgcggacccgtatcatttcaaccagtcggtgatgctgtatcggaaggaacgcttcgacgaagagacggtgcgtcaggtgctgcaaaagctggctgagcatcatgacgccttgcggatggtgttccgcaagacggaacaagggtttagcgcgcggacccgcgcgattcaggaaggcgggctgttcacgctggacgtgttcgacttcaagcatgcggagaataccgcgcaggctgtggaagcgaaggcaacggacattcaagcgggtatcgatctggagaacgggcccctcgtgaaggcgggactgttccggtgcgcggacggcgaccatttgctgctcgcggttcatcatgccgtggtggacggcgtgtcttggcgcattttgatggaggatttcgctctgggttacgagcaggccggcaaaagcgaggaaattcgtttccctgcgaaaacggatgcgtaccgcacttggtccgagcagttggccgcttacgcgcaaagcccggagatggcgaaggaacgggcctattggcaggccgtggaacaaattgcggttccggccgtgccgaaggatctggaggcagaggttacgacgcagcaggacagcgaatcgctgttcgtccgtttgactcccgaagaaacggagctgctgctgaagcgggttcaccgggcctacaacaccgaaatgaacgatattttggtaacggcgctcggcatagccgttcgcaagtggacgggacacgaacgggtgctgatcaatctcgaaggacacggacgcgaatcgatcggaacgaatatcgacatcacgcgcacagtcggctggtttacgaccaagtttccggtcgtcctggagccggaaaccgaccgggatttggcctatcagattaaacaggtcaaggaaagcttgcgccgcattccgaacaaggggcttgggtacggcgtatgccgctatctctcccaatcggaggatggctttgtttggggcgcagagccggaaattaattttaactacctcggccagttcgacgatgatgtcaatcaggacgagatcggcatatcttcttattccagcggcagcccggccagcgaccggcaggcccgcagctttgtgctggatatcaacggcatggtgctggacggcgctttatcgctcgatctcagctacagccggaagcagtatcgcaaggaaacgatggaagccttcgctcagcggcttgagcaaagtctccgagagctcattacccactgcgcaggcaaagaaaacaccgaattgacgccgagcgacgtgcaatttaaaggcttgaccatcgcggaattggagcaaatcgcccagcgctcgggccatctcggggaagtcgaaaatatttactcgcttacgccgatgcagaagggcatgtggttccacagcgcgcttgaccgacaaacggccgcttacttcgagcagacgcgttttacgatgcggggagcgctcgacgtccagcttttcgagaggagctggatggagcttgcgaaacgtcatctggtgctgcgggcgaattttgtgaaaggaccggcgggcgagccgctgcaaatcatatatcgcgacaagccggtcggctttgaatatgaagagctgcttcatttgcaggcggacgagaaacaagcgtatttggataaaaaggccgaggatgacaagcttcgcggcttcgacatggaacatgacgcgctcgttcgggttacgatcctgcgcaccgaagagcaaagctatcatgtgctgtggagtttccagcatattttgatggacggctggtgcctgccgcagctgacgcaggagctgtttgagacgtactcggccttggcatccggcaagcagccagcgggagataagggatcggattatggcgcttatatcgaatggttggagaaacaggacgatcaggcggcatccggctattggacggcattcctggcaggttatgaagggcaaaccgtactcccgggacaaaaggaaccggcgccaaacggcagatttacggctgatcacgtcaccgccgagctgggcaaggacttgagcgagcggatggaccgggtggcgaaacagcgcctggttacggtcaatacgctgctgcaagccgcttggggcgtgatgctgcaaaaatataacggaacaaacgatgccgtattcggcagcgtcgtggccggaagaccggcggaaatcccgggcatcgagtccatgattgggctgttcatcaatacggtgccggtccgcgtgacgagcgaagcggacaccgtgttcgtcgacctgatggcgaagctccaagagcgggcgctggagtccgggcgttatgattactatccgctgtatgaaattcaagcccgcagcgtgcaaaagcagaacctgatcaaccatatcatcgctttcgagaactatccggtggacgagcagatggagcaggcgggcgaccagcagcacggcgacctgacgatcgctgacgttcagatggaggagcagacgaactataacttcaacgtgactgtggtgccgggagtcgagatcgaaattcgattcgactttaacgccgaagtgttcgataaagacagcatcgaacggctcaaggggcatctcgtccatctgctggagcaggtgacggataacccggaaattaccgtgggcgagctggaacttgtgacggaggcggaaaaggccgaccttctcggacgttttaacgacaccaccacggaatttccgcgcgggaagacgctcattcaattgttcgaagagcaggcggagcgcatcccggatgcagccgctatatccttgaatgagcaagagctgacctaccgcgagctgaacgatcgcgtcaaccgccttgcccgtaccttgcgtagccacgggatatccaaaggccgtctggtcgccattatggctgagcgttccatcgaaatggtggtgggcatgctggcggcacacaaagccggagcggcttacgtaccgattgacccggaatatcccgaggagcgtatccgtttcttgattgaggattcgggagcgcaggtcatgctgacgcaaagccgcttgcgcgagcgcctggcgggttcggactccgtgatcttactggatgacgagtccttctatcacgaggacggcacaaatctaaatccgggcaccgaagcgacggatctggcctgcgtcatctatacgtcaggcacgacgggcaagccgaaaggcaaccttgtttcgcaccgcaacatcgtgcggatcgtgcaaaatacgaattatatcgacatcaccgaacgggatcatgtcctccagctttcgagctattcgttcgacggagcgattttcgatattttcggcgctttgaccaacggggcgcggctggtgctggttccccgcgagactttgctggaaatcgtccggctggcggatctcatccagcgtgagcgcatctcggtcatgctgattacgacggctttcttcaacgtccttgtagatgtgaacgtcgattgcctgcgggatgtccgggcgattttgttcggaggagagcgagtgtcggtcggacatgtacgtaaagcgctcgcccatatcggaccgggcaggctcaaccacctgtacggcccgtcggaaagcacggtttataccacgtaccttccggtcgacttcgtcgatgagtcggcggttaccgtacccatcggacggccgatcagtaatacgaaggtgtatatcgtcgacagccggaataagcttctgccgatcggcgtggccggggagctttgcgtcggcggagaaggcttggtacggggctacaataaccggccggagctgacggcggagaaatttgtggacaatccgtttgtgctgggagagcgcatgtaccggacgggggatttggcgaaatggctgccggacggcacgatcgaatacgtgggacggacggacgaccaagtgaaaatccgcggcttccgcattgagctgggcgagatcgaagctcagcttcagaaagtggagggaattcggaaagcgacggtattcgcgagggaagacgcctccggcgagaagcagctttgcgcctattatgaagcggaccgcgagcttacggcggccgagctgaagagcgtgctttcccaggaactgccggcctatatgattccggcgtacctgatccagttggagcggctcccgctgacgacgaacggcaaggtcgaccgcctatcactcccggcgccggaggagagcttgcagccgggcgaagaacgtactccgcctcggactccgctggaagccagcttggcgggaatttggaaaagcgtgctcggactggagcacatcggggttcatgacaacttcttcgacctgggcggccattccctgcgggcgacgacactggtgagcaaggtgcatcaggagctgaacgtcgagctgcctctgcgcgacgtattccgctactcgacgatcgaagagatggctctcgccatctcccggatcggagagcagtcgttctcgtcgattccgctggcgggcgcaagagcatattatccgctttcctcagctcagaagcggctgtttatcctgaatcagctggaaggggctgatcagagctacaacatgccgggcgtgctgctactggaaggatcgattgaccggagcctgctggagaaggctttccgcggactgatcacacggcacgaaacgctgcgaaccggctttgagatcgtacaaggcgaagctgtacagcgcatttacgagagcgtcgactttgccgtcgagtaccgtcatgtgagcgaggaagaagcgcccgaagtcgtgcaggccttcatccggcctttcgacttggcgaagcccccgctgctgcgggcggagctcgtagagctggcagccgaacgttatttgctgatgttcgacatgcaccatatcgtctccgacggggtttcaatggacgtgttagtcgaggaactcgttcgtatgtacggcggcgagtcattagagcctttgcgcattcaatacaaggactatgcggtatggcagcagtcggacgagcaaaaagtgcagttgaaacgcgaggaagcttactggctggaccgttaccggggcgagctgccggttctggaaatgccgacggactatccgcgtcctgccgtgcagagctttgagggacaaacgctgacgtccttcgtggacgaggcaacgaacgaaggcttgaagcagctggccgctcaaagaggaacgacgctgtatatggtgctgcttgcggcatataccgtgcttttgcaaaaatacacaggtcaggacgatttgatcgtcggaacgtcgattgcgggcagaacgcacggagacacgcagcctttgatcggaatgttcgtcaatacgctggcgcttcgcaattatccggcttcggagaagaccttcctatcgtatctggaggaagtgaaagaaacgaccttaggcgcttacgagcatcagaattatccgttcgaagagctcgtcgataaagtgcaggtcagccgggatttgagccgtaacccgctgtttgacacgatgttctccctgcaaaacttggaggataaagagtttgagctggaagggctgaaattgtccccgtaccctagcgaatacggcacggccaagttcgacctgagtgtggatgtaacggaagaaaacggcggcctggagtgcagctttgaatttgcaacggctctttataaagaaagcacgatccggcggctgtcgactcatttcggacatttgcttgcggcgatcgtaagccgtccggatgcgaagattgccgagctgaacttgttgacggcagaggaaaaagaacaaattctcggcgcgtttaacccggcacagccggaagcggctcctgcggccgcgttccaccggctgttcgaggaacaggcggagcgcacgccggaagcggaggccgtcgtgtacgagaacgaccggctgacgtatgcggagctgaacaagcgggcgaaccgcttggcggctacgctgcgtgcaagcggcatcggccgggagacgatcgtcggcattctcgccgagcgttcggtggacttgctggtggccgcgctggccgtctggaaagcgggcggggcgtatgtgccgctcgacccggattatccggcggagcgcgtgcggttcatgctcgaagacagcggagcgaaggtactgctgacgcaaacggcgctgcgagagcgtgctgaagcctggctcgacgaagaggagctggcgctggcggcggtgctgtacctcgacgacgaagcgtcgtacagcgaggagcgggcgaatgcgtcggttgtctccggcattgtctccggcaagctgacggatgctgtggacgacggcgatgagagccatcagaatgttggcaccgacagcttccatgaagcccgtccggaggacctggcgtacgtgatctacacgtcgggaacgacgggcaagccgaagggcgtgatgatcgagcaccgcagcctggtgaacacggcggcgggctaccggcgggaataccggttggatcagttcccggtgcggctgctgcagctcgcaagcttctcgtttgacgtgttcgtgggagatat

SEQ ID NO: 2630 - DNA, 1651 bp, Unknown
  Kingdom: Bacteria, Phylum: Firmicutes, Class: Bacilli, Order: Bacillales, Family: Paenibacillaceae, Genus: Paenibacillus
aagcccatcaagagtggatgcaacgtcaggaagcgtactggctcgacaccttccggggtgaactgcctgtgctggatctaccgacagactttgcccgtccgtcggtacgaagtacggcaggcgatacggtggtgttcgggctggaacgtgaagtcagcgaacgtctgaaagaactggcggcgcacacaggctcgacgttgtatatggtgctgctggcagcgtacaccgcgctcttacaccaatacagcgggcaagaggacatcgtagtcggcacaccgattgcaggacgaccgcatgcagatttggaaccgatcctcgggatgttcgtcggtacgttggcattgcgaaactatccgacagcggaacataccttccgcagctacgtggaagaagtgaaagtttgtgctctgcaagcctatgaacatcaggactacccatttgaggaactggtggaaaagctaaatgtgaagcgggatatgagccgccatccgctgttcgatacgatgtttaccctgcaaaccaccgaggaaggcgaactgcaactggcagatctgagcttccgtccatacggtttggaacaaacgccagcgaagtttgatttgacgctggaagccagagaggaagaggcaggtatccagttcggattacagtatgcaactgcgttgtacgagcgcgaaacggtagaacggatgacgcgtcactttgttcgcttggccgaagccgtggcggcgaacccggatgcgaagctgggtgagctggagctgattacggcggaagaaaccgtgcagattctggaggtatttaatgacccgaacgcacatagtgtgcattgtgctgaacacagacaggtgcaaggccgttcgctcagcgaacgctttgaagagcaagcgaagtgcaaccctgagcggatagcagttgtgtctggggccaccgcgctgacctacactgagctgaatgagcgtgcgaaccaattggctcgtgtgttacaagcggaaggggtcgaagcagatcaaccggttggcgtattgctggaacgttctgcggatattctggtgagcattctgggggtacttaaggccggaggcgcatatgtaccaatggatacgatgtatccacaggagcgcatcgactacatgctccaagacagtggggccaaggtcgtgattacaagcagagttgccaacctgtcgctcagcttgccatccacagttcgagctgtagtcttggatgatgaggacgttcaagctcaactgggagcacaggatgcgagcaatctaatccctgtcgcccgcccgcataacctggcctatatgatttacacgtcaggtaccactggccagccgaaaggggtcatgatcgagcagggcagtgttagcaatctggtagatgctttattggagcgagtatacagccgttatgaacagccgcttcatgtcgcatggctgtcggcatttgtatttgacgcttcagtgaagcaaatctttgccagcttgctgttaggccacaccctgcacgtggtgtcccgtgacgtcagtctgagcggagagcatttgatcgcctactaccgcacgcaccggattgatctgtcggacggcacacctgcgcatctgcatattttgaacgaaagcgtcaatgtgacggaagcgccgga

SEQ ID NO: 2631 - DNA, 67578 bp, Unknown
  Kingdom: Bacteria, Phylum: Firmicutes, Class: Bacilli, Order: Bacillales, Family: Paenibacillaceae, Genus: Paenibacillus
tcagttttcaaagatcaaacattcttttttgttaactcagtttgtcgcctcatcaactcttatatcttatcatgtccgaaccaactttgcaagcatttttttgaaatctttttttgtaacactcgctcgcaatattgtatttcttggccggaattagaatataccatatatatatcccttttgcaagcatttattagataaggtttcacaatactttattattattcgttttccttctatataatagctcctttgtatctatctgcgtctaactacaaaaaaagaacctcttcccttaagcaacaggaaagaggttctttgttctatatctactgattattcggagcccataaagacaaagcggatcactacaataatagcaagcacccacatgagccagtgaattttaactttattgctggtaaacaggttactaaacacagccagcacaacgtaagacagaataccagcagagataccattcgcgattccacctgtgaaaggcatcagcacgatggtcaaaaatgcaggaaacgccaacaggaagttatcccagtcgatattgcgaacctgactcatcattaggaccccaacgataatcagagctggagcagtagcggcagaaggcacaaccagagccaacggtgcaataaacagggccaacaagaacagaacacctgtcgttacagcagtcagtccggtacgtccgccttcttctacccctgcggagctttctacgaatgctgtaatcgtacttgtacccaatactgcaccagtacttaccccaactgcatcaaccagcattgctttaccgataattttctcgccttttttcttatctttcattatacccgcgcgtgtagccgtacctaccaaggtaccgaacgtatcaaacaactctacaaatgtgaaaatgaaaatgatatcaaacagaccgatatgcaaagctgctttcaagtctaactgacctacagccaaattactgaaatcaggaatccagttgcctgttgtcaagctactcaaatttgttactcccatcggaataccgattaatgtagtagctacgatcccaatcagcaatgcacctttgacccgaacgaccatcagtgctgcgataataagcaatccgattagcgccagcagtgcatccttttgatgtaccagacttcccagaatcaaattaaaagcatgacccggaaccggttgaccaacatctgtccctggaacgatgctcaccataaccaggttacaaagcttgaatccgacaattgtaataaacaaaccgatacccactgtaatggctgtctttaaattttccggaactgcaacaagcagcatctgtcttactcgtgtcacggttaaaatcagaaagacgataccggatataaatacagcgccaagtgccgcttgccaagtaatcatgccattggaactcaggactacagtcataaaataagcattcaaacccatacccggcgccataccgatcggtacattaacgaatagccccatcagtatggtaaccaaacctgcacctaccgccgtcgcaaaaaagacagcttcactgggcatacctgctccagtcggacctaaaaaggtattgttgaccaccagaatataagccatggtcataaaagtagtaatccccgcaataatctctgtgcggacgttcgtgccatgttcctttaatttaaagaaacgctccatgagtcgtaattcctcctacgcaaagcatactcgtattgttgtcgttcgtttgaagtaatattcgcattcatatgcgctatattattacattcgttattttaggctctcacctactgcttgtcaacagaaaaagcgaatgttgcaaattgaacacatatgtattgttcggaaaatagaaaaccagcaagctattatgcagctgacgggttatcatttagaggaatcagatatttttgtacttatcaaaggcattcgctgagtccggtatattttccagataaacgatagatcaagtagtgaaaataatcttctaaaatcttcatcgtgtgcaattcctttcgtgctgtatatgtgtatgcgtccttatgggaaggttattgcaattttaccaacagcgtggtgggtttcgcttaaagcgtgtgcgtcatacaaacctttttgtgaaaaaggaaacgtagctcctattaccgatcttactttcttttgctccaacagatcggcaatttcctgtagttgctgtccattgggctccagccatatattttgggctgttacgttgtactccttcaccagctcttcgtcaaaattgctgacaatggatatgatccgtccggtatcccttttcattaccttaaagctgttcttctgaacatccccgcccatcgtatcgaacaccacgtccacatcagataaaacttcctcaaaacgagttgtacgatagtcaatgatttggtcagctcccaatgaagcaagcaattcatgattacgctcactggctgtagtaatgacataggctccggcctgtttggcaaactggatagcaaacatacctacgccacctgcacctgcgtggattaatactttttcccctttggtcagttgaccatgtgtaaagagcgcctgccaagcagtcaaccccgccaaaggtacagaagcggcttcctcccaagaaattgaggtgggtttacgtgccagcagatgatcatccaccaaggtatactcggcataagtaccgaatcgggtggtgtccgggcgtgcaaacacttcatctcccactttccaatcggtgacctcgctgcctacttccgaaatagtaccggctacatcccagcctaaaataatcgggaactcccaatccatcatttgttttaagtaaccttcacgtagcttccagtcaattggattgatggaggtagccgccactttgactacaacctggtgagcctgtggtgtaggagtaggcacttctctttctttcaattcatccttgcttccatactgatctataacgatggctttcatattcatttcctcctcgcacatttacatattctttacattgctagacatacgttgtagcacatctgtcaaaaccacaatttcctcatctgtaaacttacatagcagcttttcctgaaaggcttgtctttgctctgacaaaacttgcagctcttgaacccctaattcggtcaaacgtatataggtcacacgcttatcctgctcttttttactacgtaaaatcagaccttcctcttccagccttctcagatgtcgggtcactgctgcaccatccagaacgagcagatgttggagctctagctgacttagttcctgacgatgatcaatatgatacaaaatttcgaccttggtaaaactggtttttaattgtgcttcaaaagcgttattcatttctttacacaaaagatgcatgcgataaaacaactggcttctttcagagcaatgttcgatgacaaaccctccttctaatgcttgacctatcaattgatgcatcaagtattatacaccctcactaaaaataaacaagtctgagacaagtatatacaatcctacattcacaaaaaaagctcaagctaaacggatagcgcgctatagacttgacctgtgatggcattaggcagatgctcaggaaccgtatcacttgatccgtgaggcgggatcaaaaagacgatcagcttgtccgggtaacggttaattaatccttcggcaatatgcttaagcgcaccataaaacgtacgcgtttctgtcgatgggcgctcgcacatcggttcaaaaccgctgctggctacactgctgccggatatgccgtgattctgtaaatcaattccccctactctattagatcgtattgttgatttcgataaatttatgttcaatcgctgtcatttcgtgatttggacgagatattaaatatgtatccatgtagccgaaggttgggggagtgggcaaataggatgttactttgaattgccgcgcaagccttttagacataagggtgattcccattcccatcaaggcaaattccaccatcgtatcaaacacaccgacctccacaacctcgccatgggtcaattgcatgtcctgatacatcttctttaaatgcgttaggtacaggcagccatccgacaatatgataatagaggctccttgcagcacctgtttgaggtctgagccttcatgtatgcctttccccaccagcaccaactcttcacggcatattttttgataatgaatatacgggttggtgggataccctgtgacaaaagcaatatcgagctcgccgtcgaggatcaatcgctccatttccgtggtggttccggtttttaatgtaaccgaggcctgcgggtacagctcgtataccttcgtaagcgcccttgttgtttcccccgcaacaatggactgcatcgtaccgatgcgcagcttttcctcctgcggtctcattttcatctccgtgtcttgccacagcaacaacatttgcttgaactgagcatataggatttctcctgcaggtgtcagctccataccacggggctttcggtaaaataacgctgtgccgtaatgggcctccagcttctttattttggccgtcatattcgattgcaggtgattcaacttttgagctgcttctgtcaggcttctcagctctgccaccgaaacaaatgcctgcatattttcaatatccatctcttcatctcccatcaaataaaatgatatctatatcataaacaagcattattatttatgagttaaatgtattatattggccttggatgctattttccaccctcattttaaaaatcaggaggtatggcaacatggtcaaaaagaagattcgtgtaggtatcgtaggaggttcgatgaataataaatgggccagtcaaacacatattccggctttgctcaagcacttgaacctggatatcactgccgtcggtacctctcgtatggagagtgcgcgacgaagcgcagaagaagtaggcgcggcactggcttttgatgatgccaaaaagctcgcagcttccgaggatgtggatatggtcgtggtgagcataaaagttccacatcattacgaggcggtgatggcggcaattcaagagagaaagcatattttttgtgaatggcccttgggggcaaacactgcggaagctgctgaaatggccaaggcggcggaattggcaggcattcatcatagcgtcggcttgcaggcacggcaggatcttgaagtgcaaacgatgaaaaaactcgtagagggcggagagattggtgaaattatatcctgtcatatgcaagtagctactcccggcaaaggaggacaagtaaatcaggacactgcttatttgctgaatagagccaatggggctaatctgctcacgattaatggcgggcattccctggatgcgctgcaatacatcgttggcgaattccgcgagctatcggccatcacatcatcccgctataacgaagccactattcaggaaacgggtgaagtcatttccaaggatacagccgatcagattctgattcacgggctgttggaaaaaggagtaccagtatccgttcacattcaaggtggagtaaattctaagtttgagatagagattcaggggaaaaagggcattttgcgtttgacacagaatccttcgcttgggcatgttcaatttgggaatctaacgctcgaaaaacttgtgtacgatccaagcagtacgcagagtcatggtcctaatggcgcttttgaacaaataagtataactagagagcctaatacaagcctggatttcccaaaacaaggggtaaccctgaatgtagccaaggctcattatgtttttgccgaggatattttgacacacacccgtctcgctcccgatttcaaccatgccttaaagctgcatcagctactggaccgcattgaggaatcggctgcaactgggaaaaagatcgtatggtaaggtagaattataaaaaaagaaccttcaaccccacgatagatgtggagttaaaggttctttatattgtgctgcctttttaatgaagtcatgtgttctccacttttatcctgtcaccttcaaccaaaataacttccgcgttgctgattggatataaatttaattggctgccatattcctcaatgatgttctccaccgcttttttaaacggaatgttcgtatgatgggggactggatagaattcaatgacccctagtgcagcaaaggaatctaatgcaggggcctcctgcacatcgtccataagttgaacatattcgatattcggtgataaaatcaacgaaccggcagattcgcctatatacaatttccctgcattaacttcttcagcaatgattttgtcagccccagttctttttaactcttgaagtaaataaaatgtgttgcctccggtaatataaatatagtcattccctctaattttactcgctatttcatcccaggttgctgtgcttatttcgatttcatccacgactaatcctaaactctctaatgctttttttcctgattccacataaaacttaactttctctggaatacttgcggttgggatgaaggtgactttttttccttccaagttttcaccggcgaaatggactaaccatggtgcaacatccttaaatgaggacgacaaaaataattttttcatctctttattctccttagaacagcgtttaatgaaacgggatatgtaacactttattctaggtatattataaaatatattagtatcaaaacatgacaccattggaggataacataaaaaagcttgaagctgataaagtcatataaaaaaaggagacattattattgaatactatctcctctttttcaacctcatatccgttgaaaataactggggtttcttgattttgacccataaaaatactctcttccccgctctcattttggagtgggagcagatgttcgaccttgatccgtaaaaaagactcctgccgcacagcgatatttcggccgatgcggaggagtcctgatgttgtattggtgaatctcaaaaggtttgtgattacagggcgggagttcccacgtttattcccactcaatcgttgctggtggtttggaggtgatatcgtacacgatgcgattcacgttatccacttcgtttacgatacgtaccgaaattttctccagcacatcccaagggatacgcgcccagtcggcggtcataccgtcgatggaggttactgcacgaatacctacagtgtaagaatacgtacgagcatcgcccataacgccaacactcttcatattcggcaaagcggtgaagtattgccagatttcccggtccagaccggctttagcaatctcctcgcgcaaaatgtaatccgactcacgaacaatcgttagcttgtcctctgtcacttcacccagcacacgaatggcaagaccaggacctgggaatggttgacgccatacaatctcagctggcagtccacattcttcgccgactttacgcacttcgtccttgaacagagcattcaacggctcgatcagcttgaacttcatgttctctggcaaaccacccacattatgatgggatttaatggtctgtgccgttgctgttccgctctctacaatatccgtatatagcgtaccttgtgccaggaaagtaaaatcgtcaaattgagaagattcttcctcgaacacatagataaactcgttaccgatgattttacgtttttgttctggatcatcgactcctgccagcttggacaagaagcgctcacgtgcgtcaattttgacaactttcatatcaaatttaccaacgaacgtctccattacactttcggcttcacctttgcgcagcaatccatggtcaatgaacatacacgtcagttggtcaccgatcgctttgtgaatgagcatcgctacaacggaagaatccacgccaccgcttaaggcacacaatactttcttgtcgcctacctgttgacgaatctcacgaatctgatcttcgatgaacgactccatggtccagttgccttcacaaccgcacacttcataaaggaagttgctgatcatctcgttaccttgaacggaatgacgtacctctggatggaattgcaccgcatacagattccgctccaggttactcatcgcggcaatcggcgcactctctgttcctgcatccagtgtaaagccagtcggcaggtctgtaacgtgatccccatggctcatccatacggtttgacgagaatccaatcctttagccaagcgagcatcctgattgaattgcacgtctgctttgccatactcacgcttgcccgcacgttctaccttaccatccagttggtgagccatcagctgcatgccataacaaataccaaagataggaatgccaagatcataaattgcccgatccacctgaggagcattgtctgtatatacgctggaaggtccgcctgagaaaacaatcccttttggcgccagctctctcagcttctccgcaggcgtattgtatggaaggagctcgctatatacgccgagatcccgaattcttcttgcgattaactggttgtattgtcctccaaaatcaagaactacaacgatttcattaggcttattcattaccgtgcctccctcaattgttcgtttcattatacgcaacgataaaacaagacgtcaagaaatcaaccggagttgagtgggcatgaaaagattgttaaaatgaattgattctaaaatactcaatctgttcgtaggagtgtaaacgatggatgtgctgaagtggatcgtgcaattgttcgaagaatacggctacggcgtcctttttttcggcttgctgcttgagtttattgctttaccatttcccggggaaaccacaatggcttatgcgggatatctctcctatgccggtaccttggatttcggtaaactggtgctactagcttttctgggaacaaccctcggtatgactattacctactttattggaagatgggctggactcccctttattcagaaatacggtaaatgggttttgttatcgccggacaagcttcagaaaacacaaaaatggttccaacgatatggatactggcttatcttccttggatattttatccccggtgtcaggcattttaccggttattttgccgggattattgctctttctttccgtaaatttgccttgtatgcttacagcggcgctttattctgggtcatcctctttctaagcatcggcaagctatttggtccccaatgggatgccattttccatttggtagagctgtatgcgctgcgaattgcgggagtcgtcgggttcataatcctgctgtatattatttaccggtggagaagcttcctgtttagctcgctacgcaaatccgaaaaatcggtgaaaaccagcaacaaggatgacttgaagtagtcaaactcctgctgccttacggctacgaatccttgcataatacatcgaaatcacgatagatatcaccgcaaatcccgcgcctccaaccaaacccaacatacgcggctccatcatttcaatcgtcacccctgctccaaacatagacagtccgatgataccttggctccacgccgtcagcatgcccaacaatggaccctgtaaatacaatggggtctcccgcattaataatgtatccagacaaatggcccctaccccgccagccaacgaaattaagaagtaaatagcaaccgccgcccatgcttgataaataccgcttaatcccataagtaaaatcccctccaacaaaaggcataccagtcctcccttcaacaaagaaccactgaataaatgtcctattgcatagctggcaaccagacccgcgcccaaagcggcgtaaaacaatccgattccggcatctcccagcctgaattcctgcactgcatatacactaatcagaacattatcaatgccattgagcatgggaaccagcaactcaaatgcaacaacaacttggagaggaacggatgcacgaatacagtccaacattcgcgatctgctccggtttggatgatcctccctgcttattttctccttcatgacaggtggaaatgcaatattgcgaacgatcaaacctgcggcaaaaaaacttgctgcgttcaatataaatgcagcttgtggtccaaagagagcagatatgatgcctccggcagcagcaccaacgaccagcaccagcccgctcatcacctgctcaagactgttcaccttcaataattcggagggatgaacaagcagcggaatggatgatttacgagcaggagcatacaaagcttctccgcaggctagcagggtactgactccataaatgatccaaatgtcctcaggactatgaacacttaaaaaggcaagggctgccaagcctctgaaaagatccgtggtcatcataagcatacgccgggatatgcgggtaataagcacgcccgccgcaggtgacaggactaaaaaaggaatcacccgcaatcccagcatgatacccacactgaatcccgatccggtaagccgataaattaaagccaacaaagcgatctgacagaatcggtctcccattccgttaatgatacctgcggcaaataacttcctgtattgcctatctaccattttaaatcaactccgatacttaggattcatttattatacataaatctaattagttatttatctaatttataaaaatcgctctataatcgtcaaggcataaattcatatattcagagcatactaagccaacaaactccaatatcggaggattttacgtatgccaaatcagaataaaagttgtccacttactcatgtgtcctctaacttgagggataatgtaaaccatattgaaagctcctttggaaacagcggagatgtaatcattaaagagctattatggatgcaaaaatggccagcagctttgttctatatcgatggtctgattaacactcaattgctccatgattccgttctgcgttcattaatgcgggtaaacgagcatcatgtaccggagggtgcggaaccgttcgactatttaaaggatcaagttttgattgcaggtaactcaggtagtgtggacgaaatggatgccttattcaaccagatgctatctggcggtattatcattttgctggacggatacgcaaagggcatatggattgatgcggtcggttgggaggatcgcagtgtcagcgaaccccaatcccaaagtgtcgtacggggtccaatggaggcttttaccgaaaatttgcgtaccaatactgccctaattcgtaggcgaatccgcgatccgcgtctctggatggaaacaagacagatcggtcaagtgactcataccaatgtagccgtgatgtatgtcaaaggaattgctgacgaaggagttattcaggaactgagagaacgtctggaccgaattgatattgacggaattttggaagggggttacatcgaggaggaaattcaggatgaaacctataccctgtttcccaccatttataacagcgagcgtccggattcggtcgctgccagcctgctggaagggcgaattgctattttggtagacggaacaccatttgttctgctgatacctgcattgttcgttcaatttttccagtcggcagaggattattaccagcgtgctgacatcagcactttgctgcgtatgctacgcttcttttctttttttatcgctatgcttgcgccagcagtatatattgcggtaactacctttcatcaagagatgattcctacaaacttattggtcagtctcgctgcacaaagagaaggcgtaccgtttccggcttttgtcgaggcgatgctcatggaaataacttatgaaattttgcgtgaagcaggagttcgaattcccaagaccatcgggcaagccgtatccattgtaggtacactggtcattggacaagcagccgtggatgcaggagtggtctcggcggctatggtcattattgtgtcaatcacagcgatctccagctatgttattccagaaaatggtttatcgatagcggttcgtattgttcgcttcgccttaatgatgctagcggcagcctttggacttctgggaatattgatggggttaatcgtacttttgttgcacttaaccagtctgcgatcgttcggagtatcttatatgagcccgtttggtccctatgtggaaagcgatataaaagatacgctgtttcgcctaccttggcctcgcatgaagacacggcctcaatccatctctatccaaaatacaattcgtcaaaaaacgaaaaaaagacggattggcaataaatcgaaaaccagaagggatcagccatgaaacagaccatacatttgttcttcgtctggggactgattgcattactattaggtggttgctgggatcgtaaagaattaaacgagctgggcatcgctattgggatcggagtggacatggaaggagaccaatatcaggtgactgctcaggtggtcattccttctgctgtagcctccaaatcctcacccagctcaggctcaccagttgttacttatgaggctactgcgcccacgattcaagaggctattcaaaaaatgacggatacaagcccgcgatccatctatttatctcatattcgtatgctgattttaggtgaagagtacgcgagaagaggaatttcggatgcgattgaagccttgatgcgagagccttttaccagaagcgacttttatattgcgatagctaaaaataataaggcctctacgatgttaaagatccccactccactggaaaagttgccagccaataaaatgtttgcttcattggatacgttaactaaaacatgggctcctgccaccaaagtaaccatggatcaattgctgagcgacttggctaatccagacatccagtccactctacccgcattggaagcagtgggggatatagaatcgtccaatgaaaaaggtgtagatgccaccaaaagcatatctcctggaaccatactaaggttctctggcattggtgtattagagaaagaccgcttgctgggctggatcaataatcaagacagcaaagggttcaactacattcggaatacagtggagtcaactacaggacatgccgactgtcagggaggggggaacattgccttattaaccttaagcagtaacacccaaaaaaaagtgcttattcgcgatggagagcctgttatctccatatccgttactaacgacagcacagtacgagaggtcaactgtaagcatatgaagttaagcagtatggctgatatcaaagaaattgaggccgcaagcaatgaaaaaatcgttgaaattatgaagcattccgtagagactgttcgacgtgagtttaagtcagacatattcggctttggtcaactgatccaccagtccaaaccagagctttggaaaagactaaaagaagaaaaagaaaatccatttatggatttacagattgaatacaaggcaaagactacgatcaaaaaaattggttccttgtttgaatcgttccaaaaagaaataaaggagtgagcttggtggaggagaaagggcgtatcagcattacaaatatagccgtactcgtatttttgagtattattggagactgtgtactggtatacccctccctcattactagcatatccaagcaggatgcctggatcagctcattacttagcatccctgcaggactggctgtactactgttactcctgcgggtacatcagctgtatcctgatctcacctttgttcagctctgccagcgaattttgggtccgtggctaggcgccctcatttcaatatggtatttgttccatttaatgatgaattcagcgatttatttaagagaagtcggagattttatgaacaatcagacctatgtgatgacgcctcttcccgtgatcaatttactcttcatccttgtgctgatgtgggggatgtatatgggattggaacccattgcgcgtacggctcaaatcttatttccattatgcttggcttttgctttgtttttaatcctatgcttgcttccccaatgtgacagtcagcagcttaagcccattatggagcaaggtattcctaaaattatggagggcagcctatttgcgctctcctacccattcggtgaactagcttttttactcatgatttttccctatgtgagcaaaaaaccgggtctaaaaaaatccgttttactttccggacttgctgccagtattctgttaagcgtactactcctagtttctctcctggtgctgggcccttttgtaaccgaacatagcgtgtacacctcttatacgctatctaaaaagatcaacataggaaatttcttgcagagaattgaatccatgatgagtactgcctggattatcactacctttgttaaaaccattttacacttctatgcctttaccttaggaatgactcagctactgcgattaaataatgttcggacctttcttggtcctagcttcatgatcctgtttggtctgattatcgtgtcggcgcctaatattacttactatctggatacgatcgtccatgcctggatttattgggatttgacggattctgttgtccttccttcgctgctgcttatcgtatacaagtttagatcgaaaggccgtcacagcctgggacctggttgaccctcacccttaacggaaggagccttaacatgctgatcaccattgtcattatctgtatcggtctagccattgctgccaaagatttaccaggcttgtaccgaaagcatcgctttaaggatatgttcgtgtatatcattatgctcggattaggcacatggcttagtattcttgctgcaaaattagaggttacgccaagcccgctgattctgattgaaaccatctataaccctgttaacgcttttgtgtcaaatatatttggtttttagaaaggaggcagccacatgttaaaaaaagcacgtattagcgttcggcaagtgactgtcctgatgttcctgagtttaatcggggatatgctcttaatctatccgactatcattacacatattgctcagcaggatgcctggatcagctctatattatctatcccgttgggcttagttatcatttatgtacttattcgcgttcatgagctctacccgaatctttcgcttattgaagccatccgcaaaattttgggacctgtgttcggatctattgtttcctgctggtatctgttttatttttttatgggtaccgcccttaatgcgagagaggtaggagattttctgagtacacaattatttgaagaaacccctttgagcgttctactggcgatggaagtttcactactggtgcttactgcgctagcgggaattgaagcctttagtcgggttagcgagattttgttacctgtgtatgtactcatcttctgtggtctgatcttggcactcctgccacaaattcagctttctaatgtacggcctgttttggaaaacgggctcgctcctgttgctaaagggatggttccaggcgcgggaatgccttttgccagcatgtctatcatgctcatggtatttccttttgtaaacaaaagaggccactttaaaagagatatgctgctggcatcgctcataggcggagtgctgattaccctctttttactgctctccctccttatcattgggccctttgtgaccaactacagtccatacatttcttctgcacttacaacaaaaatcaatgaactgaattatattacacgcgttgagtcgcttgtctcattaacctgggcactggccgcttttttcaagggagtcgttttcttttacgcgtttaccttcggaacaacccaactattccgaatttctaatatccgtccctttgtcattcccgcaggagggcttgtgtttggcatgaccatttcgataaccccaaatgtgttttattatgtaagaactctggtttatcccatgtctacttggcattataccaacggcttgatcattccgcttgttttatggggtgtttatctctgcaagcaaaagtggaagcatcgacaaaacgcatctaaaaattaacaaaaaccttttgaaaccgatgcttaaaaaagcataatccgatttcaaaaggttttatttgttcttcacttacgccatatcctgaatgtatgccagcgcagcatcaatatgccctttcactcttaaaccacgccattcatgaactaaaatgccattttcatcaataaggaacgtagaccgaacaatacccatgtactgcttgccgtacatctgtttttgctgccataccccatacgtctcagcgacctgatgctcttcatcagataacaactgaaaagggagtccgtactttgcaataaacttgtcatgctgcttgagtggatctgggcttatccccagaatcaccgtgtccaaaccttcaaactccgtatgtttatcccgaaaatcgcaagcttgtgtggagcagctagaggtcaaatccttgggatagaaatacagcaacactctattgcctcgataatcagacagcttgacacgctttccttcactcccaggcaattcaaaatccggtgcctcttgcccaataacggtaaatacagcggacatttcatcatctcctatcttgtggggggcttatgtgaactgacctatgagcctgcccctctgtagcggcgaattccccagttccatgccagtaagcccaaggtcagaaagacaatccccatcacaggagttaagagagccatatggcgcatgtcctctcggtggaggaatagggaggctggatatacaccaacaaaagcaaaaggtagtatccaagtcagcacaacctgaatggctcggttatagatcgtcactggataacgtccgtagccctgaatattgtacatgagcggaataattccagtgggcgcatccgaaaagaatgaaagagaagtcaatatggtgtaaatgcctgtatagattgccacggcacttaggctcaaaacgatcagcgctggtacgaaccaccactccatagccaagtccatctgtgccccgctgatccccataataatcagaccgatcactgagcccaccagcgctggcgggtctacattttcaaggaaaatctggaacagattatatgcaggacgagtcattacccgatcgagctcacctttcacaatataacgttcgctaaagttccaaaggttgacgaaacagctgaatagtccgtaaggaaccatgaaaaatccataaacgaacacgacttcattttcactccagccccccaaactgtctgtatgcataaaaataaccaggataaaaataagattcgtggcctgaaacagcaggtctgaaatcacttctacccaaaagtcagcccgataggtgagccgagacttcatgtaatttttcaaatattcgctaatgagacccaaatagtacatcatcggcttaccctccctgcacgaacagacgtctgcgcgccagtcgccaaatgatgatcatcggcacgagcagaacgaccagccaaatgatttggatacccagtacattccagatgcccacgccttttacacgtcccgtaaatacagaacccggcaaataggtaatcgcctgaaacggcatccattgggcgatcgtcgccagccagccgggaaacaaactgattggcaaaatcaacccagaaaacagatctacaactacgcgcttcatacgcatcatgccctcattattttcgataaaaaaggccgttaatcccgtaataatattaatctgagtgttgatcataaagctaaaaaacagcatgaccagaaaaccaacccaggctaccggatccgtgggaagctttaccggaaataacagcatcgcaatcgccatgcctggaatcataaacagcagaaaacggaacataccctcgccgagtccttgcataaatttaacaagtacatagttataaggtcggatcatctgaattgcaatgcttccatcacgtatatccgtcgagatctcacgatccagattgttaaaataaaaagctctcgccatccacgatactgctacatacgtcgtcatctgagcagcggtaaagcctccaatgctacccgcatcgccatatatcgctttgtatgtgaaataatacacgccaatattcatgcaataaataaggattcctgaataatagttcacacgatacgcaagcatcgtgagaaatcggatacgaataaaatcggtgtatacgctaagcatgaactttggcctccactatcggattgccctggcgttcagccgaaccagactgatagatactgcggacgatatcatccgtgttggtttcaatgattttgatatccgtaatgtctgtgcgaccgactacgcaagcgagcacatccgatacattaatatgaagaggaatccatactttggcagccaaatcattatccatcgtccaagccagtggcatatcagcagtccatgcctgtaattgctccaactgggtcgatgtgccaaactggaaccgtacttctcgacctgtcccccaacgcgccttcagatcctccagaccaccatcataaatgatatttccatcatccagcataatgacgcgcgagcacagcgcttcaatatcctgcaaatcatgggtcgtcagcaaaatagtcgtaccgtgatcccggttcatgtccttcagaaactcacgaatttcggacttcaccataatatcaagcccaatggtcggctcgtccagaaaaacaatagacggattgtgcagcaaggcagctaccagctcacagcgcatcctttgcccgagactaagcttgcgtaccgggcggcttagcagatcctgcaattgcagcctctctaccagctcatccagcctacgtttgaagtccgtagccggaacctgatatactttccgcagtagttgaaaagactcgatcacaccgatgtcccaccaaagctgactgcgctgaccgaaaacaacgccaatgttgcctacaaatttctcgcgttcctcataggggacataaccgcccaccttgagatgtcccgatgtcggcacgagaatacctgtcagcatcttaatcgtggtggactttccggcgccattctcaccgatataaccgcatatttctccttgcggaatacggaaagatatatctttgactgcggctacctcgttgtattcgcgggcgaataaatcaaggaaggcaccctttaagccctcgcgatttttttgaaccttaaatgttttgcgcagatcctgcacatcaattgccagcatgttatacctctcaatcaggatttgtaaaatccatagttaaattgattgtgctccaaaaagaaattataatgtaatgaactgaaaagcgaaagggagagcatccatgacaagcagaaccaaaaggacgatatggtcggttctagccgtggtaatcgtcgcgattgtcggctttgccgtgtactattttacatccatttataatcagctggataatctgcataaagagggcgctaactcccccttcaaaaatgtaaaacaggtcgatcaggttcgtacgccagaaccgcccaagtgggaaggtaccgatatggttaacattttactgatgggtgtcgatgggcgcggtatccagaaaggggaagtcccccgatcagacagcatgatggttgtatcactggaccccgttaagaaaaaaatccacctgttctctattttgcgtgatacgtacgtggatattcccggctatggaaaaaatcgaattaacactgccattactcacggacccaacacggccatgaagacggctggcgacctgttaggcatcccggttcaatattatgtgtacacggatttccagggctttatcaaactggtggatgccgtaggcgggattgattttgaagtggaaaaggatatgcattatacaagtaatgcggataaacatcagtacgatattgatttgaaaaagggcatgcagcatctagatggcaacacggcgcttcaatatgtgcggttccgccacgatgcaatgtccgacttctcccgatcaggacgacaacgggcattcttggaagccgtagcccagaaaatgcagaccacgacttccatcgctaacttgccgaatatcttagaacaggttaacccgtacatcgacacgaatctcagtgttaacgatatgtggaagctggcaaatgtggggtaccaaagcaactttgcaggcagcgaacaggttccaccgatgaagatgctcggagaagagaatgtgggcggcgcagcagttcttacggtccgcgatccggaagaactgaaaacgtatgtgcaggatatatttaataatccacccacacaaacacaggaacaaaacaaggatcagaacgaaacgaaacagccagacagtgcatcgtctaccaagaaggataaagcttcttttacagggggcagtaaaaccagtaatgaggatgcttccacacaatcaacaacaaagacaggtcaaaaagagctataatgatgtatgcaggggcagccgtgaacgctgccctttggcgtgtgtataccctattttaatgaacggaaaggaagttttgatgatgaaacgggaaaactccgaagcactatataaagaagccctgaagcatattgtcgggggcgttaacagcccttcacgctcctttaaagctgtgggcggcggcgctccagtattcatgaaacgcgctaaaggtgctcatttctgggatgaggatgataatcgatatatcgactatttggcggcttatggccctattattactgggcatgcccatccccatattactaaggccatcagcgaagcggctgcgaacggcgtattatacggaacctcaacggtattggaaatcaaactggcgaagatgctgaaggaagcaattccttctatggacaaggtccggtttgtgaattctggcacagaagcggttatgacgacgattcgtgtggcacgggcctatactgggcgaaacaagatcatcaaattcgccgggtgctaccatggtcactcggatctggtacttgtagccgcaggctccggtccttccacactgggcataccggacagcgcaggcattacgaccaacattgcgagcgaggttattaccgtgccattcaatgatctcgacgcgttgcgccaagccttggagcgttggagcgacgatgtggcggcagtcatggtcgagccgattgttggtaatttcggcatggtcatgccgcagccaggctatctggaagggctctgctccatggcgcgtgcgaacggctcactcgtcatttatgacgaggtcatcaccgcattccgattccacttcggttccacccaaacgtatgcaggtttgaataaccatgatgcgattcagccggatttgaccgctctgggcaaaatcatgggtggtggtctgccgattggtgcctacggcggcagcaagcacatcatggagcaggttgccccactcggcccggcttatcaggcgggtacgatggccggcaacccggcttccatctcgtcaggcatcgcctgccttgaagtccttcaaggggaaggcgtgtacgaagagatggaacgtctggccgtgagactgacggacggtattcagtcctctgctgaacgctacggcgtgccattgacgatcaaccgtattcgtggagcgttctcgacgcatttctgtgatcatccgatcacgaattacgcacaggcgcaggatacggatagcgaagcattcgcatccttcttccgtcacatgctggatcgcggtattcatctggcaccatccaagtacgaagcctggttccttacaacagcgcataccgacgaagatgtggatgctacgctggaagcggcggatgattcgttccgggcgatgtcacaaggtaagtaaacccagcagtaagtgatagaatatgaataggataagagctggaagtagtcttagggatgggtatccgacctctgggacttcgttccggctttttttatttcacaactgtacccgtacagtttcagattttatggattgtatcagatgatgccatccgggtatattgagagaacaacaggttaaggtcatgattacggaggtttattatgcacagtcgttccagaaatggagccgcctatctggcagctctcagctatgcagctatacttggattttcatttttatttgtaaaattgacagtcacagaggcgagcccgctggatgtgatcgcccaccgctttgcgctgtcatttatcgctttgaccgttccagtgctgctcggttggattaagctcaacatcaagttacgtgacattttgcacattttaccactggcgctgctctcgccattagtgtattttccactgcaagccttcgggctgatgagcacttcttcatcggaaggtggaattattcaagcaaccgttcctatttttacgttgctgttagcttcctattttattaaagagcgtacaacggtagtccaaaaaatttccttactgctctctgtctttggcgtggtttttatatttgtgatgaaaagcggagcaccgctagcatccaatagctatggaggtattcttctactcgtgctctctgcgatatgcctatccggctataatgtgctggcacgaccattaacacaaaagtacaaccccatggaattgacctacgttacctctattttgggatgtatcgtttttaacgtggtggcactgggatatcatgctatagacggctccatgagcgcctatatcgctccactggtgaagcctggttattggatggcactgatttatctgggcattctgtctaccctcgtcacctcgctgttatcgagctttgccttgaagtggatcgaagcctccaaaatgagtgtgatcggtaatttatccaccctcatttccatgattgccggtgcttacattttgaaggagcagctcgcctactatcacattgttggggctgtgatgatcattatcggcgtgctgggtaccaatttcggagggcgaaaaaacttcacgccgatcaaaacaacttcggcaaaatcacaaaaaacgggctaaaaatagacactcatttgcctgcaaaaaaagaaatctcccagctgcacaattgcagccgagagatttcttttttcacttcttagtcttcgtcggattaaataggatacgccatgacactcattaatgccaattccggctgtgtcgtgtccaatctgctatattgtacgatgatgggcacatcgctagtgaccgtaattgcgtaaggaatgcctgtcggaatccgttcgccggatttctccaacgaggctgttcggatatgacgggttcgtcttccttccaccacctcgatcaatccctctaatggctcgcggtcttcaaaatagatgtctatacttagatttgccacacggctcccacaattcagcacgcatatactctcatgactgagcagctctccccggctttccggtggaatatacccatcggggatgacccagaatagactgcctcgcggctgattagccaccttttcctgagaaagttcagcatttcccatactattggcctcctttacccatcatactttttggcgcttatgccccttcttctagccgtacggattctccttggtacgcaacagttgagccagaaaagcaagcgccaatccctgcccccagccctgaaggcgtttgtacggaacgtttcgatagccgtcaatatcgttcatcacagcagttccagcggatacccccgttactgtgccgtcgtccttaatgcggcaaagaataccgtcgatcgccttttgggtgtatttgttaaacaatcttccttgcataagcaaggcagtcgcaattcctgccgagcccgaggtttccagataagaggtatcatcgttcagcaccgtatgccacagcccttccggggattgcagccgcaccagcgcattgagctggtcacgcagcgagccgtcgatgatcatataagatggatgctgcacctccaccaatttcagcgcttttgccatcgtgagggctgcccatgaattgccgcgcgcccaatatattcctgacatccggctttgattcacatgatcccatccgtgataatacagattcgtatccgggtcctgcaaaaattcttcatgcccgtgatattgacgaaccccatcctcccaatactccttgttgcctaacagatgaccgatacgaagcaaataataaccggccataaacatcgtatccacccatgcttgctgcggaaatacatcatgaagtgaattcaccgtatgctggaaaatgccgtcggcaaaccgctccgctttttgggccaaaaattcggccatctcgatagcaatatcaaggtatttttgctcacctgtggcctgataaagcgtcaacaaacagtgcccgacagaaacgccgttcaccgagagagatggaagtccgtcctcaatattttcatcaacccattctttcagcttggtcaaatacttttcgttccctgtcgcttcatacgcttcgcatactccgtaaaaggcgactccgcccggccaatcccagctgtagtgcatttgaaatgtgcgttctacgacccggtcgatcacctgcttaacttgttcttcatcaaaaatcaatgcaggcatttccacgtctccccctttggtaagtttcacgtgagttacctccttgacgcccgtacatgaaaaggtcgtccttcaacgtaaatacatgcgcagcggttgcaaatccagttccttcacagcatccaccaccatgtctgcaatacgaaccgcgccattctcatgaaaatgtgtgttatcctctaagccgccggaaaagttcatgtattcaccaggcagcagccacataaaaagctctttactctcttcgggacccagctgctcatataactcctgcgtgcgagcagacaaatcaatcagcggtacattcgcttcttccgccagctctcgaaccgctattacatagtcaccatgtgtgtcagatagcgtaccatctgcgttaaaatagcgacgatgtacgggcgtgaccagtaccggggtggccccatggcttttcgctccgtcgatgtagaggcgaagatgctccttgtaggttgtaaaagcctctgtagcccgctccggatcaggcttctgatcattatgaccgaactggatgaacaggaaatctcctgcctttatttcgtccaaaatgacatccagccgtccttcttccgcgaagcttttggagcttcgtcccgatacggcatgattatccacgcagacatcatgcttgaacagggcgggcaaagcctgaccccagccagtatacggatagccggaggcgtcctgatccgtaaccgtggagtctccggctaggaatagccggagggtctgtggcgctggcgcaatctccagcgcattgagccgtggcgcggtgcctgacacggtgaggcgtagcttgccaccccggactggcaccgcaaacagcgcttcgatgaactggcccggcagcgtgtgtactgggggcagcatgtgcttgccttcaccagccttgaatcgcgtgagcgtttccgcctgcgaatcgccgaccagtacggtgacgagatacatcccgtctggcacatctgcaacaaatgcagcgttcagtggaatacaaaagctgcttcgtagccgcgtgcgtgcatccttggctgcactctgcctttttcgaccgtatacatgctccgtcgtctcgaagccatagccctgttcagttgtatataagcaatccggaggcactcctttgtagccatccgcaggcccccccggaccaaaatcaaacttccacaatgtactcacctctcagccatcgccctcaaatcccgtccattcaatcgtacaaacccgggtgccttccatttctactcgtaagcttcatatcctcacgctatggattttggatcttaccccttcaaaccactcgtactcattccttctacaatttgcttctggaatgcgaagaatacagcgataactggaagcaggcttaggatagacatcgcgaacattcctccccagttggaagccgactcactgtcgaggaacatcttgagtgcaatagatacggtatatttctccggcgaattcagatacagtaccggaccaagcaaatcctcccacttccaatagaaagagaagattgccgctgtagccaacgacgatttgagtaagggtaaaataattctgaaatacagccggaacttgccgcacccgtcaatcgtcgccgcttcatccaactctgctggaatcgttcgtataaactgcaccatcaggaagatgaagaacggcatcccgaaaaaggagggtaccaccaacggtaagatcgtattgatccaaccgagcttggtgaaaataatatattgcggtaccagtaccacatcccctggtagcataagcgtcaccatcatcaaagcaaaccacaagttacgccctttgaatttcaagcgtgcgaagccaaatgcgatcaatgaagaggaaaatacagctccaatcgttgaaatcaccacgatcgtgagcgagtttagaatgtacgtgccaaagttgtagccagttgtccctttccagcctgttacatagttttgccagatccattctgtaggaaaaagcgaggatgccgtgacgaatatcgtccgactttctttaaacgaactgaacagcatccaaaaaacgggatacagcatcaggagcgccagtgcagcaaccagtatgtgataaattggccatttgaccgttttccatgccatcggtatcagcgccccttttccgtttcataaaatacccagtatctggaggttataaataaaatcgctgtcagtatcccaatcataatgagcatgacccaagccatggctgccgcatatcccatgttgctgaacataaacgcctgccggaacagatacagtgaatgcagcatcgttccatccatcgggcctccttcacccttagaaataacataagccgggacgaaggtcataaaagcgctgatcgtctgcataatcagattaaatagaataatcgggctaagcaacggtagcgtaatactgaaaaattttcgtactggcttagcgccatctacactggacgcctcgtacaattcaacaggaatgttcttcaaacctgccagaaaaatcagcatggaggagccaaattgccatacggacagggtgatcagcatcgtaagcgatgcatccgggtcaccaaaccatttcaccggagtcgcccctaaggtcgaaagcaggctgttcactatgccgttattactgaaaatgttccgccacataatggataccgcaacgctacctccgataatcgacggcagatagtacattgtccgataggtgccgaccatgcgcgatttggtattcaaaatcatagccacaaacagcgcgaaaatcagtcgcaacggtacaccgaccagcacatacgtaaacgtgaccctgatcgaattccagtacttcgggtcgcctgtgaacattttttcgaagttacccagaccaatccatttgggcggggtgaacaggttgtaggtggtaaaggacagatacagcgaaataaacattggaattaacgtaaacgccagaaagcccacaataaacgggctgataaacgcatatccggtcatattggctttcaagctctgatgatttcgcaagctcatcaagcctcccttctgttgcatttaaagaattagaaaactttatgttgttaataattcgttgttatatgaatattattgtgatgtctgcaaagggtgcttatgcagttggttcgtcgaatcaaccgtgcgcaatcatgctttggactacgcacggttaacttaacgaaacgttccttcgatcttgtcgttcttatgctaaaacgatgtcagataccctaaaggtctcattgcgctcattattgcttgttattcgcaaggatagtattcgcatcagcccggaacttggccgctgcgtcttcagccgtcatctgtccgaaattgacctgctcaatataatcggtcagagtcgcaatcacttccggcgatccgactggtggcggcgggctcattggagaagccttcggctccatggaagctacaaattcaaacacctgcttcgtaggctcgcttaactctggcgcaacagcctccttgattttggaggaaatcggcacgccccgttcgcctttaatcaatttattcgcttctacatcattcatccagaaatcaataaactttgcggcctcatccttcacctgtgaacgggaagcaaccgtccagtacatcgtaggctgcatgtatacgcctttttccatattcggcccaaacattggagccagtgccattgggcggttaacaacctgctgtaagcccacatactgattggaccactgccaaataccgatgcctgttccttttacgatatcggattcctcaagaatccccttggtctggttcataatttcaggaggcggggtcgctccctttttaatcagatcagccaatccgctgaagaagtcaacaaacagcttatcatcgtcataccccaatcctgttccttccgcattgtagagagtctttccttgcgtacgcaaatagtagtggaagaaaatatcagcagccatcgagctgtcaaagtatactttattggaaccagcctttaaagccagttctttgtactgatcccatgtccagttgtcagggattttgtctatacccgcttttttgagcaacgccgggtcatactggaaacccagaacattgacaccggttggaataccatattgctttccggcaattacgccggttttgagtacattttcggtcacatcagcgacctgaattttttgattcaagtaaggcgcgagatcctccagttgaccatttttcgcatattggctaatgtacgaaatgtccatttgcacgatatcaggcaactgattagccgcagcctgcggggcgagctttttccaatagtcatcaaaagaggcatattccacatcaatcgttacattaggatttttctgcttatacaaatcaacgaccttttgcgtgtattcatgacgcgtatccgatccccaccaagcgatacgtaactttactttcccgtctgcacttgtgcccgaattgctgccgccgtccgctccgctacatgccgtcgtcaaaacgagcagcatagctatgatcagaaaccatccctttttgcccacctatctctccccttttcgctgttctagaaaggagccaaatcacgagtgacaacgcatttacgcaattttgatagcgtttacattagctcctgttgttattttcccaaaagcagagaaacattggaatacacaaatcaggtttcctgggtttaaaaaacagtgggggccatcagctcatccccgttcatgtgacttaatatactcggaaggcgtcatacccgcccattttttgaacacctggctaaaatattgcgcgttcccaccgaagccgaaccattccgccagttcaaataccttcacgtctcctgtctctcgaatatgctcagccgcacgttcgatccgataacgattgacgtagtgtgaaaagttttcccctgtcacctttttgaaaatttttcctaagtagtcggaattcatatacagcatttgacctgccactccgttcagcgacagatcggattttctgtagttttgctcaataatagtgatcattttatcaacggtggaagattggcgatacacattacttttataatagattgcggtcattcgttcggcagcttcctgtacaaaagatttgagacatgccagcgttttttgctctgccagcaccaccattcggctcgtaaacgccgcacgctcttcttcagggcatatacggatcatagcggcatagagctgaagcacataggagcgggtcacggagatttccagcttcatccgggacaaaataccgaacaaccgatccacttcctgtgcaacctccaccgtatttccagccttgattagcagaccgaacttctcctcgtccagctccaaatctgccatctcccgggtatcctcagccgctaaatcctccttcgtaatcaaactgccctccccggtgtaaaaacggtgattcatacaatgtagtgtctcccggtacatcccccgtgaatgctgcatactatccgactcactaactgcgactgttacctctagcttgtaaaagcgatgaaatgtcgcacgtaccgcttcaatctgtttcataaaccgtgacgtgtcatcctcactttccagcacgatgagcaattgcccctgcatggtcgtactgagcaagacatcatccatcaaatctgccgctatattttgcaatgcaaacaaatgctccggctcatgggattcctccacccgcagcagcagcattcgaacctgcttatcttgcaattcaattccgaataaccgctcataaaatgcgatatcacggctaccgtaagttttataggaaataaactccttcaaaaagtgttccttcacatgaggcagcatacgctgaaaatctagcttcatccggtttacaaactgcttgcgttcttcctgctcctcccgctcctgccccaactcggtcagagcctcatgaatttgtcgctcattgcatggcttcaacaagtagtgcttcaccccgtattgcatggcccgacaggcataatcaaaatctttgtaaccagacaacagaatgaaacggacgtctggaaaatgctccgtcgttttggcaaccagtccgataccgtccaatccaggcatagagatgtcgctaatcacaaagtcaggcgggctggcctgaatctgatcataagcctcaatcccgttacgtgccgtaccaaccaatctcgttcccgcttttccccaatcaaccacctgtgatatgccttccaaaatcatacgctcatcatcaaccagtagcaccttgtacacgaccctgatcccctttcacatatggaatacagacatgaatcgacgttcctgttcctgactcgctatgcagttctatcccccaaggtgtaccaaatgtcaggttaatccgttcctcaatattcgtaagtccaatgccctgcccacgagtcatgacctgcccgctccgcagcttttccaagaaatccggcgtcattcccggtccgtcatcttcaactcgtagaaataaagacccctcgctttctctcgcaataatagcaatccgacagggttcaattcgcggctccagcgcataatgaatggcattctccaccaagggctgaagcgttagcttcggaatttgtgcatccatcagttcttccgggacatccagatggaaaacgagacgttcatcaaaacgtgttttttggatcgttacgtagctccttacaatatccagttcttttcgaagcggaatcagctgctcttcaaaactgaccgcactacgcaatagaaaagcaagtgcttccaccatctctgaaatccgatcctgcttattggccttggcgagccagttcacggattccagcgtgttgtataaaaagtgtggattaatctgtgcctgtaatgcctttagctctgtttcccgcagtaatagctgcttggcaacattctcattaatgagctcacgaatgcgacgaatcattttcttatatgtccgatgtaacaagcctacctcatcctgtgtggaaagggggaccgcgccaagtgcttcttcttccaaacggtcgagatcgcctttttctattttacgcatgttctggattaattgaacaatcggtttggtaatgctccctgacaacctagcccccagtgccaatgcgataagaagcataattacaaaaatagcgcttacaacttctttaatgatcgtaatactgcgaaacatatcatcgaagggggtcatatgcaaatacgtccaccccgtataagaggatttgatttgagcagcgaaaaaggttcctcctgagtaggtcgcaatcccgtaaggctgctttcggccaagctccgcctggatatcactctcactcaaaagtggtgtttcgggataaatcatccgtcttccatctgtaatcatcagttgtccgtcacggccggaagtttgcacacgatccgctacaatccggtcaattcgcacacgaatcgcaagcgttccgagcccattcagtgtaaaattggaatcggtaaaggatttgaactgccgagcggccagcaaggaggaatgacctgccgcataccatgcattggaaccgtcatgttcgtctgccagctccgacagggtggatcgaagctcctggggaataccttcgcggttgcccgcgctcatgacctgtccctctttatcgattactatcatagaatagacataggtctcagagccggcaaaggcgacgagcctattcgttatttttttacgcagcaccattttggtataaggtgacttttccttttccaattgcagcaaataacgttgaagctgctcgtccgttgttaccttgaaagtaactttttccacatccttcagctcattttctatgccgattgaagaaatattgagtacttcggatgtttttttgtacatttgattatcataaatatgaaatacgtacttaagtatgactgcaacaactgcaaaattaaccagcataagcaccgtaatcagcagtaccattttatgatggattccagcatttttgtaagcgcttttaaagtaggtaatcagtgaatgtcgcctccttcgctcatcctgcccggtccagcccaaaatggagaaaactctatatatcatacaaaataccccatgccttggtcattcggcaagaggtatttgtatttgcttagcgttgatcggttggtttcgatttgtccgccttgctcatatattcgtcgtatcggtcatcaagttcccgtgccatactccggtatttacgtgtctcctcaacaatgggatcgatatgagtctgaacccgcacctcatatttaggactgagtctttcccgcttctgggcctcattctcacgaatttcgccttccgtcagcagttcactgagctggcgttccaattcttcggattggctcatcgcgatttcctccttcatgatgatgttctacgtagaattataatccggttgcgtctgcttctttcagcacttgaataagttgagaatgaatagctgtattcgtcgctgcaatatgccgtacactcaggtcataaggtctgcccaatgtatcggtaatggtgccgcctgattcctgcaccagcaaagcgcccgctgccacatcccacgcattcaaaccaatttcgcaataggccgacagccgtcctgatgctacataagccagatgcaatgctgccgagcccatcgcccgaatgccgcgtacctgaggtgtaagaacctgcgtaattttcatatttagcggttgtgcatacgtacgatccggcgggaagccgacgcacaccagactatctcccagtgtttcttctctcgatgcttgcatgcgattgccatgtacatatgcgccttttcctttttctgctacaaacatttcatcacgggatggatcataaataaccccgacaatcacctctccacgatgggccaaggcaattgacacactgtaatacggcagactgtgcacaaaattggtagtcccatctaccggatcaataatccatagatattcctcttcacgggcagcctctaatgcgcgggccgaagcttcggctcccggctctacaccctcttcacccaaaatagcatgatcgggaaaatgggtcagaatcagtctgcgaatcatctgctctgcacctttatctacctcggtcactagatccgtaggagactgtttggtattcaaatgttcaacagttcccagcctgcttttaatccattccccggctttggatgccgcgttaatagccacggcagtatagctttttcctgatacgatatagggaaccttttcgttttcattttcgttcaacgtgttcactctactttctatatcattgttacgtggtttacgaagctgctctacaacacagtctcttaaccatctctgtttcagtacaagtttgctagtttacacattctagtatacacaataagctgcataaagtttctctaaatgggagctttatccgcaaaatgctactttctaaggcataatttctacggaagctccatccagcactttaaccccattagcttcctgaaggcgcagttcattcatcaacccgaataacgcttcatccttaagtttggcttcaagcatgacatcaatccgatccgtatatccggcaatattgcgcaaaaaggtaagcaagggctccactagaacaccgtccgcatggccccgaggatctttttcacttttggggctggacgcatggattttgggcggcaatggatgatccacagaagatccggcttgggccaattcccctgtccaggtatccaaaatatccggccatagctcccacggcttttccccctcattattcacccattgatgatgaatatcgagaaccatcggtaaccccgtcaatttgcaagcctccagcgtttccaccgcattgaacgttttatcatcattttccagcgttaaccgttctcttaacgaaagatccagagcactaacctgctctacaaaacgctggcctgaggtcaccttatctccgtatgcaccaccaatatgaatgttgttcttggcttcggcaccgagtcccatggcctccagcatcgctttgtggtacttcagatcattaatggagctctgcaacacctcaggacggggagtgcttaacactgtaaaatgatcggggtgaaacgataccctcatcttattcgccctgacatagttcccaacctctgcaaagtcagcagcaagcgcctgaaaagggtcccaatctcgcagatcctgatgggtcgcgagcggaatcagcttggatgagaaacgatagacctggatatcactcgcgcgattatggcgcagcagcctcaaagtattatggagattttcggctgctatccgttctagcttgcggattgcagcttctcggtctccaatcttgttaaagctgctcaatgtcattgttttagagggggatgcattttgaacgttaaccgacatggctacataaccgaaccttacgatcatagggtgtcttcctttcagcagtcgcagtagatggtaaggtcgctttcgttcagtgacctaaaacccttttctactgatcatacccggaaaagcacctgctgattcggtgttatcgcacaaattgcaagaagaaaacagctaggattgctgctgtgctccaaaaaacatttcatacgccaatgcggtctgaattcttgattcctcttcattcagcttacgaatgaggatcatttcaacttcggtcacttcatcgccctggaaattaatttcggcgatacagcccacaatctgcacgatggctactgccacgttgtccacgctgtaagcgatgaccttctggcctgtcggaaacacgcgcagcccggatttaaccattttgccacgtccgtattccagtagttcgtaaagttcttgctcgctcttgaatttgcacactgagttaaattcagtttgaaagcccatgtgtagccgccacctttcatcattaagggtttagtgcagtgctcaaagatatgccatatatatgaacaaaaaggagagtgatcagctcccctttgtttcgtttatgagttctcgtagtgcagtgccgacctgcgctcataacgctccaatgcaagagcaatcatgcgatccagcagacttgcataggatacgccagtttctctccacagcaatggatacatactgaacggtgtaaagccaggcatcgtattcacttcattaataaggatatgtccgtccgagcgtctgacgaagaaatcggcacgggaaatcccgcagccttccagagcgcggaatgcttgcaatgcggcttcacgaatacgatctgccacttcctcatccaacggtgccggaatgagcatttccgattggccatccgtatatttggcagcgtaatcgtaataatcactcgacgatacaatttcacccggtaccgaggcaatcggctcatcattgccaagtacgctgacctcaatctcacgggcatcgacgtactcctcgacaatcacctttaggtcaaattgcaaagccagatctacagccttttccagctcttcccggttactggctttggaaataccgacacttgatcccagattggccggtttgacaaagcaaggataacctagctcggtttccatgttacgtaccagatcatgactggtttgggcccactgtgtactattaaaataacagtatttcacttgcggcaatcctgcatgctcaaacagcttcttcatgacgcctttatccatacctgctgccgaagccagcactcctgcaccgacatagggcatatcggccatttcgaatagaccctgaatcgttccgtcctcgccaaaggtaccgtgcagcaacggaaacagcacatccagcgtctgctctccgtacagcttgccgaacaatgtatctaatgccgccttggtgccgccctctgcgcgttccagcttcaattgctctacagaagccagaggagcgcttaatagcgcccctctacgccaatcgccagccttcgtaatataaaaaggaataatctcgtatttctcatagttaaaagcgttcattaccgcatacgccgtttgcagcgaaacctcatgttcgcccgatttgccaccgtacactagccctacggtcaatttttgatttgccatgcctatcctccgctttcctgctttcgtcattgtgactgatttgcatcactgtacctgttatccatcatctcatttaaaaatagtcggcgatgtgataaaagcgatataccgtgttgtccgtccacgcatacgaatttttatagtcccaataacgatgtctggagcttaccgtatgtgcattgactagcggcatgccgcccgcatcaaaggccgtgaccaccgtgctgtgctggaaggttccgtcaccatcccaatcgtaaaaaatgacgtcccccagcatgagctgctctgggcgactcacctgctcagcagtcagcccccatgagctggagcccaaaaaccgctccagactgttggaaactgcccaactgtagctccacagttcacgtccggcaacccgtcctttataccaccagcccgattctcttttaccagtatagtggatcggtgctccccctgcaaagaggcattgcgagatataattggtgcaatccacatcaaaaccttcaaactccggattgaagctatcccaccactgatctgcataggccgctgcttcttcgcggcgatatcggctgggacgtgctgatgagccaaagcccagcacaccgcgattcagcagcggcagatttcctccttgattaaacgaagcctgttcaaaaggaacctctccccccgctggcttcctttctgccggatcgcgctcaattctcgctacctgccaggcttcaccctcgcgtgtgaacgtcagacgctcccgctcgatccgatcctcccggtgagtcatcccacccttctcataaaagagtcggacatgcagttgtacatctaccacagcctcatccggggtatcctgcaccattcgtaggggcttggcgcgtgtctcgctgcgtaggggaacagcatcccgttcgttgtaccactgctccaatctggccgcacgtgctgctcgttccatccgctgacccacctccagatactcatccggctgcggtacaccattcacttcactgcgattgtattgattcacgtaagcaaaaagggcctgtttccattcccgctcccccatcccaatccctccatattcgtcccgctatccttttccggggataaccggaatgatgaataacttcctttcttgcctctctggtctgaaatgctctctatctataagtatgaatctctaaagcttggtatgaacatcgaaacgcgagggagcgggcgttttattttccaatctgcaacgcatcatttaggccaaaaaaactttacggaaccgtctgaaaacggtatacttaatccaaaagcaatcattttgaaatcatgtttcatctaatgaaacaaattacattcatctcaacctctaacacgttatgaaccactgaagatgtaattgagaacgcaaccaatttaaaccaactgtgcaagacgtcgaaaaaacgacatccctattttcccccaagcatccacttcaaggaggtaatacttatgtcaggaaaagatcaattctccatcgcccgtagtctggaagttaacgggaagccttaccgctactacagccttaaggcactggaggaacaaggaaaaagtggtatcgccaagctgcctttctccattaaagtattgctggaagccgcggttcgacagtttgacggtcgcgccattacggaagaacatgtgcaacagctgacaggctgggctgaggatcgggataccaacaaggagattccgttcattcctgcacgcatcgtgctacaggattttaccggtgtcccggtggttgtcgatttggcagctatgcgtgatacggtgaaaaaagcaggcggggacccgaagcaaatcaatccgctcgttcccgtcgatctcgttatcgatcactcggtcatggtcgatgctttcggtaccagtgatgcgctggattacaatattaatgtagagtttgaacgcaacgaggagcggtaccgttttctgcgttgggcgcaaacggcgttcaacaacttccgggccgttccgccatccaccggtatcgtccatcaggtcaatctggagtatctcgcctccgttgccgctaccaaaaccattgacggtgaaacggtcgtctttccagattccctcgtaggaacagactcccataccacgatgattaacgggctgggtgttgtaggctggggtgtcggcgggattgaagcagaggcgggtatgctggggcagccgctgtattttgtcactcccgatgtgatcggcttcaaactgacaggcagcctgtcggaaggctctactgccaccgatctggcgctcactgttacgcaaatgctgcgtaaaaaaggcgtagtcggcaaattcgtggaattttacgggcctggtctggctaacatcagcttggctgaccgtgcgacagttgccaacatggcaccggaatacggcgcaacgattggcttcttcccggtcgatgcggaaacgctggcctacctgcgcagcaccggacgttccgatgagcaagtaagcctcgtagaggagtattacaaagcccaaggcatgttccgcacatccgatacaccggaccctgtgttcagcgatacgattgagcttgatctggcttcggtagtaccgagtctcgccggacccaaacgtccgcaggaccgtgttgagcttagccgcatgaaagaaacgttcgaaggcattatccgtaccccggtggacaaaggcggctatggactgagcgatgaaaaaatcgcacagaaaattccgctgacccatccggacggctccaccagcgagttgggtacaggagcagtcgttattgcggcgatcacaagctgcacgaatacctccaatccaagcgttatgctcggtgcgggcttgctggccaaaaaagcagtacagcgtgggctcaaaaagccaggctatgttaaaacaagcttgacaccaggctccctcgtcgtgacggaatacctgcaaaaagccggattaatcggaccgctcgaagccctcggcttccatgtagccggttacggctgcgcaacctgtattggtaactccggcccacttcctgacgaagtgagtcaagccatcacagaccatgatttgacggttggcgcagttatttccggcaaccggaactttgaaggccgtgtgcatgcgcaggtcaaagccaactatctcggctcaccgccactggttgtcgcttatgcgctggcaggcacagtgaacattgatttggtgaatgatcctctcggttacgatcaggacaatcaaccagtctacctgaaagacatctggcccacttccgaggaaatcaaggaagccatcagcctgtctctcagcccggatatgttccgtcgcaaatacgaaaatgtatttactgccaacgaaaaatggaattccattccggttcctgaaggcgaactgtatgaatgggatgaaaactcaacttatattcaaaatccgccgttctttgaaggacttcaggatggcgtacaagatatcaaggaaatccgtaatgcccgtgtgcttgccctgttgaatgattcggtcacgacggaccatatctcaccagcaggcaacattgccccatccagcccggcaggactgtatttgaaggagcatggcgtggaacgcaaggacttcaactcctacggctcacgtcgcggtaaccacgaggtcatgatgcgcggtacattcgccaacatccgtatccgcaacaatgtggctccaggcaccgagggcggcgtgaccaaatacttgccaacggatgaggaaatgtccatctatgatgcatccatgaaatatcaggcagccgatcagaacctgatcgtcattgctggtaaggaatacggcacaggcagctctcgtgactgggctgccaaaggtacgcttctgctgggcgttaaggctgtcattgccgaaagcttcgagcggattcaccgcagtaacctggtcggcatgggtgtactgcctctgcaattccaggagggctatggctggtccagcctgggtctgaacggtcgtgaaacgtttgacattcttggcatcgacaatgacgtgaagcctggtcaagagcttacagtggtggctaaacgcgaggatggcacaaagttcgaattcccggtaattgcccgtctagacagcaccgtcgatatcgactactaccacaacggtggtattctgcaaaccgtattgcgtcagatgattcaagcctaatattgtaacattatatatacagaacccccgagtgccgatttatctgcgattcgggggttctttttatcttgtttgagactctatcatcacaaaaaaagccgatccctcaggaccgacttcataccctattctcctataacctgaccttcgcacgcgagctacttcgaaatatccagaaaaccctctccgaacacgtcccgcacgtcatgaatggtaataaacgctgctgtgtcgatggctttcactatctttttaagcgctgacacctcttgtttactaatgacgatatacagcacttcttttggatttttagtgtaatagccgtggcctgacagcacggtaactccacgatccattttcgtaatgaccatctcggcaattttatcttggtgctccgaaatgatcatgaccgcttttttagggtttagtccttcgatcatgaagtccatcaccttcgtaccaacgtacaaaataacgatagttagcatcaatttttccggaccaataataaaataggaagagaatgcgacaatcaaatcaaaaaacagcaagccatagctgatattccaatccagatacttcttggcaatccgggctaaaatgaccgttcctgccgttgtgccacctacccgtacgattaagccaatgccgacccccaccaaaactccggcaaatacagcattaatcgtcggctcatgcgaatcaatccgccagttgaccgttaaatgtaaaaacagcgagttaaaagcgaccgcaattatagtgtacaaggtcgttctcttgtccaaaaatttatatccgacaatcagcagcaaaccattaatcaccagattgacgatcgagggagaccactgaaacaggtagtacaggatgatcgtgacccctgtaacgcccccctcgccaaattcattcgggatcacaaacagattaacagctagcgcgaaaaaaaacgctcccagaataataaatgcgatgtctgcaatactttttttcatatatgttctaatcctctctctaacatttcaaaggatgaatcgccagatggattggctgactcttgttgccaaaatacgctgacaaccagttcatggtatctactaccaaacataaagtcaatacaactttgacactttaattcgccaccagactgcctcaatcctgacttgaggattccgcaaaatcctccttttacaaggttattcgacaaaaaaacacaatcccgactactaaactaagaaaacgggcctctagcccttgttttagacctaggcacattttcccctaaaatgaccatcctcctaatccaaattttggacacatatgaccatcttcctgttttatgtcaaaagcgttttactttgagaaaatgtgggtataatgattgaaacattaccaagcaacctacacggtattacgacatcaagtacatacaaatagtcctatacagacgtcctaagcaactcaatctgaatttgacaatatggaattggaggaacgacctacatgaatacaatgaacttaaccgtccacaccctgatgccctttcaccaccaataccaacgtgccaacgcggtgagtatgcagaagaaagaagatagctcggagaagaagctcagctttcaggacattttgaatgaaaaaatgggtaaaaaataaggcgccgtttatccggttgaatgatcccactttacataagaagctaaaaagccgtagtttcctacattgactgtagagaaccacggcttttttaattcatacgttcctaaactcacacgttcgttttactgacctccatcccgatactgctctgccttctcacgcatcccgacagctactgcttcttgggtgttcagccccttatccgctgcataggcgcgaatgtcctgagtgatacgcatactacaaaatttagggccgcacatcgagcaaaaatgtgcttccttggcgccctctgccggtagcgtttcatcatggtaggacaaggcacgctcgggatcaagcgacagattgaactgatcccgccagcggaactcaaagcgcgccttggacaaagcatcatcccgctgctgcgctcgtggatgccccttcgccagatcggcagcatgtgccgcaattttgtaggtaatgacaccctcgcggacatcatccttattgggcagacccaaatgctccttaggcgtaacatagcacagcatggacgtcccgaaccaaccgatcatcgccgccccgatggctgaggtaatatgatcatatccgggggcaatatccgtcgtgagcggtcccaaggtatagaaaggagcttccttacaaatctccatttgtaaatccacattctctttgattttatgcatagggacatgtcccggcccttcaatcatgacctgaacatcatgcttccatgcgatttgcgttagctcgcccaacgtttccagctctgcaaactgtgcttcatcattcgcatcatagatactacctggacgtagaccatccccgagagaaaaggccacatcataggctttcataatttcgcaaatttcttcaaaatgtgtatacaaaaaattctcctgatggtgcgcaaggcaccaggctgccatgattgacccgcctcgggatacaattcccgtcattctattcgccgtcatcggaatataccgcagcaatacacccgcatgaattgtaaaatagtccactccctgttccgcctgctcaatcagcgtatcgcgatacaactcccacgtcagcgcttctgcttcaccgttcaccttttcaagtgcctgatacagcggcacagtcccaatcggtacaggagaattccgaatgatccattcacgtgttgtatggatattagggcctgtggacaggtccataaccgtatccgagccccaacgcacagcccaagtcattttctccacttcctcctcgatggaggaggtgaccgcagaattaccaatgttcgcattgatcttcacgtgaaaatgacgcccaatgaccattggctcactttccgggtgattgatattcgaaggcaaaatggctcgtccagccgccaattcctgccgtacaaactcaggctccaccccttcgcggatcgccgcaaattccatttcgggcgtaatgatcccttgccgcgcataatgcatttgcgtcactgtacgcccttgcgaagcacgaagcggacgattggtcacgccgggaaattccactgtctcccgtttggagccaggtttcagtccattatcctccggcttgacggcgcgtccctcgtaagcctccacatcgccccgttccagtgcccaagctcgccgtaatggaggcaggccctgacggatatcgacctgataggctttgtcggtcatgggaccgcttgtatcatatacacgcaatggctcatgatgctccgtgccctgcggcgtatgtgtaggataaagagcaatttcgcgctctggcacggcaatgtccggccgcgagccttgaatatataccttacagcttcctggaaagggcgttaccccactggcttgctccccgtttgtcttctctacctcaacttcttttgttcctaccaatcttacttctgctgatttcaattctgttccttttgttccttctgcttctgtcggcttcattgtccattcctcccgtttcgatgaaatgacacaccgatccggaaccattcccagggtggcgctgatctatgcaaaaaagccggttccccagggaaccggctaatctaacgaggcagctgtccagacagtgcgcatatggaatatccattccaatgcgccactgaagacagcagccgcgtatacatttcaatggccgattacttccctacgctggtatgatccagatcaggtgcaaagggtccggaatcttgcacgattccatctcagcccggcattacaggctcccccagtaactgtgatacttctattcacatgaggcggatataacagacatccgccttccttaccagactacttcaaatttatggctttggcaacccttctaggtacccttttaccaagaagacactccctatcaaatcactctgcttgcttcaactgtgttcattcttgttacggaagcataagccccatttccttcgccgcttcgatcaaaatcggagcaaagtcatgtagcgtctcgggtgcaagtcgactgaccgggccggatacagataaagccgcagtgacctgtcccttccggttcacaattggcgctgccacagcagcagcccctggctcccgttcttcatagctggtcgcatagcccttctcgcgaatgtcctgcagctgggctttatagacctccgggtctactgagggcggccattcatccccgcttagcagggcttccagctcctgcggcggcataaaggccgccagcaccttgctggaggcccctacagccagcggcatacgcgcacctacaggagcgaccctgcggatcgcctgattgctctgcacggcttgtatgcgaatacgcatgctgccgtcccgtaagtacaagctgaccgtctcccccagacggtcacgtagtccttccattgcaggttgtaacagcaccgccggctcgtcactttgggacaaatgcgtggatagctcccaaatgcggaagccaagtcgatatttttccgtttcggcattccgaacgacaaagccccgatcctccaacgtagtcagcagccgatgaaccgtgcttttatgtagaccaattttggaggcaatctccgtcaggccaagatccgaatttgcagtaaaacacagcagtatatcaagtgcacgctctacagcgcgaacggttaatttacggtcttccatcgtgaaccgctcctcttgtatccatattcgtttcacactatgaaacatggttacataaattatatagaatagttgcggctactgtaaaccgatgtttttgtgacaaccatattacagaacgagaacaaacatcgacaattctttgcatcatttttacttttccggttcaggcgttgactttggataatccccatcatacgataataggtatctatacggatctacactactattttcaagtggaattatacctaaattttatgaaacgaagatcaattttatataaggaggctcttacatgatttcgacatcccagcgcaacgctcagctacagaccgctgttcaggagccgtccaccccactctttaatccccgtctgctgcggttcaagcacgttgtgattgctctgctgctgtcggtcgtcttttttctgttgttttgttttattgccttgcatgcttacatcgcatgggtacttacgaatcccaccgttgcaccactgtactctaatccgatgcaggccaaaagcatgccttatgaggaagtcagcttccctgccaaggatggtagccgcatggtacaaggctggtatatcccggcgggtcaatcgcggaaaacgattattttcagccatggttatggggctaaccgcgaagaaagctggattcccatgtatgatctggcgcattatgcccacagtttgaactttaatgtggtcatgttcgattatggatttgcgtcacaaaacagcaaagcagtcgcaaccggaggcaaagcagaatcccaacagctcctcggagcaattcagcttgcgaagcaacgcggctcgtcggagattatcgtatggggcttctccatgggagcaggcaccgctcttcaggcgggcttgcaaaccaaggatgtggacgcaatgattttggacagcaccttcctgctggaaccggatacgctgtaccataacattcacaatcaaattaatctgccaagacatccgtctttggaaattctggagttgctgtttccagtattgaacggcaccagcttgcatcagattccatatcaggaagttaaaaaggaaaactatccattcccgattatgtttgtgcatggtacacaggatgaaaaagctccttatcctattgcggaaaagctcgctgccaatcaaaccaaccctctttccagtgtatggattgttaaaaacgggatacatgagcttattttcagagagcatcctcgtgaatatttacgacgggtatcaacgtttctaagcagtgtacaggagctggaggacaagaaaaccaccgctgctgcccacaagcaaacgaatacgaagtaaaaaattatttttcgaagaactgtgtattctattcttcgcctggaagaagcctgcctatggacacttaacccgtgtcgtagctgggcttctttttcgttttccatgggtattcattgttttagtaacagatgtgaccggattaagggagttcatagacatatttccgatgagacagtgaatatactgggtacgtatgcgtccagggcagatctgccagatcggccggatagccatagtgggatacgggaggtaaaaaacgatgctgagtacttatgggtctttcctgcccttacgtgtgctggaggaaattcggcattggaagcagcaggaaagttggcatgtggaagtgattaaatccgctaccgagggactggagcctacttatgtacggctgctggatgattggcggactgtattcgaacagacggaacgcaccgccatagagctgcttgaagagcaacggagcgcactcgatccggcagatcaggcgtggcatcaggagtggaaacagatgtcggctgctccacaagcacatacacacgaattcactgaacattcaaaacagtcaagaggattaaacgcatcatcatctgtaaagatgccattgtcagagtcagcctcaaactctcagcttgactcacaagaattaaatcgtcgattagacgatttgctgcaaacctcaaaccgtcagtcacaggagtatgtacgacagctcgggctgctaagcgagcacagtcatgcattgcgtcagcaaccaaaatccgccggagttgtattacacgcggcacatgaaagccaatatttcctgatctcgacaaccccctttcaggaacctggctccatcgcaagggctgctaggttgtatcatgtagctacagagggcgagaattacccagaggaagcacttcgagaacggcaggcgggcataaggggagaaggcgcatggacgactaaaggcgtcaagtccagccaggtgcaaccttcggcagaggaaaaaacctcaatcggccggtcggttcctattgggggacatcggctaccgccgctcccttacccctataatgcgcttgaaccgtatattgatgagaaaacaatgcgtattcaccataacaagcatcatttgagctatgtgaatgacctgaataaagcggaaaagaaactggaagaagcccgaaaaacaggtgattttgacctcgtaaaacattgggaacgggaactggcattcaacggcgcaggccattatctgcatactcttttttggacgatcatgagtcctcaaggtggtggaaacccaagcggcccgctggctgaacagattaaaaaggattttggcagctatgaggcattcaaaaagcaattcagttcggcagccgaaaaggtcgagggtggcggctgggctatcctggtatggagtccacgcgcgggacgacttgaaattttgcaggccgaaaagcaccagaatctgactcaatgggagtccattccgctgctagcgctagatgtatgggaacatgcatattacttaaagcatcaggccgaacgcaacaaatacattgaagattggtggcatgtcgttaactggccagaggttgcagagcgctatacccaagcctccaaactgagatggcaacccttctaagcttctaagctaaagaaaaactacacctgcaaatcgtatcgatctctgagtgctgccatttgttcggtcaattcttccggttgtaccagccagccatcggcaggtaaaacggctgtccggctctcaacaacacggcgcagagatgccgtgtacgcctcaacagacggcactccagccagctctgccaggctacccattgttgctggattcacccgggggtaatcctgctgctgcacgcctgccgacgtgtccccggctgcctctgtgtagaactcctgtaccgcctgtgcacgctctacaccactgccctcaatcatcacgaaagctgtgatgatatacgccttggcttggcgccgctgtgcaatgccgcaaaacttgcggcctcggacgctgacatcgtaatccccgggacagaaggacccggggatttctccggtctgcgcctcgccagaccacggaaccagcgcatcggcaattagcgctgccatgagccgaaaatcctcatgcaggctgatggcccgctgtggattcggcaggatcaaggacaggttcagcacccccctgtccagcatgacggctgctccacccgaggggcgtacgcataccgaggttcccgcgctgcgcactcgctccatcgcctgcggggcgtagggaagcctgcggtcccggtgaccgatcacaagcgctgacggatgccgccaaagatgcaaaatgggtgcagctcctttccctacttgccgacaggccagctcctcccaagccagcggagacaaaacgtcctcctgagtggccacgagtggcgcttcaaaccactgcaactcaggcaaagctgttgttttttctgttgatctatgtacattctccatacgttatcccctatctataaaaattactgttatccataggcaaatcgtaattttaaggcggctatcccgtcgtctctatttctgatgttaacaaaaaaagggggctacgcctatgcgtaaaccaccctttttttgttcatcacataaacgtcttgcgatgttcgatcaatccttgagcagcgacagaaattctgcgcgctgcgctgcatcatcacgaaacgtaccgcgtaccgcagatgttaccgttttgctaccaggctttttgacacctcttgcacacatgcacaggtgctcgccttccacgaccaccataaccccgtgagcggagaccgcttcatttaaaatatcagcgatctgtgatgtaatacgctcctgtacttgcaatcggcgggtcactgcctctaccaggcgtgcaagcttgctcagtcctacaattttgccgctgggtacatagccgatatgcacttttccgaagaaaggagccatatggtgttcacactggctgtaataaacgatgtccttcacgatcacaagctcctcgtgattctcgtcaaatgtcacacccagcgcatcccggggatcaacctcataacccgcaaatatttcctcatacatgcgcgcaacgcgtgccggtgtttccaataacccttcacgcttggggtcctcaccgatcagttgtaaaatctgctccacatggtactcgattttatcccggttatccgcagctttgcggttaatataatcttttacgccagccacagtaatcctcctctatgcagcaacctcatgcggcatccgtgctcacgttgctcattatttccgacggccctgatttttacgcggaccaggctgatttttggagaactgttggttcttcatcatctgctgggctttttgcatttgtttcccattcaggttgtaacccatctgtttggccattttttgcagcgtttcagggtcgttttgcatcttttcaagctgtttacgaagataataagcaccgatgaaaaatcccccaaccaaaccagcaatcagggtaataatcggaatgacaatattccacaccacgaagtcgtcacctctgtatatttatatgaaacatcttgaattgcacgaacctatcatagcaaaacatgggacagctagcaaatcactttttgcaaacatatgtccttattgtttctccaaatccagcagcttcatcttgactggcaagcctccagcataaccgaccaaacttccgttttcacccgatacccgatgacatggaaacaggatgggtaacggatttttattatttgcttccccaacagcacgtaccgccttggctcggccgatcgattccgcaatatctttgtaggacacactttgcccgtacggaatattttgcagtgcacgccatacctgttcttgaaaaggagtccctctcaaatcataggctatactaaattcccgtcgttctcccgcaaaatattcacgcagttgatccgcggcttcgcgtagcttttccggctcttgcacatagacatattccccaatccatgttcgggcccattgctgaagcagtgcttccttcgcatgaaaaacgccatagtctattcggcacagcccccgatctgtagcgcacagcgtcaacgtgcccacaggtgtctccatctcatcataataaatggtggttggaccctgcgaatccccggtcgtcacttctgattttgataattcagacgcctttagctgttctgtctgctcttgttcctctagtttggaatgcgcttgcgcgatcatttcgcgtacttgctcatgttgttccttctctgatgcttgcttgatcgctgtcatagcgttttcccctcctattcgactcaaagcccacgccgccgtgcctcgcagctcgggacgcggatcatccaataaaacctccgttaatttgggcaccgcgctgatatccttgaaattgcccagtccaatgaccgcattgcgttgaatgggcttcttcccccgccaagccgccgcactttgaccaaatcggtctttgaattcacgattgctcaaatccagtaacggcagcagcaacggcttcacaatttcgggatcgggtgtaagctccggatgatgatcccagttaaggcctcgatttttgggacatacgatttggcacgtatcacatccatacagccgattccctatcttccgcataaactcctcatccagaaagcccttcgtttgcgtcaaaaaggacacacaccgctgggcattcagctgccccggacccacaagcgcgcccgtaggacaggcatccaaacatttggtacactcgccgcaaccatccgataccggttcatctggctggaaaggaatgttcgtcaacagctcacctagataaatccatgatcccagcgtcggtgaaatcatcatcgtatttttgccgctaaaaccaatccctgcgcgttccgcaacggctcgatccgacagttctccggtatccaccatgtttttcaatatggcatcaggcacccgctcacttataaaagcctcaagcttttccatcgcttcgcgtagtaccagatgataatctttcccccaggctgaacgcgccaaaatgccacggtacttccccttgtccgacttcggcgggtccttcattttagaagggtacgccaccgcaatagcaatcagagatgcaggctgtgagccatacagctccgggtagatccgcttatcaatatctggctcctcaaagccggattcatagcctttcgcacgatgctcttccaatatagctttcagagacagaaaggggtcggcggatgcgaacccgatggagtcgatacccagccctggagctgcctcaataatttcctgcttgagcgcagcccaagtcgaagcggttccggcagccgcctgagtcaatccgcgttgcatccgatactcacctctcttccactttttatcattacagatatgaggatttgcaaaattcccatacctcaaatttcaacagaaaatagcagcagatgctaccgtaaatttttaacagcactggtcgccagaaaatcacagcgattattcagttcgttgtcactgtgccccttaacctttacatattcaacctcatgcttacccatcagttcccacagttcttcccatagttccttgttctccactggctgatttttactgttgcgccagccattacgaagccaattcttaatccagccctgtttaaagcaattgacgacataggcagagtcactgtgtactttcacatggcaaggctccttgagcagctttagcgcttcaatcacggacttgatctccatacggttgtttgtcgtcattttctcggcacctgacagctccttacgatgctccccatacagcaaaacgatcccccagcccccagggcccggatttcccgaacaagcaccgtcggtatataccatcacttctttcatcatcctcttcctttcctcatcggtaaccgcctgttccgtcatggtcctgatcggttcggacgtgttccccattgatttcagactatagttgctctatagccatttccactcagatatcggccaaaatataaattctgcacgtcccagtaaatcttgagatttaatgctgccaaaatagcggctatccttgcttgctgcaatatggcgattatcccccatgacaaaaaagtgctccggctccaccgtaaaaggaccataatcaccatcctccacgtcagagttggtgtaaggttcatttagtagttcaccgttcacatacaattgattatgttcaactcggattacatctccgggaatacctatgactctcttcactaaaaatcttgggctcgacagcttggaatcgggatcttttaaaatcacaatgtcccccctgcccggatcatgaaaattataaaccagcttgttaacgaacaaatgctggctttccattagcgtcggctgcatcgaatgtcctctgaccgtggacaagttaaatacgaacaggttcagaagcagcaagacgaccatggcgatcagcagagtgactaaccaatcgcgtatgtaaccagagcggcctgcttgtttggacgtttccggcgagggaagcgggcctgacgaaggagccaaagcgtccataattaaacctcctcaaccctgttataaatagaaaagcatatcccgtacccgattgcaacggttactcagatatgctctaaatgtaaatattatacttaatgttattcaattctctttatttcgattcccgattaatgaggcgccaaaatactcagcttctgaaaagcctgtaaaatctggcttgctccatagcccatcgcttcgtacaaaggcatggccgcactgttatgcttgtcccctgctacccaaatacggctaaccttacgttgctgaaaacgctgctccatggactccacaagcgatttgccgattcccatccgacgacgatccgggtgaatagcgatacgatagtaacaaccatcattctgatccatcgtgccgatcaaagcaccaacgatctctccctcttcttctgcaacgatgatcaaaccggaatcccacgaaagctgacgggcaaacgcactcaccgtctctttgtagcactcctctgacaaggcaatttgcatgagttccgttactgagttcacatcacttaattgaaaggaacgaacgtgcataagtaatatctcccttttcgtaagcataataaaaaaattgagacagcaccgtcatttttacataaatccttaaatttcttatcatggtgttaatcacaaggcattatgataaaaatgcatacgatctgctatatatgaaatgaagaacaggaaaagggtgtatgccctcaagttcgtcatgtcatagacatgacagattatagcagacgacaaaaaagccgaaatttctgcttccttgaccattaaaccatactttttgacggaatacatccctttttctcatgtaagcgctgcatataaagcgtttacattttaaagttcacaatttacctcttattacctatgtattgtgtattccaatcgggtttttggacatgctagctaccaggccgtattgcccagtttgctattttacaaacaaaaatgttgataaaataggctgaatgcggtttaatataactatcgagggtattattacataggaacacttacccaaccatataaccaggagggattttactatggcatttcaattaccagaacttccttacgcaaaagacgcactggaaccgcacattgatgcactgacagtagaaattcaccatgatcgtcaccataacacatatgtaacgaacttaaacgcagcgctggagagcgctcctgaactgcaaagcaaaagccttgaggatctgatctccaatctggacagcgttcctgaaagcatccgcactgcggttcgcaacaacggtggtggacaccacaaccacagcctgttctgggaagttatcggtcctaacggcggcggacaaccgactggtgctattgctgaagcaatcagcaacgagctgggcggctacgacaaatttaaagaagacttcactaaagcagctacaacacgttttggtagcggttgggcttggttggttgtcggcaaagacggcaaactggcgatcactagcactccaaatcaggatagcccgctgtctgaaggtctgactccggtacttggactggacgtttgggagcatgcttactacctgaaatatcaaaacaaacgcccagactacattgcagcattctacaatgtaatcaactgggatgaagtaaacaaacgttacgcggctgcaaagaaataagccagtaacaacatctctatcctataataaagggctgtctcaaaagtagattttctacgaatgagacagcccttttggcattccatggtaaactggtggagatgattctcaaatacagctctggaggttgatgaatgcagactttttttcgttacaactggatgattcgggaacaatggtaccgctggtgtgaagaggtgtcgcaggaggaattactgaaacaacgcgtcgggggagtcggcggcattctaaagacactctttcatatcgttgatgtagagtggagctggattcaaacgattcagggcaaacctgactttcaggaggacttctctctctatgatacgctcgacaaagtccgtgagctggatgcaaagtttcgactcgatgtcgagccgttcgtgctcgcctggcatgatggtctggaacggaaaaggttcgaagatcacctcccggacggcaggattgtaattgatgcctggggcgaggtgatgcgtcatgttatcgcccaccagattcatcatatcgggcaactgtccgtatggtcccgggagctcggcaagcctccagtttcggccaatgtaatcggcaaagggctgattgagagcgatcgtagcattgattagctttaacgaacatacaaatatattcatgtgactcagagccgtccccggtcgtttttaacgactgaggtcggctcttttactttatcatctatgctctcttgtccattccacgaaggttctattatttttacccgttttcataaaaacttgatggtaccttactaattttgtccaacctgttcatactctcttggttcagactgttgacctcttactcttgaaagcaccgtaagccaatgtaaataatgctccacataacagggcaataagatgagcgatcagataattcatatgaccatggttctctgacgcggcaattgcaaagccaggaagagccgtggttccgaatcctatggctgtcagcttgcttaaatatacatatgctcccgcaatcattcctccgaggcatccagcaaccaaggggaacttatactttaaagtgaccccaaagatcgctggttccgagattccaaaaagtacagacccgaatgcagagtaacccatttctttaaccttggtgtctttgcgattcaaaagaatataccccaaaacggcgcccccttgagccatcaaagctactgatgccaatgggttgataaaatttctgcctgtatcggttaacagctgcgcttctaccgcacccataacatgatgtaagcctgtaataacaatgatctgctgaatgcctgcaaaaaacataaaaccgaatattcctaggttttgtgtcatccaaagcagcgaaacagtcaccagactagccaactctcgcccaagagggccgataatagtaaacaatagcagggaagaaacaaagaccgtcagcaacggagccaaaaatagtttaatcatgtctggaacctttttgttaaaaaactgatccaacttggctaccacatatcccatcatcagagagataataataccgccctgaaagcctaccaactgtacgggaaggccgaaaagactgatcgattccggattttggctccctttagctacctcaaaggcgtccgccaaggctggatgaagcataattgcacccagcacaagccccagaatcggacggccgccatatctcttggttgcagaataaacaacaagcagcggcaggatggtgaaaatacctgtggaaacgatttgaacaaagcgattgatcccttggaaaattggatacatctccacaatcgatttagggccgaataaccccttctgacctaacagcccggttatccccattaacaatgcggcggcaagaattcccggcatgatctcaatgaaaacatctgacagcgatttaatggctttttgaaaaggattttgcctttgtgcggacttcgatttgacgtcacttaatgacatatcttccgttccggtcagtttggaaaacacggcatagatattattgaccaaccctgctccaaaaatgatctgtagttgatcccccgctatgaaaacgcctttaaccagatcaatatcttcaatcatttttaattccgctttttcattgtcctcaagtacaattcttaatcttgtggcacaatgggccacaccgataatgttgtcttcaccaccgatatattttaaaatttcttgagaaatttgcttatactgcttttcttttgcttccatctagtaaaaccccctctagctgaatcagatgtcttctttaacaaatatccagaacatccctaaaaagtcctgctttaccctggcaagcgttatgcctacatgcattaattcatcaccgccaaacagctcaccagtttctatatttctataaatgtagtctggattcagacctttgaattttaacgttttaatcgcggcagcgggttgggataaaaccttgaaatagctggccgccatttccgtttgatcttccgacacaaagttccatgcggcttcattttcatcaaacggattaattattctataaaacttcccaaattgaatgagcgatctaatttctttatatagagctatctgtttttttactatttctttttcctcaacggttaatgtcgtcagatccagctcatatccaaaattcccggccatggcgacataacctctggtctccaagggagttattctacccacttgatggttgggtaccgtggagacgtgtgcccccatagtaatcggagggtagacaagacttgttccccattgaatcttcagtcggcaaatggcatccgtattgtcactcgtccaggtctgaggcatgtaatagagcatgccggcatcaaaacggcctcctccactagaacagctctcgaataagacatggggaaatcttgatgtaagctcttccataacactatagagtcccaggatataacgatgcgcagtctccctctgtctctcaggtggcaaggctgccgaacccacatccgtcatgtgacgattcatgtcccattttacataattaattggaacgtccgataaaatatcggaaaccgacttaataatgtactcacacacttccttccttgataaatccaacatcagttgatttcttcccaacgtatacggacgatcagggacatggatacaccaatccggatgctttctgtataaatcgctgtctatggataccatttcaggttcaaaccacaaaccaaactccatacccagatttcgtatgcggtttgcaagatccagcaatccatctggaagtttgcgacgatccaccacccaatcgcctaatgaagtattgtcatcatcccgttttccaaaccacccatcatccaatacaaacagttccactcctacactttgagcttccttcgccaactgctcaatcttgtcggcatcaaagttaaagtaagtggcttcccagttattaatcaggatcggccgctctttgtcacgaaaaggcccacgacataatctgttcctgtataattcatgataaattctcgacatgccgcccaagccattttcggtgtataccatgaccacttcaggcgtttggaacgattcctcaggttcaagcagccatgtaaaatcaaaaggattaatccccatcgtgactcttgtgttccgataggaatctacctgagcctgggccgtaaagttcccactgtacaccagattaaaggcgtacacttcaccctgttcttcatctgttccttctcttacaagtgccataaagggtgcctgttgagggctgctggctccacggcagctgtctaccatttgaattccaggtaaaatttttcgccttgctatatttttttcattattatgcgcaccgtacaaggtaattagttcatattcatcatcacgaaaatccacactagcacttaacgctttaagcagttttagctgctgccgaccttcattatcgaaacggactgaacgggtaatgacatcccacttttgatataggctataggatagtacaacctttacattaattaatgggtcttcaagaacgatttccagagtttctacttcgctagcatcttctgcataagtagaaggaagccctttcaattctggtttaccttgataaacccgatgttctttataccgaaaatctgttactgtagagccattctccaattgaagctgatacgcaggaatcctgaaatcactatttccaaatgacggatattcttgtgggatggtatccagtgaaaaggctcgatccttgccatccggattgggtgaaaatcctctatccataaagatgattttattgcttccccgatagttctgaattttctttccccaatacagatgggctaaataaccatctcgtataacctgcatgacataactcgtattgctgccttgtaaatggaataaaagcttctctttatcgatgtgtatagccatagcaacccccttatagagccaatagtatgatttccaaaaagtataaattatgttgtttactcattgtttacatcctaataataattgaatagtttcaataattatatggaataatgtagactctatatgaaacggtgtgataatatgcagagatgaattaaggggtgaaaacaaatgagttcacacttttccaatcattcctataacaacctggacctcaatttatacacatgtggcaaagaaagctgtaccagcaagcactcttatgggccagccattcgaagcgggtatatggtgcattatattttaaaaggaaaagggatctttaaagtcaacgataaaatctatcatttggagaaaaacgatgctttctttattgagccgaaggttttaatttactacgaagcggatgaagtcgacccatgggaatatgcctggattggttttaatgggatgcaagcaaaagaatatctaagccggacctctatcaatacggacaatcccattttccggtttgaagcagagggcagccttgcccgctgtatggaaagcatcgtcgtttcttctacactgaaatccaacaaagacctactgcttgcatccaagatgtatgaatttctgtatctgatgtttgaacattaccctaatcaggaagtcaaccatgaggtaagacagcagcggtatattaaagaagcgcttctcttcattcaacaaaactattcacacttcattaccgtaagcgacattgccaagtacatttcaattgaccgttcgtatttgcatcgtttatttaaacagcaactaaataagtcaccacaggaatttttattacatttgaggattgaaaaatcgtgctccctattaagaaatacttcccttaaaatcggagatattgctcggtctgtagggtataaggatgtactcctattctccaaaatgttcaaaacggtcaacaaggtgactccatccgaataccgaaaaaatccccaggaataacacgcttcgttcgcaactaaattaggcatattcctcccagaaaacagaaaatagcggcagcatggatcaacctcatgtccatactgcgctattgtcaaaagaaaataaagttctagactgaaaaataaagtattagactgacatccaaaaaaacacataaacaagaatgatatttcagcgacatagcctgaagtacaaaagtcatatccataatttccgtcggctgtcgtcgcctgctgctaacgaggcggccttccgccaacatgtataatttgcggccgtccaccaattaatactctttgatgttgcggcgcatggttcttttcgaagccgatatcgcttctaactccaatttgtttacttccataacgaaataacccgcgttagaaagaatcgtattcattttgaaactctcaaatcgatccagccgcattccactcttcgtccaataaatccaattgaatagcagcagctgctgttgcaccactcgatgcggctgatatcaattggaatggactgcctgatgcatcgcctgccaaatatactccggggacattcgtccttcccattgcatccgtatcccccttcataacggggccattatcagacatcccacaccccattatttctggaatatttgtactttgcaccagggttggagcaaagaaaatcccttcacattcaatagatcggtcattgttaaacgtaattcgactcacatatcattgatgtttcttcgcatctccttatcgattaccagtacccgtctgcgtgaacgagccagcaccaaggcggcgttcagtccagcagggccaccgccaacaatcgcaacaccatatatttcggcctcagtctccggtcatcttccttctacctccctgatcaacatcgcaatcttcaaaagctattggcaagccaagtttgcacggattcggcttcaggcttccagccaagcaagtttcgagcatgcacagagcgaattcggcaattcgtcgcaagtgtatattgagcaagaaggccaaattcagcaaccgcttcttccagagaccagctcatcgtgcgtccctcatatccaagcgcctcactcacgtaacggcttagatcacggaacgattcctcgccattttctgcgaaaaagtaagaggaggatggcgctttgtctagcgcaagaagatacaattgggccaagtcacggatatggacgttcgaccatctgttcagacctttgctaatatagactccggccttcatttctttcgatttctgtacaatcattggaagctgaatgctgtctcttggaagtccgagagacgttccatataccatggaaggtacgatgacaatgcctcgcactccttgatcaacccctgctttacgcaccagctcattgactcgaatcgattccaagtcccttgttacaggtgtttcttcgttatagatttgctcgctctggaattcgcccttggcatcatccccaacgttgcctgaaccggatgtgtgaatcaacggctttcctgtaccgcgcaatgcgctaataaacgtctcaatagccttgcggtgagcaacgtcagctgtatgaatcactccatcgctccgttttgcgtaatcagccagtatttccgtatctccaagtgtgcccacgacaggctccactccaagctctttcagctcgtttatttggctggtgctccgggtcagaccatagatagaatgccctgcatcgagcaatactttagccacagaacttccaatatatccggtaacgcctgtcataaatattttcatcgttcgtcatctccctaatctaagttcttaaaagtaaagtgatacgatctgtcactgcctcctatacttaaattaataataagatattatagacccactatgtctataataaagcgaaaaaaaggtgcgtgattcagcttgcattcatacaaagaaccagctcctttgatcgcatggacacgaagtgcatagtcgagttaagaataattcatttgcgctctaattatcgactcatcgagtccataatcgactgacttagctcattttagggctacggattacatatgtcaagtacctggctcgcctaaaccgacataaaccattgtaatcttaaacttgttgctcttagcatcccgtatgagacgggttgcatagcaacgtattccacatgctatcaagcgtaccagaagactgaaaatatctcgtcatagactctgtcgaaatcaactggcagtggttaaataattcaaaattttaaaacaattattcaaagctgttcgcaatttctttgttagctttatgtcgttctcgtgccaaatgtttttaacaacgagcatccggtttttcgttccgcaattatctcagctcggccgatgaagctatcaacattaggatatcttctgcatattatttcaataaattggcttttaccacgccttatttaatgccaaagagagcctatccctttattaattggaaatgatttaacctccaaatcaaagtgatgggcttattttctttctcctaagcactacactacattagactgacgctatttcattaagctaacgagcagattagtttaaagtcaatcgatatgaaccttatcacaggtaaggttatttttttgtgcgcattcatcaataaagaacaaagctcgctgtcacttcagcgagctttgttctttatatgtcaaaaccaagtcatagtaaaccctattcgaggtctgagattagaggaggatgaacaggctgccatctcaagattctccgggtcaagttatcgaaagaagtagcgcattaggcgcgttctcatccgcaggttaacagtattctggactgtttaaacagatttattatacacatctgcaaaaacttttgcaaagtcttcgaccttgactttaccgaggtggtagtcggtggcacggaggctggcgtagaactcgtcggcgttctcgcaggcgcggttcatttgggcaaaggcgttggcagtgttttcgtggaagccgatttttttcatattctcagcaagagcttcaacggggatttgttggtatttggcctcgataccattctcagcaagggcattgagccagtcgttacctgtggcccagtcactaacaatgaacttcgcacttttacccgatggggtgtgagagatcagggcgtaagcgacgtccgcgatatcaacggggctgacccagccttgtgggatgtcaactgaaattgggctgaagatagtctgctgggttttgaggctttgcatgtcggcaaaaagattgctgtaaaagccgacaggccggatgtggacaacgttcacgttttcaagcgagtttagcgcgtcttctgcaaaatgatagctgtagagaatgccggcgtttgggttgtcggcgccgactgagctgaggttgacgacattttttacgcctgattttagcacagcggccttataattttcagcaagatcaatagcggtctgccacatgtcggtgccagaggcataattgatgcccgaaatcatgaggtaaacgacgtcgctacctgcgaaggcctgcgcgaggaattcgacgtcgaggtttgagccgaccgctggtttggcaccgagcgcttcgatgtcggcgatacgatctttggagcttgtgatgacggtgacatcgtggccgtctgcgattagggatggcaggtagttgcggttgatattgccgagtgagccgagaactgtgattttcattgtattttctccttttaataatgtgatttcgagaaatgtatatcgcttttgagaccgttatcccttcctcgattggctattcattacaagagagattatacaacgataaattaaccaagtaaactaaattaacgaaattagttaatttaatatatttattaaatattgtttattgatacctctattttgatataatatgatttgacgagcattagaggaggctttaatcgtgagaaaacccgtgagcgcagatcaatatctcaataaaatcaaacctgtaattagaagaaccagattcagccaactgaaaattgacgatatcgcaaaacatatggatattagtaaagtgacgctttacaagcatttttcatccaaagatgaaatcatcgaacaggttgtagagtatggaattcagtacttgcagcaggctgacaccgttgtatatgatgattccgtttcatatattgatcgatttcaaaaaacgtttctggaatcgttaataggtgttatttatttatccgatttgttcctgcaagacctcaaggagttttatccacgactttttgaagatatttctgttgctcaacaaaatagaattaaaaatttacaatctttttttcaatccggtatggataagaagatttttaacagaatgcacgttgcgctgtccttagttcaagacgatgctacgcttcggcgcattatggaaccgacctttagtattcaatggtatgatctcaccttgaaacaggccgttatggaattttataagatgaaacagtatcaagtgattagtcctgagtatctggatactgttgacgattccgttatcgaaaaagaaatcattcgtattttacaaaccatttcgtgaacgcgttcgtttctcccgacttgctcttagtgatgctgtcgtccgttatctgagtaatcgttgtaaagtttgtagcttattacgctaagaaggccatccttgtagatgaccattaaacttgccggttagagacagcgcagtgaaccgtatcacaagtagggcaaaatttatggttataacaaggaacctcttcgaaaaagtcggagaggttccttgctaaaatagaaagtcggttggttatctgatatatattctgctaagtgatgttgacgtccgctccagtccaattgcaacggattattgcatagggttgccttgtgctgcattcgagacagtctcccaggcttcccaggtagctagacggtcagcatagataccgcgtgccataggcaagacttccgagccgagcgcaaatcgtagggggggttccgctgcgtccacgatcttgagaacggcttctgcagtcgcttgagggttgccgcgtttttcgtttgatagacgcgtgaacacctgcttccgtacatcggcatagacgtccatttccggtactcgcttacctgaagcgccaaactcggtcgcataggcagcgggttcgagcagcgtcaccttaatcccaaagcccttgacctcttgcaccaggctttcgtggagtccttcgaccgcccatttggaggagcaatagaagccgatgagcggccttgcctcgatcccaagggagcttgaaacgctgagcaaatgcccgctgccctgcttcctcagcaatggcaaggcggcttggatgactcgaagataaccaaagtagttcgcgtcaaacagagcgcgaacatcggcttcgcttgcctcctcgaccattccgaccaaggtgtaaccggcattattgaggacaacgtccagcttgccgaaatgggaatgagcctgctgaacgacctggcgaacctgctcagcatccgttacgtcgagcgccatgggaagaacgagatctccgaaacgttccttcaaatcggaaacatcttccaatttgcgggcggtagccgcaacctcatctccacgcgcgagcgcggcctctgcccatatgcgtcctaaaccgcgagaggctcccgtgatgaaccagacttttttgtccatggtatactcctcctttaaattccctgttctgtgtgggatacttaaattaaagcacccaaatacggaactgtcaagttccggaactgtaaagtatctaaaaaagggagttaaattttatgaataagattaaaaatgaagagtcagtcggatccaaattagctgacaaagtagcggaaaaaccagcgaaaacattaggccgtaaacgagatcacacgcgggatgctaaaatcctggaagcgacaatcgacatcctcgccgaagccggttttgatggaatgacaatggacatggtcgcagctagagcgaaggccgggaaggcgacaatgtatcgccgctggtcctccaaggcagagttagtccgagatgccttgacctggatgaatcgaaatcatcttgagcttgacctcttgcccgatacgggaaccttgcgcaatgatctgctcgcgctattgaagccgcaatcgatcgaagaaggtgaacgcaaacttcgagtactcgcaggcctgggctcctttttttcgcagaatccggaatcggttaacggagggattttcgaaccgtgggctgtagtgaatcgtgagctcatgcaccgggccgtcggccgcggtgaaatctccacccacgcggacattgagatggcttgccaggttattacttcaatggcttcttatcgcggactcgtacagcgcaaaacatttgacaagcatttctacacttcgctaatcgacgttgtcctactccctgccctcaaaaatccgttaacgtctccaaatgaaatggaataaggaaggcgaccttttgcttgtggaaagaaaatcctaccacgaattggtcatgatggaagggtcatcccaaaaggatggccttaaaacttgccgttacagacagcacggtgaaccgtatcacagtaagtcattatgctccctcgaagtgattaag

SEQ ID NO: 2632 - DNA, 54680 bp, Unknown
  Kingdom: Bacteria, Phylum: Firmicutes, Class: Bacilli, Order: Bacillales, Family: Paenibacillaceae, Genus: Paenibacillus
agccttgcgagtgtgtttgcagatgaagacagcgacgcactgacatatacggcaacctcgacggatacgggcgtggcaacagcagcggtaaacggaagcgatctgaaaattacgccagtgaacgcgggtacagtcacgattacggtaacggcagatgacggcaagggcggcacggtggatacgcagttcaacgtgacgatcacgccggtgatcccggaagccgtgaaccatgcgccgacggtggacacgtcgatcagcaatgtgacaacaggagccgcggatggagttaagacggtgagccttgcgagtgtgtttgcagatgaagacagcgacgcgctgatgtacacggcaacctcgacagatacgggcgtggcaacagcagcggtaaacggaagcgatctgaaaattacgccagtgaacgcgggtacggtcacgattacggttacagcagatgacggaaacgggggaaccgttcaaacaatcttccaagtcactgctggagaaaagaagggacttttcttctccgagttggcatggggggagagcgactctatgatgcaaattattgagctttataatgcgggttctgaggaattggatgcttcaaaaattagaattgaacgcagtgatagtggaaattcgatcgaaataagtcaagacgctggtgcttttattccaggtggagctactttcgtgataggagataccatgtattttggtgatgcgcatgtagattacttcacagacatgggattttataacgatgattcagcacctgttactttatcgctttattacgataatcagttgattgatacggcagtgtttcagcctcataccactttagctagacaatccgatgttacccatggaaatgcagactacgaggcaagtgaatggtttgatgaaggaaccgattatacggataatatcggcatctttagtagtgaggcaccataatgaatacaaagaatagaggaaacatcatgagttctaaacctaataaatggctgattacattagccttggctgcacttgttgctccaacggctttgcagacgattgcatctgctgccagcggtgcatcaaacggagtagctctggccagtctgccttttaaagacatcaataatattgcttcagagcaaaagacaaacatcctgcgagccattgaagccgggcttctgcatggcgacccatctggatcctatcggccaacggatttgttgacccgtcaagaaatggcggttctattaactcaagctctgcaactctctatttctaaagcagcaagcagcagtttctcggatgtagaaacgaaaagttggtcgagtccctatattgaggctgtacatcgtgcaggactcatgaatggagacgacggctccaaattcaggcccaaagcggcagttaccagagaggaggctgcggttctgcttatgcgggccgccgggcttcctattacagctgacgccacggaatctgctaaacttactgattggaatcgggtcagtccgtgggcacggccttacgttaatacggctttacagtcgggctccatgaagacggatcagtccggtttcaaacctaaatcgtccgttcagcgccaagatatagcccagtatatgatgtctacctttttccctaaggaccatgtagtccaactccaaaaagtagaggatggaaaggcctggattaacgggattgaatataaactctcggattcagttaaaggaatcctgcaaacctctaaccaagagattctcaaaggagcagatattcaatttgtagcatcacagcggaccattgaatcgatcaccaaattggtcatccatgcgagcgggcaagctccgatagggcaagcttccgaattcagcggcaatcttgtattagatggtcataactcctcgattgacggaaatttaactattgacggtgattacatttcggttatgaatttgaatgtcaaaaatagttttacagttacgtcaagccttgaacatgatttctatgcctctaaatttacggtacaaggaaaaacatatattcagggcggtgaccagaacaccgtattgtttaacacatctgagttgcaggatgtcgaggtatccaaacaggatgtccacgtagtcattcaaggaaattcgacggtggatcaaatgtcgttgatttccaatgcaacgattgaaaatgattcatcctcaacgatacagcagttgaatgttcttaccggtgccaagcaagtagagttgcaggggattattaagcaattgtcggtcaacagtgatcagcccgtagctctgacaggccaggcctccattaatacattggctgtgaacagttcctctccggtcagtctggaggtagctggaactatttcaaatttacaagtaaataactctgcagcaaatattagtgtaagctcctccagccaagtcacgaatacttcatttgcagtaggtgtgtcttcttcgacggtatcaggagtcactggagtcactacaacttcttctggtagctcgcgttctacggttgtgaccaatacagcaccgaaattagtgaccaaatatgatgatcaagccgtaacggtgggcgattctgaacttcagattgacttacttggtcattttacggacgaggagcagtccgagctcaaatatacggcagtatcgtctagtacaaaaatcagtacagtccgaatagagggaacaaacctgtttatcaaggctgttggcaaagggactgcgaccattacgatcgccgcagatgaccaggctgggaaaaaagcgggaacgaatttcaagatccgtgtcaatgaatctcctgtttcattgagtatccccgatcaaaacgaacagttggggagcggcgacgtaaccttatctttaggatcgttttttacggattctgaaaatgatcctatgacttatgaggttgcaatcgatgatccttccattgctacctttaccctgacgggtgatcaattggtattaactccggcagctgtaggccaggcccaagttaccgtcaaggcatccgatggtcggggaggcagcgcaagccagtcgtttcaattggttgtaactgcagtacctaatcaaaatccggttgtaaatcagaagccgggcaaccaaacgctcactgtgggggatgcggactacatcctggatttatctccggtgttccttgattcggacagcaatccgctaaccatctcggcagaatcctcggatctatccattgcgacggtctccgttaacggaacccaggccacagttcatgcggtttcctcaggaacagcaaacatccagctaaaagcggcaaatggccttggaggcgaggttaagaccgattttgatattaccgttaatgaacctccggtatccttgcgaattccggaccagacgaaacaaatcaattcagacgacattcaattatctttaaacgacttctttaccgaccatgagaaggattcgttgtcatacagcattgatatttccgattcttcggttgcgaatgcagtgctaaatggagacacgcttaccattacaccgttaaaaattggcagcacatcagtttctgttaaggcatctgatggccatggaggtagcacaagccagtcgtttcaaatggaagtaactgctgtatctaaccaaaatccggttatagaccagaagccgggtaatcagacactgaatctaggcgatgtggattatatcctggatttatcttcggtattccacgatcccgatggcgaccctgtggacgttttggcagaatcttcggattcgtcagttgctgttgtatccgttaacggatacatagccacggtccatgcagtttcctcaggaatagcaacgattcagcttaaagcaaaagatggccgcgggggcgaggtcactactgattttgatgttaccgtcaatgaatccccgatttccacagggattccggatcagatgaaagaaataaatacaggcgatattcaattgtccttaaatgatttcttttccagtcctgatagcgatgttttaacttacgatgttcatagcatttctgaccctactgttgtgacggctgccgtttatggagatatgcttactcttacaccgttaacgatcggtagtacatcggtatcgatcaaagcaacagatagctggggagggaaagtgatcgaaactttcaaaaccaccgtcacggctgaacctccacagaatcagtatccagtagaaactaaacctgccgaccagtcgcttactgtaggtggtgcggtctactcactcaatttaggttccgtttttactgatcctgatggggatacgttgacctttaaggcaacctcttctgatccgtccgttgcttcggcggaaatcactggagctcaattggaaattcaggcactaagtgcagggacgacaatcatagaaatcaaggttatggatggccgcggaggggaaacttcaaccacattccaggtcagtgtccaatcatccggttcgtctaacccatcttctaatcagccgcctcaagtagatgcgaccatttatgaacaagtgttgactgcaggagttacgaatgcaagaagctacgacctatctcaattgttcagtgatgctgacggggatgccctgacgtttacttctactgttgaatcaaccggtatggtaaatgcagaggttaacggatcaacgttgactcttactccgggtaatcagacaggaagtaccaaggtaacgattactgcgaatgacgggcatggcggaacagccacctataattttcaggtaacgaatgctcctcttgcgacgaatggaattgttcaaatccgaaccaagcaaggggttaaagatccgattacttatgacatgtcaacagtgttcccgggtgaaacttcatttaaaatctattcgggtacggcagattccacctttactgggccaatccctcttaatgggacggtttgggcatggaacggggatatttttcaatacttctgggtaatcggggcgaacggatctgccgctgtattccaagtgacctcaaatcctcaaggaccggaggatctatatttttcccagtatctatccttagataaaacccggactgctattgagctgttctacaatccggtaggagatacttctaagcctatagaaaatgcaggatactcacttgagattcatcaatacaatttagctacaaatactcctaaagtgtggagccagcctattaattcgttttggaaaggcatgccttatatatatatcgattccatcttttatgactttttcgacattgttcctacgacatactataatgatgaattgatgttactagaaacgaataccaatgtaacgacaggctatgtcctgaaaaagaacggtgtaacgatcgacgtcttaggtgatcctaacggaaaaacgcaatttatgccgaataatgggactattatccgaaaatcggggattaagtccggttccacctcttataatcttccaggagaatggaattcttttccaaccggaacgctccaatattttagtcatcatactccataacattttgttgaattaacgggaagcccccagcgccaatggtacttgggccgaagggccccgggagagtaggatgtcgccaagcaattaatgtataactctgccatagtggtactcaagctgtcgagacattctcgacagctttttttattcccaatctttcaacatggcatcctataaggtacatactgcgtagatgcaaatttatgatagttacgaaaaaaaaggccgttccctgacttttaaaagtcaaaggaacagccttattaatttcgtagacataccaaagggaattttcatcattactagccgaatatgtcgattacagcgacacgaagcactgttcccattgatcggtaatggaggctttgtcaagctgttctccaatgagtgtgacatatccctggctcacaggaagtgcagtaggctgccactccaagtgatttcctgaaaattgcaaaagcatagtaccttcctgaggaagcacgcagtaacctttcgcacgaagcaacgaggaacctaacccggtcaaaaagttttccaatcgttgtttgtcgagtggctgaggagaatactgatgcagcgtcaagctctccagacgggagaaagaatgaggctgcttaggatcgtggttatgactgtgtgccgcaataactttgaaagccgtacttctggagacactactggtgcttccgatacttttgacgggaatggaaacggacggtacacctgcatcggtggactggacttgtgcaggtgcaggttgaagtgtctgtatgggtttcgcggcaacggatgcggaggccagaacaggctctagtagtggttcaaggtcaattcggctatattcagtagtttgcagcttggccgtaccgttgagcttgcggatgctcttgacgaccttcgtcacttcacggctacttgctgcatccgtcttgttcaccacaataaagtctgcggtgcgcagttgtccgtgcagggtgcgaaccagttctttatcagccgtaaagcggctattgtattcatggaacagctcagcatccacaacactgatgctgtgaaccagataaagccgatctgccagtagaggggagcgaagctcctccagtacttgttcggggttggctaccccggtggtttccatgaagatcaggtctggcttctggttgagcagggtatgcagagcccctgccagctcatttcttttgctgcaacaaatgcagccttctagcaatccttctactgttacgtcaggcatttcctctgaaattatagcgctgtctacatcatattcacccatttcgttcattaaaacagcagcacgaaggggaatttggcgagtatgggctaacaggcgtaaaagcagtgttgttttgccgcttccaagaaaaccactgattaaaataacaggaactttgttcatcattttccctccttggtgggtttagtgtactgtgttcaagcgatcaaaggtagctaccgagtctgcttgggtatagacataaggggattctggctgctcgacagcggttattttttcggatcgaatttcaagtaccggaacgttgcccttttgtgtggcatgcagtgttccttcaatggtcacccaggtatccttgtcaaaggacggggccttctgggattggacgatgatcccgaatggcatggcatcggcagtacagcacatgacgaggaatcttcctactgcaaataggcctttacccggcaggttgtcgtctttatagacaaagccagtcacctgtactttttttccttcaaaagcttgtttatataactcaatggcgccaatagtttcggagaaaacctccggcttgatctgtatgataggttgctgatacaggcgtttcgccagctcggcgaattctacattgtacttgtcaggcggaacgaacagcttatccagcgtttcctgactccattttccctctggagggggcgaagttgggacagaagatgcagttgataaaagggaggaggtggatgcttttgtggtctgtatatctgcttttcgtcggatatccggattgggatacgtgaaggacatgccttttttggcggccatatcactaccaagtgcctgattgggcagcagagaaccgaacaggagcgggatgagcagcattccatatacgagtgtttttttgaaccagctttgcggcaacggatgctcacaatcacatacatcctcaccgtcccgctctccgatgattccgtgtaatgccatcgccaatgcgatgaacaagagtggtacaggacagagtaggagcagcttttgcatatggggagctaggtagtaatgaagtgcattcgtacggtttaatgagataatgtacacagccaatccgattaggagcaaggagcgcataccatattgccagcggatgctaaaggttgaattcacgtttgtattcacctccccaataaccattctgcagctatagaacccacgaggacgagtgaaacaatgagcaagcccaggatggcgacaaatttagtgcggaaggtgcttagcagcatgagcgtgcctttgaagtctagcatcgggccgagtacaagaaaggctgccagcggacctagtgtaaaggtgtgtgaaaaagcagtggctacaaaggcatcggaggtggaacatagcgacagtatgtaggcaaaacccatcataaaggcgtacgatccgaccgttccgttgcttaacgaaagcatctcatcacgtgggatgaaggtttggatgcaggctgttaataatgcgccgatagtgagatatttactcatgtccaaaaactcgtcaccagcatgtacaaaaaagccccgccatgtgcgactatgccgatgagtctgattgttctgcttttgctggttaaaagagagcaacgaccgtttgagcggatgcactcgcacaaaggcatacacgatcagcccgatgatcgcggagacggcaaaagccaaacccattcgaacggcagtgacctcgggatgggaagggaaagccatcatcgtcgcagccagtaccacgggattgataatgggcccgcttaaaataaaagtgatacccatataggcaggcattcccttgagcattaattggcgaacgacagggatcatgccgcattcacagatgggaaacagcatacctaataaggaggccagcaggacacccggtacaggatgcgcaggcgctattttgcgaatccatgtctccggtacaagccactgcaaaagggatgagacgagtacaccgataaggagaaacggaacagcttccagaaaaatacccataaataccgtttttaacggttgcagttggcccatatctaacaaacgaagccactggggagatagcgtaacaagtacagggatgagaaaggcaaacggaatcataaaaggcagcatcttcaacagcgtactgtttttcattccacgtctccttgggaataagggttcttatctaaatcctatgtctgtagggggacaatcatgcccactggattgtgcttgtctcacctcctatattgacaattcaaagaggggtcatatatatttatgtttattattagtaattattacgattaaaatccgataaatgattgcaagaaggaaacttttacggtacgatccatattaaatgttgtaaagacaaggaggggttatatgataccgatagttgttttatccggttttttgggtagcggtaaaaccactcttcttcagcatgcgctggcttactacaaggagaagggcctcaagccagccattttgatgaatgagttgggtgatgttaatctggacggcagtttggtgaatggccaagcacccatgaaggaaatgctcagtggttgtatatgctgtactattcgcggggatttgggcgtcgagctcatgaatcttgctgaggaatataagccggacgtgattattgtagaatgtactggagtagctaacccgatggagatcgtagatgcagtgacagacgcctccatctattcttctatgatattacaatccgttatcacggtcatagacgcgcgtcaatttctggattttgcctcggggaacgagagaggcaagtcgcttcgtttgatgcaggatcagcttcggtgcgcttccaaactgattattaacaagaccgatttattggctgcgggcgagttgcagaaagtacaggccctcgtaaaagagttaaatccatatgctctgactgtgagcacgcaacgaagtgacgtggacgcgggtacctttttctccactcaaggagaggggcgtatggacgttgaccatcactctcatgatcaccatgaccacgcccatgaccacgcccatgaccacgaacatggggagcattatcattcctacgaccacgtagtggttcacacgtatttctttggacaacctgtgccacgctccgagtttgaacagttgttccgcagtttgccagctgaaatttaccgggccaaaggaattgtgcggtttctggaatcagagggtcagatgatgtttcagtttgcctatcgggagctggaaatcattccgatccgcccgcaaaagccagtgaacgatgtagcggttgtcatgggtgagaatttctctgcttccgagatcgaggaacaattgagaaagttggaagcggccgaaaagccattgagtagtagttcatgacttcgagaacgagcaaccttaatccatcacaacataattctcgcgcacacctagctggcaagtctacttggggatttacaacaattctgctgctgactgctgggctgttgctttcggtgacactcgcagtcatgctcggtcctgtagctgtcgcaccggggacgatatggcgaattgcactgtctcatcttccctggctggaccagtggatacccgtgacatggaccaagcctgagcaatatatcgtttgggaaatccgctttccacgcgtgctgctaggtgtcgtcgtaggagcaggacttgctgttacaggggcgactatacaggcattaattcgtaattcgttagcggacccctatattttaggagtctcgtctggggcttcggtgacagccacgttggtaattgtgttcggagctttcggatttttaggacgacttgcgctgcctttatctgcttttataggctcgttaactgcaatgcttatggtgttcgcgttagcccgtgtggctgggagcatatcgacgacccgcttattgctggcaggagtggcggtgtccatgatgctgtcggctgtgactagctttatcgttacgatggccccgaatgaaaaaggcattcgtgacgcgatgtattggatgatgggaagtctggcaggtgctcaatgggacacgcttttcattccaagcctcattgtagccgttggaacggtagtcctcctgacccgatatcgttcgctgaatgctttgctaacgggtgaagaaaccgcagtaacgctaggggtgaacgtacagacgttccgcgtattactggttgttgtggcgtctcttttaaccggggcagtcgtatcagtgagtggctcgattggctttgtcgggcttatgattccgcacatcgttaggctcatagtgggatcagatcatcggcgtgtactgcccgtcagtctgttggcgggagctatttttgtcgtgtgggctgatgtatgtgcccggctcgtgctggctccacaggagctgccgattggtattgtaacggctgtgtgcggaggacccttttttgtgtggctgctgcgtcgtagttcctactcgtttggaggcgaaaaatgaatatagaagtcgaaagcgtcaccttcagtattcacgataaacggctgatcgacggcatctgtctccaggtaaaagcaggggagctggttggattgattggtccgaatggcagcgggaaatcgacgttgctcaaaaatatgtatcgtgtgctaaagcctgacagtggtttggttacgttggatggccaagatatgctgcagatgaagtataaagaaacggcccgacaaatggcagtggtgagtcaggatgcgccgcaaacgtttgatttttcagtacgggacatcgtcctgatgggtcgccatccgcataagaaactgctggaagcagatactgtcgccgatcatgaattggtcgagcaggcgctggagcgggtaggcatgaatgctcaggcggatcagggttttgccaccttgtctggcggcgaaaagcaacgggtattgatcgccagagctttggccgggcaggcgaaatttcttgttttggatgagccaacaaatcatctggacatccggtatcagctgcaaattctggatttggtcaaaacacttcggataactacgctagctgcactacatgatttgaatttggcggcattttattgtgatcgaatgtatgtattaaaagaaggcaaagtggtagcctccggcataacagaggatgtgcttcagccagacctgctgtggagtgtattcggggtggagacagaaatctgtattcatccaaaaaccgggaagccgaatattacctttttaccggattctctcaggagaggaggctatccatgatgcgaacagaacaggtgatatgatgaggtaagataaactacaaataaaagaggagacggtacatatgaaaaaatatagcaagcccgcgttaccgctggttatgatcgctttggcgatgatgctgttgttatcagcctgcgcagcaggaaacacggctcaaacaagcgatccatcggcaaacgggcagcaacctgccgcatcgcaatcggcaaccaataagacgtcggtagagcttgagaacatgggcgttaaaatggcatttcccgaggcgcccaaacgcgcggttacactgaaccagcacgcgactgaggttatgctggctcttggactggaatcctctatggtaggaactgcgtatttggatgatcagattttaccgaaatataagaatcaatatgacaaaattccggtactggccgaacaatatccgtccaaagaggtgtttatggccgctgcaccggattttgcctatgcaggctggaagagtgcctttaatgataaaaatctgggttcccgtgaggagctagccaaacaaggggtgctgacctatgtacaggagtcctcaaacaagccgggtcccatattagaagatgtatatcaggatatactaaatattgggcgtattttcagggttgaggagcgtgcagaaaagctggtaaatgacattcgtgaacaagtgaagtccattcagactcaaattggtactgttgagcaggcacccaaggtgtttgtttatgacagcggagaagacaagccctttacggctgccaacaattatctaacgtctttgattgaaagtgtgaaggcgaaaaatatttttgatgatattgacaaaagtttcaccgaagtaagctgggaagaggttgtgaaccgtaaccctgatgtgatcgtcatcctcgactatggtgatacttcactggctgataaagagaagctgctcctgagcaagcctgcgctggctggtgtggaagcgatcaaaaacaaacggtttatagtcctgccattatccgcggcagctgaaggtgtacgtgcaccgattgcactgaaaaccttggctgaaggcttgtacccggacaaaatgaagtaaacaaacaaaagagttgccaaaacattgacgaaccttgcctaaactgttaaacttgctaatgcgtaaaggttacgtttatcaaacgcttatttttttattaccaaatcgtaataattacggtagatggtttaatgatcataaacgacctggagaatctgcgcaaataatgatcgctcagatggctccaggctttttaaaggaaaaggagatttgcgtcatgttattggcctcattggaacaggtcacatttggctacggagatgttcctaacttggtggatgccaatgttgaaattttttcgggagaatttgtggctattaccggaccgaatggtgcttccaaatcaaccatgctcaaactattactcggcttgcttcagccttggaagggcaaggtgtttatgtctaaccgtacaggtgaaggcaaaaagctcgttgtcggctttgtatcccaacaaattgctgctttcaatggcggatttccaagtacgattttggaatttgtccgttcaggaagatatactcatggctcttggttacgccgtatgcggtctgaggatcatgatctgactgagcaagcgctgcgtcaggtaggcatgtgggatttgcgtcaccgtaaaattggcgaattgtccggtggacaaaagcaacgcatttgtgtggcgagagcgctcgctcaggaatcggatttgctcattttggatgagcccacgaccggcatggatcaggaaagccgccatcatttctacgatctgatgaatcagcaggttaaggaatatggaagaaccgtggtcatggtgacccatggactatcggaagtacaacattatctggatcgaattattgagcttgaaaggaaggaagatggcggatggaaatgctgcactacgacttcatgcagcgggcattttgtgccggtggggtaattgcactgctggcctcggtgcttggagtatacctgatgctgcggcgtcaggctctcatggcggacatgctatcgcatgtatcgctggcaggggtggcagcgggtgcctatttaggcattaacccgacgataaccggatttgttgttgccgtaatcggcgcgattatcgttgaatatgtccgcaggtcttataaaacatatagtgagatatctgtggctattattatggtaggtggcctctcgacggccgttattttaatgaatctgaatcagagcatcaacaaaggattttccgcttatttgtttggttcggtcgtagcggtcaatcagacagagctgatgttgatgattgtagtggctatcatcggaggtattttcttttttgtattccggcgtcctttatatcagattacctttgatgaagaaacggcgaagaccaatggtcttcctgtcaagtccatttcatttgcatttagtattttaacagggatgattgtagccgcagccatgccgattgttggtgtgctgcttgtctcctcgctaatcgtattgcccgctgcgctggcgattcgaattgcaccgagcttcgcggcagccatcgggatatctatggtcactgcattgatcggcgtatttatgggtttaacggcatcatatgaactcagtactcccccaggggggacgattgccatggtgctgttattattcctgattataggagctggtattcaaaagctggtccgtaagctgggcaagcaacaggcttcccggcggaagaaggcgacaggccagtgagtgtaattacagtgagaatttaccaaaaaatctaacacataaggagttatgaatatgaatacatggttcaaaaaatcatttgtattgtctgcgggactagcacttattttatctggctgcggagccaaatctgataatgcagctacaaatgcttcccaaaccgagccgaatgcggcacaaacaaagctgaatgtagtcaccactttttatccaatgtatgaattcacgaagcaagttgctggagaccatgctaacgtaaccgcgttgattcctgctggtgctgaaccgcatgactgggaaccgagcgccaaagatatggcacaggttaaggatgctgacgtatttgtgtataacggtattgtcgaaggttgggcagaacaggctttgagcagcgcgtccaacgataagcgtgttgtagttgaagcgagcaaagggttgaacctgatggaagggactgctgaggaggaagaaggagaagaagcacacgcagaggaaggccatgatcacgatcatgtgctggaccctcatgtatggcttgatccagtcttagctcaaaaagaagtagaagctatagaagcagggcttgtaaaagccgattcggcaaacaaagctgattatgagaaaaacgccgatgcttatatcgctaagctgaaagaactggataccgagttcaaaacgggtctgaaagatgtaaaacgtaaagactttattacgcagcatgctgcttttagctatttggctaagcaatacggtctaacccaagtacccattgccggtttatctccagagcaagagcctacaccggacaagctggcgggtattatcaaatttgccaaagaaaataatgttaaaacgattttctttgaaactcttgttgatccgaaggtcgctgagaccgtagctactgaaatcggttcaaaaaccgatgtgctgaatccgcttgaagggttgacagatgaagacaaacagaagaacctggattaccttggtgtgatgaaaaacaatctggaggctttgaaaaaagccttgaatgaataaacagaccttaaacgaatagtacaaaaaatgacgttggggaacgataccagcgtctttttttatgtctgtctaagaagattgtacttttttggctagtgctctagatacagtagatatatagtgctttgtaatttgctttacaggaaagatttacgtcattgtgaaacgtttttttgaaaactaatgctgtagtagctagtttcaaatttcttttataattcattggtagcgtttttatttttacagattctttctattaatattactagtttattcaccgatattgaagtttgggtgtgcatatcatttgacaacggattggagagattaatttggcaacagttatagtagtggatgactctttatttatgcgttctgtgcttaaggatattcttttggatttaggtcacgctgttatcgcggaagcagaaaatgggtatgatgctgttttgaaatacgcacactttcgtcccgatttaatcaccatggatattaatatgcctaagatggacggacttgaggctgttaaaaagattgtagagcttgatccacaagccaacattttgatgtgttctgctttggggcagcaggaagcgattataaaagcatttcaggcaggtgcaaaagactttattgttaaaccatttgagatggaaagggtcgtgaatgcagtcacaaaaatgctggggagttaatgaatcaagattttaatacataaatattgaacatattaaagcgagaattccatgcttattttcacgaatatggagatgaataggatgagcaatcgagtgttgtctcaaaaagtatttatagacgaattgatcgctacgatcaagaatggagggcttgtccctgtaaattatgaacacctcatcagcgaacaaagagaaagaatggatgctcttaacaatgaacttacccttcgtattgagggattagagactgatttgatctctgcttcgacacattccattccttttgccaatggcgaaattatgtttcttgctcgttatattgtactcattggggatcataccgaaggatactttgtgttctatcgggcagaagattgtgaaggtccagaggaatatcagtttttaacaagctcttatcaacttccacatttattacttgaattatctctttctttaaaagaacatggtactaatgagccgatcgatattctgacttattggaatggccctgtctacccgctgaaagatttgaataaagaagatattaagctatccacctatgaattttaattcccttgagagagtcaaatccctcaggggatttttttacattgataatcaaacgcatgttcgcatataatacaaacaaacgttctgataaggagtgaaggatcatgttggaaaaatacgtggggcagatcgtggaaatcgtgtatttggatcggaagggcaagctgtctcatcggcgtatcgaggtgcaccgtgtgcagaatggcttgatacgagccacctgtctacagacaggccagccacgtgtttttcgattagatcatgtattggcatggcatccggtaaccagaacagcataggaggggcttatgatggggaaaaagcttgaaggaaatggcatatgggaaagctcgcgcatgattttgcctgagcatcgggaggcatatttaagactgatgaaggagcaaggaaggcgcggcaagccagcactggacgatcaggaaatgcagcagattgaacaggccatcatcgtatcctataacgaacggaagcctattacgctaaaagtgttcaacccgtttgatgatgaggagcttcgtggattggtcacggtgattaatacaagtcggcgagaagtgaaactgtcccgtggggaggaggattttagctggattaagttggaggaaattatcgaggcagatatataaaaaagtctgactaagtcggacttttttatgttttgtcctgccgttttataattaagattgtagctctatgaattcatatataaaataaactgtaattgcaaaaggaggagttcaataatgaaaattagtaaaaataatgcggaacattatatatggggagatcaatgtgatggttggcgcttggtgaaaaataatgatttgagcattattcatgagcggatgcccggaaatacacatgaggtcagacattatcatcatcatgcgcgccaatttttctttattttatcaggcacagcggtacttgaagtggatggtgaacgaatccaattaggatctcaggaaggatgtgaggttcctcctatggtgcctcatcaaatgtttaatgaaacgaatcaggatgttgaatttttggttatttctcagcctgcgagcagaggtgaccgggttctgaccgaaaaataatattttggagcagacctaaaggagcatataggacagaataacttagagtataaaaataaaaccagcctagtacatgaaaatcaagtgccgactggttttttttatcaataaatgcccttagcatctgctgggagagcttttacgtgatggagatagttcgtaacatgttgatcgtccagagtcggatattcgtagccataatagttcgctacttccaaggcaacttctctaaataaatttcccatgatcaaaagagactgccacatatgttcataatctgcatccgcaaatgtttggatgtagagcgtccaaagtccaggctcaaggtagttctcgaaatattttccctgtttacccggatctgccgcgaagtctgttcgtataccaatatgccattccagcatcaagtggagcgcatctctaacaggccgatctagcataaatttagcatagggcagctcctgtcgccataaccctttagccacataagtactgacccaccagaactcattacaggaatctgcataggtttgggcggttggagggaccgtcttataatcttgaagacttggcggtgggaaaggctccacaagcccgtctttatccagcagcagtacacttaagctgtctcgggtccaattggcgatgttagccacaggacagagggtaagatctatgcgattgccatccgtaaataacataagaaaagcaaagcgatcatgggacgtcacagtaggctccacatgctcatcgggcgtctgcataatgatcaattctccaaagtggtgaatccagccacgttcctgaataaagctgtccatggaagatacgagaaagacgatgtcataatcctgaaaaatgtcccgtagagcatgtggattagcgcgtgaaccgttcataatcacagcacgtacccgttcgtcctcttgagcaaattggagaatggtatgcagcatctcttgttcacttctcactatagtcgtctccacaaacggtatcgaaaggaaaaaaacgtagacaagacagcagtagaaataagggccaccagttcaaggatcatcaagaaaaacgacctcctgtaagttcttttatctgggaaaagtatcctatccttacaatagcctatccatggaagccattcaactgtgctgccgaggccttcttcattacccaaagtacacttgaccgaattgtatgttttatccataatgaagcgaggcatcaagtacagaccatcgaaactctcataggcttatgggaggcaaatcagacagatgtgtgctcatcacatgattcaaggaatgaactcgcagaatcttatttttataagggattcggtctttttaatacaatgaagcatcacatatcgattcaaggtgtcattagcggcaccataccgggtagaattttttatctaataatggggataacgctgtattgagcaacccccaaggcatttttctgggaggaagtccggacaataaatttttaaaagaaatcaacatgttgcttcaagaaatcctattacctcaactggcatccaaaggagaaatatccggaactggagaggcgctttgagcgcgactttttttgtcaattcgagtccatgcggctcttgtgtgttatataaatgcagtccatttaaagaggttgggaggtataaagatgccaaaaacgatattagttgtagacgacgatgaagaaatcgtaaaactcatcacaaagagtttaaggtacgagcaatttgcaataatttcggcatgttccgggaaagaagccttatctgcattggaagaaaatcacattgatttcatcgttcttgatatagtgatgcctgatatggatggacttgatgtctgcagaagtatccgaaattcttataatgtcccaattctgtttttaagtgcgcgtgataaggacattgataaaatcgtcgggctcgaaataggagcagacgattacatgaccaaacctttcagtattcaggagcttgtctccaggataaaggctcacttcagaaaagtggacaggctttttaaagagtgggatgaacttagtcccagtaacgaaaaggcggatgctccgctcattttgaacgataagacgtttgaagcatttctgaatagcaggaagctcgacttatcaacgaaggaatttcagattctgtctatcctcatgcgccaccccaatcatgtattgactcgtgagcagatatatgaaaacgtctggggagacgaatacggagaaataaataccgtaacggttcatataaaaaatatccgtaagaaacttggttctgaatatgactttattaaaacaatatggggcataggatataaatacacggaaagagagcaatagtatgaaactgaaaataaagctgcctcttttgttcctgctgatgtttataatattcatgttttcgattggaatgtatctgaagcttgtctttgcagtatattcccctatacgcagttcattgctggactcgcgatatatagcattgctcctgcccatatttgcaattgcctgtttcatatttattattctgattatctatattcatttttgcatagagaaacccattcagcttctgaataccaggcttgaagaagtaaatattgtacatccactgcctccgctagctctgagaagtaatgatgagatcggagaactttataagcacttcaataagatggagcatcggcttcaactcgcgcacaaagagcagatcgatatgatcgcggcaattgcccacgacttgaaaacacccttgacatctattaatggttttactgaactgctggctacacacaaggatttaccagaaactgaaaagcaggaatattatgatttgattcaaaggaagtcaggatatatggtcgaactcatcaatgatttctccagcttcaccaaagaaaaactggagttggaatctatggtagctaaacctgtaaaagcatcaaaattatttgaaaacattgcccttgaatatgagtatgagttggcgggacttgacaacgagcttacttgccgccattcattcacggaaaatatattgctgatggtcaatgaaccgatgatacgtcgggttttcggcaacctctttagcaatgctgtaagatatggagggaaaaataaactgaaagtgtatatgaccggatacccgctaggacagcatgccttttttcaaatcgaagataatggaattggagtgccggataaggatatatcttctctgttcctcaaatttttcactgtggataaatcgcggcaaatccaaaagggcgggctgggtctgggtcttgcaagctgtaaatccattattgaacatcataggggcgaaatttgcgcctacccttccgaatatggcggtttggggataagattcagccttcccttggccgcacaacactgattttatttttgcacattttcttttactacaggagttaaaggctgctgccgggtgtgaacacccaggcagcagccttttttgttttttcagcggtttatagttttttatattctctttataaacatttatttttcttttaaagaagctttatctttgtgttgtaaaaattacttgtagtaaaaaaactacaatcactagaactggaaaaggaggatgttgcaatgtcaattgagttcagccgttggcccaatcactacatgatgtcataccaagtcaccaaagctttgggtatggcaagcctcggtgctacggacgtcaccgagatctacgaggcctgcaaaaaaatcgaccccgatgacaaggacacgtggcacagggagtggctcataacggctcaggtattggaaagacacggcaaggaggccgaaacggctggaaactggtatacatcacgaaactgctacattcgtgcctgcaattactacagaattgcggaatatgcggtgatggatgatgacaccgagaaaatccgtatatttaagaaagtaaatgaactcttcgaagctgccggaaagtacttcgatgtccaaccggagaagatccaagtcgattacgaagatgtcaagttggatggttacttcttctccccttcctggataaaaggtccgaagccgaccctttttgctctcaacggtggcgacgagtggtcaattgaaaactatttctggctaggtcccgcttttatttcgtgtggatataactttctggtctatgaccagcctgggaccggcctctcgctgtacgaaaagggaaaaggaagacgagcggacagtgaggctttccattcccgggcaatcgactttcttctaacgcggccggaagtcgatcccgataagattatcgtgcacggggagagttttgcggcttacgactcgctgcgattcgcttcgttcgatcacaggattgctgccgtcatctccgacggcggtacgcacgccttcgactgggatgccatgcttaaatggatgccgccgagtctggccgcacacggcatgagaattctgggggcaaaaagcttggaggattttgcggggaatccgcgttttgcctatgatcttgagggcgtgctccaccagatagaatgtccgcttcttgtaatgcacggagcggaagagatattggttcagccaaatccgctgacacaagccttgaagaattacgagcaagcgggttcgaaaaacaagacgttcttcccgatagaggatagacgacttggcggattagaacactgtcaggtagacaacatcaacgtgctgcatgaggtagtgctgaattggctctgctcaattgggcttgggccagcctcgcctcgcttaagcgattgccaggacatcataaagtagatttattgaaaaatttctgattgagcttgttcaggagtgttgtacttagaatcctgaataagctctctgtttatggaggagttgaaggctatgagtattttatcaaaggaaaaaaatggcggaacgcccgccatacaaattgagggagtgcacaaaaaatttggcgactatatcgtattgaacaatctttcgctggaggtgaaccgaggagagatatttggatttttgggactgaatggcgctggaaagacaacgaccataaagatgctcttggcgatgctcaagccaacctccggcaagctctatatgttaggtgaaaaggtcgatgccggaaactataaattatgggacaaggttggatatttggaggaggctactttttatcccgatttaactgtagttgaaaatcttgacatagcacgacgcatgcaaggggtgcctgacaaagattccgtaaatcgggttatctataagttggggcttgagctgcacaaacagaagaaggcaaagaatctttctttaggaaacaaacaacgcctgggacttgcgaaagcaatgattcacaatccggaaattctaatattggatgagccgataaatggcctcgatcccgcaggcgtggcggagatacggaatatgttatataacctagcgaaaaatttcggcgtaactgtttttatatccagccatctgttagaggaactctcgaaagtttccacacgcattgggattattcacaatggccatcttgttaaagaagtcgcaatggataagctggagcaatcgttacagaaaaacttagtggtgaatggccgcgacaaacatgccttaaaggaggtgcttgaagagcatggatatgaatttgaggagataatagacggctatattaaactaaccgatgaccacgcagcggatagtcctgaacgactggccgaactgctggttaaatccaatcaaccgccaacattgcttcgagtgattacggaggatttggaaggatattttctccgcacaattggtatgacaagggggaatatataagggggaatatataatgaatattttttctgtcttacattgtgagattcgcaagattatccgcgccaatgtgttttggttggtatttcttatttttgcatttgggccaatcatgatgggagtcggaattattttatccagtgacgccggcggcatcaattggaaaatgtatttaaccgaattgcttgatagtcttgccccgctgggacttatcgggtacacctttatcgcggcatgggtatttggacgagagttttcggataaaacaattaaagatttgcttgcaaagcccgtttccagatcgaaaattgtactgtccaaatttcttgtaattttagcatggagcctattactttccatgtatatgtttgccataggttttgccgtggggggtattctaggagttgcgggcgggttagcttcttttatttggaatatcttctttaaattcattataacatcgctattgtttattattgttaccacaccaggcactcttctggccaatgtgagcaagggatacttggcaccattaggactcatcctgatgatcgtcattctctcaaatgttttggcctcttttggattcggcccctattttccgtggaccatcccgtcggtatttcaaagcaccgggtttttaaagttgagtagtataatcattcttgcgtctacgggaatagccggaatagtcggaacatttgcctggtggagatttgccgagcagcaataaacgcgctacatgcactgagttgtagatatatcaattatgaaaaggaacaacaatctctccgctgctcgcacgttcatgcttgacgaaaaactaagcgctggattggagagtgtaccacaaccgaagcagttcaaaacgcgcgtttcaagggttgaaacatacacacagcccattctggagggcaaagggttgaacgattagaacggacaaatggatcggatattctcaagaaatacgaaaggcgaggaacatctgccgaagagcaggtgtttttttgcttagaattacagagggagcagcaacccttaaattatgaggggggatatgatgtgttcttatgctgaacctgtttccggtgttcaccggcatcgggctgatcattccgataatgccgaaattcattaatgaactggggattgccggaagatgtgtaatgctcccattgagccagtcgacttcaacggtaagttgaccgaccagcttttctaggcgctcctgtttgctttcgtattcctttctcatcttgtccgcttcactcgtccctttctcgaacaccatagacgcccggctcagaaactcggctttccaccagctaatcatcacggactcatttcatatttggcggcaatctcgttcacggtctgctcttcctgcaagacctccagcacaatcttcgtcttaaactctggggtgtatcggttccgtttttccatagctttattattatttatttatcaccctcccgtgtctaaacctatgggagcattataaagaatggaaccctgtacctcaatttttaatttttgatcaaccaagtcaagtttattttcctgataaattacaaaaagtctcgaatattaattacacaccggaagacatcataaaaatagaaaagatatttgcagcttgtgttcttcatataaatcttcgaatcagcgtgtattaacaggggggaaattccaaaacggcttactagcacacagattccccctccccaggagaccgggcatctacatttccatgtgaaattttaggagcgctcattccaatagggcgattcgatattccatccgtttccaggtgtggtgattgacgaatgccttcgccagtttgagtacggtggttcgactatgacttccttgatgtagttttccatcaacaccgctcgctggttgtaaaagcgccacaaatcgatggattcccactccaggctcgtgacgatcgcttcatactcccaatcggtatccagcaggagacaagcttggtcgtcctgaacgactttcgccttgcggatgacggcgactcgccgcggtttcttccaagacgtggcctggtacccaagggcgatgccttcaatgacccagtcttcgtccacgtaacgtttccaataccaacaagcggccacttcagccgccaatcgcttggtccatttcgttttgcccacatagtcgatctgctgtccttcccagagtgaatagaagtcttcgccgcttagtcctgattgccgtagaccgtccacagtcgaatccaaatcgagaatgagcttggaggacagacaaggccggatcacttcgaggttcacttgtcggagttcccttcgtacattaggattcgtttttcccagccgatccagttccttgtacagaagcgagtagtgtggacagcgccccccaagaaaacgttggagtagagagtccttttgccaactgtgaaaatgaaacagtcactcacatcccagtatccagatacgtcttctcataggctatatctctccataattgtagaggtgctgagcttcaagacttggtacctaccgctagcatatgcgggctcataccgatcacagattcctgctcttcaacctgccgtgatatatctagcaaacggctgcgatgggaaggaacctcccacttctcttcaaatccgggtgcaatccagatgggaccttctacgcccaatacacgaggctccgcaatccagcagcctgccaatcagcacgcaaggtatctggtgtatgaaagtaggagcgtgtgagtaaagaggggtaagcagaggggcgcacatgctgaccatctgtcaactcctgtctgaccatatccatgaacgcatcttcctccacaatggtattgcgctcgccgtataccgatagtccccacagtagcgagccaaacctggaaatagctgaagtaatcagcgttccccctttttttaagacacgcgccgcttcttgcagtgcttttactcgttctttctgttccgttaaatgatataaaggtcccattaatagcacgatgtccgcgctttcatctttacgatcaagattcctggcatctgcgttttccagcttgctgatgttggggttgttcagttgctgctgacgagcgaattcaatggcttggggagatagatcaaatagatgcacttcgtatcccagttctgccaaccacgaagagtagacccctataccgccgccgatatcgtaaataacatgagtagactcgctgagataacgtgaaatgatttcttttgatctttccagttctatttttcctatgcctcgctctaacctgcctatttctgcaccatcatcataataagccagaatttcctgcgtatctttttcgagcatagcgcacctcatttcaagcgattggaataatataacattatcacttacatcatgaacaagtctaccgtgtttaggattaagaaatcatcggaagcattgggaaagaaaaaagctgttccccagtagctaaacctactttttgggaacagcccatatttaaatgatgtttgtttccagcatgccttcgagatcttctttggtaagatggtagtgtgcgttacaaaagtggcaatgagcttcagcctgtccatcggtatggatcatatcttctatttccttattccctaagctgataatggcattggtaactctttcttctgagcagggacaatgaaattttacaggtatggtttccagtatgttcaggttgctttctcccaaaatctgacccagaatctgctctggcgtaagaccttccatgaccattgcggagatgcttggaatgctctcaatgcgtctctcgataaaactgataacctcctcctgcgtatctggcatcagctgaataataaaacctccagccgcctgaatagagttatccgggttaacaataactcccgctcctacagaagaaggaatttgttcggattggacgagataagatgtgaaatcctcccccagttcacccgaaacgagagggacttgtccaacaaatgggtgttttaagccgatatctttagatacaattagcgctccatctgttcctacagctctggcgacatctaatttccctatctgattaagctcaaaatgggtttgtggattttttacataacctctaacttcacctttggagttggtatcgacaagaatagtgccgataggtccgccgccattaatcctgatcgtcagtttatcctcatctttaagcatggctcccagcatgacgccgaccgtcatagaacgtcccaatgcagccgatgctgtgggccaggtataatgacgccattgagcttcacttaccgtttccgttgttctcacggcataagcccgtacctggttattgtaggcaagagcttttactaaataatcgttcatgttcatattcctttctgttcattagagttctttacaagaccattttttcctgaatccagttctccaaagaagtcattttgtcatcatatccttctttaaaaaaatcagcggatagtgacgcgatggtttctcttttcagaacggctttccaggaggcttccgcttcttccatcaaatttgccagtaaacaacactgatcgtctttctttaattcaagcatatcgttgtagataccgctggaagaatagagagtctgttgtccttcaatcgccagataaatatcaaatacccgtatatcctcaggttttttctttaatttgaacccgcccttgacaccaggtacagaagtaatcaaatcggcgctaaccaatttacgtaacagtttatgaaaataagtaggtgaagcacctaactgctggctaatggcctccccaggtaaaacggctttgtccggcagcatcgtgagtagaagaagcgcgtagacagattgttcgacacctgttttcatatgcactagcaatcacctcaatatttataaccaggctaatatggataatgattatccacataaatgcatgatagacgagcttctcgtaaaagtaaactgtttttgaacaaaactaaaaatttaaatcatttgcaatttataacgggacacattatcataattgacgtatcaattgatgggtcaaagaattaaggcgttgaggaaaattcataaaataatattttgacagggggtttatatataatgactacgcgtaacgttgcactatctatattagatcttgcacctgtccttgaaggcggcactcctgccgattccttccgcgacacggtggatcttgcccagcatgctgaacaatgggggtaccatcggtactggctaacggagcatcataatatgcaggcggttgccagtgcggctacgtccgtgatcattgggcatgtagctgcacatacaaacaagattcgggtcggttcagggggtattatgctggctaaccatgctccactcatgattgcagagcagtttggaaccctagagtcgctctatccgggacgaattgatctgggacttggtcgggctccaggcacggatcaacctgcgatgagggcactgcggcgaggacttcacagtactggagaagatttccccgagcaattgaatgagctgcgttcttacctgaatccagcgctgaacggagccgttccgggagtaagagcggttcctggagaagggctggacattcccatctggttactgggatcaagcggattcagcgcacagctggcaggtcagcttgggctgccgttcgcgttcgccagccactttgccccggctcatttgctacaggctctggagttgtaccatcgcaattttcggccatccaaagcactggataagccatatgtgatggtcggtgttaatgtgcttgttgcagattctgatgaagaagcaaaatggctcttcacttcacaagaacagcagtttctaaatgtgctgcgcgggcacagcggaggactgaagccaccagtggatgacatggaaaagctatggagtgagcacgagaaggagatggttcgtggtaatatgctggggtattcagccatcggcagtcccgacaccgtcaaacaaaagatggatttgataatcgaccagacgagagccaatgagttgattacaacctctcaggtatatgaccatcaggcgcgcctgcgctcgtacgagctgctagccaaagtgatgcgtatagttgggtaattagatgagttaaacgaatgaggccgtgccagaaaggttcttataaccgattctgacatggcctttattttgtgcgtggcaatgatcgtttaccaaatgaatatatccatttttttagatgggtaaaaattaaaatttatttttgattatttttgtattactcattttcaaattaaaacaaaagtgttatagtctccataaacaaagaaaaaccactgtaataaagcctttcaaaactaaaactgaacttggaggtctttttcctatggtacaaagtctgtggatttcttcacaagcatctgagcagaaaagcacgctggaagagctcgtataccgttctaacctgattggcacagataggagtgtgtgcaactggggaggcggtaacacttcggccaaaacgatgatacaagattttcgtaggcgtgaagtagaagtgatgtacgttaagggcagcggttccgatctcgcaacaatgaaagcgcataacttcacagggcttcgtatggaggatattcgtcctttatttgaaagggaagatatgtctgacgaggatatggtcgcatatttggcgaactgtatgatagatgccaagcatccacgggcttcaattgagacgctattgcatgcttttctgccttttacacatgtcgatcatacacacccagacgcgattattagcttgtgttgtgcgcacaacggtaaggaaatggctaaggaaatcttcggtgaccgttttgtatgggtgccttatatccgtcctggctttaagctgtcgaaaatgattgcccaaggtgtaatcgatcatccacaagctgaattggtattgatggaaaagcatggtctggttacgtggggagacacatccgaagcggcttatgcgaaaacaatcgaaatcattcaagaagcagaaagctatattaaagctcgtcaagaggaaaagcaggcgtttggaggcgtaaaatataaagcgcttacttctgaagagcgccgaagcattgcgtcccaagttatgccatccgtccggggtgcagtaagtgatgagaaaaagatgatcctcacctttgatgacgcggaggatgtgttggagtttgtgaacggccgagattctgctgttttatcccaggttggggcagcatgcccggatcatctggttcataccaagatgaagccactctatgtagattggataccgaatgtggaggacgtagagggcttgaaagttaagctcgctgagggtatagcggtctataaggaacagtatcaagcttatttcgagcgcaatcggcatgagggagatgttatgtttgaggctgcgccacgcgtaattttgattccgggtattggtatgatcaacacaggaaaaagctggagcaacgcgcaggtaagcggcgccttgtatcatcgtgctattgctgtcatgcgaggggcaacggcgttaggagagtttgtttcactcagcgagaacgagtcctataacgtggaatattggccgctggagctttataagctgtcactcgcaccagcagaagctgaattttcccgtaaaattgcgttcattacaggcggtgcaggcgggattggcagtgcaaccgcacgtcgcttggtggatgaaggtgcacatgtcgtactggcagatctgaatctggaaggcgcgcaaaaggtagccgcagagataaatagcagctacggagaaaaccgtgccatcgccgtaaaaatggatgtgacgcaggaggagcagattcaggctgcctatgcagaaacggcattgacctatggcggtgtagatatcattgtcaacaatgcaggccttgctacatccagtccgttcgatgaaacatcgttaaaggaatggaatttaaatgtgaatgtgctgggaacgggttattttctggttgcacgagaagcgttcaagctcatgaaggagcagacacttggtggcagcatggtgttcgtcggctccaaaaactcagtctacgcaggtaaaaatgtaacggcctatagctcggtcaaggcgctggaagcacatttagcccgttgtattgccgcagaaggcggtgaatatggcatccgcgtgaataccattttgccggatgccattctgcaaggctcggcaatttggaactccaattggcgcaacgagcgcgctgccgcctacggcatcgagcccgaccaactggaggagcattaccgcaaacggacgacgctgctggttaacatttatccgcaggatatcgccgagggcattgcctttttcgcctcatccaaggcagagaaaacgacaggctgtatgctgaccatcgacggtggcgtccccgcagcatttacacgctagccgaattaaaatgaacctatgtaagccacatgacgatagtttcgaagggttgtaaaacactttggaaaacacgtaaataagcaatataacgtatttacgtgttctcatcctttatatacacactaacactttaaaaatagaagtgactttatgggtggtcagcagcggagcgagcggaattgttctgaagaagcgtagcgttcgcctttatccccggattttcacctttaatatgttttagaaaataaaaaaatctggggataacagcgatcggaagaacaatccgcacgcgaagcggcctcccccccgtaactcactttattttccaaggaggaaccacgatgagtgacaaagcgtacgccttattcgaggagcaacagcaacaacgaggcattgacttggagcaagtaaaggcaaagatgaaagcgcttagcatagaaacaccatcctggggatatggcgactcaggtacacggtttaaagtctttcagaaaacgggcgtgccgcgtgatccattcgaaaagctggaggatgccgcgcaggttcatgctgtgacaggcttatgtccatccgttgcgatccacattccgtgggatacagtagacaattacggcaagcttcgcggtcatgccgaaagcctcggtttgcggattggggccgtgaatcccaatttgtttcaagacgaggactacatgctcggcagtgtcaccaatgtagacccgtccatccgccgcaaggccatcaaccatttgctggaatgcgtggatattgcgaaggaaacgggctctaacgattttagcttatggttcgcagacggaacgaattatcccggtcagggggatatacgcaaacggaaaaattggatgctggaagcgctcagtgaaatgtataaggcgctcacacctgacatgcgcatgctgattgaatacaaggcgttcgagccagccttttatcatacggatattgccgattggggcatggcgtacaattacgcaaccaagctggggccgcaggcacaggtgctggtggatacagggcatcatctgccgggagccaacgtggagcatattgtcgcgtttctaattgatgagcagcgactaggtgggttccattttaatagctataaatatgcagatgatgatctgattgtaggttctgccaatccgtatgagttatttttgatcttttatcaaattttaaatgccgctcaggatatagaagctgatatccgccaaaccgtggacaaaatcgcatacttgattgatcagtcgcacaatattgaatccaaaatcccggccatgattcgctccgtgttgaatgtgcagactcaatatgcaaaggcactcttgattaatcatgcagaggtggaagatgcagcaaagcgccaggatgtgctgggtgcagaggatgctgtacgccaggcgtttgagtttgatgtggcaccattgctcagagtgatccgtgaagagcagggattacctacagacccgatgaaagccttcctggcatctaattatggcacgcagattttacaaagaggcaagggtggtgcaagctggtgagtatcctcgcttatgatttgggggcaagcagtggcagggttctactcggagaattgacagattcacgtatagtggtggaggaaatccatcgcttttcgaatgatccggaggcattcagtttttgacgtttaacacgatttatcagctggctgctatgcgaaaggcgagttcaccgttgctggagcaggcaaagcatttcttgatgattccagatctgctgcggtattttctgacaggtgaaatgtacaatgagttttcgaatgcgaccagcacgcaattatataatccgttgcagcaaaaatgggatgaagagcttttgtctggaatcgatatcccccgttcctggtttagtgaggttctagaaccaggaaatgttgtaggaacgatccgctcgtcggtcatgaccgatctgggcattggagcgattcctgtgattgcagtagcagagcacgatacgggatctgctgtggctgccgtacctgcgctggagcgctcgtttgcgtacttgagctgcggaacatggtccctgatgggaacggaaacggcacagcctgtaatcaatgacgatacgcttcgttttaattttacgaacgaaggtggggtcggtcgaacttacagactgcttaaaaatatcatgggattgtggattttacaggaggcgcgtagagagtggaagcggcagggctactcctattccttccccgaactggttcatatggcagaacaggctccagcattcacttctttgattgatccggacgatgaactgttcctgcacgccggggatatgaaaacacgtatccgtcaatattgccgcaacactgggcagccgttgccggagacgccgggagagattacgcgctgtattttggagagtctggcgttaaagtatcgttacattttggagcttacggagcaggtgtcaggacaacggtttaatggtttgcatatggtcggaggagggattcaaaatcgcttgctgtgccaatggacggccaattcaattcaaaaacccgtgtgggctggacccgcagaagcgagcgcaatcggcaatcttgcggtacaatggatgacacagggaaagttcgccgatatatgggaagcacgccgggtcatcgcagattctatttccgtggaggaatatgaacctgccgagtcagaagtgtgggaggatgcctacgggcaattccggcgagtggcgggactttttgtacattaaagatgtggagtgagattgccatgctggtcgcagaaagatacgagatgattgtgcagctcgttaatgaaaaagggagcatacgggtgtccgaattgagtgagttgtgcaaagtaacggaggaaacgatccgccgtgatctggaccgcctggagcaggcgggacgactgcgccgttcgcatgggggagcggttagtgtcaaaaacgagcaacctgaaacgccctatacagtacgggaaattatgaacgcagaggaaaagcgtaggattgccgaggaagcggtcaagcagattcagccgaatgatcgtattttgctggatgctagcacaaccgcctggtatatggcgtccagcttaccggatattcctttgacaatattaacaaattcgattcgggtagctacagagctggcgggtaaggaaaaaatcgaggtcatttcgacgggggggcagttgcttcaacgctcgttgtcatttgtaggcccgctcgcagagcgttcactagaaacctattatgtggataaattgtttttctccagccaaggggttcatctggatcgcggtattagcgaatcgaatgaactgcaagctcgtttgaagcagaaaatggtcagcattgcagaccgtgtgattttactggcggatgcgagcaaatttgggcagcaggcgtttacgcatgtcgtgagcctgtcgcaagtgtccgagatcattacagattcacggttgtcggacccgattcgcagtcaacttgcggagctggcgattccagttacggttgtataaagcggggagtttccaaggtgaaggccgctttgtgtttcatttgatcctacgatcgctgttgcagggggattctttgatgatgtaaaaaagttataagcgagaatcccgctgcaagcttctaaattatcacttccccggatttttagcattgagtaaaaaaaatctgggggcaacagcgatgggaagcaacatccgactgcgcagtggcaccaaaggtaacttttcagttataaagtaatagcaattccatggacggaaggggtgttccgtatgaaggtatctttatttattacctgcctgagtgatacgatttatcccaaggtgggggaagcgatggcacgcttgcttgccagatatggtgttcagctggattttccgaaggtgcagacatgctgcggacagccgtcctataacagcggctattgggatgaaacgagggctgcggccaaaacgattttgaaagcgtttaacgacagcgattttgtcgtatctccttccggctcttgcacatatatgattcatcattacccggagttgtttaaggatgaacccgaatggctcgattcggcacggaggctggagcaaaagacgtatgagtttacgcaatttatggtgcaggtacttggcgtgaccgatgtgggcgcgtcttttccgcataaggtaacctatcatccgtcttgccatggcacacgtttgctcggcgtgaaggaggaaccgatgaagctgcttggcagtgtaaaggggctgcaattagtaccacttccctttgctgaggactgctgtggctttggcgggactttcgcggtaaaaatgccggatatttcgggagcgatggtgactgaaaaagtggaccacatcagggagaccgaagccgaggtactggtcggactagatatggcctgcttgatgaacattgccggaaatatccggtatcgggaggagccagttcgggtcatgcatctggctgagctgctgtacgaaggggtgaagcacgcatgaccgccatacactcacattccatgaaccaaaaggttaagaaacgcgcagagctggctctcaatgatgattttctgcggaatgcagttcgtttcactacagagcggctgcgcaacggtaagcgggtggcttcagagcagaacggaaattgggaggaatggcgtgagcgcgggcgccaaattcgtcttcataccattgcccatctggactattacttaaatctatttgtagaaaatgcccgcgccaacggggtgcatatccattttgccgacacagcagccgatgccgtacgtattacactgggaattgctgtgcatagccaagctcgttccgtcgtcaaatccaagtcgatggtgtcggaggagttacatttgaatcaggcgctggagggtgcggatatcgagacgattgaaagtgacctcggtgaatatattattcaactggcaggagagcccccgtctcatatcgtcattccggcgattcacaaaaaccgctatcagattgccgagctgctgtccaaagaagcaggggagaaactgtccggggatacgacgattttggcaggctttgtccgcaaaaagctgcgtgaaaagtttctagaagcggatattggcatgaccgggtgtaattttgccatcgccgagacaggctccatggttctgttcgaaaatgaaggcaacgcacgaatggtatccactttgcctaaaacgcaaattacgctgatgggcatggaacggattattccatcctggacggatttggaggtcatggctacattactgccacgatccgctaccggacagaagctgaccatgtacatgtccggtatttcaggccctcggcgcagccaagatgccgatgggcctgacgaaatgcacatcatcatcgtagataacggacgttcactacagctaggcaatcccgagtttcaagagctgttgaattgcattcgctgcggggcttgcctgaatgcctgtccggtgtaccgacacattggcgggcacgcgtatggcgggacatatagtggccctatcggtgcagtgcttacgcctgcccttcatggcaatatcgaagagtggaacgatattgcaagtgcgtccagtctgtgtggtgcgtgttatgaagcctgtccagtcaaaataccgctgcatgatatgctggtatatttgcgtagacgcaaggtggaggcgggacaaggagataagctggaaacggcaggaatgaaaggttttgcgaccgtggtttccagctcgaagcgattcgcagcggcgattcgactagggcagattgcacagaaagcggtcgtccgtaagggcgaaatcaccctaaagctaggccccctaaagggatggaatacgtaccgtgtagccccctctctggcgaaaaaatccttccgtcagcagtggaacacgctggagcataagctggagcaggaacgcaacgtgatgaagccggatgttctcagccgaatggagaagattttggcagatagaagtaaaggagggacgcagcatgagtgaacagagtaatccttctgcccaagcaaaagcggcccatgaagcgtggcttcagcaaatggaagcagaatcgcgtgctaggcaagtacgctttatggacggcatcgcgacgcggctcaagcgtccacgacagacggagccgccagttcagccgtttcgcggggcacctgcattttggcacgaattcgaatggagcgcggagcagcgcatcgaggagtttaccgccaactttacaagtgttggcgggcatgttgtgcgtctgccggatttggagcagaccgcagactggatcgcgctcaaagcgcgagagctgggagcggcctatatcgtccggcagaatgagccggacctggatgcgctccagctggaatcggcgctgccggaagtccgtttatcggtgtggaacaccgatccagtcgaggactggaaggctcgcgccgccgaggcggatattggcatcgtcatcgccgacgaagcggctgcttacaccggttcggtagcggtgctatcctcgccggagaaaggccgtgcggtcagccttttgccaaccgcactgattattcttctgcccgtagagcgcttgcgaacacgactgggcgagattctaagccgctttgacgaaatcgggcgtgagcaactgcccgcaggcattcattttattactggaccgagccgctcgtcggatattgaaaatgatttgacgattggcgtgcatggacccggcatcgtctatacgttgttagtgggctagcgtggagaccgcctaacgagcatgatagaggggaaaacgggtttcaaaatctgtttgtctgcgattactcctaaccgaaatgcggccatcgtgcagctcagtaatactttttgtaatcgcaaggcctagcccggtgcctccagtttccttggagcgtgatttgtccacccggtaaaaccgctcaaacaagtgcgggacatcttccacaggaattggggtgccgtagttggtgcagattaccaccgcctcgtcgtcttcgcgtcctatggtaatatcgaggcgtttgccgtcttttccgtaccgaatagcgttggaaaataaattttcatacaggcgtaccagctcgtctgtatcggctagaatccgaacaggctcgacgattcggacacggtaagacatgtccgcctgttccagcgagggtacaaattcctcagcaagctgagtgagcaatttgccgagatctacaggctccagctccagtggcagactgccaccgctcacacgcgtgtattcaaacagctcgtcgatcagcttttttagcgtcaatgacttttcataagcaatgttcacataatagcgcagctcaatttcatcccgatagcggtcggtttcaatatattccaaaaaaccgatcacggatgttagcggggtacgaagatcatgagatacgccggtgatcaggtcgtttttggctttggcggaagcccgttcttcttccagtgagagacggagcttgtccgccatggtgttcatattttttgccaaggtacccagctcgtccgctgaagaaacaggaatcgtataggacaaatctccatcagcaaactcctgcatccccgtcgtaatttcgcgaaggtagcccatcgtatttttggtaaaaaggaaaaagaaatagatatatgtaggtagcccccccaccagcatgatcagtggggatccaatgtgatttacggtccagcgaaccagacgggtgccaaaaaatgaacgggaagggttcagccatagcagcaaagatgctccataataaaacaccatcaaaatcagtccggttagagcgaaagcggcaaggctaagggctgccagcttccatcccaacgtgtcatatcgttttgccttcaagacgtgaatcctccattaatcgaatttttccattttgtagccgatgccccacaccgttttcaggtatttgggttttctcggatcagtctcaattttttcgcgaattttacgcacatgaaccatcagcgtgttgttggattccagatattgctctttccacactttttcatagatctgctccatgctcagtacttgaccacgattacgggccaacagctcgacaatggcaaattcgcgcggggtcagcttaatggattctccggcgagagtgatctcatgcgtagcagaattaatggtgagttcgtccagtatcatttcatgctccaatgcaggggaagagtgggtatatttccgtactctgcgcagctgggatttgatgcgtgccaccagctccaacgggctgaacggcttagtgacataatcatcggccccaacgctaagtcctgtgattttgtccatatcttgtcccttcgcagacaacataataatcggaaaatgctcggtttccctgatcttcatgcaagcttcaaccccgtccatattgggcatcatcacatcaagcaccatcacatctattgattcccgactgacttgctccagcgcttccagtccgtcccgtgccatgagcagtcgatatccttcattttccaaataaatttgcatcagcttaataatttcaggttcatcgtctactaataaaatggttccgttatgcatggcccgtgcaccctttctgttctttctagcagtaaacaatatgggcgtattatatacctttttaaagatggaggctatggacactcatctcagttcgcttgcttggggtcttcagcctttggatagtgctgtttcagttgaagaaatacggttttcttgcttgaattgtcttttttctatttctggtagttgaccgaacaagatccaagcaaatggcaggaaacgagagatgatcgacacgacgagccaagagcaaagaagtgcaaagaaaaaacctccggcataccacacatgaataagctgcggagaagcgatatgtggtgaaaactgccgatacacgagcaggaagaacggatgaaccagatacataccaaaggacagtgtgcctagacgttccagtttgggagtgacaaaggaatgttgccgtctgtacattaaaaaggaaatctgtagtattaccagcgtgctagacaggctgtacgtattatacataagttcaaaaactagcgaattgtacgagattccgtacattctattttcgtaccacatatagacatgcatggtggctgaaatcagccataaagcccaaattacgatccatgtcagcactccggcaacacttcgttcccccttacgcatcagaaaccacgttttcagctgtgggtagtagtaaccgagagcagcacccagcatgtagcaggctatataagacagtgcccaactgcccttattttgaacctgaaatagaaatttatttccaataacaaatgaccactgtatcaatagcccaaggacaatagaccattgtggaagttgccgacaacgctggaacagccacagtacgaatggaaatgcgagatagaattgcatcatgataaaaatataatataaatgagtataagctttgcctgtggccagtttcagagcaaagctcttcgcaagtgtggctatattccatggttcggagctgccagccataagggacagaatgaaataaaacagagagaacatgacataaggtaagaggatgtacagcaatctctgcttataaaagcggcttaagagctgtcgtcccatcggacgatccttgtagttgtagaacagcaccatgctgctaagcgcgataaatacgggggttccatacttcatcaacacattgagggcattgtatacaacatataggctggaatttgtaagctgaaccgttgcataagaagtggcatgtaccatcaagacggctaaaatcgccatggctctggccaactgcaattcgggaattttttctttggttttaggcttcataagcttcatttcctttcaggagtgaactgtatcttgttgaactctttctattaaaagataaagttcttaacaacctgaaagggaacggcttaagaaacgcttatgaacttcttaacttttgttaagaattgaggattttacaaaaatcccacaagcgacttccaatgaacaagatatagatcgaaatggtttggttcgtctatatattgcactttggagcgactggaatcgaattttgcaaaatcctgaataaaaaagaacttccatagcctcaaaatgagtggcatggaagttcttttttatactcatgttcattcgttatttgcaacgtttgataggtgcgcgtctaatctgtccacggatggcaccgttcggatgacggatcgtgtggacattgacgtaggcattgccctctctaatttggcacaccaaatcataaatggttctgcctctgagtggaccggtaagatcacatgcacgaagcacgccgctaacgacgcctcttctaacggttatcccaaacttcgaaggaccaaacagtgtagcaacaacagggccattttcacctcttcgtcccagatgaatatgcgcttcggttacccgtgaaatattgcgtacagtcagttcaaagcttaattgttggctcgttggacggtaacgaaattcggctgttcctgtcgcatttgttctgacaggaggcacttcattagccccccttaaggtggctctaaacttattagacatgacatccctcctttcccagtgttggtttagtgtattcacagggccagagaaagggctgtacattagcctattcatcagaagttgtgtgttttacaagttattcagtccaagcacaaaacaaactttttcatagtctatgagtatctgctagagagaggaggggaaaccatgggaacatttattgatggaagaacatcccaaaatgcttcgacagccaactctattgccattccgatcactcttttaaatacacctcaattgttcgggcagatcggattaaacacacagggagctacaggtacgccacgggttctgcttaaaggaaccatatcgcttcaacttccgcttgctttagtcgggataacgatcactattgtaagaggtaccctggtcactgaccctgttgtttattcggctacgtctacttttagtttgagtttattagctccacaggttattgcgttctcagctgatgactttaacccgccgattacaccacaattggtttatacagcttttgtttctgctaacctgctgggtacagtacgagtaggtccagagagttttgacggaattttggttgcagattaatgtagtaattttgatatgacgaaatatgcttcataaagcttcgcagttgtaactgcgaagcttttttgtgtacaagtacaagtacaagtttcagcttaacgaataaactacttttcttttgcataagaattacataggcataaccctgcaacaatggatagaattttatgtatgcgcttacaaaaaacgaaatgtcctttgcttcatacaattgaaaatctggaggaggaatgaagaatgaagtggaaaataggattgactggtatgcttttagcagcttttttatgtggtgcaccaggtgtgggcatagctaccccggcacatgcatccgctggcgagtacaagtttgattttggtgggtacggtcgaaacgggttatactggagtgagcgcttcgctgtcctatgactcagcacgtggctatggctttcgtacccctgagaatatgcgtaatgtcagtgcttcggggactggagtggcaagcgatgcggtacggttcctggctacaggtacgaaaagcgagaatacttttgacgttgatcttcctcctggtttgtatgaggtgtcggttactttaggagatacctctcgttcgagtattgcggctgaaggggtatatcaggtcattaatatgacagggaatggggccaaggatcgctttcaaattccagtgacagacggacagctaaatctgctggttactgaaggcaaagagggcgcggtcttcacactcagtgcattggaaatcaggcaattatctagcaatccggttacgaatcgaacgatttatatcggtggagattctacggtttgtaactattatccgctagatagcagtgtgcaggcgggatggggtcaactgctgccagagtttgtgaacacgaatacttttcaaattcgcaatatggcgtcaggaggccaaattgctagaggcttccaccaggacggtcagttggaggccatcgtccaatatatcaagccgggggattattttattctccaattgggcattaatgacaccaatccaaagcataacgaaagcgaagcggagtttaaggactggatgcgggatatgatccggcaggttaaggctaagggggcgacggtaatcctgtcaactccgcaaggacgagccactgactttaatgctaaccatgtacacaacgcagaaaatagatggtatagaagcgctattttggcgctggctcaagaggaacaaacacctttagtcgatctgaatgttcttagttcagcttatttcacttctattggtaaagacgctacactggccttgtatatgaatggcgatacacttcatccaaactatgaaggtgcaagggaattggcccgattggtagcacaggatttaaaaaggcagggtctgagcggattctaaatttaaattaatgggttttcccctgcttcttgcattcgtaggagcaggggtttttagcctctgttcatagtgctataattattgaaaaagcaatagtaatacggaggaattagaacatgcagcctttcactgcccgtgtgcttcaaattatacggttgatccctgagggaaaagtaatgacttacggtcaaattgcggcaaaggccggaagcccaagaggtgccaggcaggtggtgcgaattttgcatacattgagccaaaaacaccgacttccttggcatagagtagtcaaccgcttgggggagattgctttgcaggaggatgagtccgcatccctgcagcgtctgtatttggaggaggaaggcatacgttttaatgaaagcgggcgtattccactagatcaatatctctatgatccgcaagcggagatggaagaataggaacggaacaagctatgcggttttataatagatttgattatcacaaaaatccgggccaaatcaattatcgatttgtcccggatttttttatctagcatacgaagcagataactagaggtaatctgttatttatagcataagattcacttgtcattttatccgataagatgctgctgatcccgttgggcaaggtgaaaagaaatgctgttcatcagtggtatatcgttatttttccgggcttcccggattagttgtttctttttttgttctgattcacgtaaaaagcgggtcatccacaaatcagacggttcgttagtggttgtcatgcgagattcttttatcatctattaaccctcccagtgagcggctgttattctttctctagtatatgttccaaaccttaatagatgctgttggtttccttaaaattagctgaaaattaggtaaagttcaggtaaaaatagcttgaatcaatgtcttattggacgaaagtagtataaagcgagtaatcaggaagtaaaggttacaaaaatgtattgttttgacaccttgtaccaacataaacctgaaagtacaattagaatgcaaagagttcgtggaaatttatgtcgaaaagaatggaaatgattcgaagaacgcacgaaaggggagagattcatctatgaagcaaaaagcggctgccgtgctgcttgtattgtccttatcatcaggcttggcctccactgtacaggctgagagtttatcaggaaatgtagcatcaagtacgtcagttagtccatccgctggggctacatcgaagacatcatccgtaacgggtcaggctttacctacattgacactcaagcaggccgcggaatgggcacagacgaacagttacaatacgcgtaccgccgaacgggacgtagagcgtcgcagaatggaactgaaaaatgcagaaaaggatctggggaattcacctgtcgattttatagacaatgagtatgttgatgatgaaacgtcatggaagaattacagttcctctaccttatcctatctagccagcaaaaagcaggcgcagttcgccaaagaccagatttattttaatgtgatgaaaagctatcaaagtgtgtttgtagcagaaaaccaggtgaaaaatgatctggaagcgcttgaaattgctcaagcggaggaaaagattgcacttgctaaatttgcgcgcggcaagctgtctgagtatacgaaaaacgagagtacacaggccagaagccaggctcagcaaacagtagagcaggggaaaattgcgttgcaaaaatccagagatgctctgaacttccttatgggacagcctaatggaacagcttatgaattggttgatcgacccgtgtacaaggaacccaaaaaactggatatcgaattacatatacaacagctgacagacatgaatccgaatttatggaagctggaggatagtatcaaaacttcggagctcaatgtgagatacttcgattttaacagcggcgcaggtgcttacgatctagctaaaatggatgtcgatacagctaaagaggagctcgccaaaggtcaaaaggattttgccgaatcactccgcaatttgtatgccacggttaaggaaaaccaaaagaaatacgtacaactggaagaaagcttgcgtacggcaaaagaggccttggagttatcacgcaaaaagtgggccagaggtctaattatcgagacggagttgaaaaataatcagctaaaagtgaaccagattgaacggcaaatggaagagctggcgatcgagttggatcaaaatgagtatacgttgaacaagccatggagcacatagggaggaaaaaacgttggcagaaacggttttaaatgatgctttaatcaagttacggaaaaaacggagaaaaaagtggatatggactgcaattgttctactggttgtaggtggaggcggagcggcagtatatctgagtctgcctaaagagcaggaggcacctttagttcaggatgagacgcttaaagtagagcgcggcgatgtgagtgaaaagctggacacgtccggcacagtgcaagcgtccaaggaagtgaagttaaacttcacgagtgcaggtgataacaagctggcagcggtaaatgtgaaagccggggacaaggtgaaaaaaggacaggtgctggctcttctggacagttcagaaattaaaatgcaaattcagactgcgtctgatactttggaaatatccaaagccaagctggctgaattggaaaaaggtccgaaggcagaggacattgaaattcagaaaacaaatgtacttcgggccaaaatggctatcgatacagcgcaagaatcatttgaattggaagaagccgaaagtcagaagaaaacttcccaaaagcagttggaacaggcgcgaaaggcatatgaagaccaaaagtttttacatgatgccggggcggtgtccaacagtgaattggagcaggcagagcaagcactggataaagcacagacggactatgatggtctggatctgcagttccgcaaaatcatgtcgcaaaaacgtcgcaccatttcggaagctgaaatcggatatcgtacggcaatggcagagcttcgcaaaattcaggttccggctgatgcatccaatattcaagcctcacggatagaggttcgaagacaggcgacggaactggagcagaagaaaaatgaattgaacaagcttcaggtcacagcgccttgggacggagtgatcttgaaggtgaacggggatgtggggaccagtccgaccgctccattcattgtcatgaataactcggattccaacgatcttaaggtagttgtaaaggtaagtcagaccgacattgtcaaagtaaagaagggtctttcagccgtgttgactaccaatgcctatccgggtgaatcttttccagggaaggtgcaattcgtctcaccggaagcctctacggatgaagggatgacgacgtatctgatggaactgtctgtccatgacccgaaaggcaagctcaaaacaggcatgattatgaatgtggccgttattttgggaatacacaaaaatgtactgttcgtacctgcgactgcgctgagatccgaagggggacaggatggcgtgtatgttgccgccaataacgctgcgaatccaggggcgcgcactttcaagcccgtagaactcggattttatacgccagatcgagtcgaactcaagtcaggtgtaaaagagggtgacacgcttattgtgcctgctcctgaacctccgccggacccttccgctatgggcggcatgcagggaggcttttaaaagggtatgagatacgtcattcagattgaggatttgaaaaaagtgtatcaggtcggagatcaggaaattcatgccctgcgagaggtacaacttgatattgctgacggtgattttgttgcgatcatgggaccgtctggatcaggcaagtccacgatgatgaatgtcatcggctgtctggatttacctacatcaggacaattttatttggatggctattcgatattagatgcccgcgaggatgaactggctattatacgtaatcagaaaatcggatttgtatttcaaaaattccatttgctcccgcgagcaacggctttggagaatgtggaactgcctatgatctatgcgggtatttctgccaaggagcgtcgtttgcgggcaatggaagccctcactagcgtaggtctaggcgatcggatgaacaataggccgaacgaattgtcaggcggtcagcagcagcgggtatctattgcgcgcgcacttgtgaacaatccggttattctcttggcggatgaaccaacaggggctttggattccaaaacaagtgtggaaatcatggggatttttcagcgtctgaatgatcaggggaaaacggttgtattggttactcatgatcaggaggttgcggaatacgccaagcgtctgattcattttcgagatgggcggattgaagaggatcagcctgttgggaaacgaagaatggcggcagaggaagtgaaggcatgaagtttaaggaaattatccgtgtgtcgctcaacagtttgcgaaccaatatgctgcgatctttgctgaccatggtgggcattattatcggagtggccgctgtgattatgattgtagccatcggtaaaggatcaacggctacgattacatcgcagatcaacagtatgggaaataatctgctgatgatctatccttatgctccatatgatgggtccagctccatgtcgttcagtcagacgaaaggaatatctctggaagatatcgatgcgctagagcagcaaaaagcagtagcagaggtagcaccaagtgccatgaccaatgcagatattacgtggagccgcaataaggtcagcgggcaaattgaggggacttcgctggcatttgttcatgtgagaaagctgtcgctagctcaaggtaggtcctttacccactatgaagtggataaacgaatgaatgtggctgtgcttgggagtgatgcggcccgtaatatttttggtccggatgcctccagagcggtcggtgagacgatcatgatcaaacagcttccttttaaggtggttggtgtgctggcaaattccaattccaatatgagtaacagtggtcagcaggtatatgtaccgattacaacggggatggaacggctaggcaatatgagtattcagcaggtgaacgcctccgcaacaacagaggagaagattagtcaggcaagtgctgaaattcggcaggtgctacgtgtcagacatgagctaaagccatcagagggtgatgattttcagattatgacccagacggaaatcttaaaaacagtgtccggggttgatcggattatgaatatgttgctggccggtgtagctgcaattgcgcttggcgttggtggtgtcggcattatgaatattatgctggtgtccgttacggaacgcacaagggagatcgggattcgcaaagcgattggtgcgcagcgcagtgatattatgttgcagtttgtggctgaggctgtttttctcagtctgatgggtggactggtcggcgtaatggtgggtctcggaggtgcaaagttgctcgagaaattcgtccaaatgccgattgtgtattcgatagagcccgtgctgtactcttttctgagctgtatggcagtcggggtgttgttcggagtatatccggcgcggaaggcgtcgaagctacgtccgattgatgctttaagatacgaataagggagcgggtacttcgccttactcgaaagagcagggtgtaagtacccgttttttgtgtgtaataagtgttttaaatgatgaaaagacatgaataaacactttagttttatatatatgatgttttatatgatttttaaggttgatttattgttatatatgacgtattatattcaatatcagatcgaaagaaaaaaggagggacgttcatcattgaccttacggcaagacaagtagaaattttaaacattgtacaaaagcatgccccgattaccggggatcagattgcggaaatgcttaatcttagcaaggcgaccattcggaccgacctatccaaattgggcattctgaattacatagatgcaaagcccaaggtcggatattttgttggaaagcggggcacgccgaaccgggaggaaaaattccggctgttgcaaatgaaggtcggcgatcttcatggggttccagtcatcgtacgtgaaacaacaacgattcaggaagctgtcgtggctctctttttggaaaatgtgagcaatttgatcgtcaccgatgaagacggagatttggcaggggtagcttcccgcaaggatttgcttaaggtaacgttagggaatcccaatgcagcaaccattcctgtcagccttgtgatgacccgacaggcgaatgttgtcaccgtttccccagaggatacggtattagaggcagcgcgcaaaattattgcccgtcaaatcgacagcctgcctgtcgtcgtcccttccgactccgacaagccaggggagcactggaaagtcgtgggacgcattacaaaaacgaatattattaaaatgttgctcgatatggtagcagaggattaatgggaggaatcgaatggttcaggcgagcagtcattttatagcgatctgttcagactcgattggcgaaacggcagaagctgtcgtacaggcgaccatgcgccaatttgagttaccagacactgagatcaaaagatttatgaacgtgagggatgaagacgagctgagccgggtgatggaggaagttgccgagcgtaaaggctttgtagcttatacgctggtacagccggaattgagagaggcgatgaaagaggaggctgtccggctgaatgtgcgggctgtcgacattatgggaccgatgatgcaggcgtttgccgatacgttccatgacgatcccaaagagaagcctggtctgctgcatcgactggacgacaactattttcgccgtgtagaggccttggattttgcggttcaatacgatgatggcaaagatgtgagcgccattcttaaagcggatattgtattgcttggggtatcccgtatttccaaaacccctttatccatgtttctcgcgcataaaggttataaaacggtcaacataccgattgtaccggagctgacaccccctgttcagttgaaggatgttcagcgtggtcgagtgttcggattaacgatcgagccagagttactgttaaaaatacgcagtgagcgactaaaggttatggggcttcctaataatgtgcagtatgctacagcgacgagggtggaagaggaaatagcgtatgcgcagtctttgtttaaagagctgaattgtccggttattgatgttacagataaggcgattgaagagacggcaggtttgattatcagaatgttatagagcctagtagctgctcatataactaaaaattaaaatcgtaggatacaggagtttataaatagaagattgcagcaaagctaccctgaataattcatttgcttaagggtaacgattatttttaggagaggtggagggataggtatggagagtcaaatggctttggaattcgttcgggtaacagaggcagcggcactgcaatcagcacaatggacagggcgtggagataagaatagcgcggacgaggcggctacggtagccatccgcactcattttaatgcggtatccatggacggcacggtcgtcattggcgaaggcgaaatggatgaggctcccatgctgtatatcggagaaagagtaggcaatcgtagaggaccggctatggatatcgctgtcgatccactagagggaaccgaaacagtagcaaatggtttgaataatgctctgtctgtcattgctgctgcacctcgtggtagtctactccacgctccagatatgtacatgcaaaaaatggccgttggcccagcattggctggaaagctgtcacttgaggacccaatcccaactacaatgtcaaaagctgcacgagtacttggtaaatccttgtctgatcttaccgtgtccattctggatcgtacacggcacgccgggatcatcaagcttctgcgggaaagcggcgttcgaatcaaattgcttggccatggggatgtgatgggcgcgattgaaacatgcctggatagcggtgtggatttgcatatcggttctggtggcgctcctgagggtgtattggccgctgcggcgctgaaatgcatgggcggagaaatccagggtcgcctgctgcctcatggtgaagaagagattgagcgttgcaaacgtatgggcattactaaccccggtgcgttgctttccatggatgatatggtcggacgccaaggcgtgatgtttgtggctacaggtgtgacacctggagagtggttgcagggggttcgttctcttcccggtcacagagcggaaactcattcagtcgtaatgcactcggaaacaaaaacgattcgcttcgttcggagtattcatcatacagctgattcttccggtacgcttgcggtagcggcatcctcttgaacattaaagtcatggcttcctaaatctgtctctacagtaggcaaaaggttcttcttcaccttgcatcgccgagaggtgaactcaaagcaggagttgcgtatgttgtaaacacaatacggagattaagtttatcgttttaacaaacgaggaacgatagttcaataaaacagcggtatctaggactcgtctaaagataccgctgtttttcatatttcgggatcaatctaactgtcatagagcagatgaagttatcaactcttggaatacgcatcgagtataacctcactttcattgagagatgtatgcataattatttttaccataactaattgacaaagcaaatccttatgtaaaattagaataacacagatttaagtaatacttccgcctattggcattatgaattactttggtgtttatctatagttgtctattaaaaggaattaattgcaagtagaattaatttggtatacgtgttatatactagtccagccgataaaacaagatcaaagatttttaataagtttgaacaagctggaaatttttacaggtagacttaattgctttaaattgatatattgttaatccagcccgaaaatgattattaaaaatatgggttggatgaatcgcctggaattatttacaggttgaacaaattagacgaaaatgttatattattattctggctcaaacaaagccgtatgaaaatttgatctttgaaaactgaacaacgagtgagtatggattttgtttacaaaatccaacgctgagattttggtacatgccgtcaggctgtaacaaatggaagcgaacaagagatatttttatct

SEQ ID NO: 2633 - DNA, 17342 bp, Unknown
  Kingdom: Bacteria, Phylum: Firmicutes, Class: Bacilli, Order: Bacillales, Family: Paenibacillaceae, Genus: Paenibacillus
ttgttcctgatttagaacctgcgtcttatcttaatgacattgccgtcaaacggagggctttttttatagattatatcagcacttccttacaatactttggcaagaaaatcacgggtgcgatcatggcttggagtgccaaatacctgctctggtgtaccttgctccacaatttgaccgttatccataaagataattcgatcgcctacctcgcgggcaaagcccatttcatgcgtcacgattaccattgtcatcccgccttcggcgagcttcttcattacatccagaacctctccaaccatttcagggtccaatgcagaagtcggctcatcgaacagcattacatgcggctgcatggccaaagcacgtgcaatcgcaatacgttgcttctgtcctccggatagctggttcggataggtattcttcttatcctcaagccctacggtacgcaagagttctagcgaaattttttccgcttccttccctgactgtcttttaacctgtgttggggcaagtgtcaggttctgcaacactgttttatgcgggaaaagattaaaatgctggaacaccatccccatcttctcccgggttacattaatattatggccacgagctgtaatcggctcgccctcaaataaaatctccccgtccgtaggctgttccaacagattcatacaacgcaaaaacgtactcttccccgaaccactggggccgatgatgacgacgacttcacctttggcgatatctatatcaatgccttttaaaatttcattcttaccgaacgatttacgcagttgtttaacggtgatcactggctctcaacttcctttcccataaacccagcagcttagacaagctgaatgtcattacaaaataaatagcggctgcgattatgaacggacttaatccttcgtaggtaatgttcttaatgacctgggcctgatacataatatccaccatcccaatggtcgaaataatggatgattctttaatgatcgtaataaactcattaccgatagcaggcaaaatagatttaaacgcttgcggcaaaatgacatgacgcatagctttgcctctccccatcccgagcgagcgggcagcttccatctgtccacggtccactgcctggatacctgcacggaaaatttcagccagatacgccgagctattcagagacaatgtgattatgccagactgaagtggcgtaaagttgacacccagcgtcaaagcaaccccgtaatgaatgatcataagttgcaccagcataggtgtgccacgcaggatctctacataagtggtacctaaccattcaatgatacgtactccactcattcgcagcaaggatatgattagaccaatgataaatccgaacaatactccgagcgcagacagcaacagagtgtagccgatacccgtagcgtataaactgcggtatttccaaaaaatatctacgatgttattagaagaaacctgtcgatctgctgagagtgcacttgcctccgtggaaaacttctcaatcgacccgtccgcttttaggcgagccaacgttttatttacagaggcaagcaattctgcgttccccttgcgtatacctacagctgtttctgctccggcatcctcaggcaccgccttggcaagtgttacggtaccatctaacgtgtatcctttagcaaccgtatcttcgatcacaacagcgttgatacgctgggtccgcagttggagtaccagatccgatattttatccaatgacgttacagtggcattgggcactttttgagcaatttcttcctgaatactccctttttgtgcgccaatcttctcgcctttcaaagcatccatcgtaggatatttgtctttatcctctgggcgtaccataatgacttgcttggagcgataatatacatctgaaaaatcaatgctctttctccgctcatccgtcggtgtcataccggacagtaccaagtctacacgaccactttgcaaagcaggcagcaaagagtcaaaactcatgtcctcagggaccatctccgcatccaaatctttggcgatttccttggcgatatccacatcgaacccaacaatggtatccttaccgttaatgactttatgaaactcatacggcggaaaatcggcactcatgcccactacaagttttttctgtggctttgcttccgttccgtatgcagtgagcatgggaagaccagtcaacagcaagataaccgccgacaaaaccagggcggtaaaacgatatgcctttttcaatctttttttctctccttaaattctttataataaataagattgtgtcattataaatgaatatgcatgattatgcaatgaatgttatagtacaatttcagcatacctaacgcagtacctacattacagtttatataaaggagttttcagcatggattttaagcagaccattcaaaagacaattgagcagcatgccccacggtttaaggacatttcgttatatattggcgcaaatcctgaacttggaaacgaggaatttctggccgctgcccgtttaaaagaagaactggtttttcacggttttgagatccagacacccgtattgggcatagaaacagcctttattgcaacttacaaatctgcaaaacccggaccggttgtcgcttttctggcagaatatgacgctctgaaaggtctaggacacgcctgtgggcaccatttgatatgtatgatgagtacaggtgctgccgtcggccttaagtcgatcatcgacgaaactggtggagaagtacgggtatatggcacacctgccgaagaaacacgcggtgcaaaggtcccgatggccgctgccgggttgtttgatgattgcgacatagcacttatgacgcatccttatgaccattacgaaaaatcaggcaaatcactggcgattgatgctgtacaattcgaattttttggtcaatccgcccacgcggctgccagtccgcacgagggcattaacgcgctggacgctgtgattcaaacgttcaatggcatcaatgcgttccgtcaacaagtaaaaagtacagtgcgtatccatgggatcattaatcagggtgggcaagcagccaatattattcctgattacgcctcagcccaattttatgtgagggccgctacacgtcaagaactgaacccgctgactcgccgtgttattcaaattgctgaaggagctgctttacaggccggatgtcgtttggagacctccaattatgagacatcttatgatgaaatggtcacaaaccgcgtactttccgatgcctttaccgcaaatttggtgcaggctggcatttcgcaagaagatataacggaaggtgaagatcacggctccatggatatcggaaatgtatcgcttcattgccctgctatccatccgtacattcaagttattgacgagaagcatgccttgcatacaccagaattccgcgatttggcgatgcaggaccgggccatggaaggaatgctgctggctgcaagaaccttggcatggactgcttgcgatgtaatcacgaatcctgaactgctagcccaaataaaaaaagaattctctctgctgaataacgaaagctaaatcttaattccgtgttctttcagaaaggagcagccagccatcatggatagtatgagcagcttttggacgttgtttattgtggtggacctcatcattgtttggtttatattccgttcaatacgcaggaaccggggaaacagaaaaacacggcgccggaatgcttttttcctcagttccccttctccttcgtcccttacacaggagcgtcatccagagattacagagctgatgcagctactggagcaatccatacccgcctcctatgctcaaagcgtaaggcgtcgtgtaatggaagcccacccagagctgacgaagcaagaatatgattggcgctggcttgagctaaaacgatattttatgctatgcgcgattatgaatagagtgcctatgttcagtagtgatgtggatgaattatggcacgaaatgttgatgtttacccgcgaatatcagcaattctcggaagctttttttggtcgtatgcttcaccatgcgccccattctggcggctctaagccgatgcctgaggagcgggcgtggtttgactggttgtatgtggaatgctttggctggaaccgctatagcgccagtttgtggggtactttttttaatcatccattaccgaacgacgagctttcgcgctattataaactcgcaacttcggcgcagccagcaggtgaccgctggaatacacaggagaatacagccatttcacatcaggcccaacaagcggttcataagattgtacaacgtctgcgcgagcgggtgaataaagcggtggatgatcctgaggggaagcaattgcctaaggtcaactatttacaggtcgactatttattattagctgttgtgtggtattcatggtatcaacctgaacaatttgccatacacatgcacccggatgctacaggtaatgccgtattagctagctcatccggctgtagctcggcaagcggttgctcgaactgggatacacatcactcgcaccatcattcctcccatgacagttctcatcatggaggctcttctcaccatgattcaggcgattctggtagtcattcttcgtgtagcagcggctcttcatgtggaagcagctgtggtggcgggggcgactgatcatagcaaaaagggaattcctcagccaaacactggctaaagggattccctttttcattaacatgactatggtgttcctactctgttcagtccgtctttgttagcaaatggtaaatatccatatacgctttagctgaaacatcccaactatattctcctgcaaaagccgtctgtgtaagtttcgaccaatgctcagattggcgataaaaatgaacagcacgacgaatagtgttcagcatatcatgtgcattgtagttcgtaaaactaaatccgtttccttcccctgtggtctcattgtaagcctgcacagtatcgttaagaccccctgtttctcgcacaatagggatacttccataacgaagcgccagcagttggctgatcccgcaaggctcaaaccttgatggcataagatacatatcacttgccgcatatatttttcgtgacagaggttcgctaaaagcgagctgtgccgacattttcagtggatagcgtcccgctgcctcacgaaaccaatgctcaaaagccggatcccctgttcccagcacgacaaactggatatcatcataatacaggatttcgtcaagcactctcgttaccagatctagccccttcatatctacaagccgggttaccatggcaatcataggtacgtctggccgcaccggcagacccaactctttttgcaggccaattttgttttcctttttctttgtcagactcgtgcggtacttcgtataaatacgattgtccgtggcaggattgtagcttttggtgtcaattccgttcacaacccctgttaagcgaccctgatctcccaatttacgaagcagaccctccagcccgtatccgtaaaattcggtttgaatctcctctgcataggttggactcacggtcgtgacatgatccgagtacgtaagcccacctttcataaaattcagtctgccatgatactccacaccctcgggggtgaaatagcttccatccaggttgagcagctcagttaagacctcatacggaaaatccccttgatacagcagattatgtatcgtaaacaccgtgcgaatatcgctgtagaagggcaaatgtcgataatcggcattcagaagcagcggaaccattgccgtatgccaatcatgacaatgcaaaatatccggccgaaagttcagttcaggcagcatttctaaaatcgcccggttaaaaaaggaaaaacgttcgccatcatccatataaccgtaaataccgtcacgaccgaagtaatactcattgtctataaaataaaccttgattccgtctaatgtcagttcctctattccgcaatattgattacgccagcctacggctacttgcttcaccgctaccggacgcagagactttttataagtatcgggaatccccgcatatttaggtaaaatgattcggacgtcgcaccccgcctgacgaagtgccttcggcagtgcgccaatgacatcagccaacccgcctgttttaataaatggatgtgcttctgctgccgcaaacaaaatgttcatatgtgcttcctccttatgtgtttaatctgcttttctaggcctccgaggcgctttcttgagtataacgatgcttaagggtggtatggtcacctccaagctgtgaagctgtccgtggcaaggaatggaggcggtccgtatcactccggtatttagctggccatttcccccaaagtccttatgatcactgttcagcagttcgatataacccccggccttttccagcccaattcgatagttctctctgggcacgggctgaaagttaattagcacgaccagtgtatctcccggctttttacctttacgtaaatacgtaattacgctctgcccacggtcctccgcttcaatccactgatatccatcccacgaatgatccagttcccataacgccttttcctgaatatacaaatgattcagcgctttcgtataagtgtgcagcgaacggtgactgtcataatccagcagaaaccagtcaagctgctcttcatccttccattcgatgaattggccgaattcccctcccataaataagagctttttgcccggtgaggtgatttggtaaccgagaagcgctcgaagcccggcaaatttttgctcatagctacctggcattttatcaagcagcgacttcttcccatgaacaacctcatcgtgcgacaacggcagtgtaaaattctcgctgtacgcataagctatggggaatgtcagcaaattatggcgctctggcctttgatcgaaatccgtttcgatataatcaagcgtatcgttcatccagcccatattccacttgtaattaaaaccgagtcctccatcgcttaccggggaagtcaccatcggccaggcactggactcctctgccatcatcagagcatacggataatagcggaatactgtttcattcagttgttgaaggaaggcaatagcctcctcattttcaatgcctcctttagagttaaaacgatattgaccgtcctgcttttcaaaatccagccgtagcatacttgtcacagcatctacgcgcaggccgtcaatatggtacacatccatccagaatagcgcattagatatcaggaaagaacgcacctccggcttgctgtaatcaaacgtcagcgttccccagccgggcttttccgcaatcagcggatccgcgtattcgaacaggggcgatccgtcaaacagccttaatccatgagcatcttttgcaaaatgggctggcacccaatccatcagcactccgattcccgcctgatggcaacgatccaccaaatacataaaatcatgcggctctccataacggcttgtgagtgcaaaatatccggtaagctggtagccccaggaaagatcatacggatgctcactcagcggcatcagctcaatatgtgtataccccatatcggtcacataaggcacaagaagctcagctatttccctgtatgtataaaacgtaccatcttctttttgcttccaagtgcccagatgaagctcgtatatgtgcagaggctttccataaggtgctctacgttttcggcgccaaatcgcatcgttccaagcataaccatctatagaagctaccacagaagccgttgctggcctcacttcagcacgtaccgcgtaagggtctgctttcagaaatcgttcaccgtttgcacccgtaatgtcgtatttgtaaaaagttccttgggatatccccgaaaaaaaacgactccaaaaaccggatttgggaaccctatataaggaatcctgttccccattccagttgttgcgatctgtagcaagcccgacatggagagcatgaggagcccagaccgtaaagcggacgccctgttctccgttctccacagtaaggtgggaacccaaagatcggtagctgtgataaagcgttccttcatgaaacaaataaatatcttccgatgaaatagcctgttgcggaagagtttggtctgtcatcacgtcaccacccttatatgttttgtaagtaaaaatgtatgaatcggtaatgcattcgcttttgggtcaaagctgacttgagttattaccccattctagccacattgaacagaaaaatgactaggaaaaaaataaaccttagttttgggggaatcttatataccttatggtttcaagagtaccccataccgtttatgtatgtactacactgacaactaaaccgggagggaaacgaaatgtttaataaagaatgcattgccatgctgctggcaggcggagagggacgccgtcttgctccccttacttcaacgattgcaaaacccgccgtaccttttggcggtcattaccggatcatcgattttcctctcagtaactgcgtaaattcggacattgatactgtaggtgtcttgacgcaatatgaggcagaatccttgcacgaacatatcggggatggaacaccatggggtcttacaaaaacagatgacaagggaattaccctgcttccatcttataacacaggtaacgctgaatacttaggaacggcagatgctattcataagaatatcgaatatattgacagccaagatccggagcatgtgcttattttatccggtgatcatatctactatatgaattatcgtgaaatgctgaactaccataaggaaaaaggagctgcggctaccatttctgtcatggaggtaccttgggatgaagcacaccgttttggtgttatgagtgccgatgaagatctgcgtgtcacagaatttgcagagaagccggagaaaccggaaagtaatttggcctccatggggatttaccttttcaaatgggattacttgagaaattacctgttagaagacgcacaggatgctcaatccagtcatgattttggtaaagatatcatacctaaaatgttggcggaccaagaatccttgtacgtttatgaattccagggctactggaaggacgtaggtaccgttaaaagcctatgggattcacacatggatttgttacacgaagattgtgcgatcgaccttcaacgcaaggactggccgatgtatacacgtgaacgccgcacaaggttgagcgcacaaaaggtacctaaccgtcaaacacaaccattgggcagcttgttgcatgattcctgccaagtagagggtcgaatagaacgctccgttgtatttagtggtgtcgaggtaggtaaaggttcagccattaaagaaagtatcgttatgcctgacacacgcattggacgtaacgtccatattgaacatgcgattattggtgaaggtgctgtgattcgcgatggtgctgtcattaaaggtaaaccgggcgaaattatggtcatcggacccaatgaaacggtatttggtaaaatggcggtacgaccgcaaactacacgtatgctgaaagaagcttacgagcgcaatacacgcttgcgtgccgaaggttttacttcataacgttaccccaaattaaaaacagccagccctcccgatttgagaggactggctgtttttctaattacacctataagtaggctttaaatctgtccttcagtaagttgtgatggttccacggattgctctgcttgcagagcaggtaatgaaaccgtaatggtagttccagcccccagttcacttctgatgagcatctgaccatgatggcgctcgataaactgttgcgagattgccaatcccagtccagtaccaccgttttggtggtctacctggaaaaagcggtctctgactctggcaaggttttcagcactaattccaatccctgtatcttgtacggatatctcgatattgccatcaatccgttgtagagacagaaaaataatcgaactttcatgcgaaaacttgatagcattatccacaatgttcaaaaacacctgttttagacggttaccgtctccatggacgagatatgccgtttcctccgaatccagctgaagttttatctgcttcatttctgccttggcccatacgttcagcataatctcctgtaaaagctcccgtagatccaccgttcccatcacaagcttcatggcattttgctccagcttggaaaaatcgagaatttcctccaccaagccaatcagccgatcggtctccttagaaataatcttcatcccgattttcgtctcttccgggtcatatccgccagaatttaacgtttcactccaacccttaatagatgtaagtggagtacgcaattcatgagatatggatgaaataaaatcatccttgatttgatttgttctgacaatttcctgtgccatatagttcagagtcgaagccagttcacccaactcataacgataatcgccttcaatgcgtgcatcaaacctcccctgagccatctgagcagatacatcgcggatattattaatcggcctaacaatggaattcgcgagccctgtactcactacaaatacaatgatcagtacagctgccatgactcccactgaaaatagtgtaatgatgaacaacttgtcatttactaattccagcgaagtcgtataccggataatatacacctggtctccgacgatattgtccagtttttgagataccgccatcacctgctgccccgtactcggttgctttccgatccatttgcctgtatctccaactaaggcttgtgtcacatcacttgtttgcacattaagatctgaagcaaaatttgtcgagttatcaattacatttccctgttcatcaagcacttgtagttcggttttgggcagagaaaaatctaacaaataggattgtaatgattgctcggactccttgaatttggatgcaaattcacttaccgattgaatgcggttttcgatctttttataaatggtgtcatagtaatacgaccggagtgcaaacataaaaatgacttctactaacagaagcgccaagaacactacgaaaaaatagtgaagcacaatctgtcggcgaatcccctttttgatcattgagactgacctttccatttatatccatgtccccagactgtttgtaaaaaagctggctcggatggattgttttcaattttctgccgcagacgtcggatgttcacatccacaattttcggatcgcccatatattccttgccccatacgtggtcaagtagaacatctcggctgagcggcgtgttttctttttcgagaaaaaattgaatcagggaaaactcagtcggtgtcaactcgatcagctgcccgctcttcttaaattgcttagcaatcaaatctagcgtgaacggtccggattggaaggatactttggctgctgtttcacgatgtacattcacccgacgcaataacgattgaatacgtgcaatcagctccgtcgggctaaaaggcttgctcacatgatcatcggcccctacagacaaggcatacaccttatcctgctcctgtactttcgctgtgagaaaaataatgccgatgcgctcattcgtttcccggattctccgacagacctcaaaaccatccataccgggtaccattacgtcgagcagtgcaatatcaatatcccgcaccgtgttcaaaatattcagagcctcatgcccttccgacgcctccaacacctcaaaaccgttacgtttcaagttaatgacgataaagctgcgaatggattcctcgtcttccatgattaaaactttactcactctactctacctgcctttcccccatcttgtttttaatggttttacgcggttccagctcactggatcgcttaatgccaatgacctgcgcattcgttctccacagttggctataaccttcgttgtttcgttcccattgtgacaacgagaaaaatttaatttccgctatcgttttgtctgtatcatccaaaatgaagcgcaaatagctgtccttcttcgaaactttcggatcaatagtcaccttgccatgcagctctttcggtaatctgaagtagacctgttcattagaatcacgatactgctgctgcttaaaaatcgttcctttcgccccgtcccactgatagaacgacacaaaatagggaacctcatccagcggcttgttactccaacctttaggcttctccaaattaccaaattccagaatgccgtcaccatccacatcaccactggcgatggtcgcatccttgaaggtgacatccataagattaagcttcctgagcttgccgtgatccatcacaataacattggaaacggtagtggtctgggcaattttggtgtctataataatcccctgcctaccctcggctaccttgccagcaacgacattatagacacctaagacctgactgtccaaatccaacgatccgatttccttaaaggttcccccactgaattgaaacgttttaacagtaaagaattcattacgtcgcagcgtgataatcgtcaaatcattcaaattatccccgttcaagtccatcttgttatggttaaaatcatctacgacgaagtctgtataacctgtagcatatattttctccagagttcctccggtataggaatacacgatgagtcccttctgatccccgccatcgccactatctccgctggaaaaacccgctacaatatcgagtgttccatcattcgttaaatccacgagcttaaatgactccagcacagtgccttccccatcaaacgtcagcttctttacccacgttccgccctgatcttcaaacaaggcaccatgtatttttacgctctcatctggcgtttcataaaagagcactgcttcgtctgtgccatcattgttcagatcacccgtccgaattggcgtcgggtcatctgggtcattcggccttaaaggctgtaccgcccctagttgcgtattcactgcaccattcaactgctgtttctcgtcagacatcgtcggtgtctccatcagcgaaatgggatcgctaataacattacagccgcttaaaaatccagcaaggagcagcaaggaacagcagccagccaccattctcaacagcattatattcacttctcttgccgtccccttcacaatttgttcttttctgcttgtgtcaatcgtcttccctgaatatcaaacaccaattcaccatcattcaacccccatatacgggaagcaaagcgttcagccatttccagcggcaatacagtcatgatcgtcacccgctcgtcagaacacagcttgcgaaaggtctccaatacatgcgctgccgaagttggatcaagtccatttacaggctcatcagctaaaataactttagctccgtgcacgagagcacgcgcagtcgctacccgctgccgctcgccaccgctgagcttgtcacatttatcatgcgccttatccagcagacccagatcctccagtacgtccatcgctcccatataatcgtcggaacgtaccatccccgtcaccattctccacattggagtttgaccggatctgccaatgagcacatttttaagagcggttcgattcatatttagatgcgggttttgctccaggtatgcccattcccgctttattttcttcttgcccgtccacccggatttcagcacatcattgccacctacaattaaactgccttcatcccatggctcttgtaaagcaagacagcgaagcagcgttgttttgccgcttccacttggccccactatggcaacaaattcgccctgatgaatttcagcatcaattcctcgaagtagctgggtccgttcaggccccacttgcttggtcagcttccgaattttaatcatctaagtgattcccctttgcgcgccatcaatactgtttatattttatagtaaatgtgaaacaaataccatgcaaaccgcagttttaaaccgccgttactctttttctggaaaacaaacctaacaatccgaaaacaacgtaactacctccaaggacaagaaacatactgccttgagttccaaagtccagcaaccctccgctaatattaggtccgatcacacttcccagattaaaatgaaaggatgccagtacattcgcggctgctaaaaatgatttgggcaacagatcagcggcgtaggccaaaccgagggagaaaaaggagcctactaaaccacctgctagggtcagcaatatcaaagtgaacataaaatgattgccgctccaaggtagcaacataaaggtcattccccctgctatacctacgctcattagcacctttttacgtccccaacggtcactcaatatccctagcggtagctgcagcactaaccctcccaaactgacgaacggcagcaaggcggcgatttcatcggtatgaaagccaatacgcaggccatagactggaaagttactgttcaggctcgcttccatatagccgtatagaaatgcaggtaaaagagcgtaccatgcccagctgtagctgcgacgaaatctttgagtgggacgcgcctcggactccagcttctccggtctggagtccggtagctttattaacaccaataacaaaacaagcaaacataataaggccaacgcagcgaatggaaccagcattccataatcgagtagccataatcccaatggtcctaatgcaaaacccagaccgtatgacataccataaaaggaaatgttgcggcctcgcttctctgctggagtcaccagcaatatccatagctgcgcagagtagtgcaatgcactgtcaccaatacctactagcagacgcagtatgaaccatacccgaatatcagggattagcgggaatagcagcagcgtaacgagcactagcacaagccctccggccatcagctttttgaaccctaaccaccccaatgtccgttctgccaccaacgtcattgcgaatgaaccaatatacagggcagccgcattcattccgtttagtgaagatgaaactcccatttgttccaacgagatagacagaataggtaataataaaccttggcataatccggcaacaataataacagcaattaaaataaaataatgaacccgtaacgacgacgacatcctagctcctcctgatcgaacaaataaaataattaaaatcaatgttaagaaatgatttgcatttgattccataatcaataataattcttatcactatgtatttcatgccgtcctgcaaaaccggcaaatcacatatacaaattcaggtgtaattagtgtattaaagaatagaagaaaaaaatcgccatctgagatgacgattttacggaaagagcttgtctggtatgtatccgactccttcggttaaggagcctcgtatgttcaatccgaacccattcacgtcacaacgcactatttcatattatagtggacaatccctggcagaacaagccataataaataagtgagcaattattaaaatgctcatgttttgcttatggacgggcttaattacgttcaccgctctgggctagaagacagaataggaggcattagttccatgagttatcaaattaaaatagacacttctccaatttatgaattgctcggcagcttcatggcctatgtgactaaaaagtgggtccaagatatggacttgggccatgaatggatcgacaaggtagatgcacgactacaacatgaagttcgtactgagcttgctacagctcaggattgcccttttagcgattatgacgcactctatgcctgggcgttacttcgaccggaatcggatgaaatatctgattatatctcttatttggaccacggtccggataaagatatgtttgagttgctcgttccgcatatcccttttttaacctttgaagaatctttacgcattcgcaaggtatacgcaccactcctcagattgtgggatcgtgattattttcgggccttggaaggcgaactacgtgtgttggcagaagaagacgctgcggaaaaacgcatgctgctgagtaagatggaaccggaagcactggttgaatatgcgacagctggactagtcgtgccacacgtggaagacctggatacagtagtcctatttccggttgtccataatcgcccgattaattcatactgtttttatacccgcacacttctgatccagtatccggtagatatccccgaggagagcgaggaagaaccgcctacgcttctgctacggctaactcgtgcggtcaatgatccgcagcgactgcgaattctacgttatgtagctcaaggtcctaagtctctcgaagacatgcgccacgatttgagccgtttggaagatacactcatgtctgatatgatgattttacgagtggctggtctgctccgtattcacatcggacgttatcataaggaaaaattcagcatccgtcccgatggcgcggctgatttacaggtatttttggaatcctatattggattgtaatttgaattgtacttttagttataaccaaagcagcgttaaagctttggcttggaaggagtatgcatcatgtcgtatctgaagcagcacattttatttgatcttgatgacaccttagtccactgcaacaagtattttgaccttatcctcaaccactttttcgatttgcttcaggaatggtttgcaactcataacctaacgaaaaatacgattcgtgaaaaacaaatcgaaattgatgtggctggagttcatcaggtgggctttgccagcgagcatttcccacaatctctgatagatacgtaccaatttttctcggaacaattcggacgccgtctcgattcacgggaagagcaggagcttcgctctcttggccgaagtgtatacgaacaggaaatcgaaccgtatccaggcatggtcgaaacgctgaactccctccaaaaagcagggcattcccttcacctttatactggtggtgagcagatcattcaagaaagaaagattgaacaaatgaaactggctacctactttgatgaccgcatctacattcgtcagcataaaaatgttgaagcactggaagaaatcatccagatgaatcgcttggaccgaagcatcacctggatgatcgggaactctctgcgcactgatgtatctccagcccttgccgcaggtattcatgctgtctatctcaagcagcctaaggaatggatttacaatatggttgaattgcaaaaaaacgtgaactccgtgatgtatacgatacagaagctgacggaagtaccacgggttatccacgaaagcatacaattacatcaacaaaaaaggaccctcggatagggcaatgtcattaagata

SEQ ID NO: 2634 - DNA, 13041 bp, Unknown
  Kingdom: Bacteria, Phylum: Firmicutes, Class: Bacilli, Order: Bacillales, Family: Paenibacillaceae, Genus: Paenibacillus
aacgggggtcagttccgtggttttaaaggttctttttcgtctaaaccatgctacgccattaaggtttgctacgacaagtctaacactacggagttctggctcctcctgaagaggtatgcggacattacatattactgccgtccaggcccggccggagtgcagctgacattagctgcagtgagcttgtcttcgatcgctgcaccagtggacatgccaaagcaaacctgagcgactgtcgttgcctcagatgcagtcgtattcagcacacgatgcttgacccgcaataaagattggggagacatgctaagttgatgtatccccagttccagccaaagaggaacggaccgttcatctccagccatctcaccacatacactcacatcaattcctgcttgatgtgccgcttgtgcagtcatgcgcagcattcgaagtacagctggatggtatggatggtacatatgtgcaatctgctcattcatacggtctacagccagcacatactgaaccagatcattcgttccgatactaaaaaaatctgtttcagctgccaatagatcagcgatcatcgctgcagccggtacctcaatcataatacctcgctgaatgttcggattataggtaagccctcttgcatccaaatccgccatagcctccttcaaaagagcatctgcctggcggacttcctccaccgatgagatcatcggatacattaccttgatatttcccgttgcactggctcttaaaattgcagtcaactgggttttaaacaattccttccaatccagactgatccgtatagcacggtaacctagaaaaggattttcttcctctggtagttgaagatagtccaacggcttatctccaccgatatccaatgtacggatgactacggagtggtttcctgccttttccgctatcagccgatatacttcatactgttcctcttcatctggagcagatttgcgatccatgtataaaaattccgtgcggaacagtcctacaccttgagcgccatgcttcaaagccgcctccagctctttaatcgaactaatattggccgccagcctcagagtagttccatccttggtcacggcatctacagaagcaagtacctgaagctgctcttttctgcgtcgctgctcgtcgcgcaaaattttataatgatcagttaccgttttttccggattcacataaactttgcccaggtctccgtccacaaccatcatgtctcccgtttgaacgggcaaattcagattgctctccagtcctgaaacaagtggaataccaagtgcacgggccatgatcgcagaatgcgaagttttaccaccattcatagttacaatccctaaaacatagctaggattcaagtgtgccgattgggagggtgagagctccttggctaccagaatatagggctgtgtgtccttgggaagagtcacctccggtgcacctagcaaatgtttgagcagccggttccccacatctttgatatcaattgcccgctccttcatatattcatcgtccagtaaatcaaacattgtcacaaaatgatcaatggcttccttcacggccacctcggccgccttgtactgacgctcaataattccacgaatttcattcatgaattccggatcttccaatatcgcaagatgagcatcaaagatgctggattcttctggccccaccatctctcgaaactcatccttaataaactggatttcacttttggatgtgcgtatcccttcatacaaacgttcaaattcctttgcaagatctaccgcatccattttttgatcaggtaaatcccactcccagctcggcaggacaaatgccttcccgattgccacacctgctgcggcgccgatgccttctatcatgtttctacccctccaacattcctgtcatgcagcacaacggacattaccgaggcctgaccttttttcactgttttaaacggagcaaagctccacgacttgacgcgatccggattcgtgatgaccataggagtcaccagcgatggagcttgctctcgcagcgcctgcaaatcaaatttgatcagcaattgccccggttccaccgtatcgcctgcttctaccatagcagtaaaattcccttttagctgtgaagtatcaatcccgatgtgaagtagaacttcaagtccttctcgtgtggagatgcctaaagcgtgcatagtcggatacaaatgcatcacagtaccatacaccggagaaacaagttcaccgcgttcaggaacaaaagcaacaccgtccccgaccagcttcgtcgcaaaaattttgtcaggcacttcatgaatcggtagcatttttccatgtacaggagcgttgaacaaaatttgagggagatcacgctccatcagcttcgcgatttcctcacgaatcagttctgaatacgttccgaatacaacctgcaaattacccccacccagattgataagtccggccgatcccaaagccttcatcgctccggtatcaatcagcctgtcattgtggacggtcagccgcaaacgtgtgatgcaggcctctacctgcacaatattttccttaccgccaagtgcttccaaaataagcggagcactataaggaatattgccggcccaatcctccagaactgaaccttcctcgcgcccaggagttggaatacggaaccgccggatagcccatcgaaacagtacataatacacaagcccgtacgccacccccactggaattaacaaccaggcgttatgtgagagatgaaaattaaggacataatctataaaacccgccgaataggaaaatccgtgatgaatatccagctcaaaggtaagccacatggccagcccagacataactgcatgaacgaggaacaaataaggagcagcaaacaaaaaggcaaactcaatctgttccgacactccagtaaaaaagcaaacaagcgcagctgtcaaaaatgttttttgcacctttggcttcaaatcttcacgcgcttcctgaatgatcgccagcgcaatggcagggatggcaaacatcataatggggaacaacccggacatgaaatagcccgctgtcggatcgccagcaaaaaaccggggtaaatcgccctgcacaacgttgccagacggcgttttatatgtacccagttgaaaccaaaaaatattattaagcagatggtgcagaccaaaggccgccagcaaccggtatagaataccgtagataaacagtccaaagccgcccaagcttgattccagacctactataaattgcagccctctctgtatgagtggggcaataattagcatgagtcctgcaaacacagccgagaagagaccaataagcagcagaacaaatcgggtacctccaaaaaattgaagcacctcgggcaatttgatgcttttgaagcgattataggccacccctgaaatgacccccaaaatgataccaatgagcgtcgccggttgaatgagtccgtttccaaatctcaatgtgacctgatcgtatatagccataccagccaatgctgccagtcccgcctgacctgcctgattcgacatacccagggcaacaccaaccgcaaataaatatggcaaaaaataaaaaatcccgtgtccagccgcatttgccatatcagacaccatagggaatccccatgtggaccaaggaaggctgccgagacttagcaatattgcagcggctggtagcaccatcgtcgggagcatgacagcacgaccgagctgttgtaaggatccgagccaattcatggcattcctctcctttctatccctgatggtaagccgaataaatacttttgtcaaagcaatgattccatctgccaaaatatttatttacgctactacaggtcaaaaactttatcatcacaacagataacactatgaattcgtttagagctatttcatcatcaagacatacatacattatatggattcatgaaagtataatatactgtaccatattcctcgtttcgcaccaaaaaccttcaaccctgtgaagcaagggaagaaggtttttattcatctgcgtatagcacagatcactgatccatgtttatcctttacgtacagcttgggtcactgagtcctcgaccttaatgcaacgatccataataaccgtcattccatgctcctgcgcaatgtcagcggcttcctggcttataattccctgttgaagccacaaaatcttagctccaatagtagctgcttcacgcgcaacctctgcacagtattcactgcggcggaatacattgaccagctccacagggtcaggtacttcagcaagactggcataacaagtctccccaagaatcgtttgccctgccgccgcaggattaactggaataatccggtatccccgcttctgcatggcataagaaaccatgtatgaggtacggtccgatttatcagacaaaccaacaaccgcaatatttcctacttgttccaaaatgcttttaatctcttctcttgacggattttcaaaagccattctgttccctcctattcgcatcttcgtttgtttttattttacccattctacagaagcaccaagcgtcgttagatggtcaaaatactgcggatacgatttggcgacatgatgtgcatccttgattactagcggcttctgtgcgcgcaaacctacaatcgtcaaggccataataacacggtgatcaaagtgcgcgttaatttccacgccaccttcgacaccctccggtctgccatgtacgataatttctgcttgacgttcttctacccgagcaccagccttggtcagctcattcaaataatcggtaatgcggtcacattccttataccgtaaattctccacgttataaaaacgggacgtgccttcagcaaatacagccgcagccaccattgcaagcacagcgtctgttgcagcatcaccgtcaaactcaacagctttcaatcggccattgcccttcacaacgacggtatcgttctcatgtgtcagtggcacttccatcatacgcagcacatctacaatagcgcgttctccctgtttgctctgctctttaagacgatggatggtaacatcggaattcgttactgcagccgccgccagcaccgctgcactccctggatagtctccctgtaccgtatacgtacgtggctggtaggattgccgccccgggacacggaaagacatgtaatcatcgcttgcatgaatgataataccagcctcttgcaatacctccagggtctgcccaatgaccaccttggatttcaaatcatgcagcacttcgatttcactgtcttcctccagtaaaggcgtaaggaatagcagggcgctcaaatattgtgagctaaccgagccggatacctgaattttaccgcccttcgcctgaccaccctgaatacgaatgggcaacttaccttcacgatgatctactttcacgcccagttgccccagtgcatcgattaaatcatcatgtggtctcttgcccaatgagtcggggtatgtattaacaaatgtaacatccggacatagagatgcaatacccatcaaaaaacggagcaccgctcctgcgtttcccacattcaattccttcacagcttgaggatggctaccaaaacctgtaatcactattttttcatcatcctcttccagtactgcacccagatcggcgatacaacgacgcatagcatcactgtcttcactatgggctggataataaatggtactttgtccctcagcaagtgccgcagtgagcagataacgagtagtgtagtttttggaggacagggccccaatctctccttgcaaggaaggggtaggtctaacgataacatccataatgtacatgctccttttcgattcaaaccatcctattttacgttaattatacaagttgtagcattcatttctccacccaaaaaataagaaatattaatctaggtcccccaagttgaattccgtcggttaattaatctttatctgcctttaggattaagccgattgacagcctagagatagcttagctatcatacatagagtgtgtgtgacattttgcacacgtcaaaaacatacgtagcacccaatatatatcagaaaagaggtccggcatgacgcaaatcgccctgattgaaccttctgagttgcgcgcacgtctgcaagcaggagagcaattgcaattaatcgacgtccgcgaagcggaagaagtagcggaaggcatgattgaaggtgccaagcacattccgctcggacagcttccgggtcgtcttgaagaaattgaacgcaccggtgaaattatctttatttgccggagcggttaccgcagtgaacgagcctgcgaatatctacagcagctaggttatgaaggctgtactaacatgactggcggcatgctgcaatggtcacaggagcaatagaaaacctgattaacaaaagagacgggaaccttctcgtcttttttgttttgactcaaagcttagacgcggtaatgcattaaaatattttgtccctatcataccatagcgccaaaagattacacaatcctctactgccatcataatcgtatccataattataaattaaaaaacggaagcttcttctacccatagggcaaaaaagcttccgttgtattacataatgctattcatgcatatccgtccgttcattagaaccattgatgatggaatacgccttctttgtccacacgtttgaacgtatgggcaccgaagtagtcacgttgtgcttgcagcagatttgctggcaaacgctcagtgcggtagctgtcatagtatgcaagcgcgctggagaagccaggcactggaataccttgggatacagccacggaaatcacttgacgccatgcatcttgatacgtttcaactacatttttgaagtaagaatccagcaacaggtttttcaaggcaggatcgcggtcatatgcatccttgatgttttgcaggaattgcgagcggataatgcaaccgccgcggaagatcatagcgatttttccgtatttcaaatcccaatcatattcatcggaagctgcacgcatttgagcgaaaccttgagcataggacacgattttacttgcaaacagtgctttacgtacactttcgataaattcttttttgtcgccgctgaaggactcagcattaggaccgctcagcactttacttgccgcaatgcgctcgtctttcatagcagacaagaagcgggagaatacggattcggtaatcatggacaatggcacacccagatccagcgcgctttggcttgtccatttacctgtacctttttgaccagcagcatccaagataacgtctaccattggcttgcctgtttcagcatcgtactgagagaaaatgtcagctgtaatttcgatcaggtagctgtccagttcccctttattccattccgtgaagatttcatgaagctcttccgcattcacattcaggactgatttcaacaagtgatacgcttcaccgatcaattgcatgtcgccgtactcgataccgttatgcaccatttttacatagtgaccagcaccgtcaggaccgatatatgtacagcaagggtcgccttccactttagcagagattgccgttagaatcggctctaccagtttataggcactttcttgtccacccggcatgatagcaggaccattcaaggcaccttcttcaccaccggatacgcctgtaccaataaagcgaagtcctttttcctccagctccttgctgcgacgctgtgtatcagggaagtaggcattgcctccgtctataataatgtcgcccttgtccagatgaggcacaagctgttcaatcgtggcatctgttgctttaccagcttgaaccatgatcaggattttacggggggattccaatgagttcacaaattcttcaatagagaaagtacccgtcagttttttaccttctgcttctttgataagatcgtgcgttttttctggagagcggttaaaaaccgagacggtgaagcctctgctctcaatgttaagggctaaattcttacccattaccgccaggccgatcacaccaatttgctgttttgccatctggttcctcatcctttgcaacatattttgtcttctatatcgccgctttaccgcattacactttatgtgaatcggaacacgtgcacttctattttaacgtttttgatgtaagaagtgaacccctgtctattcacagatcaaaacaccccatttacatgaggtgttcagatgtactacgcttccatcatcagcagttggtgggatagcgtttgcaggcgttcatggcaattcccgattttagccttatctccgtctgtcattgctatgaacagcttctccaattcatcgtccacttccattttaagcagcagcagtcgggtttctccttcattggaagcgtacatatcctccatttcctgtgcggacagcaccggtcccttctgataaatgacacgctgcttaaagcctgtaacctcgaccagacgaatgacctcaccaaataaaatattttctaccaaaatatgatgatccttgactcttttgacaatggcatgacctcgggtgcttccaatcagcttctccaaccactcagccagcttggcatcgcggattacataatctccagccaacttgtagtgtcctgtgcgcagctgttgaaaccggagcttcaccagcttgcgcccggttctcaccgacaaaaccaggtacgactcatcctcgctccagtacagcgaatacccttccgatatcaaatccttgatcagattatggatatgccgacggctaaaccggagctctagattgcaatattctacctcacagcccttgttcacggcattccctcctttttcaagtccgattcaagaagtccggctacagcaagcctgcggctttcccgcttgatcttcccttgctctattttatacttcattttatgtaagggtacttggttatttgacctatttttatgagtaacagcgaacaatcctacttttgccttatatgcttgtttcaaacctagtctaaagtcggccaagcccggcggcattatgctataattggacatattacgccacacgttatggcttaacccagttacaggaggaaaaggaatgacatttagtggatttactgcaaaggagttcgatgtttttgaaataccgggattggagcctcgtatggaagtgctgattcagcaggttcggcccaagctggaggcaattggcgaggaattagccccatttctgacggacttatgtggagagcccatgcacgttcacgtcgccaagcatgcacgacgcaaagtcaatccccccaaagatacttgggtagcctgggcggcaaataagcgcgggtacaaggcgctgccgcattttgaggtaggtatgttcgcttcccacctattcgttatttttgcaattatttatgaaagtcctaacaaagctacatttgcccaggcactcgaagccaatctgagcgatgtgcgctctaacctgcctgatcatttttactggtccatggatcatatggctccggaaggcacagaacaacaacatatggataatgaagattttcaaacgatcatccgcaagctgcaacaggtaaaaaaagcggaggtcatgtgtggaatccgtattgaccgagaagatccacttgccagcgacggggctgcattattacaggcagtgcgttctacctttgagcatttgctgccgctgtaccgaatgtctttctcgaaagagtagccctcgccgcttttcaaggcgctgttcaggcctctacagtcttcctgcgtggattgcgcgccagagccaggtggcagccaaacatgagcagcatcacgaccccactgatgataaatggagctgtgtgtccggcacggtcccatagcactcctgaaacgagcgggcctataaccatgccggagccttgaagtgttaaaaaaaagccccacaccgttgctcgctcgctttccggaatcaatcgggcaagaaaggtgttccatgcaggcaaaatgagcgcatatcccaaaccaataagcgccacggatacaaacaccagcggaatagatcgaacgattgagaagaaaaacagcgtaattccggctagcaaaaagccaacatgtagaaaatactccgttccaagtctgtcgaccaacttgccacaagggatcagtgccagcacagtcaccccaccgcctgcaatcagaagcacgctgtacaggtttggtgaaatcccgaggtccgtccgagcgtatagcgtcagtaccgggctgattaaaccgataacaaaagactgcaaaaacagcgccgggtaaattaacggattgacgttaagctttgttttgagcacgccgatcgtctcctggattcctttcagaatttgctgtttctgctttgtgtacccatcagacgacactagagcgctctgtttgaggtcacctttatcaggagaccttttcggtcctggcagcataagagcaaccaacaacagtacaatactgcatcctatcaaaatcatgaacaccatgccgtaagaatgcccatagtgggatatggcaaagttcataatgagcggccccaatcccgttccacccatagacgcaatttccagtgtgcccatcgccgcgccattgctgttattaggcccggacatttcggtcgttccggtcataacacaaggccagagcggagaagtacccagaccgagcagcagacacgcaacgacgagccacacgggctctgtcaatacgctcagcataataatcgctacaagcgtaaacaacagtgcggtcgacatcgttccgcggtagccgagccgttcagccatccaacccgccggtgcccgaaacgcattgtctccaaaatactgaagcgaaaaggccaaaccaataatgccggcagacaaaccaagcgtttctcccatatataccggcaggatggataccagaagagatcctttcataaattcgaccagaaataccaaaacccacaatttgctaaaaaaaggagtccacagccgcttcggagctttttttcgtccattttgcctcatctaatccacttcctccaccttcgttttttggctgtatagaccgggttatcagcctactccactctttcgcaaataaatgcgccctcaatcgcttgcattcctacttcaaactgctatactcaattttgttctattatcacttgcacaggattgtcgaaatcctgcacgaaaggttgtgacaacactaatgaatcaaagcaacaccccgctttttactgctttgaaaaagcatgctcagagcaaaccggttcaatttcacatcccaggccataaaaagggagtgggagctgattcggaatttcgcgaatttatgggggataatgccttttccatagatatgatcaacatcgctccattggacgatctgcatcagccatcaggcgtcatcgaagaagctcaaaagcttgcagcagaggccttcggagctgattatacgtattacagtgtacaggggacaagcggagccatcatcaccatgattatgtcgatttgcatacctggtgataaaattattgtaccccgaaacatacacaaatctataatgtctgccattatctttgctggtgcaaagccggtatttatttctccagtcagtgatgagaatctcggtattcaccacggggttacaaccaagtccgtacgtcgggcattggaacgtcaccctgacgccaagggcgtccttgttatcaacccgacatattacggtgtgtgcgccgatttgaaggaaattgtagatctcgctcacagctataatgtgccggtcctggtcgatgaggctcatggagtactgattcattttcactctgatctaccgatgtccgccatggaggcgggagcagacatgtcagctacaagcgttcacaagctgggtggttccttgactcaaagctcaattctgaatgtaaatacgaaaaacggatacgttaacccacagcgtgtacaaacgattttcagtatgctgacaacaacgtcgacttcgtatattctgctggcttcgttggacacatcccgacgtaatctggcccttaacggtcatgaaatagcacaacgcgctctggaattggctgaatattgtcgttcagaggtcaacaagattgaagggctatattgctttggcagcgaaattcttggcacggaagctacctatgattatgatccaaccaaaattacggttcatatccgccatttgggccttaccggatacgatgtggagaattggctgagagatcactacaatatcgaggttgagcttagcgatatgtacaatattctctgtttggtgacccctggtgataccaaagaggaaattgaaattttgttgaaagctctgcgtgagctggcttctctgcactattccacaggtcaggagcatgagctagttgtaaagataccggatatccctcagctctccctcattccaagagacgctttttatggagatacggaaatcgtgcctttcaaagaatctgcaggtcgtattattgcagaattcatctatgtgtatccacctggtattccaatcttattgccaggagaagttatttcgcaggacaatattgattatattgttgatcatgtagaagtaggcctgcctgttaaaggacctgaggaccgaacagtacatcaggtgaaggttatcgtcgaaactgacgctatttcataatattgaactgtcaacacatgcttaaaaaacatgttgatagtcaagaaaaaaagcccccattcgggcaatgtcattaagataagacgcaggttctaaatcaggaacaagagcaggttatcgaaaagatagcccgctctttttttgcatgaaaaagaaaaaaaagacttgacaagaagatggtcatatgtggcgaagccccttgaaaaaacgaggaggttacgccaatggatgagtacgcaaattccctaaaagaaacgctgacatccctcatacgagaaatgtcagccgcaccagcaccttatgtcaaaaaccctgaaaaagattttacccga

SEQ ID NO: 2635 - DNA, 139417 bp, Unknown
  Kingdom: Bacteria, Phylum: Firmicutes, Class: Bacilli, Order: Bacillales, Family: Paenibacillaceae, Genus: Paenibacillus
cacttcgagggagcttaatgacgtattgtccgtctacaactttatattcaccgaacaatatttccctttaaaactcgtagcgttatagcagcaaattaatttaagatacaagtatgaaaagcctctgataattcagcggatttttgtagtcccactcagtaagtaaccctccgtacttttgtacagtcagatcaatgtaagtttctgctttttgaagaattatatttccattaacataagtctcaccggtaacagtggcagggttatttgacttcaatgcagagtgactctttggaactgcttattttatatacttcgacattcgctgcaaataaataaaaattattgacaactgttaaattatggacaacaatagaatgcaataatatataaatattggtacttctgtatgaagggtggtttatctatgaaagttacacccacgattagagcagaattggaacaatatctaaaacaagaaggtttgagcatgatggagtttgggcatattgcaggcatgaatagggggatagtaagtagcatagtatcaggcaataaatctatgtctgttaaccagatagatcgcattaccgaggctatgggtttaccagaaggctacttttacgacctatttatagaaaactacatcatcgacacccccccgaatatgagacgaatagagccatttttgtatcgttgtgcggaattggacaagctggatgcgatccgtcgagtggtaggaaccattatggacaacctactctattcgcctaaactatttgatatggcagaagtgctattagcacagggacgacatgatgctgcgttgctgttctatgagggtgtagctgaaacggagaagtaccaacattctgaacgattggcgatctgtcagtatcgaatgttcacgattcaggttggtgatgatcaaagccgcaatctcaaggcagctacgttgtttgagccttacattgaacgtctggatgaaatggaccaacttgacgcattgaaggatttggcgaacgtgtacaggtctttgcgtaagtgggacaaggttgaggaaatggcaaggcaaatgagagggaaagctgaagtacaatattccataaagcatcagcagaagaatcgaaagaacagggagcatgaaaaggaaaccagaaatccgttatttggatacattgcttacgccgatttgttgtgtgctagtgtttgtgaagcccaaggcgattatcaacaagccctactatatacatacgcctatgcgaatttagattgggtcaaagagactgatgaagatactcaacactgggtaaacttgttcagtcagtgggcagaaggtaacacgtacgtcaataaactcctgtctggagatgttagcgtgctgccagactatgttgaatatatagcggcaacatcaaccgctaatgaaaatgagaaactctcaaagctgttgaacgttatgatagcggctaaccgatatgaaatagatgtggatgatgtcctttcacgttttgaaacgaatattaattcatttgctcaactcccaacatcatctgatatatatacccaacaagtaataccagactatttcgcatggtttgcttacgaaatggctcattattatttacatcgggtgaaatacagtgatggctttaaatacttgatgtatgcaatggcaaagtcacatataataactaatgaaacaaactttataaattgtattggtctgtttatgcgttttcaagtccatgcgactcctgaaatcaaaacagagttctccaatctaattgaaaaggtgtggttaagtaatgttgaaaaaaatggcattgttaattgttgcgagtagctttttgttttttataactgtacccgctcacaatcatgagcagcttattcagacccttgtacaaattgggggattctaaagctacagaaagctctgccgaccataaggttagcagagctttcttcagtgcaggaattaccacagaattcaccgatgtagtttgaatttagagtagatatgaaaagaactaccagatagtagtcggaagtctctttcaggtagaccaaatcaaaaaaataggaaggggatttatgaagaaaagaatatttattttctcgattttatctttagctatagcaactacgataggggttgcttcagcttcagcaagtacaactagcgaaaataccataatttctcaaagatgggtggaagcgcaactgtaggagaatcctttaatgtccctaaaggatgggggcatgttaaacttcgtatgaagaatcactctgatcatccagtaaaggtgagtttaattcacaacggttcaaacaaactatatattgatgcattagtaatcactcctcacgacacagttacttggaaatctactgatgaaggtatcaccaacggtttgcgttctggatactacacacttcagtggagaggcagcgattataaagttaatggggaaacatggggagtagctggttcacagccaggagacatctaacttgtcctagataaacgacgttattgggtggggggatgatgcgtcgttcaagatagcaagggaattagtctcttaattggtttgtgggaatttctttcttatcgagcagtttgaatttagagtagatgtaaagatgggctcggctggattgattttgtgggttctttttccacaggacaggcttgcaaatgcaagtagtgacctagctaattccaaaaggtgttgtaactccacaagcttacacagagcatgtcattaattatgtaagaaacaagtaatttaaaacttgagcaaatgattgggaagactatgcagctacggaagtaggttataaggacttgaacttcctaaatgggtataggctcgattctatctctattagttataccgactccacatgcgaattattagcaggatgcacccgttacaaaattcaaacttataattattccacatattaatagatcatcggtagcaagccaataatcagtagctgagtatgcactggagtttccgagttcgtgctatccagaaatgggagcacacatcaaagatgctatagcagtcggccattctgacgtatgtactattgacctagacgagtgaccgttggcgatgtgcgctgaaggtggcgcaggtgctgatgtccgatacataacccttattgacaacgggggaacaggatcttgggtaagtaatcagttaaataagtataatgatggcacaaaggtgagatttattgtgaaatagatgagagacgctactggttatcagccgatagagtctttttttaatacccattaaaaaataaatatgcaaatgtttagattatatttatagattagcaagtttatgtttagacacaattcctcaattaaattattcttagttctattaaacctattggaggattatttaatgaagaaagcatgtataacaattttatttttagttcttttatctcttcccttatctaatgtttttgcagccgaagcagagtattcagaaaatctagttccacatatgacaactaacattttgccatctggagtagcaagcgcaagtaatgaatattcatacgcatatgaggcgtttaacaaggaatttgctactattgctagtgcgtggacatcaagtacaactgctgcttggctaagatatgactttcctaaacccgaagttattgagcaatatgttatatatccacagacaacggcaactgaccgtgcccctaaaaattggactttcgaaggctcaaatgatgggattacttggaacgtgctagatacccagtcaaatatcactggatgggtaaatagcactcccaaaaaattcactttttctaattctaattcatacaaggattatagaattaatattacaggcaataatggaagtcagtatctagctcttagcgaattagagatgatgtctaaagtgtcaagctccactcctaatccaggaacagaggaaccaactccaaacacagaggaaccaactccaaacggagatcgtgcaattctggtagtcaccatgacgactggcttagagaaggaatttgatttgagtatgcaagaggtcaatgacttcattgcatggtatgaggctaagcaagcaggttctggatcagcttcatacgcaatcaataagcacgataacaataaaggcccattcagcagccgcaaggattacatgctgtttgatcgtatccttacgtttgaagtaagtgaatactctaaataaatcaaaaagctcaggaccttaatgggtcgactgagctttttttgttaagaagcccttccttaaaccaagacctcgcatagcctatggagtaggagtaccctaaaataaaggaggcgttacgtgtgggggaaatgaaaagagactacgagggaatcaccggaagagtttggacatcgatagctgctgtcttggcactgttcatattgctggtaatcatcttgaaattaattcatttataaagattcttaagctccaccgagggatttaatttctaaagcatagccccattagttcctgaggaacctagaaggttcgctgttcggcccgtccccgaccttaaagaagttgttgaaacaacgttttagacacacaaaaggaacctcagcggcttttccggagaaggtagggtaataccccttaacgaagcctgatccacgtcggagcagctgaaataaagtagactgattcatgagggtcgcctctttttggaatggttggtttgtgcttaccattagctgaaaaggcgactctttttatcctatttttggttaatcaacaagcttgactttgcttcaagatcttctataatttccagtgcaacaaaatatccgaaaaataatgttaaaatatcctcgtatcgttttcctgatcctcttgctctacttaatattatattttgactttcttgtattttttttttatggaaagatagagaaacaacggatgaattggaagcgatcaaatccatcattagaattgacaactttttctgaaactcttcaatcggaaagtcattattttctttcgaatacagctgcatcgtttcaggtggatctttaaatgaagtttgatattgagtattgaaaacaccttcattagctattttgtcaacaattaatttaccaaaaacgatccccgatgcgaacgcttgcccagggattcttcctataccatgatcaccattaaattgagcttctccagtagcaaaaacacgattcaagtttatagcctcggcagtagcattgatttcgattcctcctgaagaatagtgcatcgttggtgtaattttgattcttttatttttaactactttaggactaaatccatatgttttgaatttttcatttaacacattttcatcagcatggctcatatccaagtacatgtcctttttttgtttgatgcactctagttggaattttaaaatctcatcaatcatttcgtggtaatcatcccgagcaattgcatcacaaatatactcatcttctaataattgaactccttcctcatctattattttcccttgactcaaagatacaaccccgcccaataaaatttgtcttccgttatatatagaccaaggatgacacattactgtagacattccctttaatctcgcacctattttcttagctaagattagcgtttcaccagttgaaccgggcgaattatcattgaaacagaattgtcctgcatatccccccgtagctaataccaaataattagtatatattctgataaattgatctgattgtgtgtcataaaatattgcgataattccgtgatcgtacttttccaaatgtatcaaaattttattacacatcggttgttcaatatgttgtagtaaacaattgattaatttctttcccccatgtgatttaatcatacattcaggcatgataccaaaggatgttttctcataagaaatacccaattcttcgaagaaatttataattatgttggaattcctatatagcgcttcaattacggatcgatctgctccacatttatcaatagtaagattaataatatgattaatttcattctctgagggaacacgtgtatttgctgctgaaagaaaggagttgctttgtttgggtgcactcttttttgttacaatcgtgtacttgatattgttttttgacaaataataagcagcagtaagccctgagatccccgtaccgacaatcaaaattggagtgtagtgttcaacggatattccattttgtttcatcattccaactcctttttaggatgtgaatgttatcttcggctgaatctcgtagtcggtttcctatttttttgcaacaaaatgcatcaggatgatatttataaaattcttgctttattgttaattacctgtgatttatatcaaattatacaactatatttcgttttatactttatatagttattaagagctaacaaaatcaaatacaaacagttttgcaaaagtagaggaaaaaaagaaccattatagcaattgctaagatgattcttattacgagttacaatatccttgttaccgacgaagaatggaatctaaacaaaatattttcctgattgtacaagtttatcccttattttgtcaacaatatctgagaatatataactgattcagctttcacagtatgaatattcaaacaaattcttaatgtaataattggaagtacattagaaagggccacagagttcatcgtattcatccgtttgtataaccctttttttaaccttcgaattttagtcgaatgtttttactaattaagagctgatagagaaacagtgcaatgaaccgcctatattcaccttctccagccttatagccttaacctatcacttctatagatatcatatcttagaccaatcaaacatcccgtggtatattgttgacattcaagagagaggcgttagcttctctccactaggttcgaaaaacacaggggtgaataatgatgagtaaaaagaccatgttcgagaaaatttgggataaccatgtcatctatcaggaagcgggtaagccgagtattttgtacattgatcttcacctcgtacatgaggtaacttcgccacaggcgtttgagggattacgtcttagcggccgtcaggtgcgtcgtccagagcttacgtttgcaacgatggatcataacgtgccgactaaggaccgttacaatattacggacccgatttccaagcagcagatcgatacattaactcaaaattgccgtgatttcggtgtcacactgtatgatctggatacggttgatcaaggtgttgttcacgttatggggcctgaacttggtctgactcatccgggcaaaacgattgtttgtggtgatagccatacctccacacatggggcgttcggagcgctcgcttttggtatcggaaccagtgaggtagagcacgtaatggcaacacaatgtctccagcaagccaaagccaaaacgatggaagttcgctttgtaggccgccgcaaacctggtgtgacagcaaaagacatgattttgggtgtcatcgccaaatacggtacagatttcgctacaggttatgttattgagtacacaggtgaatctatccgcgaattgagcatggaagagcgcatgactgtgtgtaacatgtccattgaaggcggagccagagcaggaatgattgcaccggacgaaaccaccttcaactacttgcgtggacgtcaacatgtagcacaaggagctgcttttgagcaagcggttgctgagtggaaagagcttgtcacagatgaaggtgctgagtttgatgtcgtgctggagtttgacatagatgctttgattccgcaagtaacctggggcactagcccgggaatgggtacagatatttcctcaaccgtaccgattccggcagaactgccaaccgaaaacgaacgtaaagcggctgaaaaagcgcttgaatatatggatttgaagccaggtactccgatcacggatattgcgattgattatgtgtttatcggctcctgcaccaacgggcgaattgaagatttgcgtgcagccgctgaggttgccaaaggttacaaggtttctgacaaagtaacggccatcgtcgtaccaggttcgggtcgtgtgaaaattcaggctgaagaagaaggactggacgtcatttttaaagaagcaggatttgagtggcgtgaagcgggatgcagtatgtgtcttgcgatgaatccagacgtactgcaaccgggacagcgttgtgcttcgacttctaatcgtaactttgaaggtcgtcagggacgcggaggacggactcatctggtatctccagcaatggcagccgctgcggcgattcatggacattttgttgatgtacgggattggaaattcaagcaggaagaagtagtccgctaggatacagaggaggaattacgatggaagctttcacaacattaaaaggaattgtagcccctgtggatcgggtaaacgtggacacagatgctatcatacctaagcagtttttgaaacgaattgaacgtacgggctttggacagtttctgttctacgagtggcggtttgatgaagccggcaatgtcaatcctgaatttgaacccaacaagcctcgttatgcaggagcgtctgtgctgatctctcgcgctaactttggctgcggctcctcacgtgagcatgcgccctgggcgattatggactatgggtttcgttgcgtaattgcaccgtcttatgcagatatcttctataataactgttttaaaaatggtatattgccgatcaagctatctgaagagcaagtagaggaattgtttcagcgtacggcgcagcatgataactaccaattgaacgtagacctgaatgaaaaaacaatcactgacgactatggtctgaaaattgaattcgatctggatgaacatcgccgccagttcctgctacaaggcttggacgatattggcctgacactccagcatgaatctgaaattctggcttatgaacaaaaacgtgctgcgaaacaaggcgcatagggttaattcccagttcagtttcaatacgtagtcatataactagctcattcgttagacagaaagcccgtactggcaattcttttgcctgcgggcttttattatactcaaacaataaattggaaaataaggggttgacggttcgactcagcatggtattgtaaatgtaaattggttgaaggactgtgtctgtgagaaataccaaaaaatacatatataagttaggggaatgaggatgaagaaatatggttgggtgatactagcggctatcttgatttggttatggccgtcctcccctcatgtgaatgcggctggagcagatttgtttttggatggcaaaagagtggaagcgcctgcagatgccaaacctgaaatggttaatggaaaaatcatggtaccgctccgggtggttggggagcagctggggtatcagttcaagtgggaaccacaagcctataaaatctcaatccaaaaaaacagtaccgatatgtctatgtatgtaggccgtacatcggctgatgtgaatggaaaaacagtaagtctggatgcgcctcctgtacttcggggcaattcgaccatggttccattgcgttttgttggggagcaaatggggctgaaagtagattggaataataaaagtaaatccgtaaatctcagtcaaaaggctgcaactcaacaagcgaataaacagtctcaatcccaaccatcgtcgcaaacgtcaacacagagtacaactagcaccaataaaacgtcttcagcaacagcgacgacaataaccccagttgaagcagacaagcatactgaagctacatcttcaccagccaagcagcagaatacagaacagaccacagcgaatgcgttgcttgtacaaaatattacttttgagggtgaaacgttaaagatttctttgaacaaagatgttacccctaaagtatccacaatgacggggaatgatcgtattattgtagatttacccggggcttcactggcgactgattttcttcaaccgttcccgattcgtaaggatggcacgcgggcgttgatgaatagtgacagtgaggatgtgcaggaaattagatttgctcccacagatggaccgaatgggggcgtacgcattgtcattgctttaaatcaagcacgtgattacgatctatcaaccaatggcctaggcgatatcacccttcaattgcgtgagcatagtgtgaatccagtagcggtaacaccaacgaatgtcgaaggacggcgaatcgtcgtcattgatcccggacatggtggcaaagaccctggagcaggtagtgtgactgggcgacatgaaaaggaatttacattggcggtagcgttaaaagtcgagcagcttctgcaaaatgatgctgacattcaaatcgtattgactcgcaatggagatacgtatcccacgttggatgaacgaccacaactcgctaatagtcagcaggcaagcgtgtttgtatctattcatggtaatagtatgcaagcttcagataaaggaaaaaccaatggctctgaaacctattatgcacgtcaggacagtttggcactggcaaagacgatgcataaatatcttgtagcagctaccggatttaaggataatggcatcagggtggcaaaccatgcagtgacgagaaaatcacaaatgcctgctgtattgctggaatgtggctaccttagtaatctatccaatgaagcagccatgtttacagaagaaacacaggagaagattgccgaaggtattgtcgatgggttgaaggagtatcttggaacgggcacaggagcaactgaatcacttaactaaggatgttagcaataaaagctactttccaccttttaatgaaaattcatgggggtgaaaagtagcttttttagttttttcagctgtgactttggacggaaaacgaatgatctatatttttagtcaaaattcgacaaaaatagttctttggcacgtatatttctgttatgatggaatatattcgcaacttttggtgtgagataacgtctaaaaggttgtctgatattacataagcgcgtatatcaggtcgccgcaccggagcatgtggcaaaaaaaattatgaatggaagggtgacgaatgaagaaatttggttttttattgttattatttgtcttcatgtgggcggttccgggttatggacatgcggcttcgagtggaacacaaatctatctcgacgatcaacagttaagtgtccctagtggtgctaaggcacaagtaattggcggaagtacaatggtcccgctacgcgtaatttctgaaaatttgggatatgacgtgacatggaagcagcaggcgcgaaccataacgattgagaaggacagtacctcgatccgaatgataatcggaagtaagacggcgactgtcaatggaagcgacattagtctggatgcttcgcctctgctgcgttccaattatgcccttgtaccgcttcgttttatcggcgagcaaatgggactggacgtaaaatgggacagcagctccaagtccgtaaaattatatacccgcagtagcgggtctggaaacggggaatttacacctcccaagtctggaaataacagtacaggtactggaagtgttactgcgccaacgaataatgcgaactcaggtgttacacaggtgcagggagttagtttcagccaaaaccgtttaaccatcaccacagccagtgccgtcaagccgaaagcgtttacgatgacaggccctgatcgggtagtggtggacttgccggcgactgcgtttgctgacaattttggagaccagcagaagctggatagcaacttaaatggttcgttggacattgagaatgaagcggatgtgtccggtatccggtatgctttgtttcaaaaggaaccttcaacggtgcgcgttgttattgatttaaaacatgccatgaattataccgcatataatgatggatcgaatcgtgttatcgtcgatttggcttccaaggattcagtgaataccacgccagatgcaacgttaccagatggctcacagccggaagacacgcagacatcaccaactaacagcaatggtaaaaaagtcgttgttattgatgctggtcatggagcaaaagattcaggtgcagttggtgtttcgagaaaaaattatgaaaagaccttcaacctggctatggctctgaaagtagaaagcatattaaagcagaactccaatcttgaggttgtgctgacacgcagtgatgatacattcttggagcttaaacagcgcgtaaaagtagctgaaaaccttaatgctaacgtgttcgtgtccattcatgctaacagcagcggtagctcagcttccaacggtacagagacgtattaccagcgtagtgcaagcaaagcgttcgctaacgttatgcataagtactttgctcctgcgacgggtctgacagaccgaggcattcgttatggcaatttccatgtaattcgggaaacgactatgccagccgtattgcttgaagtaggatatctgagtaatgcaaaagaggaagccacactgtttgatgaagatttccaaaatcgggtagctcaagggattgcagatggaatcacagagtatctcgacgtaaaataaatcttcaacaaatgcttgtcaacgtcaagcaaggagggggacatatgaacaagaaaatcgtaattgcaggcctgctggcattgttcgccattgcaggtgcagggtgtgcctctaagcaaacatcggctcctgcaactccatctcaggaaacacaaacttctaatgcacaaaatagtacacctgaacagacgacccctgatccatcggctcagtctgctgagaataacggggcgagtcaaacacctgcatctccgtcaacagagcctacaaagaccaagacggacacggaaaattcaggagatcgacaaacacagcagattacggtgtactatacggatacacaagagaacggcttgaaagaacagaaaaaggaaattacctatccaagcgagctggaaaaattgcaaaaagcgtttgaagctctgcaaaagagtggggattctgctctaatcccgttgtggtccgagaaaatttccgtgcataagatcaaattggataacggtgcattgacttttgatatttccctgccggacgaggctcgattgggagctggcggcgaggaattggctattgatgccttgaagaaaacgatgttccaattcaaggaagtcaaaacgctggatttgctcgtagatgggcaatctctggagtccttaatgggacatgtagatttggatcatcccatgagccgctaaccgatcataccgtatgaaaatttcttggggatttacacacttttcacgtgcaatctgtgacagataatgataatataggagtgtatttctcgcctatgcaggcagtcatgcacaaatagtattcgtttctttccggatgattatttagagtgaccgtcttgatgcgggctatcccgtatcaagacgttttttttggtaggaggtaggatttccgtgaatgcagcaaccgcacgtcatatattggacaccatcggtacgatgtttccggatgcccattgtgagttgaaccatgacaatgcttttgaattaacgatcgccgtgttattgtctgctcaatgctccgatcagatggtcaataaagtaacggcagacctgtttcaaaaatacaagtcacctgaggattatttggctgttcctcttgaggaactggagcaggatattcgcagaatcggcttgtaccgaaacaaggccaagcatattcataacctctgtcgtattttaatagaccagtacgggggagagataccttcagagcacgatcaactggttaagctacccggtgtcggccgcaagacggctaacgtcgtagtatctactgcttttaatgtaccagctattgcggtagatacgcatgtagagcgtatttccaaacggctcggttttgcagggtgggatgattcagtgcttgaggtggaaaaaaagctgatgaagagggtacctagggatgaatggtctttgacccaccacaggcttatttttttcggacgctaccattgcaaagctcaaaatcctcaatgtcaggtatgtccgttgcttgatgtgtgcagggaaggcaagaaacgtatgaaaacgtctcttatcagaaaagataaggaacgtagagcttaaagacccacagaggtaacaaagggtttaaccatttatgtgtagaaaaggatgaagagtatgaagtgcatttcggtatatacagacaattttgaagcgttctctgatatttttgagcaaattgtaacaacagaatttgctgaaaacgaagagcgtgagcttgagggaatcacggttagtcattccggtgatgtacctgagcattatctggagcgtatgtcacaaaagccagaagtggtcgtaatgaaggacaaatcccgtgggattacgattttacagcatggtcaagtatttgaaattttgctgccagtgcttgagactgcagccaattaagttcaattagcggacgacatgcgttgcatgttccggtataggcggctcggctggtttatccagcccgaaggcgcattatacatgaaccttgcagaccatcctgatatggctagagcctattccaatgaagtgtgcatacattttgcaccctgaattaaggtatcgcgttccccatgttccaaaaggtaaatgtacgtgatgagtaggctcacccgttgtatacatatcttgcttcgtcgttgtcctttaaggggctttgatgaaatgcattcggttgccaaaatacttattcctaatgatccgttttggacagaataaaatgaacttattattatcatgtacaaaaacagcgttccctaaagccaggtactggcggggagcgctgtttagtttttttgatgtgatgattctcacaacggcttaggaatgctacaatatagctatttggtgcagacaagtgataaggagtggaaccgtagcttatgatgcaaacgattacaggagatgcgggaaagtggttggatacgatagaacagatacagaatacattacgtaaagccggggacgaagcgggagcgaaggcgacaggtgatctgctggaaaaagcatatgtgcaggagctgaccattgccttttgtggacatttttcagcgggtaaatcgagcttgattaacagcctatgtggtaaaaccgtgctgccatctggaccagtgcctacgagcgctaatgtagtgtccatccgttatgggcatccgagagcgctcattcatccagtcaaatcagcggaaaatccagagccggaaatcgtggaggcctccctgtccgagcttgctgagtattgtaaaaatggtggagcctatgaatcggttcaagtgtgggaggatgttcccatattatctagcggaggagtgttgctggatacaccaggcgtagattccacagaccacggacatgcgctggcgacacattctgctttacattgggcagatattgttttttatgtgatggattacaaccatgtccaatctgaaaataatttgtcctttgccaaaagtttgtcggattggggcaagccgttatatttgattatcaatcaaatcgataaacaccgggagcgtgagctttcatttacacgttatcgtaatgaggtggagactagctttcatgcctggcaggttcattatacggatatcctctttacttccttgaaggagcagaatcatccatggaaccagtggaaacagttgacgcacctgatcccgaaattgctggagcgaaaaacagagcttttggcatacagtttagtgtcctctatgcaccatttggtagagcaacatgtggagactgtgcaggcagctgaagaagaggaactgaacacactgctaaaagaagcaggtggagaagaagccattttgcgcctggatatagagcagaaaaccttgcagcaagaagatgaacactggaagatgcttccggagcaggagcgtaaacgactgcgtcaagagctggatcatctactggaacacgcacatttgacgccagcggagctgcgtgaagcggcaagcgaatacttagagagccgcaagccgggcttcaaaacaggactatggtttgcgggaggaaagactgagcgagaaaaggaaagccgtttggaacggctgacaggaatgctgactgatcaggtggagggacaattgcttcctcatgtgcgggagctactgaggtcttggggtgacggtcagggtttgtggtccgctgcgatggagcaggagctggatgacatccgccctgtaacggatcggcaactggtagagcaaacggtgaaggaaaatgcgttgtcgccggagtatacgttgaactattgcaaggatctacgtgctgctgtgaccgccgattgccgccgcaaggcgcttacgctagtagaccgcctgctggcccagcttgcagtgcgagccgaagcccgccgcgcggctctcgcggatgcgcgcactgcgctgctggcgcagacggaggcggcgagccgctacagcacccgcgtgcaagcttcggcttcgcacgccagcctgctgcgcagcttgctgccgcaggcttccgcgccaagcgagttgccccgtgcggacgcgcctgcacctgcgtccgatgccggcgctgtctcgccagctgcggcgccaacgggcgttgcgcgtcctggtattgctggctcgcggaacggatcagcggcgcagccgctagcaggaacggcggcagcacagcctgccgccggaggccgccgcacgcggctggatgcagtagcggcccgattgaaggccgccgctgccctggtaagcccataccctgccatgcaaacggcggtacgggatttacatgcccgcgccgctgcgctggagggtgggcagtttacgctggcgctgttcggagcgttcagcgctgggaaatctagcttcgccaacgctttgctgggtgaagctgtgttgcccgtatcgccgcatccgacgacagcggcgattaaccgcataatggcgcctgcaagtgctgagcgccatgccacggctgacgtccatatgaaatcagtggacgcgttgcgggaagatcttaaatactcatttcggctattaggattgggggaaccagcggcagcgggctggcaagaagccgttcatgctttatctccggaaggcatccatcctgcgggtaggcctcattatagttttttgaaggctgccgcagcgggatgggaagaagctgaaagcttgctgggacaacagcttcaggtggatttagagcagtatcgggattttgttgcgtctgagcacaaatcatgctttgtggagcatatcgacctttattatgattgcgctctgacccgtcagggcatcgtgctagtggatacgcctggagcggattctgtgaatgcacggcacacaggcgtgaccttcaactatatgaagcatgcggacgctcttgtatttgtcacctattataaccatgcgtttacgcaaggcgaccgacagttcctgaaccaactaggtcgagttaaagagaccttggcgctcgatcagacgttttttattgtgaatgcatcagatctagcttcttctgaagaagaacttcattctgttacccggcatgtacaggaacaactacaggcgaatggaatccgaaagccacgcatttatccgctttccagtatgctggcgttggaagctgccgaacagggagaggcttcattgcgttcagcttcacgttttgatgcatttgaagatgatttctcggcatttgcagccgaagagctggcaggtctgtccattgcttctgctatgcaggaactgagccggctgcggaaccgcatagagcaacatgcagccgatgcccggtatagcgtggaagaacgtgagatccgattcgagcgattaactcgcatccgtggggaattggagcataccctcctagacctgactgacaccaacggtgcatctgtgttatcgggcgaaaccgatgaactgctgtatcatgtccgtcaaaggctgtcctatcggactggagaatttatggcagaggcgtttcatccatctgttctgcgtgaaggagtaggtgatctccgttcggcttttgcatcttgtggtcgtgagctgatgcgcttgatcgaactggagctgtctcaggaattactggcaaccacactccggctggaaaaaacgggacaaattttggtgcacaaggttacacaacagtgcgtagaacacatgaaccatcagttgccaggactagattgcacaattcctgaatccagaaaatgggctgttcccgagctgaatgaaatttccctgcaggagtccattcattggaaggattattggaatagctttaaaaatccaaagctattttttgaaggaactggtcgagcgaatctacaaaccaaactggagccgatattacgcgagcgaatcggggaagctgtggatcagcaacgagaacgaatgtctactttttacgttacgctgatgcaggaggagcaaatgtggcagaaagctcagcttcgagagcaaatgctggagacgactcgtggcatggagcatgcgcttatgggcggtgagcagccacaggtttgggaagagcttgctggcaagattgcggctttggagtaaagataaataagtacaccatttattaaagttcaggacaccgggttgtgggacaacccggtgttttatgcatgctccaaaaagaaagcaatactgagtaaatagccatattcaataataagaaagcgatttaatttgtctaatcacccaccacttgataacctgcctgaatacggctcgttatcctctttgccgccttggaacgcgaatggtaaacttcactaagccatataacaacgtcgtgcaactaatggagggacattgacatggaagtgctcaggcaactgcaagttttttttcgcgagaggagacactatctgtttctttctattttatgccttgcgatagcgacggctctgggactggtgtatccgaacctgctccaaaggctcattgataacgctatcatccctggtgacttcgggaaagtaccggcgctggctctgactgtgctgggagtagtcatcatcaaagggttcatgcaatttttacatggtttttttggtggacggctaggtaactatctggcgtaccgactccgcaatgcttgttacgaaaagctgcaatttctgtccttcagatattatgacactgccaaaacgggtgatctcatgtcccgactgactggtgatttggaggcaattcgtaactttattgggtttggttttgcccaactcctcaatgtgctactgatggtcgtattcggctctatgatgatgctgtatattaactggcagctcaccctcattacgatgatcagcatgccattgctgctcttcgtcacattcaagtttgaatcccggattcatcccacctttcaggaaatgcggattgcccttagcgccttgacgacagcggtccaagaaaatataacaggtgtgcgaaccgtcaaatcttttgcccgcgaatcctatgaagttgagaaattttcagtacgtaatgaacaatacaagagtaatcaaattcaggctgcttccttatggagtcggtttttccccgctatggaactgattgcttctgtcagtgtggtccttctgttgggcatgggggggtatctggttattcagaagtcaatgaccttggggcagctcgtcgctttctttagcttaatttggtatattatcggccccatctggagcattggctttcatatcaataactatacgcagtccaaagcttctggtgaaagggtcttggaactgctaaatcagtccatagatgtaaccgatgaagccggagcacttacactcgatgccgatcaggtggaaggatatgttacgtttgaacatgttacctttgcttacggaaataagcttcctgctgttgttgacatcaatttagacgcaccgccaggatcagtcattggaattttaggaggaacggggtcagggaagtctaccattattcaattactcatgcgcgcttataatgtgaatgcaggaagtatcaagttggatggcaaagatatacgtcacttaaagattcgcgatttgcgtgctcaaatttcttccgtgtttcaggagacgtttttgttttcgtcctctatacgcaacaatatttcatatggtttaagtcatgtcagtatggatgacatcatacgcgtttccaaactggctcaggcgcatgaattcataactgaactaccgctgggatatgacactgtcgtcggagaacgtggattgggactgtccggaggacagaaacaacggatcgccatcgcccgcgcactactcaaaaatccgaagattctggttctggatgatgctaccagtgcggtcgatatggaaacagagcatgaaatacagaccggttttcaagaggttatgcgtggtcgaacaacattcataatcgctcatcgaatctcttcgcttcgtcatgctaatgaaattgtggtgcttgaggaaggacgaatcgttcagcgtggaacacatgaacagctcattgctactccaggtccatatcaggatgtgtatcatattcaatacgccgattacatagctcaggctccagacggtgtatccgaagggcaggtgagaccatgaatatacccgcagaaaaagtcaaaccgttaaaaaaaccaacgaatgagcgctttgtctatcaagatgatgatgtcattgacaaaccgtttaactggtcagaattcaaacgtttgttggcatacatgaagccttatgcccgtcagattttgccgatccttctggtcatgatgattctcggcaccattaccaagctgaccgttccttatttgatcagtctggccattgataaagcaattgctcccgcatggcctgcactgcccagcgtaaagttgctgttgctcatcacgggtgccgtgctcttgttatatttaattcaatgggcagccagcacgtaccgcattaaattcaccaatattatcggtcaacgggttatttacgatttgcgtgaagatttgttcaagcatattcaaaagctatcttttaacttttttgataagagaccggcaggttctgtattagtgcgcgtaacgaatgacattaactcgctacaggatctatttacgaacggtgcagtgaatgtcctgattgactgcgtacagcttatcggaattattgtcattttgctgcttattaactggaagctcggtttagcggtaattgtcactgttccgatcatgtttttgatctcaaccaagctgcgcgtacgtatccgccgcgcttggcaagaagtgcgtatgaagaactcgcgtatcaactctcatttgaatgagtctattcagggcattcgtgtgacacaagcatatacgcaggagcaggaaaacatggcttatttcgacgacatgaacagctctagcaaaaagtcgtgggataaggcttctgccatgaatcaggtctttggtccacttattgatattaccggaggatttggtacgcttgtgctgttctggtttggagcgcatttaattcagacagaccaacttacggtgggactactggttgcgtttgccaactatgttgggaacttttgggagccgattaatcggctgggccaaatgtataatcagttactggttgcgatggcttcgtcagaacgaatttttgagtttatggatgaacagccgagtattgcaaacaaaccgggagcaatagccttgccgcccattcggggagacatccaatttgaaaaggtcatttttgagtatgaaaagggacgtcaggcgcttaaaggtattaatctttctgtcgaggcgggtcaatctatagcgcttgtgggtcataccggatcaggtaaaagtacaattattaatctgctaagccgtttttatgacattacgtcagggcggcttacgattgacggtcatgatgtgcgtgatgtcacggtggagagcttgcgaagccagattagcatcgtacttcaggatacatttattttttcggggacgatccgtgataatattcgatttggccgtttggatgcaacggatgaggaaattgaagcggctgcgaaggcggtcaatgctcatgaattcattgttcacttgccagctggctatgaaacagaggtagaggagcgtgggggaatgctgtccatgggccagcgacagctcttatcctttgctcgtgccttgctggctaatccgcgaattcttatcctagatgaggccacagctagtattgatacagaaacggagttgaaaattcaggaggctcttcagattttactagaaggcagaacttcttttatggtcgctcaccgtttgtccaccatccgtaatgctgatcatatcgttgtactggatcatggggaaatccaagaaagtggtaatcatgaacaattgatgaaaaaacatggaatatatcgggggctggtggaagcacagttcagatttttgtaaaaaaaagatcaaaaaatcgcgttttttgtaaattttaatgccgagcactattgcattcttggagctaaaccctgaaaataaagatgaaaagagatcagagcaatttcgtcagagggggaagagttcaagatgtggggtgctcctttttctgccaaggctaagaagatgctgctgctgggtagcggcgaattgggaaaagaagtcattattgaagctcagcggcttggcgtggaatgtattgctgtagatcgctatgaactggctccagcaatgcaggtggcccatcgctctcactgtctggatatgcaggatgctgaggcgttgaaggcactaattcgtaaggaaaagcccgacataattgtacctgaaatcgaagctattgctacgggtgctttggaagaattagagcaagaaggatttcacgtagtaccaacggcccgtgccgcccgtcttacgatggaccgggaaggtatccgcaggctggctgccgagaaattacagcttccgactgctgcctatcgttttgcagataactttgagcagttgcggtcggcggttcatgagctgggcacgccatccgtggtcaagcccttgatgagttcgtcgggtaaagggcagtctgtatgccgggcgatcgaagatgcagaatcctgctggaatacggcgctggaaggcgcgcgtgccaaaacaacacgtgtcattgttgaagcttttgtcccgtttgagagcgaaattaccttattgaccgtcagatcggttttgggtacgactttttgcccaccgattggccatattcagaaagatggggattatgtcgaatcctggcagcctcatggcatgacggacaagcagctttcggaagcggaagacattgcccgtaggataacggatgaactgggtggttacggattgtttggcgtagagctatttttaacagctgacggcgtcatattcagtgaagtatcccctcgtccgcatgatacaggaatggtgaccatgattacgcaggatttgtcggaatttgcgcttcacgtgcgggccattctcggattcccggtgccatccgtcacgctgcttacaccaggagcttcagctactttgaaggcagaagtgactacgcgggattttgtaataagcggtctgcatgatgcattattgctaccccggacacaggtgcgagtgttcgggaagcctgaaaccaagccgggacgccggatggctgtagcgcttagcgctgcagaagatgtggaaacagcacggaagacggccaaagaagctgctaatatgctgaaagtggaggtaaatcatgtctaacaatgtgatgattccagtactgacaattcgttccgtagagcttggcgattgcgaagccgtaactggactactaagagaagtcggatacccgatgacttgtggtgtaatgaaagaagttatgggaacagcgcgggaggacagtcaagcgaatatgatggttgcagaaatggatggtcgtgttgtcggagtaatcggcatgcatacggctcaaagcttggcttatcctgatcctgccgtacaaatcaccatgctggtcgtgagcggggagtatcgcggcgagggcattggcaagcgcctggtggcttgtggtgaggagtggggacgtgcgcaaggatgctatcatttattcattaccggagcgaataaccgcatcaaacaagtagaggcccgagctttctacaaccgaatcggctttgaaaagcaaggctaccgtttcagcaaaaagcttagataatcagcctataacaagacaatctaatacttaaagcctcactacttttaacttagttccgcatgggtcaattccgagcggggctattttttttccaacttttataccattgatcctgctataaaacatgatatactgctagagtaaagattacaaagttgtaaccagaagcgttcacaccaaggcatttatacaacaaggagatgacgaaatgaagaatatgttgaaaaaaacactggtgatgggaagtcttagcgccattttatccgcaggattcatcgttccggcatcagcttcaccagctgacgatttgactgcccaactgcaacaatggtttcaaaataacggatataccgtcaatatgtccaacgggacgactacgataacaaagaccgtaattaaggatgtttctgaaaaggacaaggctaaaaacaaaacagcaaatccttcatccggcaaacaaacaacaaccaaacagggtggccaaaaggcttcgcagtctggtaccaagcaacagactcaaaaacaaaacacaaactcaggcgcgggtcagtccgcaggtacggatgcacaactcagcaagtcccaatttgcagctgaggttgtaaagcttgtaaataacgagcgcagccaaaaaggtctcaagcccctcgcatcgaatgcgaagcttacagaagtagccttagtcaaggcgaaggatatgagtacgaacaattacttttcccatacatcaccgacctatggttcaccatttgatatgatgaaaaaattcggtgtaacttatacgtatgcgggtgagaatattgctatgggacaacaaacaccacaagaagtgatgaaagcctggatgaacagtcagggacatcgtgagaatattttgaaggcagagtttacacaaatcggtgtggcttactacaatgggtattgggtacaagagttcacacgtaactaagatgatagtaaatacgttcccaacgttatgtcgctgctacgaaaagatggtgacgtgacgttaatctagagacccgctgacacgttcagcgggtcttttggtgtctcttcatcctccagtggcataaccactgctttataccggaaaagacataagggacgtatttatagtatgatagcagcaagttgaatagatatcagactacttatggaaagccaggtgaacaaatgagctacgaaatcgtgcatgaaggtgcctttgctatgctcaaggtgcagttgaaacccggggaaatgattaaagcagaaatgggagcgatggtttccatgtcttccagtgtagatataaaggggacggtagacggtggactgttacgtggtttaggcagaatgctgagcggagaaaaattcttttttcaagaactgagggcagccaggggaccggctgaggtgttgttagcccctgctagtataggtgatgtacaagcggtggaattggatggcacgtataggctgttcgtccaaaaggacggttttctggcttgtacggaaggcattgaggttagcaccaaaatgcaaaacctgatgaaaggtttattctccggtgaaggtttttttatcgtagaaatcagtggtcgaggtacggtattcctgtcctcttatggagccattcatcccatttatattgcgccaggagaagagcgtattattgataatgctcatctggtggcatggccggattatatggattataaaattgaaaaagcatctaaaggctggttgtccagcgtaacgagtggagaagcacttgtatgccgctttcgcggtgaaggaacggtactgattcaaagtcgaaatccgggcagttttggacaatggatcaaaagttttatccctgatagcaaatagtttgattcgtctgattagagatgagaagatcaactgttcgcacaagaaagtataatataaggatggtcatttgccatcctttttttgcatgtttatgggaaattatatgtgactctaagcatttattgcgcttttattccgaacggtttatttgcaaaatgatatgagaagctttatgtttatttcactaagctatcaggagggaacacgagtgaattcatcaaaatggatttggcggtctgtcggttccgtttccattgccgccacattgctattattgtacggattttttacagcagtacaaagtatcacggctccagagccaatggttagcactcaacctgtacattccggttcatcgcagacaaaaactgcgccatccgctactaatcagacgggagagtttcgggtagctgccattggagattcactagccaaaggcacgggggatgactccggaagtggttttgtgcgtcggtcggtgagcatgttaaataatcaggaaggccataaggctcagctcataaataatctgggaattaatggactgacgactcaaggactattgaccaagctggatgagcctggtgtttcttatgtgttgaaaaaggctaacgtcattattgtctcgattggcggaaatgatttatttcagggagctcaggctgcccaaactggcaaagagccgcctacacttagtggtttgcgtaaagctgtgcctgatgccgccaaacgtctgcaaaaagtgctgacaaaggtagggaaaatcaatccgaatgctaaaattatctatgtcggattatataatccattcagtgatctgcaggaaatgaaaattcccggtaatcttgtagtaacagaatggaatctggctgctatggcaattaccaaccaaaacagcaatatgactctggttccaactttcgatttattccagcaaaatttgcccgtctatttatcatcggatcattttcatccaaacggacagggctatcaggcaatcgctgaacgtatcgcgcaagggtttgcagttgcaaacacgaaggatgccgataaagtggataatgaacaacagtctacaagtagccaacccgctgaagtgaaaaagggaggaaacaagcaatgagcatccaatctgctgacaagaccggggctggaataaccgaaaattcgacatcaagggatgcattgtccagtttccattccgccaatcaggttggcagcggaggcagagacagaagcaataccgaaacagttctctctgttcagcacgttaagaaacgtatcaaacgcaaaatgatcattcatgatgtcacattcgacgttcgtgcgggtgaaattttcggatttcttggtcctaatggggctggaaaaacgacgactattcgtatgctggtcgatttaattaagcctacggaagggacgattaccgtctgtggtcataatgtaaatcgtgaccctgagcaggctttacggcatattggttctattgtggaaaatccagaggtgtacagctacctgacagggtgggagaatttagagcattttgcccgtatgcagcctggtgtagacgagcagcgtatccgcgaagtcgttgagctggttcggctcgatcgccgtatccatgataaagtaagtacgtattctctcggaatgcgccagcgccttggtatagcccaagccttgctaggtagaccgaaattactcattttggatgaaccgacgaacgggttagaccccaaggggatcaaggaaatgagagcttttatccgtttgctagcggcagaaggcatggctgtatttgtttccagccatttgctcagcgaaatccagctgctatgtgatcgggtggcaattataagtcggggaaaggtgctagctgtaggtggtgtacgggaactggttgagacgcactcgcacatggccgtgtggcaactggagcctcgtgatcagggtcttgccatattgcaaaattctccgcatgtgcaaatgattacgaatgccgatgaattaattgatgacagcattgttgcaggcagcggagccgatgcaatttttacagaaatggatgaagagcatattgcggagctggtgacacaaatgacggcttccggtatttccgttaaaggtgtaaccaaaatcaaccctacactggagcagctattcctgaaaatgacggaaggtgagatacttgaataacattttaccgctcgtacaaaatgaaacgctcaaaattattaagaagaaacgattttatgtcattttacttgttttacttgtgcttgtgccgatttttacgtacgctcagatgaaagtggcagaaaacaatcgcgaaaaattcggcaatgattggcggcttgaactacgccaggcgattaccgataatcaaaactcgctgggaagtgaccgggttcccgaggaatggaagacctatcgtcgggtctttgtgcagcagatgcaatattatttggagaatgatgtgaatcctaatgagccgagtggcgtcacctttaccagagagtttatggataattccataaatctgttcgttccgctgttgattatggccattgcctccgacttggtttctggagaacggacgacaggcacgataaaaatgttgctgactcgcccagtcaggcggtggaaaatactgctgagcaagctgttgacattgtatatgttcgtctcgctcatcattttggctgtatttataattagctatcttatatcaggcttgttttttggttttcgcggttttaatgttccggtatttaccggatttcaaattgttggatcgacggtggatttgtctgctgtacatgcgattccacaatggcattatctgatgctgcaagccggattgatctggtttgtcagtcttgtggtagcttcgttagcctttatggtatctgtcctggtacgaagtacggcggcaagtatcgtggtcatgatggctgcgcttatttcgggcactattttgacaaacatggcttcatcttggcagagtgctaaatatttatttatggttaacctccaattaaccgattatttatctggaagccccgccccgattgagggaatgaccttacccttttctttagctgtactgggcatttggggggctgcagcattgattgtttcattcgccgtctttacgaaacgggatatattgaattaaaatggacaaggtaaaagaaaacatctgtttgcatttttggtgaaaatcatcaagaataaggcaaaacacggttacgattagacaaagggggagcatgaatggtcgacaaaatcgacttgtctgcgggagtatccggcacacaaagcggagcttcagaatatggcgtggacgacattcaagtgctcgaagggcttgtggcagttcgcaaacggccgggcatgtacatcgggagcaccagttcttcgggactgcatcatttggtatgggaaattgtagacaacgcggtggatgaacatctcgccaagttttgctctcgcattgatattacaatgcataaggacggttccgttacagtatcagacaacgggcgcggtattcctacaggaatgcacaaaacgggaattcctacgcctcaggttgtattcaccattttgcacgccggaggtaagtttggcggttcgggatataaaaagtccgggggtctgcacggtgtaggtgcgtctgtaacgaacgctctttcggaatggcttgaagtagaaatttaccgggacggcaagattcaccgtcagcggtttgaatattggcaggacaagaagggcgtggagcatgtcggagaaccgaccacaggccttgaagtgctgggcaatactaacaagacgggctcgaaaattacatttaaaccggatattcgtgtttttcaggcaggcattcattttaactacgatacgttggctgagcgccttcaggaaattgcttttctaaattcgggccttcgtattcaacttaaagacgaacgcagcggaaagtcagatgagtatttttatgagggtggcgcgagtcagtttgttgcttttctgaatgagggcaaggatgtgctgcatgacgttattcactttaatgccgagaaagaagacattgaagtagagattgccatccagtacaatgcgggttatacagagacgattgcttcgttcgttaactccattccgacacgtggcggaggtacgcatgaaacgggattcaaaaccgcctacactcgtgtcatgaacgactatgcgcgcaaaacggtgatgttgaaagaaaaggataaaaacttggagggcaacgatctacgtgagggcatgatggctgtaatcagtgtcaaaatggctgaagttgaatttgtcggccagacaaaggatcagctgggtagcgcttcggcacggagtacagtggatgccatcgtatctgagcagatgcagcgttttttggaagaaaatccgcagatagcacaaactttgatcaagaaggcagttcaagcatccagagcgcgtgaagctgcacgtaaagctcgagatgagatgcgttccggtaaaaagcgcagtgaaagttccaatttgaatggtaaactgtcgcctgcgcagtccaaggattttacacgtaatgagttgtttattgtggaaggcgattcggctggaggatcagccaagcagggacgggattccaaaattcaggccatattgccgctaaagggcaagccgatgaatccggaaaaatccaaactggcggatattatgaagaatgatgagtaccgtgctattacagcagctattggtgcgggggtaggaacagagttttcgctggaagacagcaattattccaaaatcatcattatgaccgatgcagatacagatggtgcgcacattcaagtgctgttgttgacgttcttttatcggtacatgaaagagcttattgatgcaggacgcatatttattgctcaaccgccattgtataaaataactcgaaagtcgggtaagctcgaaacggtgcgttatgcttggactgacgagcaacttgataattatttaaaagaatttggacgaaattttgagcttcagcgctataaaggacttggggaaatgaaccctgatcagttatgggaaacaacgatgaatcccgattcacgcaccttgttacgcgttcagatagaggatgcagccaaggctgaacgcagggtgtccactttgatgggtgataaggtggatccgcgcaagcgctggatcgtggaaaacgtagatttcacggaatacgtagagtagtgctatcaaaagaggtgtatacatgagcttatcggagcagtttttgccagcttttctggaggaagtggtcggtgaccgctttggccgatattccaaatatattattcaggatcgggcgatacccgatgtacgggacggattaaaacccgtacaacgtcgtattctttatgcaatgtacgattcgggcaatacgccggataaagcatatcgtaaatcggccaaaaccgttggggacgttatgggtaattaccacccccacggtgactcgtcgatttacgacggcatggtacggatggcgcagccttggaaaatgagtcacgtgctggtggatggtcacggtaactggggctctcaggatgatgatccggcggcagctatgcgttatacggaggctcgtttgtctccgatcgcaatggaaatgctacgcgatattgaaaagcgtacggttttgttcaaggacaattttgataactcggccaaagagcctgttgtgttgccgtctcgttatccaaatttgttggtgaacggttccagtgggatctcggcaggatttgcgacagagatccctacacatagtttacgcgaagttattgatgccagcattgcggtgatggaaaagccggagattgagctggaagagattatgacctttatcaaaggtcctgatttcccgacgggcggactcattatgggtggcgaaggcatcaaggacgcttatcgcacgggaaaaggacgcatttatattcgttccaaaacggaaattcagtctttgcgcggaggcaagcagcagctggtcattaccgaaatcccataccagatcgtcaaatcaaggctcgtaaccgccatggaaaatatccgtctggagaaaaaggtggaagggattgccgaggttcgtgacgaaagtggacgaaatggtttgcgcatcgttgtggagctgaagaaggaagctgatgcggaagggattttagcttatttgctgaaaaaaaccgacctacaggtggcatataacttcaacatggtagccattgtgaacaaagcgccacatcagcttgggttgaaatccattttggaagcgtatatcgcccatcaacgcgaagttgtcactcaccgtatccagtatgaactggaaaaggcagaggatcgtgcccatgtgctggaaggtttggtcaaagcactgaacattctggatgaggtcatcgcagccattaaagcttccaaaaatcgtcaggacgcacaaaataatttgcaatggatgtttggttttagcgaacggcaggcagattctattttgaccttgcagttgtaccgtctcaccaatctggaaatcacaacgcttgaaaaagaactgggtgatatccagaaaaaaatcgcgcaatatcgttctattctggaaagtgatcgcaagctgatcagcctgattcgcaaggaacttttggaaattcgcgaaaagtacggcattgaccgtcgttcagatatccagggcgaggtagaagagattaaggtgaacctggaagtcatggtgggagcagaggatgtactgctgacactctcgaaagatggctatgtgaaacgtacaagtatgttgtcattcactcgttcaggcggggaacgttcaagttctggtgttaaagaaggggattacgttacccaattgcttgatgtgaatacgctggatgtattgctcgtcttcacccagcgcggacaatattttttactgcctgtacatcaggtgccagagtataagtggaaagagccgggcacacccattgtcaacgtcattccgttatcgaaggaagatcgtatcgtaagtgttattccgctcaaaaacatcgaggaaatcggcaaaagtctagtatttgtaacaaagaagggccaagtaaagcgtacagaattaaaagaatatgctacaaaacgttctagtgccgtagccgcctgcaaagtagcaggggacgatgaggtattatcggtaacgttaagcgagggtacccgggatattatgctgattacccgcgcgggtatgagtatacgcttcaaggagcaagaggttaatgcgatgggtcgcgtctcggctggtgtcaaaggtatacagctagcagaaggcgatgaaattatcgcggcgttatgggtagaagaggatgaaggagaagtgttggtgctgaccgagtccggttatggtaagcgtacgcttctgctggattatcctacacagggaagaggcggcaaaggtatcaccacctttgagttcaaggaaggcaaacgagtacgttcgaatggaactcgaatcgtggctgccttctattgccgtgaagctgttcaattatttgcaatcacagcagaaggacaaacgatgtccttcctttcggaaaaggctcctttgaccgaccgaaaggatacgggcaagctgctggctccagtggagaagaaggacgaaattgtgaatgtgctgctgcgtagtgagccgcaagcttctcagtccatagaataataggaaagtcaagcgcttattagctcgaaaaagagaggtcctctcgtgccattccggcacgaatgaggacctttttgccgtcatggtgtcgaactctgaccagccttcaaaaccgaggtgagacttccttccccttttcatttcgtgctccaaaaacggcaggaaaccggggctgaatggcgaaaatttaatgtgatgaaatacaatccggacggtggcccatacggtaactttgatgcttttactgaccctgttatctaaaggagtgaggcaaaatgcaaacgaccgaatttgcgaaaatctggtccagaatggctaaggattataaggttcatatggagcagcaactggctccatcattaaccgaagctcaacttacggtgctggaggttttgaacgaatacggccgtatgaaaccgtctcaactaatcccatatctcgccaccacaccagccgcggttacgatgctgctggatcggatggaacggaatcgactggtcacccgtttcagagatgtaaaagaccgtagaattgtatggattgtcatttcggatcaagggagagaagaagtagagcgtggattacgaatacgggatgattttctgggttctgcactaaaccgaatttctcagcacaatcaaaatttgctggtttatttgttggggaaaattacaacgaaggcgaagacttcagtatcggcaagtgagactgagggagtaaaggaaccaatagagcgagcagaataactagaatggtggctacatgaaaagtagctgtacgcagcagattatcattttaaggcaaataggagtgcgcggatgtaaatacctattgtggtattcataccgcgcttttttgtgttgaagtatagatgatatttgggtgaatgttgacatttacataagagatgataaaataatagttataaataaataacaattcgtatacaaatagttgcttgtttatgttatatggattgtgaattgggtattagaaagaaggatggtttcagtgagtgacagagaggaagacagacttgaggtgtaccggattattcaatcggtaagggaggttaacaaaacgatattttatgccttctggaatgaggagcagcatttggatctgacggccattcagcatatggctttggcaattctgaataaacgccccaacatcgggttatccgagttggcagacatagcgcatgtgggaagcagctctatgagtggggtggttgaccgcttgaccaaggcgggatatattgctcgcggacggcatgagcatgaccgtagatccttagtgttgacgcttacgccggaagggaaagatatcatgcaaaaagtagacgccatgtggatggagcgcgtcttgcccattctggacatcccgaaggagcagctagagatggtcctagatatccataaacaaatgatcatgaaattaacaccgaagggaatgaatcaacttgagcagtcctcaaatgacactaccaggtaatgtacgcagagcacccattgtggccgctctgttgattggcgcgattgtagcgatattaaatcagacgttgatcagtgtggctttaccgaaaatgatgagtgatctgaatatagatgccaatatagctcagtggctcagcacggggtttatgctcgtgaatggggtattgatcccggtgaccgcgttcttgattgcccgtttctccactcgtaaattgtttattagcgcgatgactattttttcaatcgggacgctgttatgtgctatagcaccaagcttcagcatattgctgatcggtcggcttattcaggccgcgggggcaggtatcatgatgcccttaatgatggtcgttatcttgaacatctacccaatagagcgtcgtggccgggcgatggggaccttggggattgcgatgggttttgctccagccattgggccaaccttatccggttatatagtacagcattatgactggcgggttttgttctggatcatcctgccgatatcagtaatttcaatcgtgatcggatttatttttctgaaaaatgtaacggagcagtccaagccaaagctggacattcccggcatcattttgtctacgctcggtttcggtggactattatacggctttagtgatgcgggaacatcaggttggggaagtattcctgtcctgtctacgcttatcgttgggacaattgcgcttattttgtttattgtccgccaactgaaggcagatgagcctatgctggagttccgtatctttaaatacgatgtgtacagcttgacgacaatcattaatgtgattgtgacgatggctttgtacgccggtatgatattgcttccgatttatttgcaaaatattcggggttttacaccgctccagtccggtatgctgatgttaccgggagcgattctgatggggctcatgtctcctgtaacgggggctatttttgaccgaatcggagcacgctggttgtctgtaattggcttgctgatcatggctataacgacttgggaatttacaaggttgaccgaaacaaccacctatatgacactgttaattaattatacggtgcggatgttcgggatgtcgttgctgatgatgccgatccaaacggccgggttgaatcagcttccgcaacgattgaatgcacatggtacggcaatgagtaacacgctgcgtatgatttccggctcgattgggacagcaattctggtgacagtgatgtccacacaaagcagcaaccgcttgacatcgattgttacgtctgagggactaagcgtgacggataaagcggggatgctggctgcaggtaatcaagccacgatttatgggattaactcggcttttatcattgcaacagcgttaagtgtggccgctctgattttagcatttttcatcaaaaatacgaatgcacaaaacgcccatccccgtcaacagctggtaaacagcaagaaggggcggtccgtggcttcctcgtcataaaaggatgagctgacgcattaatttaattttctgcaaaaaaagaacctggaatgcatgtttgttcacatgcgttgcaggttctttgtgcaaatggggttgaagatcgatattcagatagagcaggactttccgattcaaatttctgacgtaatcatgttctcataaagcgaccttggccattcattccatgggaattggacaggaggcaacgagtgaaatctcatatcgtccttgctaaccggatgcggtgctccagcgagtaaggaccagagcgccagctgttgaccgggtcggctcagatgaccaccatatttttggtcaccgtagaggggacagccgatcgcctgcatttgcacacgaatttggtgtgagcgtccggtgtgcaacttaatctgcacgagactgagtccatctgcttgtccgatcacgcagtactccaaaatggcttctttcgcaccagctgtgccaggtcgaaccgcttgaaccgtgttggttcggctatcctttagcaagtaatgggttagacggccctgtgggtccgtcggaacgccattcagaactgcggtatacagtttgtgaaaatgacgacttcgtaccgactctgacaggcgagaagcagctttggacgtcttagcaaaaatcatggccccacctacaggccgatccagtctgtgaactaagcccaaaaaaacgttaccaggcttattgtgtctgatttttagatcttccttgagtaaagacaacagatcaggatcaccactggcatcctcttgtgttggaacattgacaggctttacaactgccaaaacatgattgtcctcatataggacaggaatgttcggctgtgcatgctcatgccgggtaagttcattttgagtcataagaggaatttaagcctcccagcgtccgagaataccacaaggcaaattcaatcccgagcgtgtgatcggcaatccgatttcaccagcgctaatttgaccgccgtacttttgttgcatggtcatgctcagcatgttgcgcaatacagtaggcgaaatgcctgtagtataggagttaatcagcatgaacagcggttgatccgaaatgatgctcatgcaggattcgagaaacgggtataagctttcttcaagcttccaagtttctccgttcggtccgcgtccgtaagaaggagggtccatgataatggcatcataacggttgccccgacgttgttcccgttgcacgaacttgaatacgtcatccgtaatgaagcgtaccggacggtcagccagaccggacaattgaacgttttcctttgcccactgcaccatgcctttggcggcatccacgtgaactacactggctccagcatacgcagcagcagtcgtggctcctcccgtgtatgcaaacaggttcagtacggaaatcggtctgcctgcgcctttgattttatccatcatccagctccagttcgctgcttgctccggaaaaagaccggtatgcttgaagctggtcggtttaatgtggaatttaagcggtccatagctaattgtccagcgctcggggataggttttttcatatcccagttgccgccaccggaggaactacggtgataatgtccatgaacattacgccattcggctgtttcctgggccaaaggccatatgatttgcggatcgggacgacgcaggacaatatcaccccaacgttccagtttttcaccaccgcctgtatccattacttcatagtctttccactcttgtgctacatacatgtacaatccatccttcagcagtcaattcaggatttaggcagcaagctgcacagaaatccccatatggagtctattgtacaacaaacctcagcaacaatcgaatgattacataaataagtaagtagtcaaatgggtctaaaatattttttctcggatgtacttgtaattatagcgcttccatattaaaatgaaatcaatcccacttgtacgtacaacaatccgtttttttattataataatgaaaaatggattgaattgtacgtacataatatttttttatcaacacagctgaaattctacttaattaaacaaggctctaatttaatgtgcttatccatagagattatcagccaacagtcgcatataatgcggctgttttgcgtatatctccccaagaataaagctagtttttgaaattaatatttgacaatgagaatcattatcaaatattatttgagtaacagggagtgaaagcatcccatatttcaaataaaggtgagggatgaacttgggtaaaatcatgattgcttatgccagtttgaccggtaatacagaggaaattgcggaattgatcgccgagggtgttcgtcaggcagggcatgaggcggagttgaaggcttcgtatgattgcagcgcgcaagaactgcttgcatatgacgggttcctactgggtgtatatacatggggagatggtgagcttcctgatgaatttttggatttttacgaggaactagacgaacttgatttgtctggtaaaaagaccgcagtatttggcagtggagatacatcttatacgcaattctgtggcgcagtggacttggtagaggaaaaagtcaaagaacgcggcgcatcggtcattcaagagagtctgaagattgaattcaatccattggatgatgacaaggagaattgccgagcttacggaagacaatttgcacaggctggtattgaagtgtcctgagaagagagtgagggataggtatgcgcaatagcgatagcttaagcggctttcctcttctgcacgactatcagctagaggagatgtggagaactccacagccaatccgtcaatcacagaggaaaagagggcgtgagggctggaattggcggcaacgggttcaatatgcagtagggcatgcgctcaacgaatactttggaatgggagtaaaggtacggcgggaagtccctgtccagtatgtgctggagaaatggtggcccaagcagtcagacaactttgaatctttgttccattattgggatgtcaaaaataaagtgtcaggtgagttgtcaaaaatttgtggcttaaataatgacttgatggtgcctgtgatgctgtatgaacaattttgtacgtctgtgcctgagttagaggtcaatatttcgcttattgttcaggctgcttggcaactatcagcagaagcagattccctgctcattcaaaagtacatcgttgactataatcctaacgttgtcagtacattccaacatatgacaaatgtattttgttattatgcatttggagctcttcctcagcttattgaggtatactgtctgctggaaggcaaaaaggttcgcttcattccgggacctgcttctttacagcaatctctggattacgtacggctattacgggattccaaagaggatgtacatgggacggcagaacgctgccgttgcggggggtgcataggggagcaagtttctcagggaaacagaatgaataagaacacgaaggaagggcaggaggcgaaaaactgcaaacaacggtcagctgtacctacgcctttctcttaacgttactgtgtaaccctttaattgtaaactatcccttttcgtgaaagaaccttggaaacaaggttcttttttatgaaaaaaaattatgaaaaaactgaaaatttatgttgcctgaatagataaatatatctataatatttcaatgtacaatagttatatgaaaatatttaaatataaaaggcggtttgtggaccatggatcagattgtcctatgtacataagatactcctgtcttttgcatggaatgttgccatgtgtttatttatgttctctatttggtttaatggcctaatatttcaattttaaaatattagcgttgaataataaaaattttttggacaacaggggtggaagaagtgagtaagaaaactgtattgccaatcctcattgtactgctcattctgagcggtggagctattggctactattattggtatcaagcaacacactttgttaaaagtgacgatgcgcgcattcaagccgatcaatataaggtaatgccgcaaatctctggagaaattagccacattgatgtggaagaaggagatgttgttcagcgtaatgaaccgattgccgagcaggatgtatcggggctggatgcgagcatgatcagcaagtccgtactgcgtgcgccgatcaacggaaccgtcattaagatttattcgaaagagcatgaaatcggatcgccgggtagtgctgttgcaactatggtggatatgaacagcttgtacgtatctacgaatattgaagaaactgatattaaccgtattaaaccaggacagcttgttgatattacgcttgatgcagcaggtgaccaggtgattcagggtaaagttcgtaaagtgggcgaagcctccaacgccgtgttctcactcgttcctgcagtgaacacaagtggtaactttaacaaggtgactcagcgtgtgcctgtagagattgctgtgaacaagccgaaggatctgaaacttattcctggaacgaacgtggaagtaaaaattcatacaccttaaaaaggaggggtccatgtggctgccaatgatattgctgctgctccttcgacagattcttccaaagaacgctggcttgcctttttcgctatcgttttaggcgcctttgtcgccattctgaacaacagtctgatcaatgtcgccattcctagattgacgacagatttaggatctacgacgacacgtattcagtgggttattacaggttacacgcttgcatctggtgtaatcgtaccgattaccggatatatggagcagcgcctcggatacaaaaagtttttgattcttgcgctcagcgtattttcgctgggaacgggaatatgtatttttgcatggagtgattcttccctgatcgcagcacgggtgctggctggtctgggcggtggtgttattatgccgctgagtatgacgattatttacaaaattatgccgcgtgaacaaatcggtatgtcccttggtatatgggggatcgccgcaatggcagcgccggctgtagggcctacgctcagcggatatttaattgagtggtttaactggcgattcttgtttattgtcagtgtgccagttgctttatttgcaattttaatggttattcttctaatcaaagaaccgcctaaagtagagccgaagccgtttgatctaccgggctttttgctggcggcaacttgtgccggaacactcttgtacgcattgacaaacggccagcgtgatggatggacttcttttggaattgtatccctgctgtttattgctttctgggcacttgtttttctgatctatgtagaaagcggcaaggataatgctgtaattgagatctcattattcaagaattcaaagtatacgattagtgttattgcctctagtctggtcatgatggggatgtacggaggaacgttcctaacaccgttgtttttgcaaaatatccagcgtgtgtcaccgattgataccggtattatcctcattccacaggccattgccatggcggctatgatgcctattgccgggaagctattcgataagttcggcattgtgcctttgggacttgtgggcctgacgctaaccagctttatgacctatcatcttcaccagcttacgccagatacttcgcatgcctggttggaaaccgtaatggcattacggggtctgggaattggtatttgtatgatgccattgtccacggtcggcatgaatgccgttcatccgagcaaggtagccaatgcgtctacagcgtccaatctggtacgtactgtggctgcatctatggcgattgcggtgttaaccgccattatgcaaagccgttcggctgctcatgcccagcaaatttcggagtccattacaccagactcggctcatgcgcttcaagcgacattgggcagctcatggatgtcatccataagtagtttaattacactggatgctacatcaagaggaattggggatacgttcctcatttcatccataccgctgttttgcacaattccactcatctttttgtttattcagaggaagaaagcaaagacacagccggaagcttaataagtgaagtacaaaatatcgactggatgacttacattatttccacggacagaaagaaagggaattatcatgaaaatattgagagtagaaagtacattagcggctttagtgctcggcggcgcagtgctggcaggctgctccagtaatagcggggcggctcaggacatggtcgttccggttaaaatcagccaagcacagcaaggcatcatcggacagggtaatatttatacaggaacggtaacaccttcggagacggtgaacattgtgcctaaagtgggcggtaaagtggttgaactgcctgtggatattggctccgaggttaaaagggggcaagtactgttcaagcttgatgataaagacatgcggaataatgttgcgaaagctcgcgccgcagcagctgcggcagcagccggagtaagcaccgctcaagcatcccacgaatctacgatggttcaagcaaactcgggcttagtgcagtccaagagcggcgtgattcaatcccaaagcgcaatcaatcaggcacagggggctattaatcaagccactacagccgtagaacaagcaacacatggtgtctcctcggcagccaatacggtgaaacaaacgcagcaagctttggcagatgcacagaagaatgtaacacgtacacaaagtctatttgatgcaggtgcgagcactcaagcacaattggaacaagccaaaacagcagttgtgaatgcggaagcggcttacaataatgcacaaaatgcgcaggctaatgcacaagatcagttggtagctgcgcagaaggccttgactacagctcgcaacagctatgattcagcaaaaaatagctacagtaatgccaatagtggctacagcaatgcgcaaaaccaactcaaagtatctcaaaatactgcggttatcgagtccagccaacaatctcttaagcaggctcagctgaatgtaaacattgctcaggatgcattggatgacaccgttgttacatcaccgattaatggtattgtgggtacgaaaaatgcagaagtgggcgaaatggtatccgctcaatctcctgcgctggtcattgcgaatctgagtacggtcaatacattaatctatgttccagcggaacagataaacaatgtaaaagtaggtgacaaggtacaggttcgtgttgcagcgtccaacattgtaacaacaggtacagttaaaaatgtaagcccgttggatgcaagtggaaaaggctatcctgtaaaaatctcagttgcgaatccagacacaaaattgaaatccggcatgttggctgatatcagctttgtcgctgccaatgcacaagaaggcattgtggttcctactgcggcagttcaaaaggatcaaggtaaagaatatgtatatgttgtaaacggagaccatgcgaaacgtaaggaagtgaagactgttcagacggcaggttcacaaacactcgttaccagtggcttgagcaatgaggagaatgtgatcgtgaataatctggcattgctgtccgataactcaccgattacaattagccaataatttggttctagaattactactatataatagtagaagtttattatagacatatgcgcaagacagcctgcttagtgggctgtcttgttttgatttcattgagcacattttacataggattgatgtcgatataggactatttttgacgaacattggtagaataggatagactaaattggaaatagatagttttcaagatttattacattctcagataagtgatcggaggaattgtaagatggaagtaaaattggtagtggattttgaagcttatgagaatggtcaaacgatggctaaattgcttgaggaactggcagccaagccggagagcgcggaagttacggatctgatcattggagattggggtggagcctatgagagctcaccagatgatttcatcccagtgttagtgaagcttaaagatcatttccctaagttacgcaagctgtttattggtgatatggaatatgatgagtgtgaggtttcatggattaaccagacgaatctatccccgttattagaagcgtttccagcgttggagtcctttcatatcaaaggaagccaggacctgagtctggaaccacttcgtcataaccaccttcaggaattggttattatttgtggcggcctgcctgtgagcgttcttcagcaaatacacaatgcagaactgcctgaactgcgcaagctggaactgtatttgggtgtcgataactatggttttgacggtaacctgaaagatgttttgccgtttttgaatagcaatcctttccccaaacttacatacttgggactgaaagatagtgaaatacaggatgaaattgcaattgtagcagctaatgcccctgtgattggacaactggaagtgctggatctctcacaaggtacgttgtctgataaaggtgcagaagcgctgctggctagtgaaagtataaaagggctgaagcatctggatttgagctatcattatatgtctagtgaaatgatgcaacgttggaaaagctcgggtctatctgtgaacgtggaagatcaacaagaagcggatgaggaagatgattggcgttatccatcactgactgagtaatttgtacaactggatttctaaaacggactgttttcaaaattaatatgatctaaagtgaggcggctctatggttagaatgtcagactgtaatgtcagcgagccgtttatcttgttcggtaatccggggaatcgtcggactaccggattacaggaggcgcgaagcagattaatgcttccacccgctctggaggtttcctataagaatgtgctggaagctattcggcagaaacaaggtctgagcgagctgatggcgcgaatagctgcgcgagctacgcatgatagcgtgaatggcagttcctttctgcaagcgagcattgatcagttactggcggggcagatgaacagtggtccgctgcttcgtctggatgcaccgggcgaaagctttgaggtagaacgtgagttgattgctctgggcgcctcggatggtgagggagacgattctctgttgccatggcccgaatggacacaaggaacaggtatatcggcggcagaagcgcgacgtctgcaggagcagcacggtcgtatttggcacccggcacaatggttccggggctattgccgtctgctggcctggctgcgggatgaagtggctctgctctggccctcgtcatactggatgaacgatccggcggaagtggccgtgatgttcgacaaacggcgttgtagcgccgatttaagcaaggcagatataagagtcccgccagtgcttgcatcttcaggtggtgcatttcatgatgttgtcgatctgcacgcggcaataaaggagagcgggtttcaccgcgtatttgtgaaaatattttgtgggtctggtgcttctggtgtcatggcctatcaggtacatccccatacacacgcggaactggcggtgaccacgattggaacggaaatcatacgcggacagcgcgtgtattataatgccggacgactacgtcgttatacggataagcaggacattcatgctatccttaactggctatgcctggaaggggtacatgtagagcgctggattcccaaagcgaccctgaacgggcgtgtttatgatgtgcgccaactcgtgtgcggatcagaagcttgccatgcggttttacgtttgagccacagccccattacgaatttgcatttgcgtaatgagcggctctcgctgaaggaagccggattaccacagaatacggtggaatcgatccagcatacggcgaaagccgctatgagtgtttttccagcctccatggttgctggactggatgtgctggttccggctcatggcggtcgtccctatgtattggatgttaatccgttcggtgatttgctgtaccgggttgagcatcagggttggaatccatatgaatgggaaatgcagcacctcgttaataggagcgtgggtacggaaaggaaagacagatatgattgatatgaaccaaattgtcggctctcatgatattgtcatgattacgcttgatactctgcgttatgatgtagcaaagctggaggaagagaactgtccgaatttgtgcggctccgggtcgtgggaaaagcgtcatacaccgggtagctttacctatgctgcacatcatgccttttttggcggatttttgccgactccagcgaatacggataagacttcacatatccgtctgtttcacacaaaggatacgggactgcgtacgcatccacatacctggctgttcgatgccccggatattgtgtccgggctagagggtgaaggttatcggaccatctgtatcggcggcgttatttttttcacgaagaaaaataagcttgccaaagtgctgccagggtatttccaagaaagctactggcgtatgaactttggcgttaccaacccccgttcgacggagcatcaggtgaatcatgctctgaaactgttggggaatacagacccgtcgcagcgcttgtttttgtttctgaatgtatcagcgatccatgggcctaatcattattttgtgaagggctcagctaaagattcagtggagtctcaacgagcagccttgcggtatgtggatggtgaacttggacgtttgttcgatgctttacgaaatcggggcaagacgttttgcatggttttttccgatcatggtacagcttatggggaagacggctatgaaggacatcgtctggcgcatgaggtagtctggaatgtgccttaccgcgaatttatattataaagcaaatagaaatatagattgcactagtaaaatatcaaaaaatcaatccagcgcgaggaaggagcagaaatgaaagccatgaatctgaatcactcacatccaacgggtgcggtagccccggagatagacacaaacttagcaccctctaggtttcagtggcctgaaactcctgctgaatgggcacgcacgatccgtgaagctccctaccgctcctatctgtactcttacccgcataaaacggcctatcgttcgtttgatacaccgctctcattgcaggagctgtgggagaaggaggagttagaaagctattttttgtatatgcatattccgttttgcgcggctcgctgtggattttgtaacctcttcactttgccggacaagcgtctggatgtacataaggagtatgtggatgcgctagaaagacaagccaagcaatgggcacccattatgggccgtcggcctttttcgcgttttgcgatcggcggcggtacaccaaccttactggaggctcctttggtggagcgtttgtttgacatagcggaaaatataatgggactggaccctaaacgagcttctatttcggtggaaacctctcccgatactgtgactgaggataggttggaggtgctcaagcgccgcgggacagatcgtgtcagcatgggaattcagagctttgtggaatcagaaagtgccgccatttaccgacctcagaagcccaaacttgttagagaagcacttgagcggctggtggaatacaactttccattgctgaacgtggatctgatctatggcctgcctggtcaaacggtggaaacctggctgtattctttagaggaagcactgtcttactcgccaggagaaatttttctttatccgctatatattcgagaaaatacgattttaaagccaggctataccgggctggaacatgatattcgtcttagcttgtatgaagtggcgcgcgaacggctcaaacaggcaggatatgtacaatattccatgcgccgttttgcaaaaaatgatggtttatccagcaaagagcttttgccctacagttgtcaggaggaaggtatggctggtctgggatgtggtgcgcgatcctatacacgtaatgttcactatgccagccggtacggtgttagtgcagtagctacgcgtagtattatcgaagattatgttgctgcggaacgtcatgatctggctgactacggctttattttaaatgtggatgagagtaagcgacgctttatcttaaaggcgcttcttcatcgggaaggtttggagctatcggcctatgcagagcgcttcggtgtatccctatcggacgattttacgggaatgtcattgctgctggaatccggtatggctgtcgtcgaggagggtaggctgcaacttacagaggaaggaatggcctattccgatgcgattggggactggatgatctccacatcagtacgtgagcgcatggaaggatatgtaggcgcatgagagcgaccttatattatcgtggttcgttgacctcgtgcaactatacctgcccatactgcccgttcagtaaaaacgttgatagtcgggaaacgttgaacaaggatcggacccagttggaacgttttgccgattgggtacgagaacagggcgctctggggcatcgtctctctattttttttaatccgtatggagaagccttgattcattcctggtatcgcaagaccatgattgagttttcccacatggcacatgtggaaaaagtggcggtacagacgaatctatcgactaagctggattggacgcaagaactgaacccggagactgctgcgctgtgggctacatatcaccctggagagacgaaagagcaagtttttatatcgcaggctatgaagctatatgaacttggcatttcctatagtgtcggtaccgtcgggttaagacaggcatttccggctattcattccttgcgatcgaaacttccaagagatgtttatttgtggatcaacgcctacaaggatcgtccacattattatacagatgctgaggttgctgaattaactgcgatagacccctattttcaatggaatttaaaggattatagcagtcaggggcgggcatgtcgcgctggtgaagatgtattttatgtccagggtgacggaagagtaaaacactgctatcaggatcgacgggtgctaggacacttatacaggaatggtcttgagggtctaagtggcaaacgtccgtgccggatgaaagaatgcggctgctatatcggctatattcatatggaggagcagccgtttcgggaaatgtacggtagtggcttactcgaaagggtgccgcaggtacagctatctccggctccatcctttagcagacaggctactcatagagcaaatgaatccatataacaaggtacgtccgcgtctaaatgtatgctatagcaaccttaatgatctattagaaaacgagcaaaaaaaccgacccttgccatcaagcaaaggtcggttcttcttatgcgaaataatcaagtttggacaatagcagtaatttcttcatccagatccaatctgatttgttcgcgataggcacgaatattgtattcggaatacagatatctcagaattgcttcaatcatgttggcttccaccagatattgactacggccctgtacatggacttctgcggaataacctgtatcctcttcccagcttaattctactgtcacatcggtgggctgtacacctttgcgttcagccatatgcaagcaaatagagttgacaatttcatccatactcaaaatcatagcttagtaacgtcctccgcgggaatcatcgggtctgcgacgatttttaatagcacggtagatacctactccggccatgatcaggacgtaaatggcgagaacgttaacggccagaccaagcaagctacccaatgcgcccatgttgccgaacaatccgccgaagagcatacctgccaaaccgcccagcatcatacctttcaggaatccgccgccaccgccaaggaatccaccagttctgtttgtattcccagcagttgctcctgacttggttccgctatctgacttattgacgccactgctgtcatttgccttgcttggtgtagattggtatgatttaggcccggatttaaacccgccgcctcgccttgcatcagctgtagatggtgcgatcatagcaatgagtagggtaaaagccatcatcagcatcatcatatttttcaaagtaaatgtttttttcatgtaaatatatcccccttagtaaattttttttataggtcaaacaaccgctaatcagtaatacgaatggcatggaaaagggtttcaaagaattttaatttttaaaaattaaataataacgtcccataaatcctatgcatggattggtaaaagcattcagctttgcggcttaagtaaaaacggattagtatccgtactgacatcaccggcaagcagcatacgcagaaccatttggcaccattccagacctgctttagcattcaaaagtcctttttgtactaaaatatagtcaccaaaggtcttactgccaaaatgtaaattctctgctggaatgtcgttcaaaatatcctcaagatgctggattttctgaataaaatgacgtttgcgttcctccagcatacgattggcactacttttgtccgtcaaccaaagacagaacagtcgaagacttaattcatcccgtgtaaccggagcagctaacgcttcctgggaccattgctgaagcatatggattcccttgtcggtaatggtatacattttcttatcaggcttgtcggactgctgaatccaacgagaggctagcagttccttgctctccatacgggccagtagcggatagatctgactgtgcttagcctgccaaaaaggctgaatacgcaacattagatcatagccggaggattcctctcttgcgagaagccccaacagaccatacgacagtaaattcatagatcttatctccttcatccatcatagtaacggttgtaacagcactgcggcaggtattctgcagcttcatgaaaagtgtacactgaaactgtatggtttgacaactttcagacaggtcgttcacaggttagccaaaattggctcctgtcattctccacgtatatgcgctttttttcataaaaaagggtagtttaggctcgtatgtacgagcttaaactaccctggtaactttctgccgaagcgtatcctgtttactgttcattcccgtcaacgacaagcgttaacgctcctgtatctggatgaataaccatgccgtgaacgggggcattaggggggagaagcgggtgattcttaataagcttcacggtagttcttaccccttcttcaatgttatcaaaaccttttaaccatttatttagcttaatgcctgaattttctaatgtgttcagcacttcctgagaaattccgcgatcgagcatttcattgaccatgtggtctgcatttaatgcagccataccgcattcataatggcctacgacgacgacttcgtctgctcccagctcatacagggcgactagcacactgcgcattacgcttccaaagggctgtgaaataatcgcacccgcatttttgatgattttcacatcaccgttgcgcaggttcatagcttttgggagtaattccgttagccgtgtatccatacaggtgataatgaccatttttttattggggaacttgcccgttctataggcctcgtattctttgttttctacgaaaacacgattgtactctaaaatttctttgatgtgatccacgattgttccctccagattctaataaagtttgatatgtacagtccaacgtttgttttaggtcttaggagctggtcgtacatgttgtgtgttgattatactttttaatataagtatcatcaagtataggtattgtaaagttttaaccattttaagttaaagaggtgacctcaaatatgacgcaacagacgttggatcaattgacggctttaaaggagcttgcacacaaaattagtagttatggcgaagcagtaggtctgctgcactgggatttacggactggcgctccgcgcaagggcgttgatattcggtcggagacgttgggtatgctgtccactgaaatgttcaagctgatgatctcggatgaaatgggacaattgctgcaattttttgccgtagaagacaagctgaagcaactggaggacaatgatcgcagattggtggaggaatgccgtaaaaattatgaactgaatcgttcggttccggcagaccgataccgggattatagcattcttgcagcacaggcagagagcaagtgggaggacgcaaaggaacatagcgattttgccggatttgaaccgtacttgtctaaaatcgtagacatgaagcgtgaatttatcggctactggggggttaaggatacagagtatgacacgcttttggatcaatatgagccggggatgacggttgaaaagctggatgctgtgtttgatcgtctcaagaagcgccttgtacccctattgtctaaaattcaggcttcatcgaaccagccggataagagctttttagatggtgtgtttgatgtgaagcagcaggagaagttcagcctattcattttaggacagatggggtatgactttgacgcaggtcgtttggatgagagtgtacatcctttcgcaacaggattaaatccaggtgatgtgcgtataacaactcattatctgcaagatgatgtaaccagtgctattttcagttctttgcatgaaggaggtcatgcgctgtacgaacaaaatattgctccagagctggcaggatcactactgtctggaggaacctctatggggattcatgaatcccagtcccgcttgtgggagaataaaatcggacgcagtcgtgctttctgggatcggtattacgatgatttgcaaaagcattttcctgatcgtttggcaaaggttacggcagagcaattctaccgggcagtcaaccgtgtggaaaattcactgattcgtattgaagcggatgagctaacatataatttacatatcattatccgttatgaaattgaaaaaatgctgtttaatgaaaagctggatgtgaagcgtctccccgaggtgtggaatgcgaaatataaggaatacttgggacttgttccaccgaatgacggattgggcgtacttcaagacgttcactggtccggcggtgattttggttattttgcttcctactcacttggcaatatgtatgcagcgcaaattttggcgacattacgcaaaaagttgccaaatctggatgaattaattgctactggagagcttgagccgatcaagcaatggctgaccgaacgtatttaccgttacggcaagagtcggacgccgtccgagttgattgtagccattacaggtgaggatctgaacccggattatctcgccgactatctggaagagaaatatacctccatatacaagctgtaaatcatatagcatctaccccgcgttcccgggcgaacgtgggttttttttttgcaattaaccaatatatcgacaatggcataacaatatatgaagtcaaccgatgtaaaaaggtggggagggaataaggatgaaaaacggcgctcgtttcaaagctgtggtggctgcggcactactcggattactgttgctcagtgggtgcacccccaaaggaggggagcagacgattgagatcagattaggcgaggtagcccgtacggtcttttatgcgccgcagtatgtagccttgagccagggtatgtttgctcaggagggactggatgtccagctggcaacgattcccgggggtgacaaggcaatgacggcgttgttatccaatcaggcggatatcgcgctcatcggcgcggaaacatctatttatgtgtatcagcaaggagcagaggaccctatcattaattttgcccaactgacacagacggatggaacctttttgtttgcccgtcaaacgcaggatagctttgaatgggaaaagctgagaggacaaaattttttggggcaacgcaagggtggaatgccgcaaatgtcacttgaatttacgcttcgcaaacacggcattgatcctcataaggatctgaagctgattcaaaatattgattttgctaatgttgcctctgctttcggctccggtacaggggattatgtgcagctgtttgagccgcaggcatctatttttgaaaaggaaggtcgtgggcgggttgttgcctctatcggtgtggagagcggcgagttgccgtatacggtatttatggctaagcaaagctacctgaacacaaatagcgaggctgcacagaaatttacaaatgctgtatatcgggcacaacagtggattgctacgcattcacctgaacagattgccgaagcaatcacgccctattttaaagatacagattcagctgttttagcgagtagtatcaagcgatataaggaacagagtacctatgctttgaacccgatgattgaggaaaaggaatggaagaacttacaggatgtcatgacctcggcaggggagcttaaaagtccggttgcactagataagctagtgaacccaagctttgcacaacaagcgatttcgttaagctctaccgggaatactgaaccgcctgtgaaaaagagcacaactgaatctacggatgcaggtgtcggtgctggaggttcgtcatgatggaggaacggagtggcctaactttggacgcgaccatcccgatggtgagactgaagcaagtaacgcatgtctatgtaacggatcgtgaagcttcgctggcggttgagaatattgatttttccgtagagacaggggagtttgtcagcttggttggtccaagcggctgcggcaaaacaacgatcctgtccatgatcgcggggctactgcgtccagcggcaggccaagttatgttgcaaggtcagccggtaagtggtccgagtccagaggtcggttacatgttgcagcaggattatctgttcccgtggcggacgataatggataacgcattgttgggtctggaactaggcaacagagtagatgaagctgcgcgtgagcggacacggctgttactggaaggcatgggtctggaagggaaggagcatctgcatccatcccagttgtctgggggaatgcgccagcgcgtggcgctggtacggacgctggcgaccaatccgggactgctgctgctggatgaaccgttctccgcgctggattatcaaaccaagctacagctggaagatctgattgcggaaaccttgcgcgagcggaggaagacggctattttagtcacacatgatttggccgaggccattgcggtcagtgaccggattatagtgatgggtcgaaatccgggtcatatccgacgtaccttcgagattccggattgcatccgagaagctcagcctttttatgcacgcgagcagccgggttttaatgagctttttcatgaaatatggggtgaactggaggcttcgggagcaaaggagtgagttaacgtatgaaggacgaagcggatcagcttgagcaacgttggattcaaggactacatcaggcgtatttacgcagcaggcgttcgcaacgatggttagtgacaggtgtgcagacagctattttactgcttttgtttgtgctatgggaaattgcaggccgtttgaagtggattgatgtactactgttcagctatccgagcaaaatttttacccagatcggtaaggatgcggtcagtggtgaattatggggacatgtaggtgtcaccgtgggagagacgatggcggggtttttactcggtacactgttaggtacgttgctggctgtacttatttggtggtcaccgtttttgtcgagggtgcttgatccctatatggtcgtgttcaacagtatgcctaaggtggcgctaggtccaatttttatcgtcatgtttggggcgggatttactgctatcctaatgacaaccctctccattaccgttatcattacgacactagtcgtatacaacagctttcaggaagtcgattcgaatctgatcaaagtggttcgcacgtttggcggatcacgccgtgatacgtttcaaaaggtgattttacctgcatcctttcctgcaatcgtctctacgctgaaagtgaatgtcggtatggcatgggttggtgtgattgttggtgaatttctggtggctaaaaacggcttaggctatttgattatctatggttttcaggtgttcaatttcacgctggttatgtccagtctgttgatcattgctgtcgtagctacactgatgtatcaggcggtcgtgtatgtggagcatcgtctgctttctggtcgtcctcatcggtaataataaaatttctgaacatttgtgtaaaacgtgaaaataaagtaccatgaaaaatgaaaatacttaaaaattatgaaaatgagcattttgtataaatttcgaattatgcaaaatgctgaaacagatttcatctagagaggacagaattttttcatgggctttcgtacgattaaaacggctattgccgcattaatggccgtacttattgcggagggttttggcattcatggagccacctcagcagggcttttagcgattttgggggtggatgtcacacgcaagagaagtctccgtaccatttcggcgagattttttgcatccgtcgtggggcttctttttgcttgtgttttgtttgtggtattcggattccatgattgggtactggcattatatattttaacggcgtttccagtcattgtacgggtgggatttaaagaagggatcgtcaccggttcggtcgtagtttttcgcgtattcagcggcggcgtgattgatatggaggtactgctgacccagctagctctgctagtgattggactgggttccgcgatgattgtcaatttagcctatatgccgggttctgataatacaatgcaacaaattcggcaggaggtggatcggacattttctgttatattcagaaatatggccaatacgctgcgtagtccagcatacatatgggatggcaaggaagttattgaagcgaacagcgtgatagccaaaggggttactgaggcggggcgttccttggaaaatcagatgcttcgtccccaagagggctggaatgtgtatttttatatgcgaaaagaacagctggattcgatccaaaacatgatgcagttgatcgcacaaatgtatcagcatatgccgcaggccaagcttctggccgagctgttcgaccagcttagcaatgacgttttggctggacattatacgggacagaccgagaagctgctagagcaggttcgtgaagaatttaaagccatggagcttcccgcaacccgggaggaatttgagattcgctcggcattattgcagcttacacatgagcttcatcagtatttgaaaattgcgaaaaaggacaaggcccctactccagtaaaaaattagagtaaaggccttgagaggctactatccgtgacggacagtagccttttcttgttcagtaatggtagaagccgattgactcaaagtccgtttgtgccgaattcggtctgtggtccataagacagcggtgatcaggcaagggtacagcatagcccatccgacaaaggggaaaacgatcgccgtagagatgaacgatatccagctaatggctacgccccagcaactaccacgtagaagcttaattcctgctgcacaaccgccgagataggtcagaataaaggtggcgttcgggaattgaatcaggttagtgagtgaaacagcgccactaccgtacaacaccataatgatcacaaagcacacgctaagaaaagcaatgcctccgataggggtatggaaacgttgcgataacctgcccatccagcgaaaggcctgtccttgccgggataaagcataagcgacacgtgaagcggcaccaacataagcaataatagtagcggtacaaataaagatacccgtcaagccagcaattatcgcgccccacggcccgatagctcgactaatcacccatacgagtgaagcatccgaatcccccgcaaggtaactttgtgttcccacagtagccagcgcagtaaagaaataaagcaaaccgacaatgacggctgcaatggtcacacctctaacggccgcccgctggggattggtgaattcctctgacatatgggacacggcctcccagccgataaagcaccaaaacagaatcgcagccgcttgaccgatggagagccagccatgtggaacaaacggggtgaagtggactgttttcatctgaggaagtgctgcggcaatggcgaatataaggacggcaacgatagctatgacgactgcgatctgaatacgtcccgcgaccttcatgccgatccagttgatgatcaggcccaccgccagcatagcagcggctaacattatgcggctttcctctccccagcccatggctgcggtcatatagccggctccggtgagtgcggcaacaggtgccccaatcggaaccgacatgagaaaaaaccacccgatataagcaccggcacgtggggaaaaggccaacgtgacaaaatgcgatacccctcccgcattcgggaatttggcggatagaagacccatggaaagtgccattggcaggatgagcagggtcataaaaccccatgccagcagcgatgccggccccgccatttgggcagcaagaccaggcacaatcaatatccccgaacccagtacagctccgatatagagagcaatggcctgtggaagaccaatggtggattgaagtttactttcatttgtcatgcagaaaagccttctttctcttgttattttctccagcttatcagataatcaatctatcggaaaaacggaatataacgattgcttgcatcggaaaaaccgattgaaggagcggattatggaatcgcggcatttgtttacctttttaaatgtagttgaggcaggcagttttacgcgagcagcgcgtatactggattatgcacagtcgagtatcactgctcaaattcaagcgctagagacagagttgggtacgccgctttttgatcgcattggcaaaaaaatcatgctgacggatgccggacgacgtctgctgccctatgcgcaggaaatttccaaaatgcatgctatggctaaggatgcgcttcgttcagaaacagaattggcgggcacgctgaaaataggagcaccagagtctctggccgcttttcgtctaccaagtctgatccgtgagtacagagaacggtatccgaaggttaaaattgtccttaaacccggcgaatgctgggaattacgcgatttgatccgttccggtgagcttgatttggcttttttgcttcagcctgagacggaggatagagaactgaatgtcaccacgcttattcatgagccgatggccttggttgccccacttaagcattcgctggttacctatacccgggtagagcctgccgacttgaaggatgaaactattttgcatacggaggcaggatgtacgtaccgcatcctttttgagcagtatttgaataaacacggtattttttcagaccctagcctggaattttggagtattgaagccatcaagcagtgtgtcatggctggattgggtatagcgctgcttccgctggtaacggtacaaaatgagctgcgagaaggtaaaatggcgcgtttagcctgggatgacagtgaacagcaggtggctactcaggtcgcttaccacacgaaaaagtggaaatctccggctcttagtgaatttttacagatcgttgagcagcatgtaacacattggcgtgcatgagttcaagccatcgcggcatatgcttatacaaataatattttttccttttcgcctattcactcaacattcgcccacaacctgcatacatatgtatggaatgattgattgtatggaggaggttcaagaatggcattaagtcataaaaatcgtagagagattattaccaaagcgatctgtggtaaaggtcgcagattctctaccgtaacccataccgtaactccgccgaataatccaacgagcattttaggggcatggattattaaccaccagtatgaagctgtggcggcgggggacggcattgaggtcgtcgggacgtatgatatcaatatttggtactcatacgataaaaactcgcagaccgatgtggccaaggaaacggtgtcgtacgtagaaaatgtgccgctctcgtatcttgatccgaagcaccgggcgtctacagtggaagtatccgccgaagctacacaggagccgagttgcgtcgaggccagtgtgtcttctggaggtggcagcgtaatgatccgggtcgagcgggaatttgcggtggagctggtggcggaaacgaagattgttgtagaagtattcccgaatggtagcagcgatgattttgaaaaagactttgattttggagcggaagagggggactatgaggagctcgaccccgacctcattgacgacgagctctgacagaagtaaccaaaaagagggccgctttactctttgcgccggctgattctgcgcagggggcaaaggccctccttttttattgtttgggttgaaattggggtgaaatccgtacgtagtccgtagggggggatatgatgcagcagccgggacaggcgctcatacgcttcagacagatgccaaatgatgaaaaaaagcgtagactggagcgctcaggcatagcagtgcagtggatggatagcagccttgcagattttgcgataggctacgcggtgcaaatccatcaactgcgagtgctggaaattcgtagacgtgccatcgagggatcttccaaagtccgcgcatacgatctttctgagctggatcaacattcaccgctctatgtccggatggagcggctggctgtacgtgcgttgtacacactgggtttggacagtggtgaggtggtactgacgccgctaggggagcgcagctgtcaggtgcgcgaagtctcggcacagccatggctgaacgatagacgtttggccacgttatatgaaattgctgcgcgtgaaggggatattgagggtgagaatctttcagtggaacgagggagagatcgactactcattggaatggaccccgaatttgtgctggttcgtatgccagagggacgggtcgttccggcctcaagatatttgggccgtctcggcatagccggctgtgatgcagttacccgccggggacgaacgctgtatccagtcgctgagcttcgtcctgcgccgagcggagatccggcccgcctactgaagcatctgcgtcaggcttttgcaacagctgcccggcgcattgttgaccgcacactcatctggcaggcgggggggatgccgcaaccgggttttccgctgggcggacatctgcatttcagcggggtttcgctaaacggtgccttgctccgggcactggataactatttggcactgcctttggcgctactggaagacaagcgtgcggcccggcgcagaccgcattatggcaatttgggtgattttcgccgtcagtcgtatggaggctttgaatatcgtacactgcccagttttcttatttcgccacagctggcgaaaggtgtgattggaatggcgtttctcattgcttctcaatatccgcgtttgcaacgtaggccgctgggtcaggaggaggctcacagagccttttatgaaggaaatcaatctgtgcttaaggagtatatggaacctcttattttggacatggtttcactggaaatatactcgcaatatgaggcttatataagcccattgctggacagcctccgcaaggagaaacagtgggatgaatcacgggatttgcggccgtattggaagcttacgtaaaatcaagtgtcgacaccaggaacggtttcatgttatcgactgtcatttttgatataatgagagataattataagtttaaacggaacaaagtgtgggggttagtgaacggtatgtccaaatatacaccgatgattgagcagtatttatccataaaagagcaggctaaagatgcatttttgtttttccgtctgggagatttttacgagatgtttttcgatgatgcaattcttgcatccaaggagctggaaattacacttacgggtcgtgagggtggtgccacggaaaaaattccgatgtgcggcgtgccttatcattcagctgaaaattacatacagcgtctcattgagaagggttataaggtggccatctgtgagcaaatggaggaagcctcagctacgaaggggatggtgcgtcgggatattgtccgcgttgtgaccccgggaacggtaatggaaggcaaggtgctgggtgacaaatccaacaactacatggtatgtgtcacagagacggacgggatgctagcgcttgcctcgtgcgacttgtcaacaggtgaattgtatgtgacttctgtgcctgattcgaaagaatggctactagatgaaattaacatttatgagccttccgaaatgttgggagatggtcatctgctggattttgtgacatcccgtatgtcccccgttggacggcgggttgtgtatacggcctgggacaaatccaaggatgatttggttcgggatcaatttggggaagccacgtgggcaaggcttacgaaggaacgcagacgatgcgtatcgcgcttgatttcctatttgaatgaaacgcaaaaaagatcgctaggccaattgacccaaatctcggtatatgagccaaaccattttatgattctggatccatttacccgcaggaacctggaactggtggagacggtacgggaacgctccaagaaaggctcgctgctgtggctgttggaccgcacagagacttccatgggagcgcgtctgttgcgtcgttggattgacaagccactgttgagcagcagtcttattgaggaacgcttggaggctgtggacaagctataccaccagtttattttccgagaggatgtacgtgctcagcttaaagagatttacgatctggagcgtctagttgggcggatcgcctttggtagtgctaatgcacgtgatctgatcgccctcaagctgtcgctggcccaaattccttctttacgcgagctgtgtgctgaatctccttcgaagacgctgagacagattgcacaaacgctggatggctgtacagatctgtgtgcgttgattgaggaagcggtggcggatgaaccgccaatttccgtaagggatggaggtcttattaaggaaggctaccatcagcgtctggacgaactgcgcgaggcgagtgtgaacggtaaacgttggatcgctgagctagaggccaaggaacgtgcagcaaccggcattcggtcacttaaaattggatacaacaaagtatttggttattatatcgaggtgaccaaatccaatttggcttcattaccggaaggtcgatatgaacgcaaacagacgttggcgaatgcggaacggtatattacaccggagttgaaggaaaaggaatctctaattctggaagccgaggataaaatggttgatctggagtacacgctttttaccgagcttcgcagtaaactaaacgctgaaattccccgtttgcaaaagctggcagagcaagtggctgaaattgacgtgtatcagtcgctggcatcggttagtgcggaacggggattcgtgaaacctgagctgactacaggatatgatttcgtagtggagcaggggcgccatcccgtggtggaagccgtaatgaaagatggcggttttatcgccaacagcacggtgttggaggaagacgatgcgcatattctacttatcaccgggccgaacatggctgggaaaagtacgtatatgcgtcaggttgcgcttattgcaattatggctcaaattggctgctttgtcccagctgcacgtgccaaggtgccgatgctggatcgcattttcacacggatcggcgcggcggatgatctcatcggcgggcagagtacgtttatggtcgaaatggcagatatccaagtaatgacggacaaggcaactccgcgaagcttgatcattattgatgaactgggacgaggtacgtccactagtgaagggatggcaattgcacaggcagtcatcgaatttgtccatgacacgatcggctgtaaggcgctggtatccacgcatttccatgagctggcgcatttggagcaaggcctgtcttcgctgcgaaattactctatggccgtgcaggaaagcggcgacaaggtgaatttcctacgcaagctcataccgggagcggctagcagtagctatggcatttattgtgcccggcttgcaggcttgcccaataacattattgagcgagcgaatggactgctaaatggttttgaacaggcagcagctcaagtaacggcaggtaccgagatagtagtaggagggaaggaagggactgatcttcgtacagtttcagggacggaagatatttcttctttgaccgaatataattcaggccagacattgcgagaaagcggagaaactgcatcatcaactcagtctttatcacagcaggccaccctggtaaaagaagatactctacagactgtggaggattccagcaggttggagcaaggagcaaccgaagtggtacagctgtccattttcggagagcaggagcttgccgcctccaagccccatgcagagacagtagaggctaacccgattgtgcgccaaattttgcgtaaggtgaaaaatgctgatgtcatgaatatgactcctttacaggcaatgcagctattaaatgatcttaaaaacaaggccaatggcctgtagttcaaataggtgacattattcttatttttcatcacactttgaagtcaggaggaggttaaaaggatgtctaaaattcgggtactggatgaacatattgcgaaccagattgctgccggtgaggtcgtggaacgtccagcctccgtcgtgaaggagctggtggaaaatgcgattgatgcaggcggtacgcgggtggacgtatgggtagaagagggcggtctgcaaagtatccgggtgacggataatggaagtggcattgagcctgaggatgtggagacggcattctatcggcacgcgacaagcaaaattggacatggtcgcgacctgtttcagatcacaagtctcggctttcggggagaggcgttgccaagtatagcggctgtatcgaaagtggagttgcttacagcagccggagatgacgggcgtgcccgtaaattggtgattgagggcggtaagctggtgcttcacgaggatgccgctagtaggcaagggacggattttaccgtacgggagctgttctataatacgcctgcacggctgaaatatatgaaaacaatccagaccgagctgggacacatttcggatgtattgtaccgaatggcgctttcgcaccctgaggttgccttcacattgcggcataatggcaatacattgttgcaaacgctgggtaatggtgatttgctccaggtgattgccgctatttatggaacttctgcggcgaagtccatgctgctgctggaaggagagagcctcgattaccgaattagcggctatatcagccgcccagagtggaccagatcgaatcggaatgcgatatcgacggtagtgaatggacgttttgtgcgtagctacgggcttaatcaggcgttgctcaaggcgtatcataccttattgccgatcaatcgttttccgctggctgtgatccaactggaaatgcatccttctttggtggatgttaacgttcatcctgccaagctggaggtaaggttcagcaaggaagctgaactgtttcagttggtcgaggattcggtaaaagctgttttagggcagcaagtgctgattccgaaggcagtcaagcgcgagatcggtggcaaggacagtggctcgtttgtgcaggagcagtttcacttctcaaagggaaatgctacggaaggggatgctccttccgacaaagaccgggggggagcactgccactttccgtgacctcgccggagaaccaggtaccgggccaatccaattacttgaacagaaacgaagagaataacagaggtagccaggagcgtgagcaacgtccgagcagggatagcctctcagctattggacgggcaaacaacctttcaggtaaaagtattagtgatgatgaactggatgcagattttgtggaagaaaacaacgggagtgaagttagaggggacgtgccgctccctgatggagcgactgtacagtcgcctgaaggagataatgccgcaataggcccatcttctttatacagtggagggataaaggaaacggctgcttctgctgcttacccatcttctgtgcctccgattgcaggacacgctacggattcccgtcatttcgcggatcagaagcctcgccagcaacgtctgaatgcagagcaattggcagcggtgtcgggagaagttccagagttgcccacttttcctgaactgaatttaatcggtcagcaccacgggacatatctgattgcacagaacgaccagggcttgtatttaattgatcaacatgccgcacatgaacgagtcaattatgaattttattatgaaaaattcggtaatcccgagtcagtatcgcaggaattgctactgccaattacactggattttacgccttccgagacagaaaagttgaaaacaaggctgcactggtttgagcaggcgggggtgtatttggagcattttggcggtcaaactttccgtgtcagctcttacccgtactggcttccccaaggggaagaagcggatgttattgaggaaatggccggatgggtgctcgaggaaagagccattgatcttgcaaagctacgggaagcagcctcaatcatgtgctcctgccgggcttcaattaaggcaaaccagaagctgactgaccgacaggctagcgtgctgctagagcgtttggcagcatgccaacaaccatatacttgcccccatgggcgacctattgtggtttccttttccacatatgatttagagaagctgtttaaaagagtaatgtaagggagtatatatatgttgcaggatcgggaaaaccatgaagaagagcgatcgaggctacgggagaagaaagtcgaattactggtcacgacaggagattccccctcggctgaggttgtggagcgagcgaagctgcttgcagccgagttaggggtgttgtatgcccctcgtcgtggcatatcggtagctaagctaatcgcggttcacagagtccgccaagcattggttctggtgcagggcggagtgagactgatcagcccagaacaatcaccgatggtttttcatccgagtatgggcttcattcgcgccaaacgggtattaaagggtgaacctgacccgatgttgacggctgcccggctcgtcccgggtgatactgtactggattgcaccgcaggacttggtacggattctcttctattttcaattggaacgggaagctctggacaagtcacggctgtggagagttctttccccgtctatgctttaatcaaggatggaatgaggcattaccgttccggcaacgctgaagtagatcaggccttttccaacattgacgttcgttttggtcatcatttgggctatttgcgcagtttgccggatcgcagtatagatattatttattttgaccctatgtttcgtgatccgttgctcgattccagtgcaatcggtccattgagagggttggctaatccagacgcgttgaatgaggaaagtattgttcatgcgaaacggattgcacgaaaaacaattgtattaaaagaaaaacggggtagcggggaatttgcccgcctcggcttccgtgtagagcagcggggcacaacgaaaacagtgtacggagtgattgatattgacagtggcacctaagcctaaattacttgttcttgttggcccgactgcggttggcaagacgaaactaagcatcgagatggctcgacaatttgacgcggaaattatttccggggattccatgcaggtataccgtcatatggacgttggaactgccaaaatttccaaacaggaaatggaaggaatcaagcactatttaattgatattcatgagcctgaatacccatattcagtagctcaatttcaggaagactgtcgtcgtctcatacctgatattcaatctagaggaaagctaccgtttatcgtaggcggaacaggtttatatgtagaatcagtctgctatgaataccagttttccgaggtgggggctgacgaagcttttcgtcaggaacagcttgactatgccgaacagtttggagctgacgcgcttcatgcgcgactacaggcggttgatcccgaaagtgcacttcgtctgcatcctaatgatcgtcgtcgtgtcgttcgggcactggaaatttaccatgttagcggaacgacacttagctctcaacttgccagtcaaaaaaaggaatctccctaccaactctgcatcgtaggtttgacaatggataggcaaatgctatataaacgtattgaagaccgaattgacgggatgctcgatcaagggcttgttgctgaggtaacctccttaatggaacggggagtgcgaagcgatgccatctccatgcaaggtctaggctataaagagatatcctcctacctgcggggagaggtgtctttggaagaggcggtgacttggctaaaacgggatacgcgtcattttgcgaagcgacagctctcgtggtttcgccatatgaaggatatccagtgggtagatgtcactgatttcggaaatttttctgctcatgcagcccgaatacacgaaattatagcaggaaagttccggacagaccttgaatatacttcaaaacaatccaaatgattattgggggtacggctaaaatgaacaagtccattaatatccaagatacgtttctgaatcaattgcgcaaggattctatacctgtaacggtatacctcatcaatggatttcaggtgcgagggacgattaaagcatttgacaattttacgattgttatcgactcggatggaaagcaacagctgatttacaagcatgccatctccacctttacaccgcaacgcaatgtatcgcttgtacagcaacaggataacgctagcgataactgattacggcttgacggtcgcccgggttcatgaaacttttcaggcgtccgtctcgtctaactgtataggaatgtgaccgggagcaacctgatcagggttgttcttttcattccgtttactttcatgctgccgacagcaagctttaggcttatgttaggtatcatatgattattcgcgaaagggagtcaggggaatgccaaacgattcattgtccagatccggcaatcgcaatagaaccacatctaaagagaagccgaagggcaagaaaaagaaaataacaggtaagcgagtggggtggacgctttttattacagcggcgttagccatattttgcgcacttggcgggtatttatttgtcatgataaatggtgaaaaaatttacgaagccaacaaggacaaaattacagtgaacgagacatcgaaggtttatgatcgcaacggtgtcctcatgggtgagttgtctgtgcaaaaaagcgatcctgttaaaagtgaagaaataccagatctgctgaaaaaagcttttgtggcaacagaggataaacggttttatgagcatcaaggggttgatatttggtctatcggtcgggcggccgtaaaggatatcgtggctcgttctgcagtggagggcggcagtacgctgactcagcagttggccaaaaacttgtttttgacacgtgacaaaacctttttccgtaaagcgaccgaggtatccatcgcaatggcgctggagcggaggttgactaaagatgagattattaccctttatctgaaccggatttggtttggacgctcgtattctggaattaaggcagcgtcggaaggctattttgggcaaacgaacttaaaagatttaaagttgtggcagattgctacactggcagctattcccaaagggccatccaagtataatccgatcagtaacccggaaaactcgaaggcacgacgtgcggtggttctccagctgatgtttgagcaagggatgattggaaagcaagagatggaagaggccaaggctgtaaattacaattacaaacaaccagaaaaagttcaaaagtatcaaaatttcatggaatacgtcatggatgaggcagaggatgcactgccaggagttagcggcaatgatttgattattggtggttataagattcatacgacaatggatgcccaggcccaaaatgcgctggatcaggcgatggcagatgatgacatgttcgaaaaaagtcctgacgatcagcctgttcaagcctcgatggtcattattaacaaccaaacaggtggaattgccgcgatggcacccggacgagattataaaaagggaaccttcaatcgtgcgacacagagccgcagacagccaggatcggctttcaagccgattgtagcctatgcgccagctcttgaatccggtaaatttacggtggatacccctttgagtaacgaacgccagagttttaacggatacagtccgaaaaacttacatggttactcatcaaccatcagcatgctcgatgccattacgaagtctgaaaatattccgcctgtatggttgctgaaccaaatcggtgtggaaaaaggggttcaatttgccgagagcgtaggcattccgatggacaaaaatgatcactcacttgctatcgcattgggtggattaagcaaaggaacgaatacccttgaaatggcgcaggcctacagcgcttttgccaataaaggacaattccaaaaggcttattccattaaaaaaattaataatagtgatgatcaggtagtttatactcatgaagaggaatctaaatctgtaatgagtgaaaaaacggcttatgaaatgacacaaatgatgcaaaatgtagtcaatagcggcacaggtcgcaaagcacgtattgactggcctgtagctggtaaaacgggtacgacccaaagcggaattagcggtaacagtggtaaccgggacatctggtttgtcggttatacgccagaatataccggagcagtatggatgggttatgataagccggacagcaaacatatgctcagaaactacagtgggcagtcggcagcctttttcggaagagtcatgggtgaagctctcaagggacacccggttacgcaattcagcgagccgaagggatatgaaccaccagttgagcagaagccagaagagccggttcaggctaccgctccaagcgggctgagcgggtcttatagtcaggacacccaaattgtatcgttgtcctggactgcggcgacgggggataatgtacaataccgtgtgtatcgcaaagggacttctgatgcaggctttgcaacaatcatggaggccatgaagggcacgagtggtgaagatacgtctcctatagctggaaacacgtatgaatattatgtagtggcttatggagcggatggtaaagaatccgaggcttctaatacgatccgtgtggaaattccggcagagactactccggttgatccacaacaagggactgatccaaacgagaatggaaccttaccggataatggcggggctacagacggacaaaacggtacagatcagggaaatacagatcctggcggtaccaacaacaataatggctcaggtcaggttccggcatctcctggagatactagtgggaatggtgctggaggcacaggcaacaataatagcaattccggcaatggaaacgatacaaatcaggaaaatggtcagactactacaccggatgcaggtatttctgatgaaggtactatggtaaatccagaaaatacggatgcatctacgactgaagtcacaacggatggaactcaagaaggcaattctaacggtcattcgaactccaatcgtggacgtcacaatcgggattagcaagtattgctttatgtaagttgaatttgcttcaaatcaaaggtattttcggaccgtttcacggtctgagaatacctttttttgctttggtaaaggggttctttttgagtgtacagtttaaatatggtaagctggttttaccaatgttggagaggaacatcatttatgaagcgcaaattcggagaccgggccaactggcgcagaatcaccaatcgcaagtttgcttgccggtatgtagaaagtgacgcgtttacaggatatgtgaccctgtatacaattttgagtctcaaggagccgttatggaaaagttacggtggtcatacgttttgcatagccgataaaggatattcctggctacaatattatccaaaaggtgagcattatgtggtgactgctatgttcgacaaccgggagcaaatcgttgaatggtacattgatacctgccgaaatcagggtgtgaccgatcaaggagtcccatggtttgacgatttgtatttggatgttgtggtgcttaaaaacggtgaaatcttcctagtggatgaggatgaattggaggaggcgttacaacgggggcatatctcaacgcaagaggcagaattggccaaccgtacagcggctgatgtgttacatcagatagatgcccacgtgttcccctattttaaaatgtcgctgaaacaccgggcagaatggtttcacaacggtgatttcaagagagaacggtgaaagttttgcagtggattaaagacactggacccaaacgccctgagtttaatagcgggcagagtcgccttaagaagatatctatggtatccaagcgtcttgtactttgtttgatgattttcattttggtcggattggtatgggcaggtatccgagtgtgggacatgaatacagccgcctctaccactccgctcaagcaagtgcaaattggtatcgtactaggtgcttctatgtggggggctgagcccagtcctggattgaaggaaaggcttgaagaagcattgcgcttataccgcaacgggacggtacagcgtctaattgtaagtgggggactggataaaccagattttccgtatacggaggctgagggcatgcaacgctatttagtagataggggggtccctgtacagcatattgtgttggaaaaccatgcgaccagtacttacgaaaatctgctctatagccagcgcatcatgaatgaatatggatggacctccaccgtgatcatcacacatagctatcatggccctcgggcgatggagattgctcaattcttgaaatttgatcatcctcagatggcactgacggaatccaaagtgctgaatatgccaattcatcaatcaagagaagtattggcatacgctaaatggacgctgcaacggtggtggatcagcgctcaaacttgggttgcctgaattaaagaaaaggctttgtgcacgttcccggtgcttttatgctaataaggacatgccagaccgaatacattaatagggtaagctgtgcctgaagaaatgttgaggtgatggatgcatgaacggacggggaatcgccgcgggcaagcggtcggaggagagaccttccagacaaattaatgtcgtgctgcgtagcccggagccgatagcttcggtgactgtggacgagacggaagcagtggcttcaaccaagtcacaggcgctaccgcagtatctcagtctttatcaggaaattcagaaagaactcgatcatctcgtcggcttggataacatcaaagacctggtatttgaggtatatgcctttttgcaaatcgcccatatgcgtacggatgcgggattattgagcaatgcacacgtatatcacatgattttcaaaggaaatccaggtacagggaaaacgacagtagcccgcattatcgctaaaatgctgcaaaaaatgggtgtactgagcaaaggtcatctgattgaggtagagagggctgatctggtcggtgagtatattggccatacggcacaaaaaacgcgagatctggtaaagaaatctcttggcggcgtgttgttcattgatgaggcttacagtttggcacgcggaggggaaaaggattttggaaaagaagcgattgataccttggtaaagacgaaagtctagcaatctatgtatatgattcaatagagttagttaaaccgaagtggggaggtgaagacagaaagaataagtgggaagaatacgagagtcaattaggagaactattaaagctatatcaggtcgatctactaagctttgagcagataggcgagaaggttaatatagaatggtggacgatcaaatcccttttcaaagcaaaaggaataaaattaataagccacaaagaaagatcaaagataaagcgagccaaagactatccattactatatgacctacactacaatcaggggctaacactaaatcaaatctatgctaaatataagtatagtcccccgtatataagacaagtatttcgagagaatcattgtttaacctagacattgagtgataatacatccacaagggctgagtacgtgcaaattagcgcgcaatttattttcgggacattttccttattaatcataacgggttgcttaaaacgaagaatagaggccgacagtgatttttcaattgaagttgacgttttcgaatttgcacaagtaagtgagaggttttgctctatatccaaagtgggttttctcattatgtgaaaagcatctgatactatattttaatttgttttgttgattccaagattacaagagtagaggaaacaataatatcgtttaaaaagaaaaagtggactccttgtttaaatgggagttctctttttataattgtgataattaatatagttacatagtactatttttatggtataattttcccattacataatgggaggttttgatgtgggaagaaggataggggtatttagtacaggggatttaccattaattttagtatctggagtagaggaaatgaaaggcgctcatagtgcagttccatatgaaacacactatagtttattaacataccatgaagagcaattcattattattaacatacgagtcaaatttgacaatgaaaaagaagacagagtatttactgtgaatttcaatgcacatgccaataggcaggctttactgaattttgccaatggtgcaccaatttggttcacagcagcagaagcaggtttcgttaaagacgatatgttaagcgcagaaatacatctagaacttatgaaacatggtggcgttcatattattcctcccgatccgatggtatctatgacaataactaattttctagagcaacataaatagacccttatagggtctgttttttacttgttgtttttaaatttatttattgtttgttcaagtttctgtataaattcttcttttgtagtgtcatagaaaaattgtaattcttcttcagtttgactcctcatcttaactccttcatattctttcccttttaaaatccaatcagtagatacttcaaaataatctgaaagagcaataattaaatcaacgtttggcttatttctatcattttcaagatttccaatagtgccttttgttacttttttatatcctgacaaactattgttttcatcatatacagggatttttaaatcctcaatcatcgtctctacagtaagcccttttctgattctaagaaatctcgctctactaccaattgtttctaacatcctttatctctccaatggtcaagacttttaattatgtacaatatcattatagcgatattctgatatttgtatacggtttttgatacaaagttttatgactatccttcttgacaatataataagttgagcgtattcttacgtaagatacaaaactttgtgtgttgtaagaatgagaaattaataaactttgtatcaaataaaagataacaagccatcttataaaaaatcttgagtataacaagagaggtgaaaataagagcaacttttttacgcaaactattcgtgttaaaaatatatcttcattcaatcttcatgttgatcccaaatatttgaaaccacataggaacatcgtcgtatatccatatataacctttgacgcatggtaccacatgcaaacaatataaacttcgcagatgcgaaaaggagataaagaaatgacaatagcattgaaaaaatttaagcaaaatgttcaacaggtaaatgtatctaatacatacaatctagactatccttcctacaactataacattacattagaacagttgttgctcgattttgaaattaagccaagcgctatcattataattgaactaatggaattttatcttagaactgttgaacgtatgaatgaatttgctaatcgtatgtcagaagagcagtttccattaaccctactaaaaaagatgcgtaacgaagatatagacaaatatggttatcgtaataagtattcatttgctcatgactttcacaaaaataaacgtcaagcatttgaacgactatttcaagaacccgtaaatgattggatgatgaataagtttaaaacagatgatccagaacgtatttttgatgtttatcttaaacaaggtaaatactcgcgtatgataaaagtctcgatgcttgcatagtcgaagaaaaatgccctccatagatttattttcttaggagggcaggttaaatgaatctttataaaattatcattttatcaggaaatcttatgaccataccgatgattactcataatcttgaaaaatgagttgtttgacttttgctcaacccatacatacaatttgaatatattggctatgaatgcaaaaaaatagttaaaatcgtaggaataaattaatttaatggagggtgaggacagaagtgaaggctaaattaaaatttttggggttggctgcccttactgttacgtttgctgtagttattagtaataatgtttttgctagtgatgatacttcagaagaaatggagagtgttacaaaagcagtagtccctgatagtgtattagaaggacttaatcatcctgataaaatttatactaaagatgcattatttataaaaaaaccgcaatctctccatgatgaagataaattcaatcaagatgaggtagtctacgacgtttcaaagactacggataaaacaaaagcgatcattcaatatgacgctacttacatcaaggaagagggtgtagaatagtcaatataaagagttgctattggacactttatattggaaatatagggcgactacggtcgtcctttttttaaactttctttctaaaggctacagaaactacaataagcaattattcaaactgatgactctaacccaaaggtttgataaatatattagacgatacccttaatcataaaatcatcgtaaactatcccaaaaggtatcttaagtgaatatatgaaaggtatatgattttatgccaaaagatggtacaatcaaaatcgttagggtattttactacttgtttcacaactacataataattttaactatgcattgtattgttagtctacgttgaaagggtggtttatagatgaaaattacacccacgattagagcagaattggaacaatatctacaacaagaaggcttaacattatcgcaatttggacaaattacagggatgaataggggaataataagtagcattgtaacaggtaacaaatctatgtctattaatcagcttgatcgaattactgaagctatgggcttaccagagggtcacttttacgacttgttcgtagaaaactacatcatcgaccatcctccgaatatgaggcgaattgagccatttttatatcgctgtgcggagttggacaagctcggtgtgatccgtcgagtggtgggagccatcatggacaatctactctattcacccaagctatttgaaattgcagaaggattgctggcaaagggacgacatgaggcagcactactgctctatgagggggtggctgaagcggagagatatcaacattctgaacgcctagccatctgtcaatatcgcatattcaagattcaggttggagatgaccaagaaaagaatttccaatcagcacttcaatttgagccatttgtcaaacgtctcgatgctatagaccaattagatgcacttatagatttggccaatgtataccgatcattgcgaaaatgggaacgcgctaaggaagttgctaaggatttaaggactttagccaaagctcaatactctttggatcattctcaggaaagggaagagcgcaaacctctgcgaccgttatttttttatatagcattcagtaaatcacttattggcggcgtttattatgaacaaggaaaatatgagttggcgttacaaattgcgtatgagtcttgtgatttggattgggtgaaagagaccgacgaagaagcattgcgctggaaaagcttgtttcaagaatggggcgaggctaacatatgtttaactaaactcatggctggagatacagaggtgctccccttatatattgatcttatctcaacaaatagagaggaattactaccgggtctgtggaatataatgatagtagccaatcgttataaattaaatgtagacagtattttgagtcaatttgagtgggaaatatccaacatacatgatcaagaaggaaggcaaacaaatgacaagcagaatattaataatcaacttgttggctttttgagtgaattggctgactattatttgaccaatggtcagtacgaaaagggaattgtctacttattagactgtatgagaatatccactataatcaataatgagcactctatacttcgttgcgtgagaatgtttgaacgttatcggcaatatgtcacaaatgaagcaaaagtggagtatcgtaatttagtggaaatggggtaatgtatatgaaacgcataattaaagggttgttcgcgactactttcttattagtgttagtagcaagcacacaaacaatgagtagtcaagattttagtatgtcacaggcagtctctaaaggtggtatccaagtgtttggatggcatattggaagctagtacattttatgaatagtgtggaatgactgttcataaaatggttcttctgattatcgcgttattactgtacctgcttagtcaaatagacatcaggtttttcaacttaaagaagttaaaataatgcactcccaaaatggttactggtgagaaccaacaggtttaaccagtgaaatttggaagtgcattatttatataatagtaaatgatttgcttctgtattggtgagtcaaataattttactcaccaaaaattgagaaattgtataacaaaacagtagatacataaccacaaaagacaccttattgatttttaagttagagcctattgcagaggatcaggccctaatacatatctgtgcaataggaaaaagtgaattattttttctgtgtgatgaaatccaaccatttatttaagttatctttttgaaatactatatgtccatctagattagcgtaggggataaattgataagtgtcataaactgatagtttctttttttgttcatcgtctctttttataatattatctagttgtgtcacagggatctttagatatgctgctgcttcttctttatttaaaacactatcacttaaagaagattgcgatatctgaggggtaagaattttttcgttggaactaaaatgtgcgttaatatagcttccaattataaaagaaccaccaagtattattgaggatattactattttgaaatctttatctttattcatttgcaccactccttggtaataatatctatactatagcatttttttctaaaattatgctacaaaaagaaggaaatagaatttttatgcagaataaatacattgtattacaaaaattagaaaaaaggatgatgatttttgaagaaaattaccgcagtaattttatccctatcaactgctctagctgtctttgctccagtgtcttttgcagaagaaaattcaggtgataccattcaaaacgcaaccgcagaaattgcagagtccagtattcaagatgttccaacatctgcaattaccagatttgaagcacaaggtaatccaaatgcgcgcgttgaatttgttgatccaaagcttgttgaaaaaaattctgtgatcacacctcaagctggggatcatcgcgtttatgtaaagtcagaatatgtacttggcaataataaaattactggatattctgtggggccagttcagaaacaaacacttattgttagtgtggccaaaggacggactgcaacacgtagttctagcctaacagtaagtggaacagtttcaattaccgccacggttgatgcgaatattgcatatatagttaaggaaagtcttacagggaatgtgagtggtacagtctccaaaacatacaatacgacagatgtatactctggccctcctgaaagctcaccgtacaatacaagaaactattacgcagctatcaactacgatcagtataatactacagttgttagatatgattattatgattattatcttggaaatgtttaccaagggagacaagcggaaaatgctgggtacacttatgttaatggaacaaaaaaacctattaacattgagtatccaaaagatgtaaattactaatctgatctgattttatgtgtatataaaatgcatacagcttgcttcaaactagctttaacaaaaaaaagggaaccctcatttaatattgagagttccctttaagttttactgttttactggtgttgctgccaccgatgtatccaataatcgaatacctttatggactagaatttcgattaacttcaattctttattggttggtgtaacttccagcctattcaacaatccatcaactgtttcaacggctaccttttccttttgttcaaatgtcaaagcgtcattggaataattatgtacatattcaattacttcacttgccacatctaaaacaaaattagctttgcctttatgctgttcagcaattggaagtacctctaaaatcaatttgcctacatcgacacttccaagaatactatccgtatcactcagattgacacctctctttttaaaccaagtaataaccaatacgcctaatagcacaaacaacactgttccaccaataatataaatatcattcactttacatttctccttgttataagaataaaaagagaggaacctttgtccctctctgcctaaaactattatttataatctgcgacatactgttcagtattatatgctcgtgatcttcctgctgaaacattctctgtacgaagtgttcttttcttactccaagtcgttccttcttttggattattaagaggggctatcttcttggtttttagtgtttctattttaccaggatcataccacatattttttattttcatcagaagttcttcgcttttattagcccattcatcgcctagtattaaaagggctagttgttcaatggttggattgctaattcctctgacttcgaaatacttatgcaatttttttagaaatttattataatctgttgcttcaggcatagtggggaatattattaatccaaccattgattgaatttcatgttttagagaatactcgtctgctttattttgtaaaagcgctattccagaacttacatcgacgattccttttatgacattgaatcttattatgcatgttgaaccaacacaaagtttacttccagttattctattatgtagtacaaaattgtgctttagattggaagtatgacacaattgacacttatcatcgaagttatcagaagttgaatcgataacatcttctatttcccattctttttttgcatcatcgaagtttttagcataacttcgtcttaacatattctttacaactaacggtctgggggttgaatgctccactttagcatcgtatctaacaactatacgtttgttgcttgtgaaagacttcaagtaatcactctccatactatatttagagcgaacgtgctgttcaaactccacatatagtatatcctaaatatttccgactgtaaacgacaaaataagatattttatgtcgattaatgtcgaaatgtggattatttaaaaaatcctttgcggtacaacacagtaattaaccgataaaagtcataacttgcgccagaagtcgtatctacagcgccagcattcttggcagccacacacgcctctattgcccaatctggaatcttatccatagacaacttggaggtcaattgttttacttgttcttgtaatgcttgaaaatccacttgttcttggcttgtcataggttgatcatcctcacttactgtagttttatttttactttttaattgatctaattctgtttggatttgaggtagaaagtttttctttgccgctgcgactgtattaccgtcaccccaaaatgcagtaccggggcatgttttacttgactcaccgggtttaaaatctgtcaatcgtgtgcctccatacgtaaaccatgcgtggtagacaatatgatttgtatcgatagttagattaaacttttcagctagacaagcataaacatgaacaacggcatttttctgtttgtcggtcataacatcattacctttgtcgaaatagccaataatctcaatacaaatggctccagtgttggcgtttcgaatcccagcaggtgttttgtttagattcctgtctaatgaaattgctacttttccatcttcgaatatggtgatattttgacctgtcccagaccatccttcacttaaatgatattttctcattccttcaagacactcaaaatgatcttgttgagcaatgccatcaaccattctacgtgttttatagttaggtgatgctgtgtgatggacttgaagacgaccaatatttcgagtaacaacctgtttctttaaccattcacggaactcatcttgctccataagcagaaaatttccttgttgaatcattttgaatcactctcctttatcgtcagcgttatttttcggttgtctgttcttcaatactgcaatgatttgtttgatttgaggaggaacaaggaagccgattcgtcctgcattttcagtaatactgattaactcattgcttatgtaaaaccaaattgtacccatcataaatatagacatgtctaaaacaatgtctgctctatgagcaataacaatgataattaacataaaggctttttttgcaagcccgatgaatcctcttttgctgctaagtccagcattaggaattccttttttggcttcaacgatacttgctataagtccagtaacataatcagccaagatcagtaaggtcaaaaactctagccaagcgttccaccctccaaaaaaataaccaaatgtactacccaagaaagcaaacattaaactcaataatttatcatacacacatctttcctcaattcttgtaatataaaaagactcctcattagaagagtcttcataaaatgtctcttttataaaatgtaccaatacacaccagatgaacgtcccttgactatgataaagctgcttaagtcgcttacatctctttttctgatttgagcaactgcatttaaatcattctctctcgccaaccttggatataagaagccgcctaattctggtctactaatcattacttcagactcaacattgtaaacattcttgatatctacagttgaatccaagtcactcttctggcggatatcgattgtcgcatctaaatattcacggttctttacatatagagagccatcaatatcgtagaagttcttaacctcaatccatgatcccaagtctggtcgtgaaacaattacattggcttctcgaaaatcaaagaatggtacttgaacaaatgaatctaagtcattatctccaacagctctaattacaacgctactattcaaatcaggcttatttacaactaagctgctatctatatctgaaaatcttacgccttgaatcattacagtggattcaatatcactatttatacgcttatacttagacacggttaaacttgcattcatatctggtctagatatagtaattaagccatcgattatagcttctcgtctgtatgctattgttagctgactttcaaggctcatcttaggatcaactgttaaccttgctcccaaatcaggtctggatatcatcaccgatgagtcgggtgcagatgttccaaagttagcaacactaatagatgcagataggtcgctatctttgcgatatacaacttttagtgtactgtttatgtctggtctagagattgctaatgttgagtcggtatcatgctgcataaagtctttgtacttgtggacatataaagaagcagggagataattaaatccaaaattacttttaaccgtaagactacctgttacttcttttctaccagcaccataaacgaatagagtagaatttaaatctcctcgcccaaaactatagttctgtgacgtaatatatttaagctgaagaacagggggctttagcgattctctagtgttgaaataggttggatgtgaactttccgatttaataataagcccatagttgattagcgattcatcttgccagcgtttgaccaaatcaaacacgtcaaattcaatgtacttattcgttctgttaaccgtataggaatccaataatagttctgttccataaggcttgttggcatatgtaatgccatactcacgccaaagtgtattcggctgatacactttaatatccgtgtcatccgtaaaacttccactataaaataatcgtaacttggcatcttcaagcttatttagatctggtacaacaactttcaaatcaccaaagttaacaaaaccctcaaattcttctgtatcagacttcccaatcatcatagattgtgtatcgccatagtttaccgtttgcaaatctgaacgacttcgtgttgtggcatcttcgataggatttagatccttggtaactcttggagcctccataagctcaaacttacctaacagccgattatgtggtctgacttctaatgtaccagctagataattaatagaggttgattctattactgaattgatttcagcattacctctatacttgatatctaattggctgctaacatctgccgatcgctgaacacgtatagtaatcgttgcatcaaaagttgtttctctgcgataagcaaccaacatttcagaatttacttcacttgcttcttgccgatagagtacaaactttccctccatacgattggagggcgattttataaatatttcaccgcctaaatcattgtaaacatccaattgctcacttcctaacatcacattgtattgtgattttaaactgctgctttgtttgagttaatcttaagttcaaatataccgtttggtactggcttggcctctatgtctgcgacgattcgcacataaaactcttgtgtttctagtggctgagtcaatccgtatgtaatataatctgttgctaaaaatggcgattgagtacgagacaattctacggttacaccttcgggcaatttctctttgtttacttccaacagtaaattatcaattgggtatcctagctgattcttgattacaactttttggtctagagtggtttgaccagcgaagatcataccgaagtctaaatacttaaggatgcctccaaatgtatcagacagatattcgcctgtttcatctgtgaacattagccctgtgtatgttcctgcaaaggtcgtttgccaatagtctgtattgccccaataatccttaaactctacacgtagtttattgtctttatcaaaatgcatatctcgttcagatatatttagattgatatcaacaggagagggggctaaacgagtaaatgaaccatcattagggaaatagggaagatcatttaacaaaacacgatattgcactttacctttatcttcatcgtttatttgtccaagaatttttccactgttaaatgtgagttgaatcgtcgcttctgtgttaagaacataaaaagataaattctgaaatttggtgtcgtcaacatttgatttgataaccagttgagtggcatcaatttttgtgggattgagcgattcttgtttcttgtcttctatgtaatatccaaatctaattttgtcaccctgattcttgaaattactttcgactagcttagatatttctttgtatgacattgcttgtcttctaattgtgttcatatcatcagcaattacttctatccatcttccataacgatacgttttccatgattgtcctgaatcaaatgaaagaaaaaactttgcattattactagtgttcttgattatagtaatttgctgtagggaaccgggcaaagtgaagtcgttagattgtttaatgaactgactgacaggtaaagcacccagcgagagattaaatggattatttgattcatctgtccaagtaacaacttcaaaattattatggatatcatctaatggggaataattagcagtatactctaaagaggctgctgtcttagttaattcatctgtgtagtagagaacatcgacgtaatcaccaagttcatcataaagaatgaaagattcagtttctagtgagatggacgattcggtttgttgtgggttatccgtgtattcaataacattaatctctttatcttgccattcctcagcaagagtaaatggggttgtctcaatagtgaattgagtttctagcttatatggatcatctgtgtaataacataattcaacatcgccttgaagttgttgccaagctgattcaggaatacctgaaatatcgtttatacctgaattgagaaattcctcttctgttggcttttgccctgctatattagcgtcaacaaaattactaccatcatagaccttgtatttattattattataaattaaatattttttttcatattctggtgccaacatctcgatttcgtaaatgtataaataataatacatgccgttgttttgagtgatattcaacctataataactataccaattatcattaagaaagctgtactctcttttctgtgtggttccccatactccacctatccaattggtttgatctgtctgagtgtctaatatagtccaatctatcccattatttgaaccctcaaacgtccaattccttggagcgctagttccatcttcaccaccagcgcgtatagtatactttttcacattctgagcagtagggaaagcatattgaattaccgctttgttaacccctctgtcagtcttccaaatagtatccaaacttccatcgaataccttccaaggagccaccatagtattttcttgggaagatgcactcgctacccctgacggcgaagtgttgcttgtcatcgcaggtattacattttttaagtacatttattctcctccattaattttgaattatgcttccttatgttatattcacaccttttattggcgttttaattgtatccacagaatgtcgaaacactttgcccgatcctagagcagatgaatttttatttatatattctctgtattttataatttccgataaatcaatttgagtagatttgcttaggccgtgtgtgataaaaccatcttcctgtgctgaagataaatattttatctttgcgtaagaagttactccatacatttcaatttcatcaatttccaaatagcttatatcgccatttatctgctctatatttagtctgtactttttatatttccccgatttagacatagtgaaaattttcttcgttccgcttacccagtccgttatattctctctttgatctagtaatgcccattgactgcttgtatacccctctacagtccatttcttgggcgcgcgagacacactggcaggtttaattgtatagcttttgatttcagttgaacttgaaaattcataacttatccatgcaggtagggacgcatatgaagccaaccatgttccatttccaccgctaacaccatcaaacgctctatatggataattagtcccccatgtgctactagcttcaactataccactaggagtattattgcttgtcatgttagggattagagttgtatcgcttattaccataggtgcataagcaatatattgatcatcaacagataatagaaatttatcgtcataaatgtattcatacatttcccaacctgtcatagtgattcttgcatagtttccgttaatgctctggatgttcagtctgtagtactggtaagattgtttattgttagacacatacttccgagttacgctgcctgtccaaccaacttgattagattgtgtatcgagtacaacccagtttaaatcatcgtttgatccttcaaatgtccaattttttggagtgccctgatactcgcttgagtgtgatgtaatgttgtaattttgtacaacaatcggattgggaaatctgtatttaatccaacctgtaattgtgttatcagttgcccaataactacctgttctatcaaatactctccatgcaggatttacgctagcattgtatgttgagctagagctagcgacacccgaaggtgttgttgctgaggtcatagttggaattgcactaacagttgaaatatatcccataaaatcactccctcattatttaaacgttatactattcactctattacgattcaagtcgatgacatgcgtaaatgttttgccagcaccaaaactaacgtttgatgactggatatctatatattcattcaagcgagtacttagattaagagcactgtcaaaattcattccatattttcgaaatgaggattcattattatcagtcattgcaattagactagggatactcaacaactcaaacatctttagctccccaacacttgtgtagtctgtagctccattatttgctgtccaattcagtctataagtagaaaaagcttttacattatcaatttcaaaaattctatcagttgcgggagtactccaaatttgtttattttgtctgtctagcacttcccatttcccatcaaaaccatttgtgctatcgtttgaaccttcaaatgtccagtttttaggtaatcgagtatagctagttagagtcccatttcgaactgcatatttcccaatgatcttaggtgtcgtaaacttatatcctaagaatccaactccacccgagctattagtagaacaatagccctcattttcatctgtttgattaaaagcaaggtgagcttcgttggaaccataagcgccccttgaaaaagctaatccagacggtgcagcgttgttagtcatcttagggatgattgttgtatcggaaattttatttggagtagtagaatagaacttattattcgatgaaagtattactttaatatacttcatacttccccaagcaaattcgccgttgtatacgccgttcgtagttgtttgagaagttggattatagtcagcatcaaaagtagtaactatgtttccaatatcagtagtgaaattatttgctaatgcacaattaataaagtcgttcctaacaccattatctgtgttagaaaaaataggaagaatagaacaattaatatactccagttttctaaccgttgcaccagaagaattaccagcaaaaataggaaaccacgtaggagcatatggcttgctatcccacacacaatttctaaacgagaggttaagaaccgaaccatcgaaaaaatactcaaatgttctcgcctcattgcccgcggaaggtctttgtatgataagtccaatgaacgtattggacttgttcatagcgaaccccccagcagtaacgtttgctaaactgaggatgacacgtttagtcttatctctaagagtaatggaggctatagtaatctcgtaattagcattaagcaccaatgttagtcttgactctgtatatgttccttctttggcaatatagatcaacgttttatcggtagtaaccgaagcaactgctttacttattgttttaaatggagaactggcagagccagtatttgtatccaaacctgttgtgccatctacgtataaaactttagagaatgaatcaagaaatccgctaaaactaggcattttttatcaccattttctgtataaaatcgttattttataatgatgcttgtaatgtcgaaatacttcttcagatcaattgtagatttaaatactttacctgatacaagtgttccattgtcgctcatgggttgagaaattgttttaacagtccgatttaggatacttagatcatccataccctttgtcataaagttatctttagtaggggaggatgtagcaactgtttgccatgctccatttaaataggttttataagttccattgtcattaattaaatgtttttgcattacgtaaaatcctcctaactttggacacttgatagagagtcaactttcctccaaatagatttatcaattgttgttctatatagttgcccatcttcagtccaagttttatcagcaaagcagtctagcgtgtaattacgtttcatttctagatagtcgttagatgtattcaagtattcatttgcatatcgattatcggtaaattcatctacagtgaagtttaggttttcggtaggtgaactgaacagctcaatttttattcgtgcatatgtatttgtaggcgattggacagaaccatcagaactaacttcaacataaggagaccattcgataccatcaatagaagattgcgtataaattttaaatgttgaagttgtgccgttaacaattgtattctttacaactttctcaaatgatttaatcttatcggcaatttgaatcatatctgattgccaagaaccagatgaggcataaactattttacctgtatcacttttttgtagttctactagctgaagcttaccgtctttataaacagtgttttcgtatttacctttggataaatctatgggtatgccgatttcggttatgctcattatttcagctcccaattcagattattactcatatttgctagcaggggagcatgaacttcttcggatacaagtccattattacggataattaattttccgtccaaatccctgtcggaagtaattttaatttgaaaatatatggcatctcgaaaaggaatggaacaaatacattgaaaatttatgttcacaccttctaattgcatttgttttttataacccatgttatattgctcaattctactatctaatttcccatatgcttctctcgtaagtagattggcatcgcttgaagcgtttttgtattgaataatatcgttatagagaaaagtcctccccgttaacggatattcttcttcttcagttttataggagatcatgaagcgataaccgttaacattgaaaataccattagctacatcgaagtagatctgagttccttctccaatataaccaaaggcaagcaatttatctttttcgatagaggcgaattcattatgtttgttgttgcgtgtatcgtattcaagaagagatgtagaatcccagtagtccgcaacccagataaaattttgaaagggaacgggcgaacgactgtattgcatgttacctagaatcatatgtagcctccctaaaaataaaatagacagggagattatccctgcctagacgattgattttaaatttacaatattttacacatatctgtaagaaacacgtagcttgaaactctgtttgccgctcgaagcatccaaaggtacagcgcattgtaacgtaactgttacataattacctgctgcatctaagggggtgccgttgttggctactcccaaaatctctttagctcccggcttgaatggagtatcgtacactgtgccatcccaatttttcgttgtactaccagttgtgccaataggtttggatgcgattttaccaatcttagagctgtcttgatcaaggtcagtctcttgtagagtatctacttgagcatggaaccaactatttttaactacttctactacatttcctacggtatcacctgtaccacctgtcatgtcacgagtggttattgtacagtcttccatttttgctacatctgttttgcctgtgccttttgtggcatcatatctgttgttccaaatattaaaagtaaaaggtgaagatttagtatccgcatcaattacaccgaaatcttgtgtaataatttcagttgcatgcgtagaatttcgccattcaatcactggttgaagacccatatgtatcactcctaagttctaactgttattgttactgttaaattctggatattaattccgttcttaattgtgttaactctaaaaatatctcctgcgttaacggtctttgttttgatttctactgatttatcatcaaagtgcttaagtgcttcaaagtgaatctttttattcaagatactagtccaagtatttaaatctcttgttttttctatgtctagttctgtttctgtatcgccctctacacctaagtaagccttgatttctacgatttctccattgaaagggaaggctgctaatccgaaaggttccgtaaatacataagaatctttgcataagacaataactctatcttgaacctctaacgggatatcatttaccttttcaagcaatgctaccgtcatcaagccatctttatccttgctaacaggaagtagattgtctccaaataaatcaatcgctatccaacgattaccatcataacgatatcgaataccatctttcgtagtttgaactgtccaaccaagttcagggtgagggtaagtagcagtcaattcttgcatatctctcacgtaaggtttgaaagcgagccttgttgttttatatgcatccagtgcattgttagctgcactgttagctaaatctgctgcttgattggcgttgtctgctgctttttctgctgtactagtagcaacctgtgattgtctaataatctcttcaagtcttccaatagccaattgggtatcgtttagtcgttgatatgcctcatctacaatatcttgtagagtttttacgatatcaggatgacgttgtaccatagcatagatacgtgatgcaggttgcatgactaagcctttgcccatatagcgacaaagtttagttgtaccttctagggaagggtggacttgaattgccccagtttgatattgtacaaggaattcgttttcgttaagatagggtcgattttcaaatacttgttggctaatttcagtcatacctgcaattgatacgccgtgagcagaagaggggagttcgaatagtgtaattagaccattcataacaggtagcgaatcagcacgattaacgaatggatcttcaggtgtacccttgcgagtaatcataattacggggtcatttaattctagataagtatgtaattctggcaatatttcacctcctaacttgatatatttatcttatcgtttcctgtttcgatagtggtatctgtgtccaacgttgttttcacaggtgaaccaatcattgccacagctttacctttgtaaaaaagctttgcacttccaccggaaacttctccttctccagtaccacttctgccgggggtaacagaagtaatgctacctctaggagcagagggaggagggttagctttccaactttcattagtcttatcgccaatcacagctaatgagacaccatttagaaagatttgattggcagatgttactttaccgatcacatcagcgtctgtatgaccgtagtcatgctcatgatcacgccctccttcgccatcactttcagtccagtcatatctaaatcgtatataattactttttgttgataattttatctctgaaccatttaatgctactccagccatagatcacactcctaaattctcttatattgatatctccacttaatatctgcgtctccatcgactttgaacacatttttcccaacaggtaggttgaaatagttgtcgttgaaatctatatatcgataagtgacagcaagtgtcgtctcgatatcttggcgctcattgtttacatatacggtttcaccatccacaagcccagcaaacttgaactgttcgttactatgtgatgtattagtcatagtaaaatcaccactaccaactttagtaatccatatttcaggttggcaggggagatcacctttgttgtgaaacacaagtactggttgaaagtgtagagttatattaggatcaaagaaggggcgaatactgtaatccgtagtttgaatgattacacgaatagttaatttcgtattgtagagtggggtgtcttcatttatttcaggaatttctccaccgttaacacagttacgccattcagaccaattgtagccatcattagatttacgagactgaacaactatcgccgatccttcaggttgcgtctgattccatgatattttgcttaaagctccatctgtaacaacaggtatagtgacggtaggatatgtatagataccatttttatttgtgagtgaattccaagtagccatagctattcaatcttcccgtagggtctaaagttagatgctaccccagcttctttccatttcaacatcttatagctcacccaagaagcgtttttatcgtatattgtttgaccgtcagccaatccccacgtaggttcaacatcgcctgattcaccagcttgcagacacacataaaatcggccattatcaatagtaggaagaacaatatcatcttttttatactgggtggttgcttgccaagtattactgccacgaacatcgccaaattctatttctactgacactggaaagactggttcagttaaacctgagtatcctgattgaatgcatttataaatatgtccgttatctacagtaggaacaattaaatcaccattggtatattgtttgagtttttgccataatggggcgctagtaccagttcgagtatttacccatccgatatagtcgccagatttaggtgttttcttgtaaaatcgctttgcaattggatatgctccagataggggaagggaatcaacataatcatcactatcatcatcaagcttttgaaagttgtcagctaattcatttaatgtattttcgatatcatctgttgcaaagttgggctttttaagacctagctttgttgtcgttgttgacatggacattctcctttcttatttagtttgaaatttcataccacttcttcccacgaaattcagtccacattgttttattagggtttaaagtaagtttgccattctcaatgataaccttgtgcttatctccacttgtatcgttaaccaacacatcaaaagggtgataacgccatttatatactggtggattataaatagaagagtaagcgtagggggcatcgcaacggaaagtgagcgtaatatatccctgtcttaagcagttgtgtacgaggtttatgtcgtctacacaaagagcataatatattttttctggatcatcggagaagaaaagaggctgataataagactgttccgttagccatatggcgacttctctaatttttacatcatcccatttatcttcgaaagcaaaggaaacattaaacttaagtggttctttttttgtattttggaaatagggtttgtctctacccttgatagacacttcattaatggatcgtgaagcagcgaatatttcttcttgcatcccagacgacatattcacgtttacgattccatagaaatcagattggatgccagcataagaaaagaagagggagtcacgaattgtaatattgatcacctccataataaatttgggcataataaaaaagcctttgtttataaggcttttaataggggagaaacactataaaattgggattttacttagtcctgtaatacgatgagaaaacagtaatgttaagcaactatttttcactcaattatagagagtttttcgatactttttctgctgatttttatacagcgaagacagagaagttttattgatattaacaggctaattttcatcagtactttctttggcattggcaactgaattttcgtatgataaaatatagtcaagatgtatatactaaaaaagagcaggatgcgctaacatcctaactcttttggcaacaaccgcttttaagggcggtcagcagtaaaacggatcaaagaaatagatcgtttaccttagtcgagggcgatctatttctttttgttttggttcaatgcaataacaattgtgacgattaatccgatcaacgctacaatcagcgtaccgaacatcatcattaatgttagagcatctttaacctccacaggcatcacctcctattcaggagactagccgaccgcccatctaagccattctgttaccaaggaatattataccatattgatgtgatagagagaaagatataatacaaaactatacttgcttgttattcaaatcagtactctgtttataatcaggatgattctcatctaagccaacatatttgtctttaatactctgaattagtctaataatttctgaaattcccattagagacagtccaccaaaaaacataccactatacatgcttagactaacatcccaagttaccccatcttttaatgtgctaaagataatcaatagcaccgaaatgatagtgcaaatcaatccaatccacttaataacaatacttgtctgattgttgttcatttttaatccacctctcaaattataccaatagtttaccatgtcttgggtaatgggtctatagtattatttgagagacgagaagtgggactaaataaacaaagcaacctctagcgatgttgaatatttgccctttgatatatatgtgtcataaataagttcaggatcatccgtcttgaaacgtttgagtttgaaatgctccatagactcttgggacaatttctccaacgctgcttgtttgtctcgataatagtcataagtaaatgttgctttgtcggtgtacccttgcgaatcaatacgttcttttctcattaaagtgagaagggacagttcacttatattgggtgttttacgttctaggaactcatttagtcgtttgacagtgttgagcttaaacttcattgtgtcgataatcgatattgaactagatagcagaggatagaggattagacataaaatttggtgttgctggtataattgaatatgagcatacaagaaaagagcctaaggctcttttgctccatttattttatttgaatgcttctcttgaagccatataaacatcaagcgaaattgcgacacctgaatttttgtctgttactaaatcataggctcgttgaccgttcttatttttaatcttaggatcaactttcatactcttaagttcccccatgtaagaggaattatcatattttaccacgtaatgtaaggctgtattcccttcattatcttgtaaattcggattcaatgcatttttatggataacttggtataatgcgtagtcgtctttttcaacaacatacatcagcaagcttttccctgtagctgcatcctgactattaatagtcaactcacctgaagcaatggctgctgcaattttctctgaatccatcttatctccttttgtgtattgctccacgttaaacgtttttcctccttgcttaaccgccgttgtattcgttgttgaagtttgttccgttgctgtcgatttactcgactgcgaagtcacaccctgaactaattcaattttactagcactcgcacttgctacactataacccattgctgaagatacgtcacgcacaggcaagtagctacgtccattgactgaaataggctgatcgttcaatttagcttctgtaccattcacaactacttttgtgtttaacaatgtcgctttaacaaagttagatgctccaacagaaacgctagctgtcaagagtattcctgctccaagaccaagaaggaatgttggaattcttcttttcataatatgtacccccatagattagatagtcttcacattattatcggtctttggagtggaaaattttagatgtgattacatgaagtcataacgcttgccattgaatttgaattctccagcagcagtaatttcaagtattgctccagatgttgttttaaatataaagtcacgcccttgtacaataactgaaccgccatcgctattgataaaaaccccttcatccattagcttcacagatctatcttttgcagtattagaagcagtatagctcaattcgaatgactttttctttttatctagccgcccaatagagccacctgagccatcgccttcgccaccttgtaaatagaactctgcattttcaccgtcaccttcaaaaccaattttacctttaaccttttggttctggcttgtatcatacacatacacaggccaaggtgtctcgttgattgtatactttccagattgagcagatgtttcccaatacaataacctaccatcgggaagcttcttctgctctccctgaacaactttacctgtaatccattttgcttcattgccttggatagtaatatagttcgaccaatcggtgatggcagcatttgtgagtgtgctgagtcttcccgctgtcaaatcgcttattattccgctatcaccagcaaatatatttgctgccattaattgggcgtcaaccatccctgcacctataatgttgtgattattggcgtaccagtcgccgttaaatgagtttagcagctttgttccatctggtttggtaatctcaacgtttttaaatcttgctgacccatccatacgaattactgcattcgctaaattttcatcagcgctccctagtctcaacccgttctggtcgataacaacaattctgttccctgatccaacttggaatttactatcgacaactactgagtcgctaatatcagcattcacggcatggagcatattcatccaaacattcccaaggtaatctgcgtggaacggtgcttcgctccatcgtgatgctcctaaggctaatccgtctttatctattctaaaaactctttcaccttcgccagcttgaaagttacccttcataaacaaatcgccatcgggagaagtatacaatgtcttttcaaatgagccatttcggtaacgttctaatttgaatccatctgcattgtcgaacgtaaacttatttaaaactttatcatttccgcatacgtttggttcttcaaatcgattaaatcgtaacccaaacttatctggattttcttcgagtagtcccaatttaacaacttcacgcttacatctgtcttgaatggttagtttagaaccttcgattgtaaatacaccagttgtgtcgccaattactacacgttcaccaaggataatttttccaagtaccatttctgcaatgactagatttcgattataatttgtatttatccattggagtgctttatattcaattatttttttctggaaaattacttgcggatgagagtcaactttgaatacctttaagaaaccgccgatttcttcacaggagaggtgatcaaataattcagagaaagttttctctatattaatagcagatgaatgtaacaatgcctcttctaaaaaactaagtgcttctttcgtctgaactccacctgtaaatatccctatgccctcatcaacaatgttttctacaatagagaaatcattgtaatatgatatttgaaagttattaataacgcccttatcattttttaagtatagaatctctagggtgggggagaggtagttgtgtttataagtttcatatgtatatttagcaatagacgataagtttacaatagatttatcgttagacaccttaaattgtcgcatgacttcataagaaatatccatagtacctgaacagaaaattatagcgtcgtctatttcaaacattttttcgccgttatcacttattctatagattacgccatcaatgtttgtagataccgccgaatcagaagctatccacgcgcaattagaggtctgaattacagctacagaactaatttaaacacacctcctattgaaacttagccaatcatccaatacaatttctgaatatgtatgttcagtattaattaatgattcgattttaactttcatttcttctatgtatggaactttatgagcgcttttaattcttaaaactttccatccttctgccttagcaaattcatctctttttctatcttctttttgacgatgtttgtgaaatgcggctccgtcatattcgatgtcaatcttaacatcgtcaaataaaagagcaatatcgaagaagcatcttccaactgaataatttaaagtaacgttgtaatctttactgagcatctcgaatattttcatttgttgagaagaagtggggacgttcccattcttcattaatgtctgcatttgttttttttgtatgtcttcgttttgtagtggattatcgcacccatatctttgcacaattgtttttctgattttttctctcacgtctttattttgaagagggctttctgttccccaattcttcaaagatgtttgtttaaatttttctctgtacccctttgtctgtgatatgtttgtagctccatatcgttgaagaattgtatcattcatcttatttttgaatttaggaacatgcattacatttttcacaccatattttcttaaattagtattcttagttttttctttaattttatctgattgagtggggtggagtgttccgtatctttcaatacatgttctttgttttttctttgtatattcttctgtcttggtgtaatttttggttccgtacttcttaagattggtgctaataattttatttttcgtatcttgtaactgaaaaacattttctacgccatacttttctagaagaacatcttttctttttaaaatagtgcagtctttacagcaatcttttgcgacaatttttcttctttctatatatgaacaatatttgttttttaatattttttgttcacctttatccaagcaataatcacacaaataacttatttctttagcacttcctaatgataagtgagatatattcaccataaaagtatcgccatactttgtaaacttatagcccaagccttcatatcttcctcttgttttgttgctccaatttattttaatctctgttgtaattaatatatttttcacctccacaaaaaacaacgctcttaataatcttgtaccaccagtaaattcttgttgagtcgcaaatgcttcatttgttccgagcagttcccatcagcagagatcgcagtttcgtacttgttgccatttgaccgagttaatcctattacgccatgtgttagcttgagccatctcatactatctttgtcgtcagtaattgttatcccagtgtgatcgatggtaaccgtttcattgatagccatctctaaacgctctttttctctattccatacattttcaaatagcttgttcatttcacttgaatcaaacactgctttgtcatacttaaacttattcagatccaacgtaactccatgagtccgtacatcttggaacaacttatcaaattcattgcccattctacttacgtcttttacattggaaattgtcagactaatattcgactgttcataatcatattcaatcttaattattcttgccgtgacatcaacgccagtcggttcatatttgatgttaacgaaatcgccaagattcatcttcttccaatcatattgtgcttcaattatctctaagaagttaacaatatcaatttccatgcttagttgtggacgtagcaattctttgaatttcttcattgtttcgtcgtacaaatcttgctcatctatgtatttactgtctgagtagtcctgcgtaataatatatgactcgcttaactccatcatttgctcatgtgtaaaattcttatcatatgcaaatgaacttctgaggttgcttatcttgttggaaacggtagtcagattagctttaacagcatcaatttctgcttgtttctgtttaatctgcatttccttattatctaaactgtatcgctcaataatctttgaatcagtgccagaatcatactcatctatgctaatattgcatacttgaatgtatacacctgtattgccaccactaattgacacattgacatgatcctgatatcgaactttacccagaagtctccattgattagaagaaacagctttacttgatccatctaaactaactgtaacgccagttgtatcatcgacctttatcataacagcatagccaaaatcagaagacaatttgaagctacgtgaactactaccagaatgttggtacttctcaaaaaacatcttcgtatcaaattgctgagatattttcgtatccgctactacaacttcattttttactaacttatccatatcaacttcaagcaatcctaattgtttttcatacccttgttgctctttaaggtatgtattaaactctgttttctttgattcaattaatgcttcaaagtcgagtagggcatgacacaatgaatcgctcatgtaatcactatgtctaataacattccgattagcatccctttcaaatggatacatgaaatattgaaagctttctacatagttttgtccagtaggatttactttttcaaatgtcatgtcatcttgaccaaatccctttagtcttgtaaccacaggttcggatgtagaatgtctagtcattgatttgagatgtttttgatgtgaaaaagttagtcctttatttgttccagtgagttcaggcttttgtaatgaaatggtgtttttatcagtattgaaaatcgttatagcgttatatgtttcaccaactgtcaaaatcgcatccaatacatttgtgcttgagaagtcaaatgctctataagttaacttgaagtcagcatcaatgtagtcgattttccatgtagttggtgcaagaatctcattcaatatttgttcagcctgatatgattctacggttaatccacgaatagcaaagccaactaaaaggccagccgtagaaatacaattcaatgtacgaatgtcagattcatctgagctagaatcttcaatgcttttaatataataccagtcaacattgtttccatttacaaccttgatcagatatctttctctaattaagtcaatgtttttgttgggaactaaacgatgattgacatcaatgtaaaaagggagggaaagctctaactcactaatatcgtgccatgttgtagaaatcttatcgttaaacgcctcacttattttgcttatgattgtcctgtctggtctacataagaaatactgaggttgaataggttttaaattgtaatcaatttctccaagcaatgtatcacctctttagaatgatggtgggggagaggtgatccccaccgattataaattgaagccataattatttcctaaaacgcctctctttgattgtgctttagcggcatcaattaatttggttaagatagtcgatcctgactccttatcatttgcatgaatttcaaccttttcaaaatgaaaactgttaacattagaagcagtagacgtattattgtttttaacaatattggggttgaaagtactcttaaccgaatctacgatgccacgggttacatcaatgattttcaacaagtttcctgtatcgcttttatttaagattaattccttttggtgagccaataagaattgaccttctttaggcatattagcaggagtcataccaccagtttcagcagagaacggcttgatcttattcaaataatcatatgatccatctggaaatccccatttagatcgcattgcatcattttcttgttttaattgcttaaattgtgcctgaagactttttatcttattggtgtcgggctttttctctctttggagctgaactacttgttttgagatattctcagccttttgtttattagacaaatacttgtcccaatcacctttttggcttgccttgtcatcacctttgcctgttcctgctccatcgccaattcctattccaatattattaccgataccactatcgaggtttaagaagtcatcaagtttgccctgatccatagaaagactatccaacatattttgcatttgcttgcttgtttctaacgattgctcttgaaggtaggtgaagaacttagaatactcgccctttaattcatcaatcacagacttaactttggtcttatcattagacatgaggtcttgcttcattctatagaagcgttgttcgtcttcaagaatgtcatcatacttctgctcagtcagttctttttctttttcaatgttatctgtaattgcatcatgatttcgatcttcagcatctttggttttatcaagatactttttacgatcttctaactggtcattcaaaccttctttacgcaattcacgctcacgatcaagtttaaacttatcgatttcttcattctttgcatctaactgatcagtcagttcttttctcttagccttagcttcataggagttatttagagcaagctcattgattttatcctgaatcttttgacgctcatccagcttcttctttaaatctttgtcgtagtcatctgagtcactggttcgatctaattcttgaagctgtcgttttataatctcttcaaatcgatcagattcttcttccaaattcttgagtcgtgcttcatgccgtttatcttcagcttctttttgcttatcgatagccttaagcgcgatatctttctgcttttcaatctgcttcttataggcttcaataatcttatcggctgcatcagatttgatggagtagatagcattgttatactcaagattcttcaacgtcagatcttgtagacgtttagacaattcttctttattctgtagactcaacttttcattcttcaattgtctttctacggctagaatttctttttctgtagcgacacgctgttcattaattaatccaatttgagtaacaagttccttctgatactccttagaattttcgttcaacgattccatacgagccttagacagagctatcttatcagaggcagcatcgatctttttctcgtattcatcaagattgctcacaataacagcataatacttttcttgtttttgctgctctaattcccaccactttgtactattcgaagctttctgcttatcaaactcaccagatgtaatcttattttgcttaactagattatcaagattaatgttctgagcaaccaattctttttgctgagctgttaacgacttaatttgagtagattcttcatcacgccagtttttcgatacttgatcatactttgcttgtctgctttgcgacttcgctatttccgcatctaaactatcaagcttgttttggctgattgttacatagttatcaatgtaatcaattcgtgctttataaatgttgtcgtatgtagttgttctttgttcacgtgcatcagcttgagccttatccatatcgctagcagaagggagggtgtacttatttttagatttgccacctgaaacagaggaggtatcaccatcatagtatctcaacacgttgccaacataattgacatcgccataaaccttgcttcccgtcttgcttttttgcagagcagagaactttttcatgttctcaacgctgtatccaccgtttttattaaaatagtccagtattcccggccccatgttgtacatagccaaagcaacgtctacattacccgtttgattgagatacttagcaaacattgaagtaccagttttaatactgctttcaacgctggtattcttaccaagactactaacctgcatgacgtttttaataccattagcgccattagaagattcctgttgaatgatagctttgattaatgcaggatctacaccgttgactccagcatatttattaatcagatcagcatttttaccagttacttttgtggatgtggaagtggagggaggttgaacttctggaatagcattaacaccggggatacgtctagcgccactatatttatctgcccaatacttgtcgttcaggttcccttgctttaagccagaatcacccatctgcataaagtttccgtcacccatatacacaccaacatgtgaattagcttttcctttgacagtgttaaagaatacaaggtcgcctttttgcaaatccttcttattggttacggcttgcccttgtttaacttgctcctgagtagttcgaggaagtttaatatcaaggaactctttaaacatttgctgtacaaacaaagagcagtcggatacagcagtagccgtgaattgatcgtagctaacattagatttagcagcttgactatacttaaatgctttagacgatgacaaagaaagagcttcagatatcatcgaatctaagccagttccaccttttgtagtagtggtaactttcgtggatactaatttggatgggtctttaataccttcggttagcaatgcggcttgcttttcaagaagcttaatctcctccttaagagctttaccgtattcctcagatccttttttcagacgactcttcttactattcaaagcatcttgagcagcttcaacagctttaagcttcttctgtgtttcagttaaaatctcatttgtttgagacatagaatcattgtattgatcatttttcttttttgattctgtgcttactccataattcggatcatcaaacaatttacctaagtcatttagctgcttataaaggtcagaaactgtttcgacttggttcttagtgtcatcgattagtttattttgttcttgggctagtttgggtagatagccatccatgatgggattcaatcccggtagaatacttggtgatttaacattcattccatcagacgtagggatctttttggaattcagttcatctatggccttttgcttatttgctatctgatctaaggcattgacttcgatatcataaatctttaatcgatttaatgtggcttgaaggagttgagtagtctttgacttctcttgttcaagagtgtatttagtttcagtaatctttgctttctgtagagcttgaattgctgatttttcaattgtccaaccgtcagcaacttttttgatgtgtccagcaagagaagggtacttaataattaactcagctacttgatcagcatttaaggcgttacctttgctaatgtctgccattaccttgtttagatccttaatatcagagctagtgtccttatatgcagattggagagatttttgtaatgactcaatttgtccagaagttttagcgaattgttgggcagcaacctctgccatactataagctgggaacatcgccattacagattctttgtaatctccaaacatcggaaccccttttgttacggtttccaatagcgctgaaatatcgctacgaactttcagtatctcattgttattttgagttgaaggatcaagcttaaaggcatcgtttagtttttgatatttctgtattaggccttcgatattgctcttattaagactatcaactatttgacgtatttgtttttcttggatagtaagactagaggagttgccagcaatagatttaaccatttcttgaacaaaagcgcgctgtgaatcagaaaccgttttacctttgtcgctcaattcagatatatattgagtcgtggaatcttggaggacttttattcttgcgcttaatgcttcatacagtttgtcatttgactcagacattttgccttgtaattcagcatctgtacgattgtattgttccaataatcctttagccgaatattgaagctgatctaaatcgttaccaaaaatagagtcagaggtagccaaatcgccatacttcttaagaatatctgaagtgttgatctttgtatcaggagatagaacacctgactctaaatccttattgagcaaatcgatttgttttttagtttgatctattttcttttggtactcttcaacttcatctttactatctttaatcttttttgtgctttcattatcttgaccagccaatttggatcgattaagtgaattttccgcttcgatttgcttctgtagtgcttcagtacgagtattaattgcttctactgaatctgtataagctttgccttcggcatttattttgttagcagcaacaccatactgttcaaccagcattacttgaatttctaacaatctctttttctgatcagtgttaattgtttgattgctttcagcttcttggagtgtgctcatttcctgagacaaatcttctatagacttcttttgctctctatacgagtttacagtgtcatagttaatcgtcctagcttctctggcggcttcgttggattttgaaatccaagaaaacagttctgtcaaagcccaagtaactccagtaataatagctaatggtgcaatagttctacccagggcagcaaaagaggtaccgagtattttaagtgaagcagaggcgagaccattggtagcaataagcgactgtaaacttgctttcattaaattgattttagcaggaatcgaaagcaacatggtgtagagtggagtaagcccagtttttgaaaataacataaatgctagtgtagcagctcctacaaccgtaggaaggaatccaattgtgctagatactttacctaatacgttaataagagtagttcctaaatcaacaacaccctttagaaaactagcactaattgagtgctcccagaaagcgctgactgcattggtaaaggtgtgaattcttccttccaatgatgctagatatgtttcattttccttagaagccgagccgaatgaattaatacctgcttctaaggaagcttgagcatctttccagttactaatcatggaagcagcaatattaccttgcattttaccagctactaattctagaacatctgcttgttgaatatcgctaagattcttccaaatctttgataagtcatcgaatatttcatatgtactcttaaaagttttatcatcttttttaagtgttaatccaagtgattggaactttttctcaagcttaggaacgagtccatcaattgcttctccatcttcccctacaccgcgcaagcgcattgatagtgtcttgagtgcattacctactttagcaggatcttgtacagtactgtttgctgctgtaattagcgctacagattgttctattgtattgccagcagaggagagggaggatgccgatctttgtaccgcttgaccaattccttcagtggagatagcaaacttattaccaacttcattgtaaacatctacaacatgttgaatgttcttaccttcattgtctacttcaatgccaaagccttttatagaagatataagctgtttagatgcttcttgagcgttgctgatatcgccaacattttgataaaccaatgtttgcttggcaagctgctgtgattgctgaattgtgtaacctaatctagcccattcggttgtggagttgattacatctagagtcaaaccaccaatctcatttgctgttttagacgaattcagaatgacttgctggtacatttcatttgtttcgtctgttacttttttgagattggtcattgctttgtctaactcatagatatgttgaatgccttctttgaaggcgttaataggagcgtagattgcggcggtgactgccgaccacatgatcatacttttaagtatgccttgaatagaactaccgaaagtttcagaacttttactcgcttcattaaaaccttgcacagttctctttaaatcgttattcagatttcctagtggagacttaaagtcaccaatattacgtatgccttttagtttattttctaactcggttaaactattttgggcttgagcgttaccactaaatttacttctggcatcattaatcttctgttgagtgcttgcgacagactgagcatattgttgatctcttttggcattttgttgtaaagctagagcatgttgcttttcttgtgcaatttgtctttcactgttactcttgagagcttgatagtgagcacgatccagcgactcagcagcttttaatgattgctcttgacttcgtctgtcgatttctctatttctttgtaatgcttgataatgcagcttatccatagcttcaatacgttgcttattagacttcaatgcatcgtaatgcgctctgtccatagtttcagccgacttaagagcagcctgttgctgtttcagtatttcattgatctcgctataattctttacattgccttgctgatctaactttacggatatctgttgtccagaatcattcttatatgtatttgtagtactatttgtttctccaagcttatttttgttggctctggttttagctaatgtataaccttcaagctctttttctagctgttttagtgtacggatctgatcttgtaatgatttagattcatcattaacagcctttttatttgcatcatgaactgtctttgtcttttcaattacttcaccgttctttaaaacttgctgagtaacttgtttaacagtaccatctaagtttttgtacacatcttgcgtttcttttacaactctattttgctgttccattgctacattaagcttctttgtagcatcaataaatccttgaatcgattttacaaaactttggtctacattaatttttaaatctaacttctgaagagaagggtgcttgctcaacgctttaattgaagcatttacatccccaattgatttacctacatttaaaccagcacttattaatatacgcatatctgccattacggtttaagccacttcctttttttactttagataaaatagaaaaaagaagagacttaatatctcttcttactgttcatcttcatatttgatttgttcaacgatttcacagaaacgaacgtactgattcccttcaattccagtaaattcagtggggccacggtttatcaccgattctttaatggatagaaacattgcttttcgttcttctgtttcatcaattacaatttgttcactatatagtttgttgagttctttgagcctttcttgatctttctcaaaggtatattttccgttttctgaaataggatttccttcaccatctttaactacgtaatcaagattaatatcattagcatcattcaccaattccgcataatgagtagtgagaagatcttgaaatttaactctatgtctagtgtcagttcgatctgtttttagctcactgagatatgtaataaagtcctcaagttcaaatttgtataatttcatattagctcccttaacattaagatatctaattgtgataaaaggatagttttactttgagtaacccttagaaaatctggtttttctcatcttcgaaatcacgtaaatcataaatagatgtggtggaaatatcattgtgatgtgcaacgaacttcgaaactattttaatatccttaccactttctaaaagataggtaatacatgaatttttaaaaatatgtacgttaactctacgctccaaaatatcagagagagtatttgagcaaaaatcatctgcccaagcaggagacatagcctttatctcattaccgtatttagtggtaaagatatattcactttcatagccacgagaatctacccatttttttaaatgaggaacaacgtctaatgggatcatatattgaatcggcttcccatctatcgatttaccttttcctcttacgttatgagtcataatataattcttgtcttgttgaatttcataatccaatatttcagtcttgaactgaataatttccgaacgtcttgcaccaactctaaaagctgtggctagccaagccatacctagccaattttcatcttcttctaaaacacccatcatcatatcgtactcatcttttgtaacttttactttttcataaacacgattttttgaaattggagggaggccacgtgtaaaatttctgaagtttttgtagttttcatcttcttctgcgataatattttcgatgtgattacagaaacttgagataacagacttcctaaagctgattgcggatgaggacattttcctgttgtctcgtataaaactcagataacgaagaaagtctctctttgtaattttgtaaaatggcttgttgttcatagaagtaaccatgtaccaaccaaactgtctagttacacttgtgtattgtttgcgagattgaggggagagatcctgtacagaaacaaactcttcagcattagatctatagtcttcattgacttgctgccacatttcatctgtgacttcggcttgctttttggctggttcgcgcaaagtattcttttttacttctttttttctcattcacacatcaaatccttatgtattattaatgagtatttaagtgaactcatcacggtattttgcagtcattaaaaacactccctagtattttttataaaatagctcttttactttatttttgcacttcaaatccttttttacgcaatcccttatagaaagcggcttcgatagcaccattattctctaattcttctcttgttgcttcggtaaatggtcttgccactccagagtaagggaaattgtattggtatccgtgacctgtctccacaatttcactcacatttctaccgtcatccatacgtttactctcaacagagactgtatccttaccaatcatttttatttcaatgttgttatcatcaatcaatccaccgtgatcttcttgacgttgatagacagaaggatgggggtaaactgaataaacctcttccttaattttatctttcattatttctttaacggtgtcccctacgtcgacctctagggtctcaacgacctgttcattcagatggttcattagatccgtcagattgttgaaatccattatcatcaccatcccgatttaaagcattggctaacataatttctcctacggttgccttagcacttttcgcagcctgtttaatcttattgacaatcttttgatattcgccttcaggaaacttattcaaaagcgcctctgtaatacctttatctgcaagcaattcagatagcccaataatatcctttagtgtcgctttttttggaacgggaatattggtaaactctctaaatgctaaaacaggaactagttttaatgtacccttaatcaattcattgtccagttgatcattttttgatgtttcacgtagctcttgaaggtatccaatataagacatagcaacgttctcgattagagagtcgcgaaattcaacgcttacggcaacttcgtattcttctccatcattagttttgatgtactcatttttctttttgtttagactagtctttaacttattcagttccgcagcagttaactttttagtcatttgcctgcctccttaatgttgtttgtactcagttattgctatctcaacagccacaaactgatagcctaaatcgggtctaaaaataacttcaatataagatactttgtcaaaaatattgttattttgtattaacacagacaactcatttgaatgagtagttaatttattaccactatgtatgtctgttgcaatgatgttttgattattatcacaccaattaatttggataaaaacgttttgatcactctcatttttctctgtacatagagaaaaattaattttgctaaagcgagctgagagggggtagcgataaataagaaaatcattatggctgaccaaataattatcctgattactatcaacaaagctttttttggtaacaattcttttataaaatccacatatggataggttattaaggctctcaataaaagaagagcttcgagtttccttagagacttcgatatttctatcaaatctatagttttgtatttctttgaacagtttcattaaactttcgacatgtagtctagatgaatatagactttcgattaatgttcttccttgacggtgtagtatgccactgtctatagtcttggagatggtttgagctaaactaacggtattttcgttctcaaataaaatcaatggttccttatagcctagttctttcgcagaatcattaataattcgatgtccatctatattagatgctataacaggagtatttgtcgaaagggcttctaataccgaaatggggagtccttcgattcgagaagctgtaacatatatatctatttcctttaatattttttcgggggatgtcgtagccctatgtaatttaactttttttaagccgtagctttgaaccatttgttcgaatatatacttatcgctaccttcgccatatatatcaacgctataatcatcatatttgtcctgaagagtagcccatgcttttagaaaaacatctattcccttggtcatatagtaactagttattaatccgattttctttttaggtgtcacactcttactcggaataaatctatcggtatcaactacatttggaactatactcgactgtttgccaaaagcagtttttaaatagttggctatatagtcagaatgagtgacaagaagagtagggatagacttgtcacattcagatgtatcggttctatgtacatattcaatagatggagtaccagaatcacgaattgctgcaacagcccaagggggaggccaatggtacaatacaatatcaaaatcttttaacgttttagttagtaagtcatagtttgttatgtaagtgtatttaaagggacatgtattattcgggttgtttaagccacctgttacaaaaacagttgcattgaaatattcttgttctattttaattaatgactctacgccaccatggtatgcattccttgttacaatagcaactttcattctatccaaccttcgtccataagaactttcgtccatgcagcttcccatttatctatagaaaacgagcttgaatatttgtaagcttgttccttataatttcttatttgtgcctgattatttactaaactattgatggcatcggcaatgtctttggcttgtggattaactagaatgcctgtaattccatcaaaaatgatatttgttaatccaccgacattggtagcaatggtcgcacaaccacttgccaatgattcaatacagcttaaactagtaccttcacatgctattgtagggatgaccacaatatcggaatttctgtaccagtttggcatctcatcaaattcagaattctttatgtaggtcaattgaggatactttgtagctagttcgctaataagctgagtatcaaaatcgtcaccttcgccaacccaagtgaattccacatttttattgtcaactctattgataatgtcttcgagaattctgcttccacggtttatttggcttcttcgtgggaatagaacttttattttattattttgagttttagtatatttcttcctcggataaaacttatttgtgtcaacaaagttggggatataggtcattttgctactcaactctggatataatgctcttattacgtttatggtattagtgtctacacttactattttttgaggagagttaaaagcgttaaataggtattcataccattgtttttccctgaatttataatattgtttgtcataattgtcatgatcgaaccaaattccatgagcgactacaatcgcatcttctcgcatcttcatagctgataactcgggaagattgtatatgacatgatcgtaatctttagatatattgtaaaactcctctgcaccatcaatgttaaattctgaataatatcgaccatgcttaatagctgtcacattgaatccgaaatactcccccttaaatgggtgaggagagatttgatatatatctacttgaaaccccagcttctttaacaatctggatagggataaacaatatctttccccaccaccaaaacgagggcgatgatcaaaccagtcaagtacctgattggtcaaataagctactcttttcatttcgttttctccctttattgtggaaagaacacgtctaatgttttagaccatttctcttcccacttactcttatcaaacgacaaagaaacttctcgcgcatttttagctaagaagtttgctttttctctattgtgatagagactttctatcgaatcacatatgttttctaatgttggcttaataagcaagccattaaaatcattgataacaagatcgcttagaccgccaacgcaactagcaacaacaggtttaccaaatgcttgcgcttcaatgcaacttagactagtaccttctgcgcctagggtggggattaaaactacatcggcttgctcataagcgcgatacattttgttcatgtcgaaatgctcccatctgactctttcttgagtagacacccaccgactaaaatgtttttctccttctggtgttccacgcccaacgaaataaaattccatatcgttgtattttggaaggagctttttggaggcttcggcggctaataaatacccccttaattcatgtaatcttcgcggtatgagtaccgtaaatttgctttttccttttttttctctagggctaaacacttctgtatctacataattagggatgtattcaaatttttcatatagttttggatacattgctttagtccagccaattgtatttgtatcgactgaaactattttgccaactcgacgataacagtctctaatatattcgttatatcccttagagtgataccattcttgaacttcgttgtcccaccagattccatgagaaatagcaattgaattttttcgtgcttctggaaatgcgagggtggctacaaaatatatcgtataatcataattctctgtgcgtttatgaaattcaatagttaaatcgggaaaagactctttatgagcaatagaacaggggatgcccgttatcttgatatctttaaacttctttacccatgaagttgttgatgcctgaaaaacatcgacttggtagtttttcttgcgaagtaaataaacaagatcgaccaaatatctttcaccgccacccatttgagtataagttccagttaaatcgaagaattgggtagttaaaagtgcaatttttttcatctatttctccctgtagtggtctttaattgaatcgataattactttaaatctgtgatcccacgaattttcattagcgatcatttttgcattatgaatatattttttatctttggataattttattgctctatctatattcttaagaaactctttatggttgttgctgaccagaacaacttcgctatagtcatccatttctggtatatctgttgctacaacaggtgttccgtgagcaagggattcatacacttttaaaggattactgtagtcactaatctgacatctttgaaaggggagaaggcttacatcacaatgatgatagtacgcttgtagctcttggtaacttttagagcctaaatattgaactccctttggcattttcttaataccccatggcaaaccaacggcaattagcgtatacttctttgcaactttttcaataagttcaatatcacaccacgttgggttgattgcacctgaaaacaaaataatgggtttatttttttccttcattgtcactagatcagagggtatatcgtagtttaactgtccaaatttatcaaagcatgcattcctaactagatgaacgttgttgtgattcatacgtctcaaattatacaaaggttttgaagcagtcaatagaatatctgataaattgatcattgtatcttcttcaggttcattctcaggaaaattatcaagagagtcataaataactaaatccgctttgatacgtcggaggtcgatatgtctcattgcccaagatgaaaaataaatatcaacctgtggcactcttttcagaaaaacttgccaattgtgatatacttcaaaattaggagaaatacgatcacgcactttatcagttctttgggtacaattcacccaatagaccttatacccattttctgaaaagtatttcattagatgatgaggtcgttgttgaagttcatggtcgaaatcaattgtattagcataaacaatcgttttttgtttcatttaagaactcccttaaatattctggactcataatatgattcgaaaacacacttaaatcacaaaaaagctcaaaccctttgtcctgagccattttacaaaaatatgcgtcctcgccttgtggatgaaatccgtattttactgacttatagattttacgacttaacatgataactgctcccgtaagatccacttccataagagtaggggaggagagagagggagcatttttgacatagctgtttacgatgtgtttgtacattccctgttcagttatcttcatgatgttgggatagaggtaaggcttatcgacattagctatatatccgttccaaatcaatcctgaaataatttctttgtttgatttgagtagattattaataatatcaggttgaacaaggatatcactgtcgacaaataacaatctatctgttctggctttggtcatgacataattctttaaaatactcaaatgagtgtatacatagttattcctagtgcttaaatctcgtttgtcttctgggacattgcggttatatttctcaattcgtatttttttatattcgtgatgagttttcttgaattctgccaatatgttaagtgactcatcttgagaatcatttacaacaaacagtaactcaattttatttttgggatattcaatatttttgatgcgttcaagatatagaggaagtatccaagctctatttctaattggagatgcaattgtaatagtttctgtataaataaaatttcatcctcctaaaataaagagtggctagacatgattgtctacccactcaaaattagttttaattatacaagttcatcttcatcatagattgtcatgatataggtctctttacgatttactggcttcaaaatctcaattggaatgtcaaatacggaagggtctccttcagcagccatagtaaggttccagttatcttccatcttagcatcgaaaatttgaatttgtgctgcaaaatcttgtttagtgaccgtatcacggatcaagcaatctagaatcaattcatatgtaccagcgaacttatcagagctaactgttatttgttttgctgaagcacctgtttgagtcgtataataagcaaccaattctgtgccatttgtaaactcaccagttttaaatgttagctctttaccttcaatcttgtattgcttatctccaagagtaccagtcgcaaaagtaatttcttcaagatgaacttgatcctcagagagtgtgtaaacactatttagtccattaacaggagttgcaggagtgtatttcaatgttgccttatcgtcaattactttaataatatcgcgatatttgataggagcttgtccactcttaatatcattgccagtcatcattgcaataacttcatttgtaaaaatagcatcttgcaacgataccttaccgccgcgatctccagaaaatccaacaatacggttattaccacgaccacccattgcatatacagtagttgcagtgttctcaattcccgatgttttcagattctgaagttgaatctttgctttaccagttttcttatcataaaacgtagcaagtgcaacctcgcggattgcccaagtattaggtgtcaatatgatcacacatctttcttattttaatttgtttgcccaatgtatgtcagccatctttatactcttaccatcaagtgttccagcatatagagctgttattgtgtggtgatagttatcgatattattactaacatacagaccgttgtagatttgataaatattcattttgtacaaatcaaaaaggcttagcccattgtctttccaagctaaacccgcaactatactatgtaagtcaattttttcttttacttttggttgtttggctcgattctttaaaatcatttctatcatcttcttagcccgtgagttggcaggtttaaattcaggctcattctgtatctctacattgttgccaagtcgtataatcttttggattagattaaaattactatgatttatttgtcccttaccaatctcaatataaacactatcatccgattcttttagggttgcactctcactgaaaaacaagtatattgctgcaaatgcattagccttaaactcttcattgtgatagcagtttgcataaaagatatcaaaattcgtaacattattgtctaagtcgctctttatcatacttttatctataagaatagatgccaagaatgagttgtacagagacatgtttatatcaacgattttttcaagaggggggattgtgaggtagccagcttgttcgatgtaaattggtctaccgccaagcaacttaaaatggatatctaaatcatccaaataaccacctacttaaattcatatagcttgtattgtaagtagtaacccacataatttgtatttacgaacatctcatccatacggtaaaattctaactttccaattcctaagcttcgttcttcgttaaacagctcatcaatggcagctatgatatcgtcgtatcttaaattctcataatcggttcttattaaatctttatgtactagaatttgaaaatgtagtagagcagacttgaatttcaaattatctgtcggtctataatctttaaaggaaaaagtaacatacgaggaagcgtcaccagataactcaggaacatggttgtaggggtatattttactgaacaatagagaagacggatcgtctattgtatttcgatttaaataattacttttatcgtatagtaaagccttacataattcttgtgaactaataagcttttctaagacctttgttctaagagatcctaattctctaaatcgagacatgctagttcacaataaaatctctggtcagtacatattccagaaaaccactagtgttcatatctcttgtatcatcaaatgtagcgacgaccttatctacctgatctagagtaagtggagtagtccggtggatttcctcgccaagactattacgaaccttaaccttatagtaattaccgttaggttgtagattgccaagttcatatgtaagagcaatacattttagagcttcaagtgcagatcctttgtctgcatgtgtttccttggagaaggccaatttaagtttgttatctgtagcaatcgaataagcatatttatattgtggattaatagctacgtctagatcagcatcaatgatttcaattgtgggtgtagcactaataattacagagttatcaatcccagatgagtgctgcatagagtagggaaggggagagaagataagccaattatttgtagctccttgagcaaattgctcaagtttaagttctccaaaacggatgatggcttgcatggatacactccttatagtaatgatttaatttcaatttcttttgttgaataagctaatctggtagagttttcgacatgcaaaataactctgcctttcttgttgttggctttaattttacagtcttgtccagcttgttcgattatgctggctaaagtggtggtagttaagccatcagtctcggtcaaccaaaaacgagccttttcttttcgatcaattccattatctttaaacgaacaagcgaaggatttggtcatattgtatttaatgaagtcgtcaccagaaatgtgagccgaataattattggtagtagaggacgtgacatttacttgaatggtttgtgatatatttctgaatgaaatggttattttacttgttccttttttcaaaggagttactaagccaataggagagactgataagatattttcatctgccacagaatatgtaatttgatcatcaacttctattacctttgaattattggttaattcaatgttcaacttaagagtttgattttcttctattgccacaatatccttaacattcaaaacctttagttggtagtcagcgatgttgcccatataatctgcaatatttagatctaaattatcggcaggaattacatcttgctcttcaagagtcaagcttattaatccatcgattaaccgattgatccccacagttttccaagcacgaccatcaataataaaacgcctatttttctttattttctcggtctgattattcttttgaaccgttatttgtcgtctttcattaggcatcatcaggattcttccttcttggatgccaaaattagacgatgtatccgatttgaaagagaatggagtttcttgaatttctcccttatcgtctaaccatttaagagttgagtaacaaattagaatcacgccacgatggtatatttccatatcatcaacatgattacataaccaagttttatctttccatacaaccaaatcacccatttttaacggataatccattgcgacaatattcttctgttctcgtacatctccgtcatcagttatccaaacttcttggttggaatctccgttgatactcacttcataatagctaggagattgtgaaaaagttgaattcataacttgctttgtgtggacgatgtttctgtctctaacaggagttttactgttagaaagatatgacttgtatgccttgtaactcatactaattcacactcatatttttcaaatagtattgcatcattagcgaatcagcacgttcgatagctttatcccgtaatacagctttttctttaaagttctgagattcgctgtatcttttccagtcagacgaagaaatcgctaatctcatatctagtatattatttacttctttttcaaaccattcaccaagcatgagctgtgatagtatttcttgctctaattcggttaaatcagcagcaaagtatttattttcttcatctctgtcaaacagatcgcttttactgtagctaaacttaaccaagcctgatttaagaaatcctgtaagatagtcttcgtaatcttcaattgagcttagaaacatttcatcgattgtataatcctgaattttaccttgaaatctctcaaatatttttgaatatggggtcatgattaatcccctttacacgttattctttactttagccagttcatacaggtcttgtttgatcaatttaccaatagagtctattttgtatctatcttggaatctactatcattagccgcaataccaaccacaattctttcaatgatattttcttttaacgttggagatacagaattcaatgtatcaattatttcttcaatatcaagagagataatattatcaattgtttcacgactcacaaatttctgataaacatcatctagatacaaggctttaaccgctttttcactttgaatcaagaatgccccttcatgagcaaacttagtgtggttatctacaattgcccgcacatcttcaaaggtaatcgtcttagagctgccaaaatcattgaatctaatagtagatgtagtgcctgttagatttaatccaccattagttaaagaaataactctaatgtattcacggggatcaatatctaatttatcctcaacagattcgaaaagagagtttacttttttagattctgttttgatttcctcatgagaagtttcaatttttttatttttctccagtaagtcttcaactaaagaagtgagtttagcaacttgatcttctaatgcgatttctcttactgttttttgagtaggttcattgcttgtgttttcagtattagctatctccattttctttggtgctgccatctatatgcctccctgttattttaaaaaaaggtcgataagaatgcacttaccgaccaatgaaattatgagaatttatacaatccataagctgctgctgtaatcaactgcacatcataattctgtgatacagaatatcccattgtttgatctgcattatcttcaggtttagattgagtaataattgtgttaccctcaaaaccaattttgaccagcttatcagagccagaagagagcacaacagcgaagtcaccatcgatagcaaactcatcgctatttggcttcaaacgttgaccaatttcaaaaagctcagtgccttggaagttacccagatgtccagtcttattaaattcttgtccaagaccaaattgaaggtactgattctctggcaagatacgagcaagtgcagttttagtgccgaataccacactcttgtccgtattgtttgcagcagaaacacgttgaaccagattgttaaaagctgtagaagtaaaggcagcattttctttatatttagcacccagagtagtaaaagagtcataaatcgaagagtaaatgcgagtagtgatatcagtttcaattgcttgagctacacgtgcaacccatgcgccccaatttgtttttcctgcaagcacacgatacagttcttcataaatttctacagtacggcgttgaggagtaagtgtcacatcttttccgaacaggcgttgacgttgattgcctcgttgaccattggcttttgtgctaaccacaaacagatcaggactatctacgtgaaacaggagttgatctccccagtttacatttttaacttctgcgaattggtagaaactatccaaaacagtttcaggaattacaatatccagcgtttgagccaccaaagcaaaagttgcccattgaacatttgggttagatgccatcataccttcagtaaaattagtatcagacggaatgcctgctagacggtaagcttctttttttaagcctttggtgaacagttcttgttttgcatcaagggttacgccatcattcgcatattgagcatacttattaaaacgaccatctttgttacggttttgataacaatagtggtaccaagcttctacaccagcttgtacaacatctttttcattttgcgacatattaaaaaacttaagattaccatagtttttcatactaaattagttcctccgattattatgtattaggcttctttaattacttgcagtttagttgctggcacacgagagcgaccaacagaaatagttgttttctccaaaactaacattgctactttcgttgttccaattgttgcactagcaatacctttatatttaccatcctgtggaataacatattgatcaacaactgttacaccatcaatgccatcgtctgtagtagtgaatgtatcgccgtttttaagacggaatgcacgagcaggggtattggctttattagtgaatagagcggggtcacttacatcaattcgaaatccgttaacctctggaatttctggacttgcaaccaacaacacttcttgagctgctacatcggttggagttgcagcaatgcgaacttctggattgcctgccaacactccttttagaactacgaagctaccgttatcaaccgcctcaggcagttgaacagactgaataaagctgtctactttagtaccagccataagattaagatttacaattgtactcattaaatatatttcctcctattgattgttttgttgagaaagtctatcccaaactgttttaggtgtttctttattttgttcactgtcatctggaagtcccattgaaataaaattaaaattcttcgattttgtagtttcgataatacgatcacatacgtaagatttgacttccttttcaaattcagcaaaagtagcaaaagttgagcgattctctgtaaacttagccttttcgtcttctgttagtagagtagggtaagagttaaatagttcatcgattttttcagtatcttcagcttctttaaactttgaaatttcttcttgaagttcattgattttctcatctttagatgtaatttgagattctacttcagtgaatttctcttgaatttcagttaatttttgattcaaagaaagaatggcttcatctttaccctcgattttttcagtaaactctgctaccacagtttctttctcagttttttctttgttcaatacttctgttgcttcgctgttaattaaatcaatagtggacttaaaggtgttgatcgcatcatcggcttcatcaccatctacccaatctacaggagaatatttaattcttgtcagagtgttgaaatcaattacaacattatctccttgcatactgtaagatgctttcttatacttgtatccgtcttggacatcgcaaagatagatgtaattttcatcaaagtcactaagataataagagcatctttctactgactctccataccaattagtacctatgtatttttgtttactaagagcgttatcaatctcttcgtataattgattagtagtcaatttgaaaagggctgcaatttcttttttgtttttttgcaattgaacattattctccttactgttctttgtttgtgtattagcttcattaaaatgatgtagaaatgaatctagctctttcatttttttggtaaagtcatcatccgaagaaaaatgctcaatttttgcgtgagcattaatcataccagtgccgtatttattgcccaataaagtaacgccagtatacctaaatgatttgatattcaatatttttgtttctttgttgtactcagattcatcaattacaatttcgattgacagcttagtctcttcttggttgttgatgatattcatctcatcttgtgcatagacattccatatgtatccatttacaactgcataatttctcccatcattttcttcataatgatagttgttattaacggcagaaattaccccaatgggcttttcgatgtatgtaattttatcttcatcttcgtcgtattccatttcgtgctcaccaaaatcattgccttcaatatgagccagtatgggaatgttgattacagacgattctgcgctctttaacacatcaagatcaatattacttttattgttatttacaccgtcatgggctatccacattcttaatcttgaaaatctagaatcgtttagaggttcaatttcatagttttcgacaaatagagtagcttttttatccttgttttttataattatcacctcctcaaaagagtctaacgattattcaaatctaaatctcttgtctttgcaccatcatcactaagatcgttatcagatacttttgggcgaccgccatccttattaccgtttacgtgggagctggaaaggggaacgaggtatttttcaacaaggttaatactgttttcataagccaacagactttgcatatcttcagggttgatacccatagccaaagagaccaatgttttggaaaatccaaactgtccagctttaaggtacttttcgaacttttcgtctctgttgaatactgttatatcagggaagacaactttatggcgatattttcccgttttgctttttagatagctattaataaaacgttcaaattgacgatacatatgaattacataaccttcatcgaccttgattgatgcttgaagaccagaagcattaacagtccccgaaccaaataatataggagtagaaccagcagcttgataaaaattatcctgactaaaaccaactatgttattttgagtttgtgattgattaaaatccaccgtttttaactcaaacggggtagtggcaacttttactccattcggaacaccagcttggaggatagcagtatactgacctgcaacatttggatcaatagcaaagttattagctaccgaagcccccttggtgtcactcttcattggaatttgcccaacaattatcttccaagtttcaagctcggtttttgttttcagtaaacctttgtaatgctctatttcggcactatctaaaaataaccccattaaaggtggagtaagtccagctcttgtttcatcaaatttaaatactggagcttttataggatcgagaggctgccaataaaaataacgatccgtgctgctcttagcattgacaaagtcactgtaatattcactaaattcaggagcgaaatcgtttatattcacacctgattgtaaaaagtaatacatattaaaagcatactgatatccgtattcggttttattgatgatcttacagtattttgcaggcatctcttgcaaagttactgaatcgccatattctcgaacataatagaatttggcatcttccaagatgacaccctttaaaatatttggaaaggtagacttgggcgatagtttttctacgatatctacggctttacgtctggattttctaaaagctgtagatttcatatcttcttcatcggcattagttgcaactataaatgagtcaaaagtaggtatagtagaatagtagttaaccaatcgattaaactgcattactacattaaaaagatactgacttaaatcctttaaggcatcttcgtttacttttggatttttaatcatttcttcaatcttttttcgatcaaatgtagtaggagacatgttcaaggatttcagcaattcattttgccatagtggactaaataacgaaccactctgataactgttagaaagggcttttgcgaattgcaatgcataatcttcgctattgtctaccggaggagcgtttttatttacgttgggtgtatctttattgctttttctggtcatcgttcacatcctttctgcatagaattattgcgatatgtatagatagtccaatatattaaaactatcttcttcacgtttataatcttcataattctttaagtaataaagaacatatgctaacgcagcccaaatatctttctctgttttctttacaacttgttcgacacctaatttaccaccttgcttttgaactaacttaagatttgctacttgatcaataagttgatcactttggaagtgggctgctttaatctgattgatttctaaatccttgtctttcgaatttttaggtttgttgcctaattcgagcatcttctccggtattaacaatctcaatctgccactttctacaaagtcgatgaaattagtaataatatcagtttggattccttgagcttttaaactaaatattttctgaagcgctaaactatcctgaggcgattcatcggtgttgatggtattccagctatcataggggtcattcataagtggatctagcgtttctttcattaattcctcaactacaccttgaccaataccattagcatcgactaccgtaatatttcctccatagtgtttatctaatcttttaataaacatagcttgttcattgaaattagttccgtttggagggacgaaaatattgcaaaccgtagctgttttaattgtcccgtttgtacttctttcgacttctattaccacgaatgcagatttattattattatttgactgtgaacgtgcaatatctgctccaatgaagtactctctatttttctttggattgatagttgcttgtttagttgtacgaagttccatgagtttattaatgttgactattgctccatcacttactccacaccatctggattcgtagttttgggcaaatgatattgcgctagtagtggggtcatcttttttagccaatatctgcgcgcgcgtctcacctctgccgtaatgacaaggtagttcccaactcgcacccaaaactattttacctttaagattagccatttcatcaatcatattgtttaatcgaataaattcatcgctgccacggtaaccactagtagtcaagtaattgatcataccattaagctcatagggattaattgtagattgcttaccaatagttcttcttggtacattgactacaggttccaatgcatctttaaacaaggagttgttcaatagtgctgattcctcgacgttcagtcttcgtctacgttgacctttagagtgttgtgaattcgcaaggacgctataaatcgcaccagatgaaaagactacttctacttgatcttttgagaagctagacttaacaatctcattattcataagaggaaaccatttaattatttcattatgtttttcttcgcttatcgaagaagcattttctcttgtttgagcactcattgcgattgtgatgtctgggaagtgaatgcatgtgtggtaaatactcattagttcaagcatcgtcttaccaaatccacggggaaagacaccatacgtactaacaaatctactcattgaacgtaaaaaaactctttggtcaagatctaacctcataccacctttttctggtgatatcaaatcataaaaaagatcaggaaaccatttactccattgaataaatgtaatccatttttctagatttttatcgaaactgctttcctttttttcatctagctttacatttgtattgaaatcgggattgttgttcgttcttgagcttgttctagtgtgtttgaagttatcgctctgaaaatttttatggctagccatttagatcatctttttctagggaattgtcactcatttgactttcataatcttccgcttttttattgtaaaaatcataaatttctttgtattcacaagatggaaggcctcgtaaatcccgaacatagttaatgaaacaccataacgttacatctactttatcttttggctgctcagtaaattgcggaaggaggggcattatttcataattttcttcaaccatcctagccaactgaccaaacgtgtctaaacctccagataaatcagctttactcatctgtgagggttttagttttcctgcttcagcaacatctttaaccattgctgcccattcttttgcttccttgaagttcccttttgctttagctaaggtttctttcactttatttacacaaaattctctaaagtattcttcgtgcatcgttgtgagtagttggaagctggtttttaattgttggtatttattttcaaacaatgtatactcttcatctggatatccgtatccgtatttatctttaagttgatctaagttgtattgctcattaatgttatgttcatagttgatatcgtcatttttttctttggtttgcgaaacgctttggtcttcactgtctttccatgtcaactctctatatttgggcagtcccagtgttttcatatatatcccgaaatggtcatgattttttagttttgattcttcctcagaagatatccacaaattatgtatgaatggtctattgatctgcattagtatgtcttttgcagtgtttagatcatcatagttaattgaaatttttaagcaatttttacatacgctcaaatgaccatcgctatcaaatttattgtaggacttataaaaatacgaaagagccaagctcttcttacaagaagtacacatcttcttattgtctgccaacacttcaccttctttacatagaagaacataataaaattcccatttgataataaaaaatcatggggtaggagggagtcggcctgtttaaaggttccttttacagagcctccccatgatgaagaacaaataagaaaaagcctgataggactcaggcattcgatttatgtattcttcggactcttggttatttcaatttattcacaatcttcgtaatttcctcaggagtgacaatttgttttgctcttttgtcagttcgattaccataaataaatgctgctccatcttcggcataatatactacggattgtttattgatcactgggtatccgtgttcttcttcaatatctacttcaacaattttcttgtttagagcgtactcttccgctagctctttctcattaactacatgcaaaatttgatatttatctaagtatgcgtacattttttcctccaacaatatgtatgtgttttattttatatcttgtaagttgatatctatcttgtattcaattcgtccatcttcattaaagatgtgcattttttgcattgcgtccgcatacatacgtttactgattgcgtaagagtccgcgccgcaaagactgccattagaaattacagttgttctaccaaaatcttttactgtgtcgtgatgaatgtggccttggaagagatattgagggatcactccgaggaattgaggtaattgtcgagcagcacttgagacatgatctagatcaccatgtacatatatgtggggcttttcaaatgattcatcgataaaatagccatcttcaccttttaatagttcaatattatcgaattctcttaggcgagtttccatataccaaggaataatattttcaaaattctcttttaatattgcttcatttttactttgaaaggtacggctgtgattaccgattagatttatgactcttactttaggtacatactttgctatctctgcaacagattcagacaacctctctgatatgtattgagtttgagagatgacatcttcactctgttcaattcttgaagttagatggataaaccctgcgatttgatctccaatagaagctattgttaactcattaacattatgtttctgacaataataaatcgtcttggatacaagatagttaaaccgcttatcgaacacatgtggattatatttatttaaagagttatctgattcttgtccatagtgaaagtctgaaaaaagcacatttgcgcgtatataagaggaactttccatgacaggagagtaggggagaggtttaactttctcaagttgctttatgcttgatgaaatttcgtctttcagatgctcaaacttagcaatcatcttgattttattattgaattcgcgcttttgatcttgaaattgatatttttgcttttgtaattcaatagttttatcttcaatttcgcgtctatattcatcagttgatgacttgtttacgccgatggagataccacgagtaagtaaatgaaactctttacggtatttagactctgtgaaatcttcattaagatattcattcataagagttgcgatttttgaccaagataactctagtgtgtccttattagaaccaatacgaataagatattcttcgtatgtttcgttatgcaaaggttttaaaggagtcattcatttactcctcttcaatttctagaccaactggaatttcataatcttcaattggagcaactttgattttttcaccatcaattgtaatggtgatcttagaggcattagggtatagtccaaaggctgcttcccgaattccattcaagccaaccagtttctctttatttgattccatatgtttttctccctaaaaatatgtattttttgagcctgagtgatctactttttatagcttaactcatttgggtaagatggaggggagattaccccctccagtatttacactttaacttcttcagccgttagtctaccatgtttcatcttgcggattcctttgttcaaggcttagtaaagaattgagtcaatgcggggcggtgtatcccgatctctgataacttgttataattgtatacaacaagcgtgtagataaccttttctacttcatcggctcatgtccgctttatgtctactttagataaagcaaaagggtaacttaggatttaatacacacggaaattatgatccccccggaagggaacgccacgttgccctgtggcgcgaaccacaaatggctctatatatgtatgtaaactttataaaattactgttttacttggtcttttagtgcttttgctgctttgaacgctggctttttagatgcagcgatagcgattgtggcctgtgctttggctgtttcgggatcaatgccttgttccttgagttcgcctagcaatttaggattaatgccattacgagctgctgtctcgcgcacttcgaaagtaccaaacccggcaattttgacttcttcgcctgtagtcaatgtatttgtaatagttgtaagcaatgtatcaaccgttgtctctacgtctttttttgtaaatcctgttgcttctgcaatcgattttaccagttctgttttattcataatataattatctcccttagatttgttttggtatattttaaaaaagatagagtcgtccgcttatacttagcctatagcctttttaagagcaacaataatttggttaacctttgccattcggaagtctctatcatatagcaataattgatgacctcaaaaaacctagtgtttatatgtattttttgacgattttaaattaaaagtgtggagtttttttaaaagccattaagaatttatctttttgggccttatagatgatgttcagcattctcgatgaaattttatcttttttgtgttttgatatttttaatagaagagagtacatagtatcttggctgacttttagtttatcaatataaaacttataatatttcagtatttcatcaacactttcgtcgcgatcttcatcggatagagccttattgtatactccgttaatcttcatacacatgtcatcgacgtactcaataattttggtttgctgctttctatctccagctttgaggttatgtttgactagtgtatctttaaaatcagcgttctttctatgacttgctttatcaatctcatccatttcattgaaaaggaaatccattggacattcatagtgtgcagttctgacggttttattctggcttacgtatttccagaatagaggtttttccttttttaactctttcgtctttgcaacaaaatcaatttctttcttaatatctatctcaaacatcttttttgctaaatcaatacatataccagagagaacagtgactacatcaatttttttcattaattctgacagttcaaattcactacacccattattcagtctatcccagtaagtagacatacaaagctgaccaacgttaacagtacgtcctatgtatttttgactctttgaaagttccttgtcaatcagtgacatgtcataattacatacttgatatttttttttactactttcaacttgattaatacatactctgtacttaccaaataactttttgctaatttttaatagatcatcattgtcaatcattagaacagtatcgctatcgtaatcacaccctgagagtatatcttgcagagggaagccgatagcatttacacagacaatattgtcagttaaattaaaatatttatcgatgtccttaacaaaaatatttttggcaactaacacgttgcttgggctggtatgcggatttctgaatccagttatctcttttaatccaaacatggtggtatgtacttcgttttccttcaaggcagggttgtttatatccaacttaccaatagcatgggaaagaaattccattgggttgcctaacatgactagataatccccgtgcatcctaatctttcctcttttgatgtggttaacatgtgcgtttatagcttcagttctaaatttacggaatatctttgtgccaactatatctctattctgatagtacaaatctacaaacatattgttactatttatatcatttgccgattcttttataaactcgatgaaataatcgtcgtcattttttagtttttctattatatatttgtcaaaaacagaaaacctcttgatatcatctctagttattggcagagagttgagcatctgataactcgtctgctggaggatattaccatattcatcaaacccacgtttagattttttttcatgtttgcagacaccaaaggaacagtcgttatctaagacaatctgtttccagtgttcccacatgtccaaatctgaacccaacagatgactaaacttcaaagccttaaggctagttggcgtaataatcaaatgaacgtctcttgctagtatatttaacccaaacatattggtcagtgaccagtcgttataattaatgtgggaggggcattgagattttaaatattcttgaatattgcaattgaatgccgcactcttaaacatatgatttcttagtagcatcattcctttattatccgtaaagtattgactatccaataaggactcaccgtcgaatagactatttcttatttccgactcgtcggtaaaactattcaaatacccattaacatctgtgcgaataacattgcaggttttaatgaatctactctcaacatctttgataatcagaatgtttcttgggttaattacaattacatcttcaagagaagatccaaccaaactttcgtatgccaagagggaggggtagtccacagaaacagaatgttctgtaaagtttaaattcatacgactccaagtaatcatgggatcaaacaactcttctttgatgaagaggcactgcccaattctgcttttggcgcttgaccttttataaacaacatatttcacattattgtacataaatccttctgtatacagctttgtacgtaaatcctcattggaaacttctgaccattttgctgagtttatatccgattcgatgtaatgtataaattcagttaatttgtttttataatttattttgtcatcatccaagtcatccactttcaaagttagggctttaattatatccctgcctgatttcaccttttgcttaaattttacgtttataatgtcagaggacagtagtttttcgttagtttttttctttgttgtgttcattccaatacttattagtttattcaactctaggctactggggatcatgccaacataattaaaatctaaatcgcgatctctaaacatataattgtatatatcgcttccttcgacagaagggatatatacgggtttatgcaattctttcaataatataaccctccgttttgttgctgcatatgtatttaattaatagaagctattttatttccttttttactgtattcagaattataaggttttctatagtgttgcttttgggcttgattcttcatccaaattacttcgtaatccatatatgtatagtcttcttcttcaatatctctatctagtgatacatctctctcatcatagtaatctaactcatatccgtcatagtacaaatcctcccaagtaataattgaatgatttcctttattctgttttggcattatgtatttatttccccttaattatatttttatgtcagagagtaatcatctctgcattaacaatatatcaccttctatcatcaacgtcaataaataatatattatttaattatatttacttgttggaatacaaagagtataatgaacataaaaccaagagggggatatgagcaatgaatgcaacaacaaataatattgttggcttacatattaaaagcgtgtatgaagacattgaaacgcatttaaatagttttgaaagtaaattcacttcaaaaacatatagaaatagtttggctaagttttttatgtggcatagcaaaggaaaagatatgtctttattaaaaaaagaggatctcacaataagaaatgcggatatattgagatatagaaattttctcgtggggttgaaagatgaagagggggacagattatatacaaacaccactgtaaataatcatatagctgctattcaaagtttatattcattttttgagaaaaatgattatgatgttaaggctattacaacgcatataaagccactatcagatgactctaaaagatgtggtgctttgtatccccgtgaagcagagaggatggctattattgcagagagaaccaaaaaaggaattgaaaaatcagcactaatccaaatggcttacacaacaagctttcgtaaaagctcacttctgaaccttgaatggaataatatagtttataatgatgttcacgactactatgaggtgcatattattggtaagggtggagtaaaacatgttatgcccatcgaacctgaattgtataattatttacttaagataaaagaacaaccttattacaagcagtacacagacaataaagtatttcatctagatcccaaaacgatacaaaagatgatggattatttaaaaatagaattgaatatttcaacggaaaggaatgtggtattccacagccttcgaaatgtagcaagtagttttgggactcttgaagaagcaaagaaacactataatcattcaagttatgatgttactgagcgatacagacacaatgacaatgacttaagtaatagcttgagcttaaggattggaaatcaaatgagcgatgcaatatttgaagaattgtcgaaaaacgagttgattgatattattcgaagtcaacacgaaggagtgatttttcaaatgaagagagatgctgcaaaaaaaattaaagaaaggataacggagtaaactctgtgaaataaaaatatcaagtatgggtgataataaaattaaaaaaacaaagcgaaataaacagtcaatccacttaccgacaagtactgttagagattcaaacataaatgctaatgatttctgtttgattctttatctcaagtacttaacatggaaaagtggaagtagatatgagtttgatgtttctctgtctgaaataaaacaatttttaaatatttctgataataaaacgctcaaatcctcttttaataacatttttaagcagggctatataaccaaggagataaaaaagattctacccaataacccaattaggtttattctaaatagggggaagtttgatacagataacaaacttgacgaaaagttttttacatatctaccaatcaacgtactatatggaatgaaggatcgtaaattagatagaaaagaggtgcgaattctttattatataaaaagttacattaattactcagatcctaacaaaaagtattgctttacaggtatagagaagacaatggttaaagaattaaatatggggaaaaatacgattccaaagtatactgacaaacttatgaagaagaaactgatatacatagaaaagaacaaattagaaacaagctatcaatatgatgaagaaggcaatttaatatttaaaagaaaaaataaaaattattat

SEQ ID NO: 2636 - DNA, 81382 bp, Unknown
  Kingdom: Bacteria, Phylum: Firmicutes, Class: Bacilli, Order: Bacillales, Family: Paenibacillaceae, Genus: Paenibacillus
tagaagcaagcttctacataaccccgctcgacttgcatgtattaggcacgccgccagcgttcgtcctgagccaggatcaaactctccattaaagaccaaccgaagttggtttatagaaagagcgataagctcatgttaaaactgacgagataaaatatctcttgtttgattttgcgaacaaaatcgttttactcactcgttgttcagttttcaaagatcaaacattcattgtcagcctcggtgtttctttcaacccctcagcaacttttatagtgtatcatattctctagagtcatgtcaacacttttttttcaaaagtgtttttcgctctttttgataacacttgaagcgacaagaaataatatatcatactttctttatattgtgcaactgtttttttaaaatacttagttaagtaacaatacactcgatataaagctctctttgcagcattaagttaatgatttccccatctacttgaatcaacggacgagtcggatgatctcgatcagcaaatataatttcccctgtacggttatcattgaggcgcaccttagttccattattgaattgggttaacttatgaataaagacttgtacgacacttgggtccagctttccaaatgattctgacttgatttgctctagaaccagatacggtgattgagcaggtcggtatgttttctccagagtcatggcatggaatacatcagcaactccgacgattttagcgtaaatgtggatttgttctccttttagacgtagtggatatccagtaccgtccactttctcatgatgctgaagagctgccaaacgcacaccttcgttaatagctttcacatttttaagcaactggtatcctagtgatgtatgactacgtatttcttcttgctcttcccacgttagtttggagggcttgtacagaatggccgggtccattttagcgttccctatgtcgtgaagcaatccagcaaaagccacttgcatccaatccttttgaggtaatccgatccattgtgcaatggagtaggaagtaagggaggttagcacggcgttgtgaaaaatatagtccacttcgatcatggcgggcggagtataggtcattacattatagcgctgaatgtgcaccagtaaggactccaattgtcctcgcagttcatatatagataaattagagacgagtaccgattgaaatgcgttcttaacgagcatcaccattttgtcatactcatcctgaaattgttcagattcatctcgcccatctaacgaaggtccttgcgattcagatattccagatcgaacagtcgtagactcgccactggattttgtaagatcatccgttcctacctcaacttgctggatcaggaacgcctgtaaaatctccaagtcacgcggtagcagaatgcgccctttcggtagcagcaagctgcccatttctgtaaatacatcgctttgcaatctaagtcctgcttttaattcgggtacgggtacagttgtcatggtcaacctctctgttctcacaacagctgctccagctgccagttatgatgtcattatattacttgggattgatcctgtacattcattttatgccatttaaagcatacttgtctgaattcgttagccagaaaaagaaaaaggctccccgaccaaatagtcagagagtctcttccatctaaaatttaataactattgttgtttccatatgcaggctcttattcgccctcagaagattctgggtcgttaccttccgtatcttctgtattcatttcgagagttggttcaacagatgatagagaggagccctctccagcttccccatcctctaataattcttcaagcagttcatcctgctcctcattcttgttcgctcgacaaacagttgcaaccgaatcatcatcgcgaatattaatcagccttaccccttgtgtattccgacccatcgtggagatttcccccatgctagtccgaatcaaggtgccactagctgtaatgatcatcagatcctcttcggtttttacaaccttgagaccgacaaccggaccatttttatccgtaacattaatcgtcttgatccccttacctccacggctttggatacgataatccacaacaggggtacgcttgccataacctttggccgttacaatcaggatatccaggctggtatctacaatatccatacctattacagcatcactcttatcaaggttgatccctttaacccctgtagcgctacggcccatagaccgtacatcactttcagggaaacggatagacatgccttgtgctgtaccaataatcatttcctgctgtccgtccgtcagcttcacttcgatcaaggcgtcatcttcacgcaagttaatggcaatcaagccacctttgcggatatttgcatagtcgtcaagtggtgtcttcttaatgattccatgctgggtcgcaaagaatagatagctatcctccacaaattcctcgattggaattaccgcattgatcgactcaccctgttcaatctgaatcaggttaataatcggtgtcccccgggctgtccggctaaggtcaggaatctcataggccttaatccgatataccttgcccttgtcggtaaagaataacaaatgatgatgtgaattcgtaatgaacagatgctctacgaaatcctcatctttggtatccatccccactacaccacgaccaccgcgcttttgactgcgataggtagtaacaggaaggcgtttgatatatcccgtatgggttacagtaataataacatcttcacgcggaatgaggtcctcatccagaatactctcttcacccactgtaatttcagtgcgacggtcatcagcgaaacgttccttaagttcattcagctcttcgctaatgatgttgagtaccagatgctcgttcgccaaaatctcacggtattccgcaatcttttgtattaactcgttatattcgttctcgatcttctcacgttccaaaccggttaagcgttgcagacgcatatccagaatagcctgagactgctcaagagtgagcgagaaacgctcaatcagtccttcacgagctgcttctgcagtttgggaagaacgaatcaaggcaataacttcgtccagatgatcaagggcaatgcgcaagccttccagaatgtgtgctctagcttcggcttttttcagatcaaattctgtccggcgacgaataacctcgacctgatgtttgagataatgatacaagacatccttcaggttcaaaatcttcggttcgttgtttacaatggccagcatattaataccgaaattcgactgcatggccgtatgtttaaacaaattattcagaacgacattcgggttcacgtctctacgcaactcaataacgacacgcatacccgtacggtccgattcatcccgaagatccgtaatgccttcaatacgtttgtcacgtactaattcggcaattttctcgaccagacgagccttattcacttggtaaggcagctcatgcacgataatccgtgctttattgccaatctcttctatggtggtcttcgcacgcatggtcacagatccgcgaccagtctggtacgcctgacgaataccagagcgtcctaaaatataacctgctgtcgggaaatccggcccttgaatataatccataagttccatcggcgtaatgtcagggttttcgatcagtgcttgtacaccatcgataacctctcccaagttatgcggaggaatattggtagccatcccgactgcaattccgccgacgccattcaccagcaagttaggataacgtgcaggtaatacaacgggctcgctctcttcaccatcgtagttcggcataaaatcaacggtctctttgttcaaatcacgtagcatttccatggcaatcttggacaaccgtgcttcggtgtaacgcatcgcagccgccatatctccatccacggagccaaagttaccgtgtccgtccaccaacatataacgcaaggaaaaatcctgcgccatccgtaccatcgtatcatatacagccgtatcaccatgagggtgatatttaccgataacttcgccgacgattcttgccgattttttgtaaggcttatctggcgacatgcctagctcggacatcgcgtacagaatacgacggtgtaccggcttcagtccgtcccgcacatcaggcaaggcacggctaacaataatactcatggcataatccataaaggattcgcgcatttccactccgatatccctattgatgatttgcgagttattttgatccgccatgctggtcctccttcttatccttcaatacaatgctctctatgtgaaaagcctaacaagatactgcctatacactccgctctctgcgcaggattttggctgaaatcctcatctgtgtaattatattactttcacaaaaagagcacaattaaacgcattgtcctctttacagcgtaaatccctcgtcattctctttctgcgtgtagcagattgctatctcttgtacaactcacaagccctgatcataacaaattccccagagctggggattagcccccaccctaagggccttttccacatacaatacgtatacggtcagggttcacttagcaaaattccgaaaaacgccgtatttctctattatatcattgttttacgcgcttgtcctttagtttcccttgttttgtcaaagtgttgcggattccaagtacatgactcatatttcgaaaagaaagggatgagattacttgtctattcagcgagtatccagtaagtggaccaaaacaaatgccattctccccaatccgacattggcggcttatgtaccagaaacacggttgtacacatttgatcacttgaacgaaatgttggctgtgtatggtactgtctatattaagccggataacggtacttatggaaaaggggttatgcgggcagagaggctgacagagccgcttccaccgacagaagaaggaattatcgaagagagaacttggtatgtgcttcgctatgaagtagataccttcaccttcgaaagtctagaagatctgcataaagtggttacttcccgcatacgaaaacgtccatatctgatccagcgtggaattccacttcttcagcatgaagcacgccctttcgatctgagggtattaacccagatgaatttgagacaccaatgggaaacaacgcttattgtaggacgcgtagctgctcctgacaaagtcgtcaccaatcatcacagcggtgggacaacgcgctttttcaatgagctagtcgctccatacatggatgtaaaggaagctgtacgactggagcaaaaattatcaaaaatgggcgaacgggtagcctggcagttgcaaaaaagatacccacgtttaagggaaattggattagatgtgggactggatcagcaaaattatccgtggattctggaggttaatacgagaccagcaattaaggtgttctcttctcttccaaacaagagcctctatcataaaatattcagatatgcagtaggctacggccggtactcttcatccacgggtaaaaccatacgctctaagaaaaaagcctaaaacaatgagttcaaatattcaaatacacccgggctggttaatgagaagaaaagggacgcccatttgggcgccccttgtgaactcctacaaaatactacctaatgagcacataaaacagtcactaggaaggaacgttaacattaaaaatcaagatttttcacgtacttcgcatgttcttggataaagtcgcggcgaggttctacattatcacccattaaggtattgaacagtgtatcagccaacatcgcgtcactgacagttacctgaagcatagtacgactctcagggtccatcgtagtttcccaaagttgggtcgcattcatctcacccaagcctttatagcgctgtacattgtatttcgcgttttctccaaattccctgatgatctcatcacgttccgcctcggagttcgcataacgtacaactttgttacgctccactttgaatagtggtggctgagcaatataaatatagcctgcatcaatgattttacgcatgtaccgatagaagaacgtcagcaacaacgtacgaatatgggcaccatcgacatccgcatctgtcatgataatgaccttgtgataacgggctttggcgatgtcaaagtcgtctccgatccctgtacccattgctgttaccatcgaccggatttcatcactggacaaaatacggtccaagcgtgccttttcaacattcaggattttaccgcgaatcggcaaaatagcttgaaagtgacgatcacgaccctgcttggccgatcctcctgctgagtcaccttcgacgatgtacagttcactaatcgaagcatccttagaggagcaatccgccagtttgcctgggagcgaactgatttccagcgcacttttacgacgtgtaagctcacgcgctttacgcgctgcttcccgggcacgtgctgcttgtaaagatttatcaaccacccggcgggaaacagacggattttcctctaggaattcctggagtttctctgcgaatagggattcgacaatccctcgcacctcactgttaccaagctttgtcttggtctgaccctcaaactgtggttctggaattttgacggagataatcgccgtcaatccttcacgcacatcgtcaccggtcaagttggcgttgttgtccttaatcaagccatttttacgtgcataatcgttaataatccgggttaatgcactcttgaaacctgattcgtgagttccgccctcatgggtgttgatgttgttggcaaaagaataaatattctcggtatagctgtcgttatattgcaatgccacttcgacttgaatcatatcacgcgagccttcgacataaatcggctgttcatgcagcgcttctcttttttgattcaaaaattgcacatattcactgattccgccctcgtagtgaaatgtatcgctggcgcccgtccgttcatcagtcaagctgattgcaatacctttgttcaggaaagccaactcacgaatccgtgtctggagcgtatcatagtcatatacggtcgtttctgtaaagatttgatcgtcaggataaaaagtcgtttgggtacccgtctcgtctgtgtcaccgatgactctgacatcatactgcggagcaccacgatgatattcctgctcatacagatgtccgtcccgtttaacatgcacgatcattttgctggagagggcatttactacggatacaccaaccccgtgcagaccaccggataccttgtaccctccgcctccaaatttaccacctgcgtgaagcacggtcataacgacttccagcgcagattttttcattttggcgtgttcacttactggaataccgcgaccgttatctgtaacggtaatgctattgtcttcgtgaacgacaacttgaatgctgtcacagtaacccgccagcgcttcgtcaatgctgttgtccacaacttcccagaccaaatgatggagacctttggcgctcgtggagccaatatacatcccgggacgtttccgaaccgcttccaggccctcaaggacctgaatctcgcccgcatcataagacggttgattcatagacatgcctttcacctacttctatagattctatggttaagcattggcaacaaactggtttgcccgctttttgagtgttgttgaggagatgggggaataatacaccgtattctgagtcactacgatggacttggcttcctcttcgccaatcatctcgacatgcttctgctgttgggcgtggttcacgtattgcttggagattttagaggatttttcaatcgagatatcgaaaatagccacaagctctgaagagcggatgattttttctccacccagatgaatatacatagcggtcactcactccttagtgttccacatgcccgtcgtggacgtgataaatattggcatccttgagtcgttctgcgttcaaagtctcaaccccggttgccgtgataaaggtctgtaccttgctttggaaagtctcgatcagctgagtctgacgataggggtccagctcggacaaaacatcatccagcagcaggacaggatattcaccaatttcttcatgaattaactctatttcggccagcttcaaggacagggccgtcgtccgctgttgcccctgcgagccatacgtatgcacttctctgccgttaatggcaaaggccaaatcatcacgatggggtcccgccaaagtcatgccacggcggatttcctgttccctcatttgggataactttatcataaatcgctccaataagacagcttcatcttcttcctctggctcactgaaggagggaacataggttaattttaactcttctgtcccacctgcaatcccttcatgaatggcctgagcccacttttgtagctttgttataaattgtttccgctttttaacaattttaacaccatgctcaacaagttgctcattccatacctccagcatcagctgcactgaagccatatccttaccccaagcttgcttgagcaggttatttcgctgcaccaatactttctggtattgctgcaaatgatacagatatcctggcgcaacctgtccaatttccatgtcaagaaaccggcggcgaacccccggtgttcctttgacgatttcgagatcctcaggtgcaaacatgaccacatttaacgaaccgataaaatcgctcagttttcgctgctccagtccgttgatctttgcttttttgccttgtgtggataacgcgagatccagtctgattttcccgtattttttatccacatccgcagctagatgagtggaagtagccccgaaggagattaactccttatcgcgggacgttcgatgacttttggttaaagccagtacaaaaatcgcctctaccagattcgttttgccctgcgcattttgtccgattagcaaattaacgggaccaaattcattcagctccagctgttcatagttccggtactgctgcaaaacaatgttgttcacaaacacatagggtcccccttgttactccgtacctaaaaggagtccttgccacccaggcgatcatgctcctgctgtaacttcgaaacttccgttgtcctctacttctacggtatcacccgggtacagttttcttccacgacgttcttccggttcaccattcacacggacttgtccctcttgcagcagggctttagccatgcctcctgtggatacacaatcggctaattttaaaaattgatcgagcttgatgtattcggtctgtatagatatctgtttcaaggcttgttcatcctttcgcttgtcctcgggtgggttaaagctaaacgtcagttggttgtgcgatatggcaggatgatatacagcgcattgctggaatctgccggttttaaaataatgggactcataatgccggtaaaagcaatcgtcagctgctcgctatcaatcaccttgagcacgtcgagcatgtatttggagttgaacgaaattttgagcggctctccctcaaatttggacacagttacttcctcacgcactttgccaagctcagaggaactagaggaaatttccaagccgccattttccagcgactgcatttttacaatattcgttttttcctcacgggacagcaaataagcacggtcaattgactcacttaaactttttgtatccacaatcagttctgttttgtaggaggtcggaataattctagaagtatcaggataggtgccgtccaagatgcgggaataaaatagcacccgatctactttgaataatacctgattgtccgctactacgatatccacaagcatattttggtctggaataattctgctcagctcatttagcgttttgcccgcaatgacaacattgctaaagcgcaagccttcagacgtctccaaatgagcgctgcgggtggcaaggcggtggcggtccgttgccacaaacttcagttccccctcagccagattccacaacacgccggttaaaatcggtgtcgtttcgtgggtggaaatggagaacaccgtctgtttaatcatatttttaagtaaatctcctggcacagagatgacttgattttcttcaatgttgggaagcaccgggaattcttcagggtccaagccaacaatctgaatttcagttgcaccggacgagataaaggtttggaattggtcttttacctccatacggatctcctgagacggcaactttttgataatttcgacaaagaatttggctggcagtacaacactaccgggttgttcgacctgaacgacagtttggtcaccatcctccatcggaataaaggattgaatggagatgtctgtatcgctggcggtcagcgttactccctggtgattcacatccagcttaataccgctcagaattggaatcgtagtccgacttgatatcgctttggatacatgttgtatagcctcgttcaaaacgtttttcagaatgctgatcttcataagttcctcctacgggttttaatccttcaagcacgcgttgacgcgggccttatttaggtgatgtatatctttaaaatatattagtaatagtaataggcgcactgaatatgtggataagtcactgtaaccctaataaaatcaagcctatccacatgtgtataaattgtgtataggctctgaacttgttcaggttggatttttgattttttctattaggttgttgataactttaaacagatcctgatccacttgaatggatttggagattttttcgtgcgcatgaatgacagtcgtatgatcacgcccaccgaaagcttcgccgattttcggcaaagaatagtcggttagctcacgagacaggtacatggcaatttgtcgtggaaaagctacagccttcgtccgcttacgcgctttaaaatcctccagccgtagattgtaaaattccccgacttgatgctgtatatcctgaatcgtgatcatttttggacggctggacgggataatgtccttcaacgcttcagccgcaagatgacttgttacatcctgatttgttaaggaagaataggcgacaacgcgtattagcgccccttccagctcacggatgttcgtatcaatttgattagcgatatacatcatggcctcattgggaatatccaggttttccgcccgcgcctttttccgaagaatagcaattctcgtctccagatccggcggttgaatatccgtaataagtccccattcgaagcgagagcgcaaccgttcttccagcgttggaatttctttaggcggccgatcgcttgagattataatctgcttgcgttcctcatgaagcgcgttaaacgtgtggaaaaattcctcctgcgtcgattccttgcccgcaatgaattgaatatcatcaatgagcaaaatatcaatgttgcgatatttattccggaaactttccccgcggttgtcccggatggcattaatgaattcattcgtaaacttctccgacgataaataaacgaccttgctggtcggattgtgctccaaaatatagtgcccgatagcgtgcatcagatgcgttttccccagccccacaccaccgtataaaaacagcggattgtaagctttggccggcgcctcggcgacggccagcgatgccgcatgggcaaaacggttccccgatccgatgacgaatgtatcgaatgtatatttgggattcagcatatgggacacagcttcttcatgaacgaccggctgctgctgaggttgttgctgaaggtcgacctcggcgggtttgttctcttcaataacgaacttgacctctagctgtttgcccaaaatttcataaaccgttgctccgactagcttggtatagcggctttcaagccattccacggcaaaagttgtcggtgcagaaatcacaatggagtggtcatttagtttcgctgccttggtagccttaaaccaagtgtcgtaactcggcttactcagcttggtttgtataatggatagaatttgctgccatagttcagaggtatggctgtccacagacgtcactccttttaaatcctgacattttaccgaattaagctgcagagagctgctctcggcgcttcggcaaaacgcctaaaatcccaaaaatgttgttgaaggccataaaaagacataccgccgcctaaatcatgcggcagtgtggtgagagaacgcagcacaaaatgaccctgaaaaatagctgatggaaattccgctgctgatcagcagaagagaggcgatatttctcaggagggaatgtgcggcacgatccgttctcttgatcccgcaggccaaaacgggactgcaatatgtcgaaatcaaatgaaaaatgtagaatatatccccagaatcccaaatccgcacaaaaataaaaagatggataaattgaacttgttcacaactttatccacagggtgttgataatatggagggcaaaacaacatattcacattcaaaagtaatatcatcatagcaaaagaagccttgtatttcaatgactggtggttatttatccacaaattcaatctgttgtgtacaatttttattcacaacacaagatattgtttataatttgttcagttttcgacaataactcttttttactctaaaatgttatgcacaggttatgaccatttaaatcacaattcagttctttttgtggatctgtgtataacagccgttgccttttggtcacagaggcttatttttctgttgaaaatttccggtaacgtttccgacattatttttgaacgaacccgataacgtcgatctgaaaataggatggattcaagtcacagaatgaaggaatgtaaaaagagcagtttttggaggagtgaaaactacaaatagaatgctgatgatggaggagaggcgaaagaaattttttgaaataagggaataaaagagcgaagtgagtgagcgggggaaggggaggaggcttcctgaatgcgaaaaagagggagaggattcacaagtacattgactttggccgctatttgtggttaaatgtacaaaggtgttttttgtggagattgctacgttaggtatattccatataaaacgtattccttgtaaggaggtgcagcacaatgagaccgactttcagaccgaatgtcagcaaacgtaaaaaagttcacggcttccgtaaaagaatgagcacgaagaatggccgtaaagttttggcagctcgtcgccaaaaaggtagaaaagtattgagtgcgtaatgcgtgcataaagaccactacggtggtcttttttttcataattgaggtattcagggatcggatcccttcttctagtgttgtaaaaatgtagtgaaagaagagggagaagtccagcatcctgtcctatattagatgaagcttttgaaaacggatataaaataagcgagattaccatgttggaatgttgtccatacttcttactatataaaaggtaaaggtaagcttaccgacatgtgtaaaagagatgagcaaggagaagcgccgtgcaaaaaaaattgcgtctacgaaaccgggcggactttgggcgcgtataccgccatggcaaatcttttgccaaccatcagtttgtggtgtactggttccgccgcagagaggtagagcagttccgcgtcggaatttcggccagcaagaagatcggcaatgcagtagttcgcaaccggatgcgtagaatcgttaaggaaattgtgcgccatcatgaacatgaattggtggagcagattgacctgatttttatcgttcgtaaaggtgcggttacaatgtcgtatcaagagctggagaaaagcgtgctgcacgttctacgcaaagcctcgctgctcaagtcttcacgccgatagtcagtatctttgtcctacaggatatggtatgatttacgttggaatggattggttaagaaaggggttatgaagtgtcgcgtttgaagactcaacggggaaaatggttcctcctgattgccttattggcacttgttgctgtgctgtccggatgtgcccagacggcccacaattcttacacgacggcagacttggccaatggatcgttttggcaaagatatgtcgtttactggttttcgtatgcgctagatacatttgcccaatggttctctggagagtatggcctggccgtactgattctggtgattatcgtgcgaaccattattttgccgcttacactcaagcaagtacgtagttccaaagctatgcaggccattcagccgcaattaaaagaaatccaagcgaagtacaaggatacgcctgaaaaggtccagcaagagacgatgaagttgttccaggaaaacaaggtcaacccgatggcgggctgtcttcctttggtagtacagatgcccattttcatcgcgctttataatgccatttattataactcagcattgcgggatcatgacttcttgtggctccagttaggtaaaccggatcacttgtttatcctgccgattttggcagcgattacgacatttgtccaaacttggatgatgatgaaaatgaatccgacgccgcagcagggaccgatgcaatttttgctgtacgtctatccggtgctgattctgttcatgtcgtacaacttcccatccgctttgccgttgtactggttctacagtaatatttacacgatcattcaaaactatttcctttatcggaataaggataaagaagcagcactggcgaatgtgaaaacagccagtctcgcgaaaacaggttcctccaatagtaagaaaaaaggtggtaaaaacacgaagggggctaaaaagtcgagatgaccaaagtcgtgacatcaggaaaaaccgttgaagatgctgtaagacaaggactctcccagctgggagtaagccgtgaacgggtaaccgtaagcgtgttggaacagccgtcaaaaggattcctggggtggctcggggtcaagaaggcgaaggtggagcttacgctgctctctgagccgtctcctgaaaccacacacgcggctgaacttcatgtatcggctcaagcaccttctagcgtgggacaggctttatcaaaagaaactgggcctgttacacaggaagcacagatgaacatggaagcaccctcgggacatatagatgcttatgaagaggcggtgcgtttcatccgtgaaacagcagcaggaatgggactggacgttaaagtcgatgtccgccaccgcaaggatgaaagtacactggatatctctggtccgtcgctcggtatgttgatcggccgcagaggacagacgttggatgcattgcagtacctgacgaatatcgttgccaaccgtcattctgacaagttcatccgaattgtgctggatgccgagcaatttcgtgcacgtcggcaaaaaacgctggaggatttggcagatcggttggcgaatcaggctattcgttatggcaaggaagtggtactggagccaatgccgtcacaggagcggaagctgattcatgccaagctccaacagcatgcgctggttagaacatacagcaagggggacgagcccaatcggcgcgtcatcattgctaaaaaataatccgacgcaatggctctctgcaagatgcagaagccattgctttttttcttatatttctcgctgaaacggctgccgtccttgatgaaggacggcaatgtcgtttctacttgataggaggtagaaactttatgctaagtgatactatagctgccattgcaacggctgtcggcgagggcggcattgcggttgtacgagtcagcggtccagaagcggtcacagaagtggaggctttgttccgtagtaaaacacctctaagcaaggctccaactcacacagtacattatggacatattatagatcctcaaagccaggaaaaggtggaggaagttttagttacagtgatgcgggccccacgctcttttacgacagaagatgtcgtagaaatcagcactcatggcggggtcgtagccgtcaaacgggtgatggatttactattgctgcaaaatatacgtctggctgaaccaggtgaatttacgaaacgtgcttttctgaatggtcgtattgacctgagtcaggcggagggtgtcattgacttaatccgctccaaatcagataaagctttttcggtggctttgaagcaggtagatggacaactgtcccagaatattcgtcgtctgcgtcatgtcttggtggagacacttgctcatattgaagtgaacattgattatcctgagcatgatgttgaatcttttacatctgacttaatcaaggataaaagcagtcaggtcatgacggaaattgatcggctgctgcatacggcggagcagggaaagattttgcgcgaagggctgactacagcgattgttggaaggccaaatgtgggcaaatcgtcactgctgaacacattggctcagggcgagcgggccattgtgaccgatattccgggcacaactcgtgacgttattgaggaatatgtgacgattaatagtattccgctcaagttgctggatacagcagggattcgtgaaacgatggatgtagtggaacggatcggagtagaacgttcgagaacggcggttagtgaagcggatctgctgctcatcgttattaacgccaacgaaccactgcatgaggatgaaatggcattaatggaacaaatccgcggtagacaagcgatcgtcattatgaataaaatggacttaccggcccaagtagaccgggatttgttgctgcgttatgttcccgaagagcttatcgtaccgatgtctgtgaaggaaaatgagggagcggaccgactggagcaggcgatatccaagttattctttagcggcaagctggaatcagcggatatgacatatgtcagcaacgtacggcatattgctttgttgaagaaggcgcgccaatcgctggtagatgcctatgaagcagctgatcaatttgtaccgatcgacatgatccagattgatgtaagactggcatgggagcatttgggtgagattgtaggcgatactgcgcatgatgcgttgatagatcaaatattttcacaattttgtctgggcaaatagaacattcaagtatggctggtataagcctgctatcgttatagatatacaagagcatattcggtgtgaagaccggaatgtataaggaggtaagaaaggtatgggttaccaaggaggcgactatgacgtaattgtcgtaggcgcgggccatgcgggcgtagaatcagccttggcagcagcacggatgggctgtcgcacgttgatgatcacaattaacctggatatggtcgcgttcatgccctgcaacccgtctattggcggtcctgcaaaagggcatgtggtgcgagaaattgatgcactgggcggcgaaatgggtcggaatattgataagacatttatccaaatgagaatgttaaatactggtaagggtccggcggttcatgcattgcgtgcacaagcagacaagttttcttatcagcatgcgatgaaggaaacgatggaaaaggaaccgaatctgaccttacgccaaggtatggtggaagagctgattatggaagacggccattgcgtaggtgtaattacgaagacgggcacagagtatcgaagtaaagcagttgtcctgaccacaggcacttatctgcgcggaaaaatcattatgggcgagctgatgtatgagagtggtccgaacaatcaacagccttcgttgagattgtctgagcatttgagagagctgggttttgatctggttcgatttaagacaggaacgccaccacgtgtgcacaaggacacgattgattttagcaaaacggaaatacaaccgggtgatgatcagccgaagtttttttcctatgaaacgaagtcttcggataatgaacagcttccttgctggctgacctatacttcagtagaaacacatcagattattaatgataacttgcaccgtgcgcccatgttctctggtctgattgaaggaacgggaccacgttattgcccatctattgaagataaagtggtacgtttcagtgataagcctaagcaccaaatctttttggagcctgaaggtaaaaacacatctgaatactatgttcaaggcttgtcgaccagcttgccagaggatgtgcaattagctgtgctgcgttcgattccggggatggaaaaggtagagatgatgcgcaatggctatgctattgaatatgatgctatggtacctacgcagttatggcctactttggaaacgaagaaagttcctggcttgttcacagcaggtcagattaacggtacctctggttatgaagaagctgcgggccaaggaattatggcagggattaacgcagctcgtaaggtgcagggcaaagagcccgtcgtattggaccgttcgcaaggctacattggggttctgatcgatgatttggtgacgaaggggacgaatgagccttatcgtctgctgacgtcgcgtgcagagtaccgtctgttattgcgtcatgataacgcggacctgcgattgactccgatcgggcatgatattggcctaattacggatgaacgatacgagcgctttttggataaaaagcaaaaggtagagcaagagattgaacgtttgcgcttggcgaaggttcgtccggttgatataaatgagatgctggagcaaggcggatctgcaccaatacaggatggcagtaatttgttaacggtgctacgtcgaccagagatcagttatgcgcaagtagcacaaatctcaccttcacctatagctcttactgaggaagaacaggagcaggtggaaatccagattaagtatgcgggctacattgaaaagcaattgatgcatgtggagcgtctgcaaaagatggagaagaagaagctcccagaggatattgtatacaatgaagttcaaggactggccattgaagccaagcagaagcttgaaaagatccgtccgatgtcgattggccaagcatcccgtatttcgggtgtaactcctgcggatatttccattttgctggtttatctggagcattataaccgcgtaacggcagcaaggggatcataatggacgcgatacaacagcaatttaagcagcggctggcagagcatagtattgtgattaatgacagtcagttagagcagtttgaaatatattaccgtgtgctggttgagtggaatgaaaaaatgaacctgacgggtattactgagcgcgatgcagtgtacaccaagcatttttatgattctctttccctggccttttatgttccgttaaatgatgtgggaagcttggctgatattggatcaggtgcaggttttccaggcattcctttgaaaatatgctttccgcagattcagttgactattgtagattcattgaacaaacgtatacaattcttggcccatgtagtagagcagttgggtttggaaaatgttgaactgattcacagcagggcagaggaattggggcgtaaaccaggataccgcgatagctatgatctagtgacagccagagcggttgctcgtctcgctgtattgaatgaattttgtctgccgtttgtccgtgaagggggacactttgccgcgatgaagggtagtgatcctacggaggaaatcaaggaagcttcctacagtttgaaagagctaaagggaaaaatcaaacatgttcaggctttccagctacctgttgaagatgcagccagacatatgattattattgaaaaaagagcggcgacaccacggaaatatccacgtaagccgggtactcctttgaagacgccgttagtgtaattgtttgaaagaaagtgaatgtttcacgtgaaacattcactttttttatggctgacagactctttacataaaagacactttgctaacatgcgttcttgtttacatgggggaagaagatggatagatatttgtcaaagaagatgcataatttattatctgatccttccgaaaagctgatagagacgataggattatggctggaaaagtgatagaatagagataatcgttttaatgtaagttgactgctcccgtacccatgaattcagatatacatatagggcagtgggacaacaaatgtcaggggtgtacgtggagtgtacccgcttacggcgctgtttcatataaaagggtctacgatccgcgtaaggaactgtttttcacgaagcgctgttagtatggtgctattatgaaattaggtggtattatacggaatgaaagaacaattttccaagctatttggtttgacggagcgatctactggggacgaaataaaacaaattccagttcgggatattgtcagcagtccttatcagccccgtaccatatttgacgacgagaagattgatgagctatgccagaccattaagacgcatggtgtaattcaaccgattgtcgttcgtttccgtaatggacaatatgagattatagcaggggaacgtcgttggagagctgtcaccaagctgggtatggaaactattccagccattgttcgtgagtttaatgattcacaagctgcatccatcgcgttgattgaaaatcttcaacgggaagggttaactgcgattgaagaggctgtagcttaccaaaagctgattgatctacatcagctcacccaggaaagcctcgctcaacgacttggcaaaagccaatccactattgctaacaagatacggctgcttcatctgccggagagagtgaaagaggctctaatggaacggaaggtgtccgagcgtcatgctcgtgcattattgtcattagagactgaagaactacagtacaaggttttagatgaagtcattgccaaggaactcaatgtgaagcagacagaggcacgagttgccttttataaacaagtatccaccaataagaaatcgaagcggatttcctttaccaaggatgtccggcttgcgctgaatacgattcgtcaatccattgatatggtgtctggctcaggcttggatatcaagaccaaggaatctgatcatgaggatcactatgagattgtcattcaaattcccaaacgtaagtaagggatgaagcgtacaggcggcagcaattgccgctttttctgtctaacgccgaataaaaccgcagcatactcaattctattctgaaattgccgttatccgtaagttaaggactaagtaacgtctccatagagcgttttgtagttatggagtgtagcaggattccgattaaattatgaggtgaatgaagtgtcaaaaataatagccgtagccaatcaaaagggcggagtaggcaaaacaactacttccgttaatttgggcgccggacttgcttccctcggcaaaagggtattgctcgtggatatcgacccgcaaggtaatacaaccagcggtgtgggtatcaataaggcggacgtggcaaattgcatttatgatgtactcattaacgaggttgatcctagcgaagctattatgagtacacaggttgagggattggatattattccggcaaccattcagttagcaggcgcggaaattgaactggtgccgaccatttctcgcgaattgagattaaaaagatcgcttcaactcgttaagcataattatgattatatactaattgattgcccgccatcgctgggtattttgacgcttaattcattgacggcttccgattcagtcattattccaatccagtgtgaatattacgcattagaaggattaagtcaattgttgaataccgtgcgattagtgcaaaaacatctgaacacctcactgcaaattgaaggcgtgttgttaaccatgtttgatgcccgcacgaacttgggtattcaggtgattgaagaagtgaaaaagtattttcaaagcaaggtttatcagacgattattccacgcaatgtgagactcagcgaagcaccatcacatggccagtccattattacgtatgatccccgttcccgtggggcagaggtatatattgagttggcaaaggaagtggtatcttatgagtaaacggttgggaaaaggacttgatgcactcattccctcccttatggtcaatgaagaagataaggttgttgacattccgctcagccagttgcgtgcgaacccgtaccagcctcgaaaaacgtttgatgaagagtccattaaagaattagccgaatccattcgtcagcacggtgttatccaacctattattgcacgtagtgtattgcgaggatatgaaatcatagccggggaaaggcggtttcgggcgtctcaattttgtgggaatccgactatacctgtagttgttcgcaattttacggatcagcaggtgatggaaattgccctgattgagaatttgcagcgtgagaatttgaatgctatggaagtagcagtagcttatcagggattgatggatcaattttctttaactcaggaagagttgtccatgaaagtgggaaaatcacgttctcatattgccaatttccttcgtttgctcgcattgcctgaagaagttaaagatcatgtttcacgtggaacattgtctatgggacacgctagggctattgttggactcaaagatccagacatggtgaaacagttagcacagcaatgtattgaacagcagtggagtgttcgcgaactggaggaagctgtacagcagttggatcataaacctggtgaggcgaaagccaaagcaaaggtacggaaaaaggacccctatattgaccatatggaagagtccctgcgtgaacgctttaaaacaactgtaaagatcaagcacaataaggataaaggcaaaattgaattgaattattacagccagcaggatttggaaagattactggagctattacagtagtttgttgaaatatggacatgtctccttgagcaaaatggaaagtgagatatgtctttgctttgtctggaattgcaggaattagaatggttttgatggataaactaatagccttgtgttatttgtttcgctgttctcaaacgtataaaatataagtatgcaggtacatgatttttgaggtagaggagtagaagcaagcatatggctgaattgaatggactaatcatggaacagcttgccggaatcgttgcagggatcgtgcttattttgctcatcctgttgattgttattatcgtgcagggtgcaaagctgaagaagatgcggcgaaagtatgaaaccatgatggcaggcagcggtgtcgagaatttggaaacgctgctgattgatttgaaggtacagatggatacgattgaggatgagcaggaaacccatcgtgcaagtatgaaatcactacgcagcaaactgactggcttgaagggacatataggcattaaacgctataatgcctttggtgagagaggaagtgatttaagcttctctctggctattgtagacgacaatcaggatggtatggtattaaccggcatttataaccgagatggttcatatgtgtatgccaagcctctagaagcgggacaatccacctattccttatcacctgaagaaaaagaagccgttactcttgcgcagcaagcaggacagaacggtaatgccactccttaatcgcggagtataggctaccagcaatgatatctgataatttcattaccaaatttagtcttgtattttgtagcacgaagtattccatgaagccgccgacgttaacgataccagtcaaatggatatcgccgaccggcggtaattctttatttacgcctgctcccggcttgagagggccttctgaaacctgaatgcatccaacactggaggtttgtccaagacatgcatctataccaatgatataaggctgttcataccggtcttgtatgccgttcagcgtcgtttgcaggttcatggcatgtacaggctcttctaatgtaccgtataggttaaacagagggcttttgtagcgtgctaaatgcgtacctacgagcggacccaggcaatctccagtggaacggtcggtgccgatgcaaataatgacgatattttgcagactcggcgcctggtgcagatggaacagcagacgatggatgatggctgattggatcccggggtctgtgtgtgatatttttaagcttaggggttcttgccccggaatgaagtcagatggatgagtcatggaatcttcctttcgctctgtaatggagtgtgtgggttacgctcgctgtaccttggagaataacaattagcctgcgggtaacatttatgctcaagatagtagctagtatatggataaacttgtgcttttatactcgaaggaagtagattattcatagccatatgtttaaagtcagtagataagcttatatagtaggaatagaattcgggaagcaggaagagtagttcccttgtttaaggaggagtacagcatgaccttaatacattggttggccggtaatgtaggtacggatgacgtagtgaaagatgcgattcaatggaaggatgctgtatggaaatggctcactgatagtacgatgtggtcaacccttttgtttgtgattttgaaaatagcgattatttttatcatcacacgtatctttattcgagttattaataaaattatagataagtcgatgcaacaaaagggagataacggcaggttccgattgaatacaagacggttaacgactgttggggaactgctgaaaaatgtaaccaatattgtatttaatttcattttgattatgctggtgctatcgcaaatgggtattaatctcggccctctgattgctggagctggagtgcttggattggctgttggttttggggcacagagtttggttaaggatgtaattaccggattctttattatttttgaagatcaatttgccgtaggagatgtcattcagacaggtactttcaagggtacagtggaaatgatcgggctgcgtacaaccagactggtgagctggaaaggtgaggtgtacattttaccaaacggctcaattacaacggtaacgaacttctctatgtctaacgcgttagcggtagtggatgtgccaatgaaggccgagcgtagcctggaggaagcagttggtttggtaaaacaggcaatccaaggtattgaagagtccaatgtacagatacttaatataccggatgtgttaggggttcagtccatgactacctcagagtatattgtgcgtgttgtggcagagtgtatgccgaatacaggggccgtggtagagcgtgatattcagaataacatcaagaaggccctagaggatgaggaacatcgtcaggccgccttggagacagcgataaccctagaaaaagaagatgaacaaggaagaaaagggggagagaagggtggagcgtaagtcatttgaactaggggacattgtacagatgaagaagcctcatccgtgtggaacgaatgaaatggaaattatccgcatggggatggatattcgaatcaaatgtgtcggttgccagcatagtgtgctgattccgcgtgccaagttcgaaaagaatatgaagaaagtgctgcgatcaaaggctaatgccgacgagcaaaacacagaagcaaattgagccaacaaagatgaatggcgatgaaccagaatcagcttgcgtcacagttgcaatgatgatataattatccttgctgcggaaaggtacccaagaggtctaagggggctgactcgaaatcagttaggcgtcgcaaggcgtgcgtgggttcgactcccactctttccgccactaacttcattaaataaaccaatctcttacgtctgtgacgtaggagattttttgtttgtggaataaaaggtcaacagagtgtgataaagtgaaaagcactaagataaaccatgagggtaagatggaagaaacgattacaaatctattggggaatgaataaggcgttatagcaaaaaaatgctcctgacagcagagaaacattgccgttaggagcacttttttgttatagctggttaggcgggtaatgatagcgttttgttttttttgagccagagatcatcagaaggatcgctgcaatcaaatggagagcccagcctacaaagggtatccaggccagcaaagaagtgagtactccccatacggagccgtagatcgcctcctgattgcgtaacgacaggataagtgttactgcgtgtaggacaagcataaatcccagagccgagtagccggtccccatgacaatagctccccccacaatcggtacggcaagcaccaattcgaatatacctgatatccactttaatattcgagaatagctcatctttaaacctccgtagatagtaggtctttgtacttggatatattctagcagaaggagctgaattaatctgcattttaccaggatatgcaaaaagtccgataatgcaacaaaggaggaccacaaaggtcctccatcgtaggcgatacatttttaacaggatacgatctgtccaatcacatcatgaaactcggtgtactgacaagcaataccgtgttgaaaagacagtgtccttttacacaaacctaacgcttctaatgcccggaatggatctcctaacagtttgtccggctacgtcgtccaacggaaccacacctctctgttgtatcgcctaatcataatatggccaggattccgaggaaatatacattagtggacacgagctttcgtttttttcttccatttgcgattatggttggcggtctccggaaaagaatcgcctctttccagcgttacttgctgcggattttggatttcagtatggaagctcttttctccgacctccatgtatacgccgtcgtttgggaccttatcccctggttcgaactcagtcttttcacccataccgtgttacctccttagataaatgattttgaactgcaacggttattgtgcgctgtcttgaacagaaacatgcgaaatgggggatacagatagtgagtgaatcaaatgatttcctttatatatgcgaaatttttgatgttctataaaattgtataaagctaatgatatgcagtgtatttagctgtgttaggcttgtgtattgaatttgtaggttgcattcagttgctcgatttggtaaactgttttagtgcgagcttaggctcgttccttgctctcaactgagattgagggccttatgtccataaggaggtgtaaagaatgcgcaaatatgaagcgatgtatattattcgtcctgacattgaacaagaagctgttcaagcgacagtcgataaattccaaggtatcatctctaacggcggtggcgaaattacgagtcacgatgtaactaaacgccgtcttgcgtatgagatcaagaaattccgtgatggttctttcgttctggtaaacttcacagcagaacctgctgttgttactgagcttgagcgtatcatgaaaatttctgacgaagtaattcgttatctcattacgaacgacgtagcttaattattgtacgtgattatgtaatgaacaacgctcaaaggaggggattggattgttgaaccgtgtcattctgatcggtcgtttgaccaaagatccagagctgcgctatacaccgtctggtgtagcagtaacccagttcaccctggctgtagaccgtccgtttacgagtcaaggcggcgaacgggaagcggatttcctgccgatcgtaacctggcgtcagcttgctgaaacatgcgctaactatcttcgcaaaggtcgtttaacggctgttgaaggccgtgtccaggtgcgtaattatgagaacaatgaaggaaaacgtgtatacgtgactgaaattgtagctgataatgtgcgtttcttggaatctaaccgcgatggcggcaatagcggtggagctgcgcgtgaggagtctcctttcggaggcggtaacagcaatagtggacgcgggaataataactcgcgaaacaatcaggatcctttttccgatgacggaaaaccgatcgatatttcggatgatgatttaccattttaattgggaaaggactgacaaagaatgggcttcagacaaagagaaggcggagacgataacaaaagaccagctcgtcgtggtggtcgcaacaaacgtcgtaaagtatgtttcttcactgtgaacaaaattactcacattgactataaagatacagacctgcttaaaaaattcatcagcgaacgtggaaaaattcttcctcgtcgtgtgactggaacaagcgcgaaatatcaacgtatgttgacaatcgctgttaaacgttcccgtcaaatcgcattgcttccttacactactgaatagtagtgggtggaaaaaagagacgttcccgatcccgggaatgtctttttttgtgatcttttatattgacaacaagtgccatctattgtaacttactaataatacaatccatgtttacccataaaccatagtataccttttaatggcttgtgaaattgcaagctcctcgactcgccagagtaaacatttcggccttccggaatgttattttatattacatgtaatcttattttttgtcattttccacaagtaaaattcataaagtttacataaatagatattttgcatttttatattacataaaaaaagatattgacgtgatattattttacacttaagataaaccttaataaaaatgtaatggttgttaacgcacaaaattgaccagaggtctaaaacacgtgtttacgctattaaagacagtaaggaggatgtgccaacttcattttcaaacctcaagctttaacgaatcaccgcaggaatgagacaggctgttaaataaagaaccgactaagggggattaacaggatgatgcagacgaagaaatgggtttctttgcttatgatgcttacgatcgttggtgttctgtttgcaggatgtagcggaggtgccaatgaggcacagccacagcaaggcaatgcgggcaataaactagagggaaatgaagcaagtgcacctgttacggagggcgttattaaagcaactgatctgtcgcaaaaccctccgggagcgactaatcggaaagataacattgtagtaggtatgacatcacctaaaggggtattcaacccgctattctggcaaacgacttacgatttatatgtagtcagaacagtatttgattccttcttacaggtgaaggcggatggtacatatgaaaatagtttggctgaaaaggttgatgtatcgccagatggtctaaaatacacattccatctgaaaccaggtgtgaagtatagtgacggtactccagtaaccgtgaaggattatgcttttgtactcaaagtgctgcatgatccgaattatgatggagaaaccgatgtattgtcttttaagattaaaggcggtaaagaatatcacgatggcaaagcaaatgatatctcggggatcaaggtcattgatgataatacagtagaggtcaccgttacagaagcaacagcgtatacgaaggattttctgggtgagcaatactttatgccagaagcttattacggaaaaggatttaaaaaaggtagcctggacagcatcaaggcgcttaataataagccgatcggctctggtcagtatgtactgaagagcttctccccaggtcaacaagtcgtattggatgcgaatccaaactactttaaaggcgcacctaaggtgaaatcagttatttttaaaacaacaacagaagaaacgaacctgtctatgctgcaaacaggtgaaacggacatggacaacatcacagttacggaagacaatgtagaggaattaaaggcgttgggcttcttggacgtgaatattatgccgacaaacggctatggatatattgcgtttaatcacaaggaaaagaaatttcaggaccctaaagtacgtcaggctttaactattgggttaaaccgcaaggagattgtgcagggcgtgtatggtccatatgcgaatgttattaacattccacaatctacagaatcttggtcttatacggatgaaggtatcaacaaatatgaatttgatacagctaaggcgaaggctttgctggatgaggcaggctggaaggttggtgctgacggaattcgtgaaaaggatggagaaaagctgaccatcaacttctctgcgactgctgataatccagtagtagaggccttgctaccgatcatgtccaataactataaggagctaggcatcaagctgacttccgaaactttagattttaacgctattatggataaaaaggacacaggcaagtttgatatgttcttcgcggcttggggcttaactccagacccggatacaacgacttttattacgaatggtgcacaaaatgatatcggctattccaataagaaggtcgatgaactaacgcttgctggtaagcatgagctggatcaagagaaacgcaaacagatttacaaacagctctatcaagagttgaacaaggatctgccaactatttttatgtaccaacgcagagatatgtggccagttaatggacgtgtaaccggcttggaaattacaccatacaaagattttgagttcactctgcataacgctcagatcgctcaataagggttgccaaacgtatgctcagctctcacgagctgggcatatcactttattcgtctggaggaatgaatatgaagcagtacattattcgaagactgctgcaactcatccccacacttattggcatatccattatcgtatttgcgatttcagccatggtgccgggtgattatattacagccaagcagaacccgaatatgacggccgaaaaggcgcagcagctacgacatatctacgggctggataaaccggaataccaacgctattttatatgggccggtaatatgttaaaggggaatatgggggattcattacagcataagcagccggtaacgaaggtcattggcaattatgtatggaactcatttattatcgctttttttagtcttatttttagctggttgattgcggttattgcaggggtattttcagccaagttccaatattcgttattcgataagtttgtcacattattcattttcttatgtatgtcgctgccctcattttttattggtctattggtcatcaaaatatttgccttggagtggggggttctcccggttgggggcatgaccacagcagggatggagccaggctcatgggcttatatggtagatgttctcaagcatatgttcctgccgacactcgtacttacgatgctgagcacaggaagcctgacccggtatttccgtacaggcatgcttgaggtcattcgtcaggattatattcgtaccgcacgcgccaaaggcctgaaggagcgtacggttattttcaagcacgcactgcgcaatgcactgattccagccatcacactactcggcttcgagcttccggccttatttggtggagcgatgattctggagaaggtatttgtgtggccgggtgtgggtcaggtctatctggagtcgatcagtatgcgggattatccgtttatgttgggcttcacgattttcctagcggtacttacgcttatcggtaatttgctctctgatgtattgtatggcatggcagatccaagaattcgcttgaagtaggagggatactattgtccgcagaaacagtcacgattgaaacgaatcaaaaggcggcgatccgtcctgaagcgtctccatggagaatcgccgttcgccgttttaaccaaaaccgtctggctttggctggtctcgttatattaattctgatggttaccatttgtagttttggaccgatgatttcaccttatcatttagatgattacaagctagctgacaaaaatttatcgcctaatgctaagtactggcttgggacggataagtttggtagagatattttgctgcgtacgatgctggccggccgtatttccttgacggtggggctggtcgccacgtttatttcggtcatgatcggagcgacgttgggtgcgctggcagggttttatcgtaaaggcgtggatacggttattatgcggattgccgatattttcatggcactccctacattaccgctgcttattattttaggtgctgttctgtcggatttgaaggtcgatccgtcgaatcgcatttattttctgatgctcattatcgggattctgagctggacgagcttgtcccgtctggtcagagggcagattcttacgctgcgtgaacaggagtttatgcaggcgacggaagcgctaggtttgagagaccgccgcaaaatattccgacatttgctgccgaacacgattcctaccattattgttacggctacgcttggagtagcgggtgcgattattacagaatctgcactcagttacttgggaatcggtgttgtgccgcccacaccttcgtgggggaatatgatatcggctgcgaataacctaattgacttccgcaaacggccttggatatgggttccaccgggaatgtgtattctcattaccgttgtagcgattaacctgattggcgacggtttgcgtgacgcgctggaccctaaaatgaagaagtaggagacgaacgtttatggaaaatgctttgattgaatttcgtaacctgaaaacccactttcatacctctaacggaactgtcaaagcggtcaatgacgtcagttttaaaattcgtgagggtgaaacgctctgtgtggtaggagaatcaggctgcggtaagagtgtaacagcgatgacgatgatgcggttgattgattctccccacacctcagacggacaaatctggttcgagggcaaagacctcctaaaactcaataaaggccaaatgcagcaaattcgcggcaatgacatctcgattatttttcaagagccgatgtcttctctgaatccagtgcttacgattggggaacagatcacggagccgttgctgatgcatacattaatgagtaaaaaagaagcacgtgctcgggcaattgaactgattaatttggtgggtatttcgcggtcagaggaaatatttcattcctatcctcatgaattgagtggcggtatgcgccagcggatcatgattgccatcgcattaagctgtaatccaaagctattgattgccgatgaaccgacaacggcactggatgttacgattcaggcgcagattctcgatttgatgcgggatttgaaggataagcttaaaacgtccattatgctgattacgcacgacttgggtgtcgtggcagaaatggctgattatgtggtcgttatgtatgccgggaacgttattgaagaggctcctgtcattgagctgttcaaaaatccgcaacatccatacactcaaggactattaaaggcgaaacccgtcattaatcagaaaatggatcgactgtattctatcccaggacaggttccaaatccgattgagctgggagaaaattgtcattttcatgatcggtgctcccattgtatgcaaatttgcaagggtcaggctcctcccttgaatgaaaaggagaatggtcataaggttgcctgctggctatatgaggaagaaggagggcaacggatatgagcgagcctttgattcaagtggaagggctgaaaaagtatttcccgatcacaggcgggatttttcagcgtactgtcggacatgtgaaagcagtcgatgatgtctcttttaacattcataagggtgagtccttcggtctggtaggagaatcgggttgcggcaaaagtacaattggacgtacgattctcagattgatggataagacagagggatcggtacgatataaaggcgaagacttgcacgcgttaaacaaagagcagatccgtgcgcttcgtccgaagttgcaaatcgtctttcaggacccttttagctcactgaatccgagaattaaggtcggtgaagccattggagaggcgttgctggatcacgggttgattgatcgtagtgagctgcggaagaaggtcaatgaaacgctgaacatttgcgggctgtcctcgtatcattatgatcggtatccgcatgagttctctggcggtcagcgccagcggattgggattgcacgggctttgattttgaatcctgattttattgtggctgacgagccggtatctgctctggatgtgtctattcaggcccagatcattaacttgttaagtgatttgcagcaggaacgccaactgacctatctgttcatctcgcatgatctaagtgtagtcgagcatctgtgtagccggattggtgtgatgtatctgggttcaatggtagagctttcctccaaggaggaactgttcagtaatccgcttcatccgtacacgaaggcgctgctatcggcagtaccgattcccgatcccacgatcaagagacaacggattgtgttgaaaggagacatcccatctccggccaatccgccttcaggatgcaagtttcatacacgttgtcctatggcagaagcacgttgtaaaacagagactccggtataccgcgatgcgggcgatcagcattttgtagcctgtcactttgcctaaaatataataattaggaagcaaaatatccgtcatcctgaaagcagaattgacggatattttggcgtggaataaaaaaggtaaaaaaattgtatctttttttcgaaaaattgcagacaaaatggatttttcatcgtctaataaagtatggaggttattacgatgatgaaaaaacattggttacgttgggctattgttgtcccggtacttattatattgatttttattacgcttggaccccgcctgttgatcggaaagccgaatgtggatgcagaggctgcggtgctgatggacatgcatactggggaattgctgatggatgtgaatggtgatacgcctatgccttccgcaaatatgtccaagctcatgactgagctattggtgctggaggatattcgggccggacggttaggctggaatgatgaagtgcgaattagccgttacgccagtacagtgggcggtgtaaatctctccctccggtatggtgaaaggatgaccgtatccgaattgttccagagtatggttgtgtattcagcgaatgatgccgctgtcgcgttagcggagcgttcagcagggaacgaatcagcttttgtgaagcgtatgaatgggaaagctgcccaaatcgggttgtcatccgatagtcgctttagcaatgcgtctggggcaggtcagagtgaactggggccgaatcaccctgaggatattcagggagaaacgaaaatgacagcaagcgacacggcaaagttggcctcctatttgattacgtcacacccggagattttgagaacgtccagtcgtacgcaaatggagttgaaggataaaggcatctacattagtaatacgaactggatgctgccttccttggctggaccgtactcttacgcgggaacggacggactgaaagcagggtacacaagcgatgctggatactgcttcacgggcacagctgagcagcatggaagacggctagttgctgtggtgctgggtgcaccgagcaaggaagagcgttttgagcagacacggaagttgttcgattatggtttttccctgtcgacttctttcccggtgagactgcaaaatttggtgaaactggctccacattaaggaaaaaaatgactttgaaagctacataggatacggatataaacatgaattggggctttgaccgtgaggtcgaagccttttttggtatgaattcgaggagctgaccacgccatgacacttttgacaacaaggcagtagaccttttatgctttgaggggaagtttcagcttcatgtgggatcaatttggtttaatgaagagatgggatttgtgacggaaagaaggaaggtacctgttatggagagaagacataagagaaggaccagtggaaggcccaaaaagaaaaagaggtttaccgctctatatatttcatgtattgttttatttttgattgcagtgggaggctacctattccgcaaacagctgacactggtggcttttgactggtttgtatcaccgacgttggaaagcaagctggagaaatcctatcagccgcgacaatccggggaacagcagcagcaagagacagtagcttaccgtaaggaacccttttcggtgctgttactgggtacagatcaaaggccaaatgaaaaggcgcggggtcgttcggatacgattatgtatgcagtagtacggcccgcggaatcgcgtgtgcttttggtttccattccaagggatacgtacgtacagattgccggacatgatccgaatcgcgatggcgaggatgattttgataagttggggcatgcttatgcgttcggaggcgaagatatgtccatggctacagtagagaagttgatggagcataaggccgattattatgctacgattaatttccagggtattcaggaggcggtgaatgcagtgggtggagttgtgcttccaatcgacaagcccattgaaaataagaacccgctgcatatcaagttccgtattgaggcgggcaagccgctttataatggtgaagaagccatgtattatgttagatatcgggaagatagtgacttcaaccgtacaaaacggcagcaaatatttttgaacgctatggcggataagctgctgaatatcaacggaattaccaagatcccggagctgctcgatattatgggagccaattttaaaaccgatatggaacctacttttattactgggcttggcaagcaagctatttcgcaggggaatccacaaatttcaagttttacgattacgggggaagggttcaagaagaagggcctgtattatgaccgggctaatgaacaggaacttgaatatgccagactcatgattgccaactggctagattccgatacaaccccgcagacgctgaggcttcccgacaagcaggacattcagtgaataatcaatggatttatatttgattttgagggggattcgtttctcatgaatatcgcttttttcttgcttcccaaacaggaagttgcttgtgtaacggcggatgctactttacggcaaacgttggaacggatggagtatcaccgttttacagcggttcctattttggataaagaaggtagatatacaggtacggttacagaaggtgatctgttgtggcatatgaaagagtccgaggggaaaatcacctttgaaaacgcttctaagttcatgcttaaggacgttccgttgcgggttacgatgaagcccgtatccattgacgcgaacatggaggatttaattaatttggcgaaggtgcagaactttgtgcccgttgtagatgatatggaacggtttattggcattgtacgtcgcagccagattattgagtattgtgaaaaatttgtgtccagggaatcgcttaatacttcaagctaaaataagcagcaaagctgctccgaaaataacgatttaccctatggggtaacagttattttcagaataggatatgctataatggagaataaagctttttcagaggggtgtgactcttcatcatatgcctaaagaaatggatgtagttaaacgagccaaggttattgaatggcttaaaacagaggtgcttgaccaagtctcccgtctgtttaaggcgatgtgggaaggcagtacagcccgcatcggtgattgtttggcgagtttggtgatgagcagttatattttggggaggcgccttggagtgtcttaccgtgaattggatgatctactcatcgacaagctaagaaagcacagaaaagaaggacaccagctggaggattggtatcaggacatttccgcactggaagaacatatgcgtaagaggtgaaaacgttgaaattccgcttggcaactgtagcatggagcgtcatttatttgcttctgctgctgactctattgacaccattaagaatcattaccgtatttttgctgattgtgcctggcgctgtattgttttcatcgctgcctttcaaaggatttctggtccacgtcataccggtgctgttaattatagcgctactcgatgtgtattcgctgctccctgcgatttattttctgattccttcaataatgatgggacggatttataaaaagggaggacctgcttttcaagcgttgatgaccggaatgggcattattttagccgagttgttggttgttctgtttatcgctacgtattcctttggatttgatctttcgcagtaccttcgtgatcaggctgcgatatcggcaagtattgtacagcaggttttgagtgctaatccgatgttttcaaacatgaattggacggcagaggatacgcagaaactcggcacaatgctgattggaaaaattccgtatgtgctgatcgtgacctcgttcatattggcggtgattacgcatgctttggcacgtccggcattgagcagtctcgacgtaccggtacgcaaaatgaagcctgcccgcgagtggaggctaccgcgtgcgctgatctggtattatctgctggcaattgtaattgaatggatagcagggtcttccgatagcagctggattcaaatggtttccattagtatgctaccgctgatccatgcatgttttattatccagacaattggttttgtatacttctggacgcatagccgtaaaatgagcccggtgattgcgttgctgctgtcgctcgtcgttctggtgttccagccgctccgcattataggtattattgatttggcctttccgctgcgtgaagctattacaagatcaaagaaatagggtgaacagtcatgcctaaatttctacaaaaacgctggcacggctatcagacggtctgggcgtttttactgctgctggtgcttgtcatatgtatttccatgtacaactgggaactgggtgtgataggactgctgctgtcattcttgctcggcgggctgatgctgaagacggaattggattttcgtcgggaactgaatcaatatatcagcggtctttccttccggatcaagcgggtggaaggggaagcgattagtgcattgccgttcggcatcattttatacagtgaaaatcgaacggtagaatggcacaatcggtttgccggggagatgttcgaggagcaatcactgattggtgaatctcttcaagatttgtttcctcaactcgcaggtgctctaagcaccaagaaggaaacaaaggagcctgctcgtgagctgaaggtagagctacagcatgatgagcgtcattatcagtttctgatcgtgcccgatgagcgtctgatatatttgtatgaagtcacggagttggcggtgctacgcaagcagtatgaaaacgagcggttggcgctcggtatcgtcatgctcgataatatggacgaggctgctcaggggatggacgatcagcagcgcaccgcgcttattgcgaaggtgtcaagcgagattacatcctgggctaatcagtacaatatttatttgcgtcgattatcttctgagcgttatctcattatgctaaatcataaagcgcttcaggagctggagcaaagtcgattcgtcattctggataccgtaagggaaatgacggcggatttgaaagtaccgatgacactgagtattggcttatccttcggtgcagagagcatcaaggagctaggcgagctggcccagtccagtctggatatggcgcttggacgtgggggcgatcaggcagcagtgaaggcgggacaacgcctgtccttctacggaggcaagtccaatgctgtcgagaagcggaccagggtacgtgcccgagtcattgcacatgcgctgcgtgatctgatgcaggagagcgaccgcgtgctgatcatgggacacaaaataccggacatggatgcagtgggagcggccatcggtgtgtggaaggctgcggcgctgtacaatgtagaggcacatatcgtactggataaatccaatccgtctatcgaccgaatgatggagcaggtaaacaaggatgagaagttatcgcaagcgctcctgacgccagagcagtcgctccagctaatgactgagcacagtctgctggtcgtggtggacacgcacaaggcctccatgacgattgagccgcgtctagtgcagacggccagtcgggtggtggttgtcgaccatcatcgtcggggcgaggaatttattaacgattcggttctgatctacttggagccctatgcgtcatcggcctgtgagctggtgaccgagctgctgcaatatatccatgagaaggtccaactgacaccgctggaggcaacatcactgctggcagggattacggtagataccaagcacttttccctgcatacaggctcgcgtacatttgaggcagcaggctttttacggcgtagcggggcagatacagttatgatccagcgcatgttaaaagaggacctggatgaatatattgctaaggcggaaattattaagcatgctaaaatgatatatgggcatatcgcaattgcggtaactgagcccggacagaaaataccgcagctcctgattgctcaggtggcggattcattactcaatatgacggatgtactggcctcctttgtggtcagtgaacgtcctgacggcctggtggggatcagcgcccgttcactcggacgcatgaacgtacaggtcgtcatggaacggctaggcggcggaggacatctgacgaatgcggcggttcagctggattgcccgctggaggaagctaagcgcagagtggtcgacgtgctggccgaaattgatggggaagaggggttatttgaatgaaagtgatattcattaaagatatgaagggccaaggcaagaaggggcaaattaaggaagtgtcggacggttatgcagcgaatttcctgttgccgcgtggtgttgctcgtccagcgacagaaggaaatatgaagacgctggaaaatcagaatgctgctgaggaaaagcgtaagcaagaggaaaaggaagaggcgcaagcgctcggcaaaaagctggaagagacaacggttcagctcaaggcgaaggctggtgaaggtggacggctgttcggcgcgattacaagcaagcaaatcgcggaggcagtagctaaaactggcatcaagctggacaaacgcaaaattgagctggaagaaccgattcgtacgttgggcgtgactcaaatgaccgttaagcttcatcctgaggtcaaagctacgctgaaagtacaggtgactgaagaataattatgggcggcgaattttttgatcggattcctccgcaaaatctggaggctgaacaggcggttatcgggtctattttgctccagtctgaagcactgattaccgcaatggagcgggtgcagaccgaggacttttatgataaggctcatcagatgatttacgaagcaatgattgagctgggtgaatccggacagccgattgacttggttacgctgacctcgaaaattcaggacaagggacagctagaggatatcggcggtgtcagttatctggcgaagctggctcacggggtgccaacagcggctaacgtggattactatgcccagatcattgaagaaaaagcgatgcttcgtcgcttgattcgtgcagctacacagattgtgagcgaaggctatagcagtggcgaggatgtcgctggtatgctgagcgatgctgagcgcaagattatggagatatccaacgggcgctcaggtagtggctttattgccatccgcgatgtcgtgatggaagtgtttgaccgcgttgaattgctgcatcagaataagggcaatacgaccggaattccgtctggatttgttgatttggacaagatgacggcgggtttccagcgcaatgacttgatcattgtggccgcccgtccatccgtaggtaaaacagcgttcgctctgaatattgcgcaaaacgttgcagttcgggcaaaagagacagtagccatcttcagtctggagatgtcggccgctcagctcgtgcagcggatgatctgcgccgaggccaatctggacgcgaacgtcatgcggacaggtgaatttaaaggcgacgacgattgggcgaagctgacgatgggcattgcagccttgtcagaggcggaaatctatatcgatgatacacccggcatcactgtggctgatatccgtgccaaatgccgccgtcttaaggcggaaaagggactgggtatgatcgtaattgactacttgcagctgattcacggacgaggcaaagcaggcgagaaccggcagcaggaggtatcggaaatttcacggacattgaaacaaattgctcgtgagcttgaagtgcctgtaattgccctctcccagctgagtcggggtgtggagcagcgtcaagacaagcggccgatgatgagtgacttgcgggaatcgggttctatcgagcaggatgctgatatcgtggcgtttctgtaccgggatgattactataatcaggaaacagaaaagaagaatattattgagattatcattgccaagcagcgtaacggcccggtcggtacggtagagttggtctttctcaaaaattataataaattcgctaattacgagcgtgcccattcggatgcgttcgccggataacatattagtatcattagaaaaggctctttcgacgcggatttcgcgatctcgaaagggtcttttttatagaattcacgtattttcatataaggaatgaaactctcaattacgaacaatactattttcatgtaatataatgttcgctttttatttgactttaaaaaatggtgctgttacacttatagtgctgcttcaacgcagtggggagatcattacgcccggggctttccgaacctacggaatgtctgcgacggacgttttttcctgctgtccgagaacgctccatatctgctcgctcaggcggttgaaatcggatatgcgtagtgtgtcagctcaaaatcagagtgtctgtgggcactccacggaggaatgaaacatgtcaactgtagtcgttgtgggaacacaatggggagacgaaggcaaaggtaaaatcacggactatctggcggaaagcgctgaagtggtggcccgttaccaaggcggaaacaatgctggtcatacgattctcattgacggtaaaaagtacaagctgagcctgattccatccggcgttttttatgaagataaaaagtgtgttattggcaacggcatggtagtcaatccagccgctcttattgaagaaattacttacattcatgataatggcttttccacgaaaaatctggtcattagtgaccgtgcacatgtgattatgccgtaccatatgacgctggatgtgctggaagaagaccgcaaaggtcctaacaaaattggtactacccgtaaagggattggccctgcttatatggataaagctgcacgtaacggtattcgtattgctgatttgctggatgcagaggaattcgaaaagaagctgcgccaccaaacgaaagaaaaaaatcaagtgattgaacaagtatatggcggcgagccattggatgtagaagcaatactgaaacagtatctggaatatgctgaatttatccgtccttatgtaggcgatacgtctgtcgtgttgaatgatgcgattgacgcaaatcaaaaggtactgtttgaaggtgcgcaaggcgttatgctcgatatcgaccaaggtacgtatccatacgttacgtcctctaacccgtcggctggcggcgtatgtattggttccggtgtgggaccatccaagattcaacaagtcatcggtgtagctaaatcgtacacaactcgtgtaggtgatggccccttcccaactgagctgaacgatgaagtcggcgattacattcgtgaaacaggtcatgagtacggtacggttacaggtcgtgctcgtcgtgtgggctggtttgacagcgtcgttgtgcgtcatgcccgtcgtgtcagtgggttaacgggtctttccctgaactcgctggacgtattgactggcctgaaaacggtgaaaatttgcacaggttacaagtaccgcggcgaggtgattacgcattatccggctagcctgaaaatgctggcggaatgcgaagcggtatatgaagaaatgccaggttggagcgaagacatcactggtgtgaaaacgctgaaggaactgcctgagactacacgcaattacgtacaacgtgtgtctgatctgacaggtatcccaatcgctattttctcggttggtcgtaatcgcgatcaaacgaatcaggtgcttccgatttatttgtaggacaagaatgatatagctattgatatacgttcaaagagagaggctgttagtagcctctctcttttttttattctgtgaagtgttaaatggttactccccctttacataatcttatcttccttgtcgatttgtgataacaaaccctctctataatccaaatagaaaagagattcggacgtctagacgtcttgagagggatgaattatgaactggtatcttcgctcactcggcacacgcaaaattgtggagttcatcgtgcttgtcattttcgtcattttttttctggggcctctgaccaatcttctccttttggcggtttcgggaaaatggcagtatcctgcaccgctcccgcagagcttgtcactggaatggtggaagtttgtacttacccaggatgatgtactcagctcgatttccctatccttcttgattgcgattaccgttacggtctgctccattatcgtatgtattcctgctgcttatgccttcgcacgaatttctttcccgctcagtaagtggtttcttttctcattcctgcttacgcatgcttttccgaaaatgggtttgtatgtgtccattgccgtactattctaccaattcgggttgatgaacacctttgcaggcattgtgcttatccatatggtaaacacgctcatgtatatgacctggattccttcctctgccttccgcagcgtacatcgtgcacaggaggagtcggcgcgggatgccggagccggaccatttcgggtgttttggaaaatcacctttcctatggcgctgcccggcattgtggtcgcctccatttttacctttcttgcttcactggatgaagcacaggggacactccttgtcggaacgccggactataaaacaatgccagtcatcatgtattccatcattgctgattatccgagcacaacaggcgctgttttctcagtcattcttaccctgccaacaatcattctgctattggcagccaagcgttttgtaagtgccgatgtactggcaggcggatttcaggtgaaataacgtaactggtcaaaagaggagtttgcacaatcctgaaaaaggagcctaaactaatgcccattcaattatccattcaagagttaaccaagcgcttcaagacaggagacggagtcaaaggcatttcacttgacgtgatgaagggagagctggtgacactgctgggaccttccggctgtggtaaaacaaccgtgcttcgctccattggcggctttttggacccggacagtggcgacattcagattcagggtaaaagcgtactcaagctgccgcccgaaaaacgtccgacagctatggtgttccaaagctataatttgtggccgcatatgaccgtgtatgacaacctggctttcgggttgaagattcgaaaggtgaagaagacagagattgaccgtcaggtgaaggaagcgctagcgctggttcggctagagagcgcagagcgtaaaacgccgggacagctctcgggcggtcagcagcagcgggtagcactcgctcgggctctgctgctaaagcctgatgtattgctgctggacgagcccttttccgcacttgatgccaaattgcgtatggagatgagagaggagctgcgcgatatccagacccagacggggatgacgatggtgttcgtcacccatgatcaggaggaggcgttgtccatttccgaccgcatcgtcgttatgaatgcgggccggattgagcagctttcttcaccgcaggagatctatgacaagccacagtcactttttgtagcaggttttattggccggatcaatttattaaagggggtgagtacaggtcgcagtgtctctgtgagcggaataccgtttgcacaagagcatgaatacacgggtgaatccatggttggtgtaaggccagaggatattgttctgacgacggaagaaaaaggttctctagccggaacgatcagacaagtgatgattctcgggcattatgcggaagtttcgctggatagcggtacccatcatctgaaaatgtttgtgccgcgtgaacgagcgaccgagctgcgcagtggagagcacatcagattcagcttcagtaaaattgttacttttccagcagcacagtgaagattcacgatcaacctctatatcgcatcaatgtccatcacgaacgcatcatctggtgatgctgcgaacttgtgcaactatctaaaggaggtaacaacgtgtttgggaaaaagaatatgggtctggttttggcaggggtacttagtttatcgttgttggctggctgtggaaacggcggtaatgccgctacggctacaggggaagccaagtctacaaaagcgggagccgctaccggaacgacggaaatctccctgtacactggagggtctctgaacgtcaaagagctgtgggaaacgttaatcaaggactttgaagctaaaaatgatcacgttaaggtcaaactggtgtatttgccagcaggaaccggaggtgcatctacactggaccgtctgatcgcagctaagaaaagcggacaaaccgatacagatatcgacctgtacgaaggcagtctggatgacatcactaaaggggtaggcgagaaactgtgggaaacggtggacgctgccaaagttccaaatttgaagaatgtggatgaaacgtatctcaagcaagtcaacaatcaggccattccataccgtgcatcttcggttgtccttgcctataacagtgcaaaagtagcgacacctccgaaaacagccgacgagctgtacacgtggattcgccagcatccgggcaagttcgcctataatgatccgtccacaggtggatcaggcagctcatttgtgaacacggttatctataatttccttccgccagaggcgatgaacagtgatgatccggcaaatatgaaaaaatgggatcaaggtttttcactgctcaaggaactgggcccttcaatgtaccaaaaaggagtctatcctaagaagaaccaaggtacgcttgatattttagcaagtggagaggtagacatggttccagcctggtctgatatggcgctcgaacaactggctaaagggctgcttccagacacggtgaaactgacacagatcgaccctgcttttacaggtggcccctcttatctgatggttccttcactttcctccaaaaaagaagcaacccaggaattcttgaattatatactgacgcctgaagcgcaaacggtggttattaataaaatgtacggctatccggggattaagtggaatctgatgccaacggaactgcaagagaaattcaacagtgtatcttctggataccgcagctttaacagcggagagcttcagcaggaaatctacaaacgctggcaaagtgaagtagcgggcggttgagcatgagttcactgtctaaaagggggatgctggggcttgccctggtcatcccgtcttttctcattttgctggtcgtcgttattattccgattctctatgccgtgaaggaaagcttgattgatcaatatggaacgggctacggactggccaactatattcggctgttcacggaacctgccatgcgtagaaatatcatgtataccattaatgtcacgttagtctcgacggcccttactctggtcatcagctatgctttggcggtttatcttagattcggcaaaggggttgtcgtaaagtggataggccggttgtattttattccgatgtttgttcccggtgtaattgcaacgtatgcgatcattacgatgtatggcaatcacggttgggctgcacgtcttttgctgccgctcggcattgagacgattccgaggattatttatgactacaaagggctggtgctggctaatttgtggttcaacattccgttcgcaaccatgctgctcagctcggcacttgccagcattccaaacgctgtcgtcgaaagcgccagagatgccggagccagcacgatgcagctgtttggtcgctttattttacccctttcctacaaaacgatgtgggttgcggtgaccttcattttcatgggaatcatgggcagctttacggctcccttcctgatcggtgccaactcgccacaagtgctgggtgttgcgatgcagcaggtgttttccagctatcaggagacgcatacggccagtgcaatggcagtgtttatgtttttactgtgttcttttatgggctacttttatattcggacaatggtgaaggatgcggatgccagcaagaccgccgttatacactaaggaggttacagggatgaacagccaagcagaggtgcaaattaccgggtttagtgggcgagtgtgggaaaaggatctgctggattgcggttatcggattgccttacacaaggcggaggttgagctcagcccgggaaacgggttccggtttaggttctccatgccagaagacggatacgcggagcttgatctgttcgccagatcagacagtgactgggctgcgacagatcgagaatctgccttcgtacgcctctacctgaatgaagcctataatcaagatgtcattttgtactatggcagcagtcagggagtgtatacccgtttgttgggacatctaaaagaaggcgattatgaggtctatgccgaatttcgcgaactggaatcggctccgcttgtatctcgagcatggatcgatggggttgaactgcgctgcgtggctgattcctctccaagatcgctgatttatcaccataccccgcttttatatggccgcaatctgtcacatccctatgagaatcgctttacggatacaccgcttgttttgttctattccgtggaagggaatgaggagaagacagtcatcgaatatcagatgatgttcagccatgaagatgagggaacgcccgcgccgctgcttatgagcaaatggggaagaaccaccgatatcgaatggatgtaccgcgtagagctagatgcagaggacaatgttctggaagctgttttccagggggcacatcatattacgaccgcgtttaatgggaattatgatctgggtgggcatcctgttctccaatccgcaacaaccaacggaaactttaaggatgacatttcatcggactatcgttttatgctgccgcctgctttccagtggaaaccagaggaagagccgcgtgaggcggtcatgagtcgttttccttttgcctatcaggtcactgggtgggagatggaacgtcaacaggagctggaaatgccgtcacaagcgtcttccattgcacttgcacaccagcgtagctatgtgtttatccagacttccaaacgccccttacgggattcagacagagaatcggctccagcgtccaagccgggcttcaatcggcgtgaggaagatgcctgtgtcgatatccagcttcgtcttcatggctcggagcagtggtattcatcgtgccattatgatctgagactcggggattttagagccgcttatgagggagcagagtcacatttttctaccacaatcaagctgtctggagaggctgtgcttgaggatatagctgaaatcagagccgtattgcttgaaggcggtgcggatagcatggaagtagccggactgtgtgcctttacgttaaacgaggataatctcccgcagtttccaggtattcgtacagaccgggtgattgagctgacgcggcttcaacccgtgggtgttttatggacagccgacaaagacgtgtcgggtgatgaagaacatcctgtgaatgatatggtgaagcaagttgtggatgaaccgtccagccaggatgggcagtcatgagcagactactgtatgtggagggaacggtcgacagaaccagcacccagagccatattacgtactccttccatattccacagccgactgaaacgatccgtattcacttctcttacacgcccaagttattggaggatcaagagcaagcacgaggaatcattgaggaaagcatgtgcaaatacggatacgacgagccggggcattcatccgatctgtggaagaagtatatcccgctgcaaaatttattaacgctgtctgtcgatgatcctctccgtcaccgtggaaatgcgcaccgtcccgagatgcagcaggagcattggctcggttcgtctgcggcttcgccgggattcctcgcaggagataatccggcgggcatgtggcggattacggtcagtctgcatgccgttgtaaccgagacgcttgcctaccaaattcatgtattgggggaggaagcagcatatgcttaaatggattccggctgagcttcacacccatacgcttcacagcgacggaaagcaaacgctggaggagcttgttcaaagcgcagtggatctgggacttgagtgcatcgctatgacggatcacaacacgcaatcggcacttgcggatcaggaacaggttcagcggcagtttggtctcccaatcatttcagggatggagtggacgaccttttacgggcatatgctgacgcttggggttgaccgctttatcgactggcgtgtgctgggaccagatgacatccatgaggggattcggcaggtgcatgagcagggaggcattgcagggattgcccatccgttcaggatcggaagtccgatctgtacggggtgcttttgggaatacacgattcaggattggcatgaggtggattatatagaagtctggtcaacgcttatgccatctattaagcgggatagccagcgggcgtttgccatgtggaccgatttgttgaaccaggggtatcgcatcactgcggtaagcggtcgggactggcatgtatctaaaccggatgatgcgcttccggctgttacgtatctgggggttcatgatgaagcagaagagcgagaaggcttagcagaccgggcagttgaggcgattcgccacggttcagtgtcagttacgatgggaccgttactgacgatgtgggcacagattaagggcagagaacatcgttatcacatcggcgaatgtatagagctgactgtagaggattcgctatctgtgacggttcaattggatgtggaagcaagagcatcccattataacctcaagcctcagaatcttcgtcttctgctgacaagtagtcatggaatatgctctgagattcagatccctgctcacacaggagtatatacgctgtcattgcaagatccgctaggtaagggctggatacgagctgagctttacggctgcatggaagactgcgtgatgatgattgcttttacgaatccgatttatatggcttaacataatagaaaggctgggcttcggacggtgtcaacaaaacaagagaacataaagcagcgtatagaagaatatatgaaggttaatcaaatgggtccgggggatcggctgccgtcggaaactgcactttcccaatcgtttcgtgtctcgcgtacgacgctacggggagctattcgccaactggaatcggaaggtaagctactagtaaaacacgggagtggcacgtttgcgacttgcccgctgccgagtattccaagctcgctggaccgcctgtatagcatcggggacatgattcgttcggcagggctacgggaagacgagcagctggaatccattcagagaatttcggcttgtcctcctgatattgccgaacagatgagattttccgagaatgagcccatgattgctctagagcgtacacgcacagccaacggagaggctgtagcccactctatcaactggatgccagagaaattagccggacccattctggaaggtgactctttttcaggctcgctttttcagagtcttgagttcaaggcgggggtgcgaatcgtcggagcgtattccgagcttaccgttcccaactatgacgatgcacatatgacgcgtctgttgaagcatccgcaggctacggtattactattgaagcagcttcactatgatgaaatgaacaggcaggtgctgtattctctggattatgtccgcagtgacattttccgtttctgggtgcgtcgtacgcgctgattcaataagaatggggcatctcctattgaattgtgctagttttacatattccatgggttaaaagtcgtcatatctcgtcaatactgatctatatgcacttcatgatgatacacacatggcaagatgcgtataaggaggtaacgggatatgaggtggcttggatggctgctcaaaaaaggaatgacggtcgtgttggttagcgcactaacgctggcagtgacaggtgtagtcgttaatgcttatgttcaatcgctgctgcggcagtttaacattcagcttgatcatcagcccatatggggattgggttggctaaagggcagtgcgggtaaggaccaaagcacagacacggggaagaacaagacgacaggaagtgactcgggaagtgtaacaccgcctgatgatgcgttgcctgtcatgggacagggcttagaagaaagcggaagtgaggctggtggcgcagccaatggcaaggtatctcaggagggtgccacgtcggcgggaacatcaggcaatgagtctcggaagcaggcagaaggtacaacagctacacccgaaacgagtattgaaggccatgatttagtgattacgcccgaccatttgacggagaagaagaacaacttaccggcggcacagaagcaggagatttttgcgattctgatgaataagctgccgccggaggagatgcagaaaatatcagctgcgatggaaggcggtctcaccgagcaggagcttcaggatattcagcaggtgcttgcaaagtatttgaccaaagaggaatataacaagttgatgtctatgcttaaatgagtattttgcgaaatcctgaataaataacgatgaattcaggggcaatgtgtatgctcaaaataggactgtagaatccgcgccatgcgcggatttttttgcgtgtcaggaagtaattggggtgtagttgaattctttgtaaaggctatgttaaagtaaacagtgttgtgaaaaggttaaatttttgaaaccttttacgcaactatgcaatggtagatagcgactaatatcatagatgcttgtgaatacaggctagattcatagtgtgaaagaccaataacgaacgcatttatatagagataagatatgctgaaaaggagagagtcatgaaggttttgaaggagcaggattcaccagacagcaggaatgcagcttcaaacgttgcagacaagcctgctgtggaagcggggaaaatagcaaagtggtggagcggtcggagaaaatggctgagctggacggcaggcggtgtggtgattgcaggcagtcttatttttgcgagtaatcagtatgtcggggctaacacagttccttattataaagtgtatgtaaaaggcgtcgaggtcggaaatatcttgaatgagcaacaacttaaacagctatacgcaacgaagagcaaacactataaggataagtatcccggcgtggatatggtgctcaatacgagcgcggtaacgacaggcattgagaaggcatataaagcggatatcgacagcgcagccacgctgaagaagctggatggtatgttgacagcgtatgccaaaggggtagaagtgaaggtcaacggtcagacggttggcattgtaaaggataaagcgactgcacaggcggctttaaagcaagtacagaagaagtacacacctgtgggtgagggtacatctacaggcatcaaggggctggttcgcaaaacatctgtgggcagtagtcatgcgagtgctagtactaaaacgcctaaggcatggctggagtctgccagtatccgtgagaaaatcgcttatgagcctgtgaaagcagacccgaacaaggtgctgacagaggctgaagcagtcaaagtgttgactgaggggcgtgaggctcctatcacgtatacagtgcaagaaggcgattctttgtcgtcgattgcaactaaatttaatatgaccgcttgggagattaagcagaacaatcccggctcgcgtgagctgtatttgcaaattggagacgaattgaagctcactgctccgaaggctccagttacagtgcgaacagtagagaaggtcgtcgaacagattgccatcgagcctgaggttgagattcgccagagcgatgaactgaaggcaggagttaccaaagtggtcagaccgggacaagcaggtcttaaagagatggactatcgtttgaccaaggagaacggtgaggttgtgcaagaggaatggctcggtcaaaaggtgctgcagccgtctgttactgaggtggttcttagaggaacgaaggttgtgggagaaggctcaggacagttcgcttggccggtgtccggtgcatcgatgtcgagtagctttggcgcacgctggggacgtatgcatgagggtgtcgatttggtcggtagtgctgacattcacgcatcagatgaaggtgtggtaacatttgcaggtcagcagaatggatacggcaatgtcattatgatcgatcatcgtaacggctaccaaaccgtgtacgggcatttgagcagcattggcgttcatgtaggacaggtggttcagcaaggcgagtcgatcggggtcatggggaacacaggacgctcgaccggaacgcatctgcattttgaaattcgtaaagataatacgccacgcaacccaatgacgtatttaagataggttggatgtttatatcgagagttacatgatttatgaagatcaaggggaaaggccatgtttttctgcatgcttaacagtaggtgcagacatggtttttttctgcgtaaagaaaagggtctggagaagtaagggaatggcgcacgggtatgatagaatagaataaacatcttataggtactgcaaacgaaagttaattatagattatgatccgtgaagagaggtgaacgctatatgcagggaacgattctggtagtggatgatgaacagcccatcgctgatattttgaaatttaatttggaaaaagagggctaccaggtgatttgcgccttcgatggaatcagcgcggtggatatcgcggtcaagcagcagcctgacctgattctgctggatctgatgctgccgggcatggatggcatggacgtatgccgcgaggtacgtgggcatcagctccagacgccgattattatgctgaccgccaaggacggcgaaatcgacaaagtgctggggctggagctgggtgcggacgattatgtgacaaagccgttcagcacacgggaattgctggcacgagtgaaggcacagatgcgcagacagcaacgtggcggggcaggcacgtcggaaagccgaccgcaggaggataagcaggggctgcgcgtgggcgacctcttttttgatacagatatgtatacagcatacaaaaacggaacaccgcttgacctgacgcaccgcgaatatgagctattgcactatatggcgaagaatgctggaaaagtcatgacgcgggagcatttgcttcaggcggtatggggcttcgaatactacggggatgtgcggacagtagatgtgaccattcggaggttgcgcgagaagattgaggagaacccgagcaagccggagaccatcctgacgcgccgtggtcttggatatatcgtgagcgggggcaaaggtggcctgcgggcatgagatggctttctttctttcgtaccattcatgcaaagctgattattatctatgtgctgctgatcttggtggctatgcagctgattggggtctattttgtcagctcgatgaagaactctctcacgagtaattttacgcaggatttgcaagcacgggcggagatgctgtccgtgctggcggagcaggatctgagtggcagtgacggcaaaatggaagaagacagcgtggaaagtctgcgtgcacgcgtaaataatttgtttgatttcagcggcgcggaaattcaggtgctagatgccagcggcaaggtgttaattacttcccaagggtcacacgccgattatgttggacgcaaaaatacgcagacagtggtcagccgcgcactccaaggtatccgtgataacgaggaatacatggtggacgaagataatgtccgcaagaaggtcgtcgccaagcctgttatcagccaaggcaagattgtcggcgcggtgtacatcgccgcttcgatgaccgagctctacgatacgatgaaacgcattaacaatgtatttctctcaggtatgctcattgcgctggcgctaacggctgtgctgggcgtggtattggcccacacgattacgcacccgattaaggtgatgacacgtcatgcaacagaggttgccgagggcaaattcgatcagcagatgcctgtatttggggatgatgagatcggcaggctcagcgtggcctttaactatatgacaggccgtctgcgtgaggcactgtctcaaaatgaagaggagaaggagaagctctcctccatcttgaccaatatgagcgacggtgtggtcgctaccgatgataacggccgggtcattctggtcaaccgtcgggccagcgccatgctgggcgtgaacgaaaacgaaatgaccggcaggcatatcgcggtactgctggggatcgacccggaggaaaccgaggccctgtatagcggatcttcggcctccacgctcttgcagctggagccagccggtcaggatgaacccatcgtcatccgtgtgacattcacgccgattcatcggcgggaaattggcattacggggacgattgccgtgctccaggacgtgacggagcaggaggaaatggagacgacacggcgggaattcgtagcgaatgtatcacatgagctacgcactccgttgacgaccatccgcagctatgctgaggcactggatgatggcgcgatggctgaaccgcagctcgcggagcgttttgtaggcgtgatccgcaacgagacagagcgtatgatccggttggttacggatttgctgcatctgtcacggctcgattccaatgaggcacctttgcggatgcagcctgcagatgtgatggagatgctggacgaggtcgcagatcggttttcttttcaaatgaagcaaaagcacattcgctcagggatgttcgtagagcagggaatcggtaaggtcgtgatcgaccgggaccaaattgagcaggtgttggacaacctgatgtccaatgcattgaaatatacgccagatggcgggagtattcggattgaagctcgccgcaacagtgagggaatgctgtccatttcggtacaagacaccggaattggtattcccaaaaaagatctggaccggatttttgaacggttttatcgtgtagataaggcgagatcgcgcaatatgggtggcacgggactgggactgtcgattgcccgggaaattgtaaaggcgcatgggggccagattttcctggaatcggaatacggtcagggaacctgtacgacctttacgctacccatgtcgagtgaagggagggaagcacagtgaaggaacgtttgaagtcctggacgcttattttgctggttgcttccagcctggtacagacttattttttgatttaccgccttccaggcagtgattctgtactcacttcagaaacgaactatgtcaaaaccgaaagcatggggcaggagaaaaaaattgagaacctcgtgtttcctgataaaatgctcattcaccaaggtgagaagaagcataccgttttttatccgggtgttactttttacgatttaatttatacacggctggaaagccggagctttaacaactttcaacgtcgaagtatccaatcagcggactgggcgcagattcgcagcgaaaatgaaggcatcgaattatccttttcaggcggagtcccggtttcattactggaacgggttatgcgtctgacgccggattcggtgtttcagggagagacgattaaccgtatttggatctatatagacgaaaaaaatgccaagccacacgcgctctttttcagtgccagaggcgatgtggtgtatgaggcgaaccagttcgacatgacggtagaggacattcggcagcatgtgaatttcggtgaaaatgccccgttgtacgagctggtggataatcagtactacattcccgtgaatgacctggaaacagtgcagcctgtggtgtatgccgggttgtttacgacggagcaaatgcagcggaacttgttcttcgatccggggattacgcgcaatattcaggagaaggacggctcacaaatttacacggacagcaagcgtagtctgcaaattaagcaggagcaacgatggatgagctataccgatcccagtgcgccaggggcaagtggcagcagtccaattagggatgtactggccgcagttgattttgtgaatcagcatggcggttgggatgcttcgtaccaaatgaaattaagaagcagtgatgaaaatcgtacgactgtgatgtttcagcagtattatggtgcttatccggtgctggacacaccatcgttccgctttggtacaatttcgctgcaaatccagcaagaaacggcatctgtctatgaacgttcgctactgtatctcaagggaggagagcaatcctcgaagaaggttatgctgccgggtggcgagcctttaaagaagcagctggagactgtagcaaaagggaagacgattcgtgatctgactcctgtatatcagccggagctgaccaatgatggattgaagcttgctcctgagtggcgcgttacgctcagtgacggttctgttgtagaaattcatgctgttcctgtaacgacagcatccaacacaacacaaacgaagccagaccgggagacaaagaggtgacaggaagggggaacgggaatggattggagccgcgccaagaacgtattgatttgtacatttttgctgctcaatgtggtattgggttaccagttgtggcatgatgcgcaggaaacggcagggccgaatctggattttacttcattggatgaaaatacgcagcgtttaatggaagagaaaagcattcaggtgctggctccgattcccggcgataccccgcagctgcctaaactttcttacacatatgttcatagtggagaaaaggatgatcgtgtgcagctggtgaagccagtggacagcaaactggtattcacccatgacgcgttagttgaggcattggagccacaaatcaaggatatcgataactttcagtacgatccgctggatgttcaggaggaattggcatccggacaagcagatgcttttgtacttcatccgctggttcagggcaaatggccgctatttaatgtgaagttggctctgttttacagcaatcaaaagattacagggtatcgcaaaattaaggtcgatctccagccttcggatgaggcaaagaaaatgctgcctgcgtccaaagcactggcaaggctgatcgatggctatttgccgcgtgatacgattgtgaaggatatccggctcggttattacggacagacctttaactccgatagccaggtggctgcccccgtgtggcggtttatgctggacaacgggaaaggtgtgtattatgtgcagatgaacggagatgtcattagtccaaagacagaacatacagaagggtcttgaacagatatggggatttcatttaccgtgctgtcgagcggttcgaccggcaacgctaccgttgtgcggaacgaagacacgacattgctcatcgacgcaggtctcagcgcgaagcgtattgacgaattgctgaaagaacgcgatctgagcggagaagagttggatggtattttggtcacgcatgagcattctgatcatgttaaaggactaggcgccatggcgcgtaaatataatttacctatatatgctaacgagaagacatggtttgccatcagcaatgctgttgggcaaattgcagacgataaccgcagaatattggagacaggcgcaacgcgggaatttgagtcattacgcgtggagtcttttggcatatcccatgatgcggctgagcctgtagggtatagcttttatgatggggcagagaaactcagtgtagcgaccgatctcggctatgtcagcgacaaagtgaaacaggcgatatcagacgcggacgtattggtactggagtctaatcatgatgtggaaatgctgcgtatggggcgttatccgtggaacatcaagcgccgtattctcagcgatatcggtcatttatccaatgagatggcgggtgcgattcttagcgagctgctgacaggtcgtacgaagcgaacgtatttggcacatttgagccgcgaccacaatatgatggaacttgcgaagttgactgtacgtggggcgatggaagaccgcggctgtttttacaaggacagtgagtttcgattgtgcgatacgtactatgatcgtcctacaccttgggataaggtaagtgagccataaagctgtccagctcggcggctttgcgttctacctcttcacgggtcactacgcctttgtccaccagtagttcaatcaatgtacttagcgccagtgtattgcggtaatgctcgtctttcaaatccgcaagcttggcagccatgcgaacttcatccatagccgaacgatgtgaattcatcatatattcctcctgtaaaaatattttagaaatggcgtgcaatgagcttggttctgtctgtggttttgctgggtgctgtgatacaataaagctaacaacggaaagctttctgaaggaaggctctcaacgaaagtataggcagctttaagcggacgggaacaggccagaacgtctctatgagacgatcattttgtaatagaatagaagacttgttactattgtagtccattggtttggaaatcattcctcttttttcctctattcggagtcagattcggcgtgtatgctaatttatgagattcggttgcttaggaaggcaccatttgtggtgattaataagtaggccggaacgattggttgctggattccgatgataagggatattcaatccatttgagatgttcaacggagcaggttctctgtagcataggttggcgcaagcccgaatagccctaattttttagtgagtgtcggtgcatgacaacgaaggggagaggattagcatgggcttgtttgaggacgatttttattcaacgaaggtatccacacgtgcggctaaaaaaatggcatttaaggcgcgccgtggaggacggggacgttggccacacaggaagcgtggagtaagtccggtgcaagctgctgtcattagcggtgcagtcagtgcagtgattgccgtgcttctgttcagctttattacaggtctgccctccactacagcggtaaccggagccagtcactatcccttgcggcaagcagcgggtgatccgtatgaccggattgtgcaggcggcagccaaggtgcgcccagccgtcgtcagcatcgtgaacctgaaagaggaagaggggaaaagcacggaacaatccgcgcttggatcgggtgtcattttccgagtgagttcgggcaaagccttcattatgacgaataaccatgtggtcgaaggatcagatgatctggatattgtaacggtagacggtgtcagaaaagaggcaaagctgatcggcaaggatcgcattagtgatatcgctgtactcgcagtggacgataaaggcattagcacggtagcggatatcggtgattccagcaaacttcgtctgggtgagacggtcattgctattggcaacccgctcggtttgggagacacgcttacctccggtattgtgagctatacgaatcgcatcattccaatttccattaaccaggatggcgtatatgactgggagcagcatgtcatccagaccgatgcggcgattaatgagggaaacagtggcggcgcgctggtcgatttggacggacgtgtgattggcatcaatacgatgaaaatcgctgatacaggtgttgagggacttggcttcgccattcccgccaatgaggtgatgaagacggtgaatgaactggtcgaggacggcaagatcactcgcccttatctgggggtatacacggtcgacctcaataatgaatatgcaccgctggatgaaactcagcgcaaggagcttaagttgccggacagcgtgaaaaatggggcagtcgttctggaggcccatggtcctgccaaggagggtggcttgaagctgaacgatgtcattacagcgtttgatagcgaaccgattaactctacgcttgatttacgtcgctacttgtacgataacaagaagattggcgatgagctgaaagttactttttaccgggcaggcaaggaagaattggtgacgttaaaattaacagataagccggaaggctaaggtttaacttataggcttaactataaaaaaggcgttctccggctcattcccgggaacgcctttttcgatcttctgctgcgccttagattaagatgtcgttcccgtcacacgggttccgctcttggtgatcttgtatgtcaccacatcgccgctccagagatggaacttcaacgtgacgtcaccatcttttacactattaaaaaattcaggcagcagcttgatgccgttggcatcataggcaggggcaaaggtattgccaaattccttataaggtgtccaatcctgtggaccggcattgccaccattcgtatacacggcttccatcgtcgcaagctggctaccacggaagtctgttggaatggtaaaggcttgcgtagtcccttcgacagcactaaatttcggtgtatcatacacgacgactctaaaattccagtctgcccccttgttaaacttggcggtaatgacggcattctcaccatatttatcggaagtggtcaggctggtgagcaagctggctttgaaggttaatgtgtctccgctcagtgtgtagtcggtgtcctgtttcagtttcttgctgttgacactgagtgatttcaaatggttgccattcaggtttaaagtgaccttggtgtcctgagcagaggtgcctttcttcaagtgaatgaggtcactggctgcgttagaggaacgtccttttaggctggacttaatgacattgaagagttcaggatcagaccatttgtacgttgtccggttcaagtgctggccgttatcccagagcatacctgttatttttttctctttcatataataggtcaggaactcgaagaattttagcttttcgccctgttcaataacgcctgtatttttatcgaagccgagtaggccgtattcaccaacaatgactgggattcccttggctacaaaggtgttatagacgttatcaaaggtttggatgatatcgtttttagtgtctttatcaaaagtagtatggcccgcaatatttacactgaagggccaataaccataatagtggacggtggcaatcagattgggatcattcagcttggttatcgtgttgtacagctcgttgattttggcctgagcaggtgcagtgtccaagccaggcagaacaaggggacgagtggcatttttaccgccagaggcgcggacaattttgtgaaaggatacgttcagttcttggagcatctggttcatttttgtttcatccgtagtccctccttcggagaaacggggttcgttaatactttcgaacatcagcttgttgggctgatctttaaagcgctgggcaatttgtgtccataacgtgttatagcgagccaacacttcatcatgtttgggctccatactgcttacccacgtccatgaatcatgatggacattaatcatgacgtacagattggcatccagtgcccagcgaacaacctcttccacacggctcatgtaggcagactctacggtatagttgggtgctgctccaatgtgcttatcccaggtgacgggaatacgaatacttttgtaaccttgggcagcaatttgctggatcaacgcctgggtaatgcgcggattaccccaggctgtctcatccgccccgacagcatccagcgagtttcctaaattccatcccggctgcatggcttccacatacgattgcgtgctgtttgcagccgcagtttgcggtgcttgtccgttggattcggcagcagcggcaacggatgcgaacgtagataacagtagagtgatggcaagcgtcaacgacagcaatgaaacgggtcttcgttttaacataacaggcccctttacaaagttattttcgaaagcgctttctaataaacactaccatacgatttgaatatggaatacctgtataatttatataaaaatcatgtgttaattagatattttaaatttgtaagcgttattattgaaaaaatacagaaatgagtgtagaatctatggccctacgtggattgtagtatagcatcggatttgtaaatacaaaagaaagaaggagatgaatatgaataagtgggacacggaagaggccattcgacgctgggatatgcatgcagaaaactttacggccaagtacacggaggaaggggatcggtctcgcgaagtcctgctgaatccagcattgcaagcttgtatggggccccttgagggcaaaaaagtgctggatgccggctgtggcgaaggttatctaagccggaaaatggccagggcgggtgcttgggtagaggctgccgattactcgacagagatgctgaggctagccaaagagcgaacgccgtcagcgttgggaattacatatcaccatggcaatctggagaagctggagatgttcggggaccagagctttgatctgatcgtgtccaatatggtcattcaggacttggctcattatgagcaggcgattgccgaaatgcggcggttattagttccaggaggccgctttattttttctattctgcatccgtgttttcagacaccgcagagtggatgggtgaaggacgagacagggaaaaagctgtattggaaagtggatcaatatttcaacgaaggcccattggagcaagcgatcccttatgatcaggaagaaaagcttttgtactttcaccgtacgctgggcagctatgtacagaccattgttgaggcaggcttgttgttggatgggatgatcgaaccgaagccgtctgctgacatgctggagaaatatccccatttccgtgaagacctgaacgtcagtaatttcctcatttttaagaccaaacgtcagggatagtgggcaagccctttcctttccgcgtcaagtgtggtagaacaaaagaaggcagttttgacacacttacaacaggaagagcttcaaacggaaagggatgcaactggaatgtacgtggtatgtaaagagcatgtggaactggcaattgatatgttcgtcgatgaatacgaggatgcaccggatgtcgtcgatcttaaggaaacgaaattttcggattgggaccctccagtgaagtgcaaggaatgtgagaagaaagccgagtttttggtcgtctaaaaaacaagcacgggcgtttcgggcagaaacgtcctttttgtataccaggatttattgcaaaaacactcatacatagagctatatttatccctaccacgtactgagacaggagtgaacgatggatggaccctttactgcattcgttatttcgtccgcttcaagtcaatggaagtgatttgtccacgtattatatcgaacaaaagccgtctgccgcactgaaagcttacgtggcctgttattgggagtccggtccggctaatagggtggtagaagagaatctagcaacttcgtgcgaagacaccgcttcgttaagcctgccgcaggaagaaaccatggagcgggtattacctgacggctgtacggatattctattagaatatgatccggtgaataagcgtcaggaactctcgtactgcgggacatttacgcaaccgtttgtgtctgccagacaagcagggtccgagacacgcatttttgccgtgcgattttttccgggtggtgcgcattattttcacgggatgccgactcacttgtttacaggtggtaattatcacttggaagatctctggcccgaaagcatcaccatcataggtgagcgcattatggaagcgcagaatttcaatgaacgggtgcgcataatggatgagtatctaaaccagcttctgctgcgccaacgcacgaacgattgtgatctgatgaaaaacctgctgcatcgtatctttatgagcggtgggagtgtgggggttaaggagcttgcggagcgtgaggcgatcagtgaaaggcagatcaatcgtaagtttggacaatggatcggaatcagccccaaaaagttcagtgaagtcgtccgcttccagagtgttctgcatagtatccaaagcggcggggggctggattggacggagatggcattgaagcatagctttttcgatcaggcgcatttaatccgcgatttccgcaggttttatggagattctccgcttaccgcggctaagaatttacggaagttgtccgatttttacaatacacgcctagaggcatcgactatactcaaaatataaagaagaatggcaaaggagagatgagaatatgagtggaacgctgcaagttcgagatcatttgctgaatgagctggagaccggagtacgaacgggggaagccttgatccgtaaaatacgtccagaggattggaactttcgcccgcaggacaatttccgctcgttgctggagctagtgcaccattttgtgcttattcctgcttcggatcttgcgataatgcaggagaagtctgagggtgaagtgggaagcattgaaaccagcctatccggggtggaagatcccgagcgcttggcagcgactttcaggcagaattttgaagcttataaggcttacattctttcgcttagcgaagacgattatctgaatcgttcgacgaaggccttctatatggagcacggacatttgcaggttcaatggcagattgagaccatgacccatgtgttccatcatcgctcgcagatttataattatctaaagcaacagggacatgaagtgagcttttttatgttgtacgcttgagtatgtttgtgaagatttatggagggcacctgtgcggtgctcttttttggttttattcaaggcttttttagggtggtatggcttactcgaacgcgcgcgaaacttctttattaactcgtctgagaatgctgatttgcttctcattcaatctgctggtcaacgcaacaaattcatctaccgtctcttgccgaatcgtttcgtctgtagtcatatgttctttggaaaacattaattcactgatagacacgtttaaggcggttaacaccttctccaaggtatcaatcgaaaagttcctttcgccacgctctaccgatccaatatatgcatcatctaatcctgaaagttccgcaagttgttgctgtgttaatcccttagccttccgaatcgttctaattctttctccaaccgaattccgtaattttgtcatattagccacctcataacaagcttatgaaagatgaagtgtaaaagtcaggtagaagagaattgttcaattctttttttgttgtaacacaactaaactaacaatattttttgttatagtagtgaggatttcgagctctgttgtttctcttgaatttatgagcaccataagttcatttatgatttgttttcgatccgtattttcgtcgaattggaaaagttcaaaggctggaacttttaaagctagaattattttttccaatgtctccaatgaaatatttcgatctccacgttctactccaccaatataactgtaatgaagtcctgctgcttcagccaattgttcctgtgtccatcctttagcttttcttagttctcgtattcggtttccgacactttctggtaaactcatgtaatcacctccacttaaggttagaagaggagagaatatcgttacagaccatcttatacaaaataaatacacataaaactgtacctttaagtactatttatattgacctcctttttcactttctatacaattggttatgaatggaaatataaggaggggctactcttgagaacttctatcctgaaatcactcaaaccggacatcattgttgaaatgttagagatggctatggcttttgaaaattggaaaaaggtgttggagacggcggatattttgtaccaatgtgtacagcgtatctatgaagaacggcagtatcataaagcaatgaaattatgcatcccgcatgtcaatttagaacgtccgttggtatactattttggtttcagtcacctgatgtgtggaatggctcaccagaaccagggtacatatgggcaggcaagggagtgcatctataagtatgctgagctggggtggatggaggatttaaaggaagaagacaatcaggttgttgaggaattcaggtttttagccaaaactaatttatatgcagtagatattttgtctggaaatatagagcttgtcgaggagtacgtagcctttttgcaggataatctagaggaaatattaccggggctgaataccatattacaggcagcgcttatgtatcatttggatgtaggagatattttacatacgtttgcagagcagattgatgaattcgggagttatgaagacgcagagaacgtatcttactattatagctactgctatcacttggctttgtactatcggaagtgtggcagattacaggatgcactgggacttactgtgcgggcgatgcaactagccgatcagtcgggtaacgatcgtaatttcaagaaatgtacagcattgtttgaatcattacgggagtcagcgacagcggaacaaatcagccaatatcgagagatgctaataaagtgtcttgatgaatacggaactgatagcatttcattgcgaagagcgtaaatgaatgatccactataacctgaacaggggataggcttgtaacggagaggaaatagataggtaagaggcgtttcgtgctaaaataactatgttaaaggtatttattcatgttagggatcgtaaatgcgattttacattatcattcgacatagataggggtatggaatttgtttattcagcttataggtgttggcaagttaaaagagaagtatttggtcatgggaattcaggaatacgctaaacggctgggcccgtacattaagtttcaaatgatcgaagtagccgatgaaaaggctcctgacacactgagcgaagcggaagtccgacaggtcaaggagcgggaaggagagcgtatccttgctcatgtgaaaagtgaagcacatgtgattgtactcgccatcgatggaaaactgtggagctcggaagaactcgcagaggaattggacaagctcggcacctacggtacaagccatgttgtcttcgtcattggcggtagccacggtctctctgacgaagtcctccgccgtgcccagcagaagctgagcttcggaaggatgaccttgccacatcagctgatgcgattggtgctggtggaacagatttatcgggcggtgaagattaatcgaggggaaccgtatcacaagtaacagcaacgaagaattgcaaaatgtaaattttattatgaagaaaactgtggaaaaagtggtattcatatttttatgtctcgagaatatcgtacgattgagaatatgtaccctaagcgtagtatgtctaagattttaaacacttcaattgaagaattaagctatggacactttgatgaaatcaaggagattgctaaaaaataaattattaatagtaagggagatagctgaggaattgactgaaaatgaagctaacgaatttcctcttgtcaaagaaatacttaaatagtggtagtcataaagtgtataatacaaattaatgataattgaacctgtcacctggttttatttgttaggtgacaggttattgcacctttaataaaggaaaagcctagctttaatgggtctgatagtgtcaagtaatattatttaaggcatgatcactatccagcaattggttcataatcaaaattatactatttatataatcgtaatagtagttagtaataatttgctcaatatcatcataaaatgagttgattttaatttgttcggcgtaataatttttcatatcctcgcgatagccagctcccctaccccatctttgctggactttaatccaaaaaagaaagtcttcttttgaaaagacaacattttcaaagtctttataaaagttatcaattaattttttcatatatcggggaagtgtgttgtttatttccttaattgctaattcaataataaccttttgctgttcagaatttttttgcacattagcattgctagttagcaaaaaaatcgcatagtcttttgcttctttaaagattaatttaatttcattttgtaactcatatgcaccaagattaaaaatgtcattatcgttaaatataccatagcgtttatttattgcagagattgtacttgtatgtttatcatctaaataatttttgtaaaaaaaaaccatcttttctttcaataaattaaaagagtcaccgacatttttcttttgaagttcagattcgagctgagaaacttgaattgtaaatatatcttgttcactcatgttttttattttataaaaatcttgtttgatcttactgatttcttgcttaacactaatctttttttgagttattatattttttattttattcagtataacctttctctcgaaatgaataattttatttttttcaaattttgcttcgtcagtagtcgaatagtcttctaagtcatcctctgttatcaccattcttttttcattatttagaaatctcagaggattataaaataatatattttcttctctaaatgggatttcattctgcgaaaggcccaatataatactatctttctttgaatgtataccatcgatctcacttggaacctctccatcactatcaattacttggttaggctcattatcgctaaaattgaacattagtataactttatcaacaatatctgatttatcgtcatatataaacgtacttaataaattaataatagttaatgagggagctccaacaaaattatcagtaactacaataagattatctgattcacttgtaaaaaaaccactaatatctctacgatcattgtttttagtttgatctaatcccctagtgtctataatctcatttacaaatggtagttcctcaaagtcaaatatttcttttcccaagtggataacaatttcgcggggcaatggtaaataatcgtctgatactaagtttatttctttaaaggtattctttaaccaatcaatttcagctacgttcttatcattatcaaacaaaagaactgttttagttcttttatctaaattcgatcgttctattatattattcaggaataatttataatcttcctgtttaaactttcctgcgagttcaactgcctgatctgttctagaatcacccttactaataacttttaactttgttatgttcctacaagcccgctctatctcaggaggcagttcaattaaagtggttacttcatccggtaatttatgaatttttgagaatgcatacttagcaaatgcctctatgtaatctagagtatcattagctgagtatggagaaatttcaataaagctttgcccattaactccacggatcctcacttgagaaatagtagttgaaccagaacctgtttgcagaatgtcttcaagtatttcaaattcactgccgttaggttttggtttttttcgcttatataccaaattgaggagtctacaaataatagtagtctttcctactcccttttccccaacaaaaatcaaagcgatcttcttttgactcagcttatctagctcttttagcctattcaaaaatgtccttagtgcttctatggtgttcttatttgtcctttctgtcatatttatctctgtgatcagttcactctgtaattctcttatttcattggtaaattgaaaattgctcattaaatgctccctctgttataaaaatttttcaccctattttgtaagtagataatgtctcccggtaattttaaaacttgtagcttttttaagcaattcgggcatacagcagctatattctctttggatagcggggtgctatcgtcggattttaggatatataactccagataaggctgcccgtcttgactaataaatggagccatattaccgcataactcacaaaaccctttggacctttctatgatttgttttctcaaataggcactttcaattttatcgtcatttaatattttattattggaattagatctttcgattccatcaaaaaaatattctaaatcgacagagaaaaagcgagaaagtataaaaattgtctcaagatcaggagtacgcatcccgcgttcatacatccctatggcagaagaagataggcctactcggtcagcaagctctttaatagtcaactgttttgactttctaagggctctgatttttattccactaatattaatcacaagtcctatgatatcaaaaaaaacacatatgtcaacaaaacacaatatgtgttttttcttgttttaaaaatggaaccttggataccaaagcaaccatcaagcaatggagcaggaacgacagggttagcttggtaaacttctcttcgttagaagggactacccaagaatctcgggactttagtcatgagaggttcaatcatacaatgtaacaatgtgaagtattaattgaaactgataaattggttataaaaaaacattttggctatcggggaaaattccgatagccatttttgtgccccatatagattttaaattaaatttatcttctcctagttcattctagcccattggtccatccgctggatggcatctaaacgtgcatcctcagaaagcaggggctttatttctccattaccctttagtagagcttggattaacgagggattaagcaagcacacgacccaagctatagtaatcttgctcctcagtttgaagctttcggccttcgacccactccgtcatgtaatagagtcttcgatgtctagaaactcaataacttccagaattgtttgacaataattaggtatatggggataaccggtttcttgcagttttcggacataagatgaaatcttgacaatttgctctttcggggtcaacctcgtttttttgttcgcccgtagaacggtttgattaaatattggccttgatcggttaccgcacaatatgccgctgcccatttataatgcgaatcataggattggacgctttttaaagtcaggccgtattggggaacaacgctcttcaacttggttatatcggaaccgtttgacaggccgtgccctccgttccctatcgtaaagcgattattctaacaatgatgctaaaatagccatttcacccagtatgccaagaaaaccaaagtaaagagtactgtaggcgggatagtgataatcgttaccttcacataatctttccaacttatttttacgttgttttgcctaattatgtgcaaccaaattaatgatgcgagagtaccgatcggtaatagcaatgagcctacatcgctgccaataacacttgccagataagctacctttaaattgagatgatctagattcatacttgtaagggaaaccgttccaatcattaatgccgggtgattattaaataaggaggacataatcgttaaaagaactcccattatcaaactgacggtgagcagatctcctgcaatcagtggttgagttaggtgaattaacatacttgttaacccaatgttatttaagccaaaaataatgatataaatactaaatgcaaacaggaatatataccatggcgttttttttaacatatcccatggaggtattttaatataaatccaacgccacccaagtaaaagcacggaacctaacaccgccacaatttcaatcggaatgttataataagaggcaataaaaagacttacacgtacggaaaatacaaagagtagaatatttctcattaatcggtttcgttctttcccggatttttgtgaaggatgcggatagatttcattaggaaacttttggttagatatgttccggggcagtcttttgtagaagcataaatataataggcctgaaaacaatagcagtcctgttacataaggaacaaacatcatcaggaaattggtgaagagatcaatccctataatttttagtgcaattaaattgacgatgttgcttactccgattggagcgcttgatgcggttgctgttaatgcgcccgaaagcaaataggggatcttttcgtgatttttcagctttagatgattcaataataaaattaaaataggtacatatgctttttcgccgttagccccgttacggtgaaccgtatcataagtgatcgtagagcggagaaatgcagagagttttatagggattctaatgggctaaatgtatggttattatgaaatttggaaataaggaggcactctaatatgcctcttactttaaatcatagaaaaaaacaattgagtatattatatatacgagttgtagctgttgctgcactgtgaggtctggggagagtatgtttctgataatatattcaggaatatgctttattttttaattaattttcaagtcaactttagcaatctttttattctttataacaacaccctcctaatcaacgcatgcactaattgttttctcttttcattactcatctaattaaacagtcatacgaattcccaaagcatacactgaatatggcccaaacttacagggttatcgttctcattactaaacaggcctttagtagcagctttacgttttaaaagtgctacttcctgctcagacaattaattattcgctccttaagcaaatgcgcctccagtatatcctcttcatacagtttaaagtatttagattccttacgtacaaggtcatttattcccttttcaatctgctttagttcatcattcaaagcccctttgttcaatctttgcctgccgtttaccctattcattatatcttcgattaattgcagcatactcacaaattcgtgaatataagccaaaatcccttttcagcatatcggctcgttaacaacaccgccattccattttccctgtctgactcgttgattcatgtctactttgacaagcgttcatcatctatctacgtgaaaaaacctatcgtctgatcttctagtgtctgttctggatctatactaataaagcaaacagtggtcatatcgaacatcaaattcttgaatcggtctttcgatagaaacacgttttagaatctgtcctcaaacctgcaatttgctagagcgaaagcgaggatataaggtcttttaagaaccatcctaaccctctttttcaccaatattatgttttccgttgaagacacgcctattggatacatattggaaaatttttttccagtttctacttgtggaaataaaagcaatatgttaatattatcaaaaatttagtaaaggagagtgtaagtgagtaataaaggttttattggtattatattctggtgatgggaagaggagcgtgaaaaataattgcggtatacgtaggtatgtgttgtcattttgctttgtgttatttctatttgcttgttgttattttcttcagaagtttaatagtgaagagaaacttcaggttcagtctttaaagagtaagcagattataccgtggggcgtaaactacataaatgcacctttgctatggtcgcggggagtcactgggaaaaatgtgagggttgctgttttggatactggtgttgacattatgcatccagacctaagcagaaatcttaggaatgggtataacactattaaccccagttcattgccaatagacgataacggtcatggaacgatggtggcaggtataatcgctgctcaaaacaataatatcggtgttacaggggtgtcaccagatgttgaattgtatccaataaaggtattggatcgatttggagagggcgagattccaaatgtaattaaaggtattgattggtgtgtaaacaataatattgatgttatgaatttgagtttttcaatcatgaaggacaatgaaaggcttcataaatctataaaaaaagccttggattcaggtattattattattgcatcagggagtaacacatctggtggaccagttggttatcctgcttcctatgatggtgtgttttcagtaacttcaattaacaaaagtaatattattggagatacttcgcctaaagggaaaattgatttttcagcccctggtgttgacattttaactacttcattaaatggtaattataaggttacaagtggtacttcgttctcagctccacatataacgggattaatagcattaatattgcaacagcatccaaagttcaatcaaaaagatatttatgagagacttaggtcattctctaaagatttgggggaaagcgggaaggattcaaccttcggtgaaggaatagttattttaaaataaaatacttgtggggagttaatagtatatgaagaaaattcttaaatttaagagtggaattgctttagtcattgctttttgtttgttgtttagtgtctcagctagcgtgtacgcaaatgatagtgtctctgtctcagatgacgtgtacggaaaagatgttactttaacaccagatggagatattaaagttatcgaagaaaatgatactcaagtgacagttatgggtgaggataaaggagttgagttgtatgccacatatgataaaataactcgtgctgttactatgcgaacggtagaaaagcaaaagaatgtcttaggattttcattggctcagtcaagagaaaacacatactccgttgatgttaaaaatgcagtcgatggaaaaattgaagcgatagcaacaaatgatgaaacaaatgatcagtttaagattgaatcatcaagttttaaagaagaaagagtacaagctcaagcaccacttgtactcataccagttgctgagtggctggggtctgcagtattagccgcgttacttgcagcggctgcggtagttgtaatcgatggttatgattatgttgcagttagcaaagtagaaaccaatatccaaaaagagaaaaatgcttattatcgtgcttttgtacaatatgaatcaaataatgtttttgttggtccaaagatttcatacaatgaggctttaaattggctgagaaagagtcaaagtaacaatattttcacaagagatagacttaatgctcaaactatagcctataacctctacagaatatccccatatcaccatgataacgagttttatgtaaagggagaaggatattatagacactatcatcctagagatccagagggcgaaaaattgtctaaccatgtttggtatcttaactaatgagattaaatccccccattccttggggggatattaatattaagagagaaggaggagatctaatggaagttattaacctaaagggatactcaggatacaatacatattggacagatctttcttttgatgatagtcgtgtgttgtttactcagaaaaaagaaaatgagatacgaggtttccctattgaaagtgtaatatgccatcatcttcacaacaacgttactgaaaactttgaacttccgcaaacaaatgtttttaccttaagttccacgagtagtagtgctacactatattacgcagattatagtaatactacagatgatattttgttttataaactggattgcagaagattggaaagccaatatatatttaaactaaatataaacgaaatattcggtaatacactccaagttcgagacttagaaggaattatatccttcctatgttcacatataaatataataggtatcgatgataggtacatgattttaaactatgaggtagaacagggaaattataaagttcagaagcattggaatattattgactccatatatggagcaatgactacattcccgccagaggcattgatggatcatatacaaacgataaacctttggtgcaacaatgatgtaacttatcttatttttaaaactggacaatatagtgctaaagagaaagagtataagtggaaaaataaatatagtgaagttagtagtgagaaggggcttattgaagaagaactcattataattgattctgaaaagtttattgatcatatacgcaaaggagaactccctttaaataaatatagtattgcctcttgtactgaaaaaagtgcactgatgagttacagttattcgcagaacaagattgtgtattttaaacagttatttgaaattcaatctacaagtattaccagttatgacccgtcagattcatccgaggaaaaactcattattaaagggctgcatagtcgtattttcacatgtggtaataaatattattcatttagagattgttattttaatgagcatgaggaacttactattatagaccttttatccaataaaatagtttttcaagaggaatctagagaaagatttttatgtggaacaaatcaagctatattcacctatatatatttggataatgggaatttaagagtaagttcaagagattataataaaaggggcgaaaaagtggttggagaaggaagagttgtcttcgttgatcaacaaagacattgtattctcattatcgagtaaagagagtggcgaatagtgatattaaatgattaaagttattgcaattatatcaatggtaatggcacacgttggatatttatactttcctcagtcagatctcctaagggcaattgggcgcctcgcatttccattgtttgcatggggaattacttttggatttaaaaatactaaaaatgttaaaaaatatatgatacgggtgctcttactagcaattgtgtcccaatacccatactatctattatttaatatgggctatttaaatgtgtgttttactctttttgctggacttgttatattaaaaatatatgaaggaacctttcataatatcatcaaaattttgttaattataatggtttttgtgattgcagatattttttcctttgagtatggaatgtatggactggcaactattctaattttttatatatttggtttaaaaccatactccattttttttcacctaattatcactatattaggaatccacttttatggatattctatgatacagattctatctctattttccttttctttaattttcttattttataaatatgattttaaaattaatcgatacattagctatgggttctatcctgtgcatctaatggtgtttcttattataaatacctttttgtacgatatataactaggcttttttgaatggataactttttaggctgagatatattcttggtctttttttttgttgatgaagcaaccaataaagtgaagtgaaccgtatcataagtgatcgtagagcggagaattgcagtttcgtataattttaatttactaattggagcatatttttagatgttattgataacttatatagatttaatcgcgactgataactgaagtataataactctcaattcctgataagtaagcagtctctttcttaaagagattaaagataaaattgtatttattatgcgataatataaataatgcgcatatatcttcgtaatttctcatcgtttatgtcttttttataggagaaatgggattttgatgagtcgttgtattctattatgcttgatttagaagtaaaaaagcgagcacggccaagatgagaggagaagctgatatgttatcgtggatgaggttctaaaccagtataatgacgttataaagagagtgaccgaaaaatatttacgatatttccaattccatgaattagattttaaaggagtacaagccgacattcttataatacttcgggtatccaaagagataataaaggcaattgatttcccgttttctccactggcaagagtaagtttgtacgcttagcattccaaattgatatgcatcctctatttcctgtttaaagaatgacaccttcgagtttttgtaatatcatacgtaagattgatcagttgaagaagcttgggctaagtttggaggaaattcgggacgtaatcgagctttactttacggatacgagcggggtgctgccgaagcggaaagtcctcggcatactgcgccaacatctggacgacacggatcaaaggcttgaagcgctcgggcagttccgcagcgatttgcagtcacatatagaacgtttcgagcgatggctcgaggccaatgatagcgattaattttttttgctctaaacatgacgttaacgtcatgtttagcatcctaaggaggttaaattcatgagagaaaacattggatttatcggactcggactgctcggtgttccagtcgcttccaatctgctccaagcaggatatgcattgaccgtatacaaccgcaccccagaaaaagcggagccgctcgtggcccaaggtgcgctgcaggcggtccgtccagctgacaccgtgacaaccggtggcatcgtcgtcaccttggtttgggacgatgaggcattggaagacgtcgtcaaaagcgaagatttcctagaacgcctgggcataggcggtattcatgtatcaatgagtacggtgtcgccggatacgggcaggaagctggcggatctgcacgcgcggcatggctccgtctatgttgaggcacctatctttggacggccggaggcagccgctgccaggcaattgtggattccaatagcgggtcccaaggaagcaaaggagcgggtccggccgatgctggatgcgatgggagctaaggggatctttgactttggcgaggaagccggttcggctgtaatcatcaaactgatcggtaacttccttattgtctccgccgcacgctcactggaagaagcactaggaatagctgagcgcagcggtgttgatcccactgcggcggttaatatgcttacgagcacactgtttaccgccccaatctatcaaagctacggcaaaatgattgccgaaaagtcagcatccgtatccgaaagcaaaattccgcagaaggatgtcggtctctttctgtcggcggcgcaaagcgcacaattcccggctccgcttgccagcctgctgcttgatatgctagagaacggagatcggagcagaccctaaggctgcggtcgatgttattcgtactcttgtataaccggcctgctctcaatccatgacgctgaaagtagtattcaaaaagcaaatgaaaaaggttcactaagcgggctccaattactgagggggcccgctttaagttttggacgattttagtcataggcttgggctacgttcatagggaggataaggtacaggtggccttgatgcgccgttgtttatttgcattgatttaagtcaagagtcgagatatacaaaaaaagtatcctctctggtcatacccctgtcaagt

SEQ ID NO: 2637 - DNA, 91736 bp, Unknown
  Kingdom: Bacteria, Phylum: Firmicutes, Class: Bacilli, Order: Bacillales, Family: Paenibacillaceae, Genus: Paenibacillus
ttgacaggggtatgaccataacgggtgtcttttttctacattcgatcacataatgtctggaatgctaatgacaaggggaataaacagtttttgaccgattgtaaatccgactattccgatttataataaatttattacatactaagaggacacgggggctagagcgatgcgtcgtaatttgactggtgtattggtatttattgtattgatgttggttgtaagtgcatgctccggcgggaattctggatctacgtctgagacgaatgggaatacacccggtaaagctaccacaacagctgataacggacagcctaaagatggcggcagcctgatcattggcgtacaagctgatccggtggtgctgaacccgaactatgcgggtgatcgggtaagtctgacgatagatcaggcgatattcgcaccattgtttcaagtgaacaatggcaaaaagacattttatttggcagacagtctgactccttcagcagacaagctgacttatacactaaaactgaaaaaaaatctgacttggcatgatggcgagaaactgacggctgacgatgttgttttcaccattagcaaaattttggacgagaagcagcacagctttttgagaagtaattttatggttaatggcaaaccggttcaggcgagcaaggttgatgatacaacggtggatttcaagcttcctcagccagctcctgcttttgaggcagcactggtacaggtatccccgattccgaagcacattttcgagaatgaagcggatattgagaagagcacaaaaaacaactctccgattggatctggtcctttcaaatttaaagagtacaaaaccggtgagtacgttacactcgaacggttcgataactatgttggcggaaagccgcatctggattcagtaacataccggattgttaaagattcaaatgctgcgaatttggcccttcaaaatggtgagatcaatgtaaactatctcgatccgcaaaatgtggagaccattaaagcaacagataagtttgacattttcccttacagcgaaggtcgcttggcttatctgatgtttaatgaaaatagtgatacgaagcagttgaacaaaaaagaagtacggcaggcgctttcttatgcattgaatcaggatgaattgattcaggtatcctatggctccaaggaatatgcagatactgcgaaatctgctctgacacaggatgtactgtatcacacgaacgacgttgcatttttcaataatgatgtgaacaaagcaaaagaactgctgaaatcggctggagctgaaggactgaagctgcgcattatcattccgggcggcaacaagatacaagaagcacaagcgctctatatccagcagaagttaaaggacataggcgttcaactggacgtgaacagcatggattcctcggcatggtcgcaaaaattcgtcgatacgaatgccaaggacttcgatctggcgatcagcggctatatcatgggatatgaccctgacgcatatcgtattttgtatagcaccggatcatcctccaactattcgcattattcaaataaagaagtggataagctgctggaagagggcgcgggtgagtcggatacgacgaaacgtggagcaatttataaaaaggtacaagagctgctggctgaggatgctgtcatctacccgattgcttacaccaagactattgtagccttcgacaagcagtatggcgggattgatcaggctgtgttaaagccggtcgtgattttcgaggatttgtccaaaatttatcacaaataagacagggttttcaaaaataagctgggctaaccagcttatttttttcgaaaacagcaaggggaagggaaacgtatgagacaactcatcgccagaaggttgctgcaagttataccgatgctattttttgtgtccattgtctgcttcggcttgatcaagctggctccaggtgatccggttctctcttttgttacaccgaatatgcatctggaagacattgaacgaatgaggcatagcttggggctggaccagcctgcttatgtgcagtacatattatggcttaaaaaaagcctaacgggtgatctcggctactcgctaattaatcaccagcccgtgctggatcagattctcgatcgtctcccggcaacagccgggttgatgggcgcctccatcatactggctgtactgattgcgattccactcggtttgacggctgcggctaatcggaatcgctggatcgacaagctcattaatctgatgtcgtacatcggaatttctgttccgctattttggcttggtattttacttatttatttgtttgcgatttatctgcattggcttccgagtacaggaatgcgtaccatcggtacggactcggtgctagatgtaatcaagcatgggattttaccatgttttgtactggccttcggctttctgtctgtgtatgtgaggtacatccgttccagcacgattacgcagctcaaggaagagtatgtgcagattcaatacgcgttcggatctggaaaaagactggttttgtttcgacatgtgctcaagcatgtgctgttgcccatcattacgctgcttggaatgtcggttgcggacctggtggccggagccattgtgacggagacggtattttcctggccgggcattggctcgctgggcatgacggcggtaaaagggatggattatcccgtcatcatggggattactttattttccgctctgctgctgatcctgggtaatctgcttgcagatatcttgtatagcatcgcggacccgagaattaaatcaacgaggtgaattcatgaatcagagcaaatggcgcaacatcgggatcgagctgatgacgagcaaaatgggcgccgtcgctctcatactattgatcgtattctcgctgggggcgattttcgcatttttatcgccgcaggacccgaataagttgaacgtgctggagcgtctccaaccaccgggagcggcacactggtttgggacggatgattatgggcgggactattttacaagagcactgtacggcggacgtgtatcattgctggtaggcttcgcgtccatgattattgcgaccagtattggtgcagtggtagggattatgagcgggtattttggaggatggatcgacaatctgcttatgcgggttttggagctgatcatgtcaattccgtctttcttggttattttgctgctgagtgtgtttttgaagccgggcgtcggcaatatcattgtcattatcgcactgctcatgtggatgaacattgcccgtgtggttcgtgcagagacaatgacgttgcgcgaacgggagtatgtactatacgccaaagcttcgggacaaagcacgttgggtattattatgaagcatatcgtaccgaatctgattccggtaattatcgtaggggcgacgaacaatatcgcttcagcgattatgatggaatcgtcactgagcttcctcggctttggtgttcagctgccgaacgctacgtggggcagtatgctgaataatgcccaaggatatattgcacaggccccatacatggcattattcccgggtctacttattttactgactgtattgagctttaatgttttgggagatgtgctgcgtgtaggctttgaacccaaattagtaaaacgatgattcatagcacagatccattacaaatggctccaggagcgacaggaaggagcgaaaagacaatgacagaacatctactgtccgtcgaacagctggaggtctcctttttcactcgtgaaggggaaaatcaggcagttcgaggggttagttttcatattgatgctggagaaacggtaggaatcgtaggagaatccgggagcggcaaaagtgttacagcgaaagcgatcatgtcgatgattgccccgccgggcaagcggctgaacggcgatattcgttaccggggacaaagcctgaccgctctgacggaaaagcaatggcgcaaaatacgcggaaaccagattgcaatggtttttcaggacccgatgacctcgctgaatccggtcaaaaaggttggctatcacctggtcgaggtgattcgcagacatcgaggactgagcaaggaagcggctacgcaagcagctgtagaactgctgcgacaagtaggcattaccgagccggagcgccgaatgaaccaatacccgcatcaattcagcggcgggatgcgccagcgggtgatgattgccatggcgctctcgtgcagcccggagctgctgattgcagatgagccgactacagcgctggacgtaacgattcaggcgcaaatcttggagttgctcaagacgctaaagcagcaatccgacatgtcgattgctctgatcacccatgatctgggcgtcgtcgcccaggtgtgtagccgtgtcatcgtcatgtacggcggcatggtgatggaggaggggcgcgtggacgatatcttttatcgtccgggccatccgtatacacagggcctgctgcgttctgtgccccagcgcacgaacggcttccgcgagcggctggtgccgattgagggcacgccgccggacctgctgaacccgccatcaggctgtccgttcatggaacggtgcccacacgcgtttgcccgctgtgtggagcggccgccgatggtggagctgcgcccggatcagcgagcagcctgctggttgaacgagccggacgcagtgcctgccggagtctgcgagacgccgaaagcgggccacgcggaaggagggaatgacggtgagtgaaacaaacgatgtattgggtgagcaacagcccttggtggaggtacaccagcttaagaagcattttgtgaccgcaaaggatttgttagggcgtagctctgaggtgctcaaggcggtggatggcgtgagctttcaaatcaagcgtggcgagacgttcggactggtcggtgagtcaggtagtgggaaatcaacggttggacgctgtctgacgcgattatacgattatacagaaggtacggtacgctttgacggtcaggatatttccaagctgaacgataaacagctcaaaccgctgcgtcggcgtattcagagcatttttcaggacccatattcctctcttaatccgggtatgaacgtgcttgacctgatcggtgagccgatggatattcacagattgcatcagggtagtgagcgtaaagatgctgtagtagctttgcttgaaaaggtagggctgaagcgggagcatctgtatcgctactcacacgagttcagtggtgggcagcgccagcggatttccatcgctcgtgctctctccgtgaaccccgagttcatcgtctgtgacgagccgatttcggcactggatgtgtccattcaggcgcaggtcattaacacgctggaggatctccagcaggagttcgggctgacgtacctgttcatcgcccatgacttgtcgatggtgcggcatatttcagaccgaatcggtgtgatgtaccatgggcgactggtagaagtagccgatgcagatgaactgtatgagcagcccgctcacccttatacgcaggcactgctatcctccatccctgtgcctgatccgagagcggtcggagagcaagggggactgggaggaggcttggcccaaccagacggttcattagtatgggacaaggataacaacagtacaaccgagctgagagaaatcagtcccggccattatgtagcatacccggttaacctttagggttaagagcggttgtacgatgtgcatgacccaaaggaggcaaaaaacgatgactgaatcgacgaaaagagtacgtatttcccaatgggacgcgctcttgctggaatcattacgctctttaggctggtcccaagaggaattaatccgtcgcgtgcagcaaaatgagctgccaacggacggaccatccgattttgattatacagagcttgtcaccgggctggcgtcccaagagccggaggtgtttgtcagcgcagtaacggatggatatcagatcaagtacaatacgatccggggcattcgttcgtggattgccgttgcgttcgggcgggagcctgagctgtcactggaggaaggaagcgaagccgttacatctgaactgacgaaggctgagtatgatcggcttgggcgggtactgtcattaggctgggtcatccaggaagtacgtcgcgcggcgggcgagacttcaggattataccgaattgtacctgcttcacagacgaattaaatcatggggatggagtaacaccattcaccagaaatgaaaacgagctgaccgtgaaggccagctcgtttttttaatgcaatccttcttcatcttttttattcagcataaccagactattgtgaatgatccgtgtcatgcagtaaaagaaggccattctggtggtttgcacaatggctcccaataacatggacatcgattccatatcgggagagtgttggataacaatccgattaataattccttcaccaaaccagacaaaatatagcggaacaatcatcttttgaatataacgggctttgccctccaattcggggtggagcacaaagtacctataaatatgggtgaatgtattagagaatccccacaagttaataaaaggaatcatgcgagcaatggctcccacggtacgaatcggataatcggaatgcttttgccggatggctttatgtacttgaactagccagatcagataggttacaaaacacaagtagtacagcacaaagctaaaaactgtaaatttttgctccagctcgtatagatgatcataataaaaatcatttgcgtagatatacactaatgtaaaaataaggatgataaattcgcctatagtgcccactgctagtaaggcttgatgtacgctgccagctgtcttggatgggaatgctttggaatctggatcattcaagatgtacttcctcccaatctagttgcttcaaatacacgatagcatcctccagtgtttctacggggataatgcgtaacttgagttcatgctccttttgaactcgggcagcctctgcttcgttgccttcctcaccgtaccattcataatctgccggtacgaaaaatagatcaacctttgccgcctcggctcccagcagcttttgctccagtccaccgactgatccgacatctccgtattcttccattgtgccagagcctgcgattttgtgacgtccgccatctgaaaagtcgatattattggcttcctcatacagtccgatacctgtcatcagacccaaggaatttcccgaaagatcctgcaaatgagtcaatagctccgcatagcgagcatcctccaatttgttaagattcgagaaagtcgccgtagccccagctgtgtcgctgtctacgcttaattccgtcgctgcatgtacggcttgcatggcagaatattttagcgtgtccgtctctgtaaggtccttcaaataagagtccacttcatcaggggcaagaggttcaaatttaatcgctcccccagatacattttcactggaatatacattccaacgctccaggagattgttagcaatacccgtttgcacagacgcaaaaaacacgcttccctgaacgccaagatctttgaccggatgcatttctccctgcaaaatatactgcgcaggcataggccttgttccaataaaggcagcgatagcggggatcagcagcagcgcgaagatgagtatacgttctttgtttatgccaaatatctttttgaggagatatggattacggcttggcacctcattcacaacctttccaactgttctcatacggatatcatcggttgaaatgattagaaaggttacatttttcaccataaatgaccgataagagtatagtagtattcatattttttacgctctgccagatcatcagacgctcattttttatgctatattttatacataaggaaaatttgagagttgaggtgcagcatgacatcaatgaatattttcgaatcatccgtcaaaccaggattaatggcttttcaggcaagcactgaagatcaggagcaggttcaggagttaattttaaagacggccagatggctgcacagcaaaggctctacgcaatggggacgcttactaaaaggaaaagatgatcataacctaggcggcgctattgcacgcggagaagtggttattttccgagcatcagaggatcatagcctggcaggcgcagtgatcttgcagcagcaacccagtgcatgggaccgtaagttgtggaaactagacgaaacggattctgaaggaggaacctcagtatatctgcatcgtttggttgtggatcgcgatagcaccgggaaggggctaggccgtgaactgatgcaatggattgaacgaggcatccacttcacaggcaaggatcgaatccgtttagactgtattgcgggcaatgacaagcttagtgagttttacagacaatgcggttatacgtatataggcgaaacgaacggctataatatttttgaaaagatgctaataaattcatagaaaacggaatcatactgaaggaatacgaaagaaggaagcaggtgatctgcattcttctttttttgttgtgcagccctttactttcccttggtcgctgtcatatcagagcccccaaaagaaaaaaatttatataaaaatgaaaatggggatatcgcgcctccccctcctacatatgatgatagggaaagttttgtaagcgcttcaaaagaaggatgacatacaaccatgcgaagctacaggaggcggttaaggtggacaattacatgagctggataaagattggatttttcctcagcgttctgtttttacttgcagcggcatgcagtacctctcccaaaatagaggagacagaagggcaaaaagtgcgacttacaatgcaggcttggggtaatcctgcggaggtgaaggtgtatcagcgggcgctggatgcatttgaaaaggaaaacccaaatatcgaggttaagctggtgcctgtaccgggagaccaatatgagcaaaagctgttgacacagcttcagggaagtcgcggaccggatgtgttttattcgtatgaatcgacgattgcgcgtttgatcggggcgaagcaggtacagcctttgggtgagtttttaaaaagtgatgcgagtgatgtgaaggctgaggattttccggaaggattgtggggaccggcaaagcgtgatggggaaatttatggggtcactcccgactcaaacccgatggtcatgtattacaacaaaaaggtatttaaggaagcaggcgtgaagacgccgcaagaatactatgacgaaggcaagtggaattgggacgcctttgaagaggttacatccaagctgaaggcagccggaaagcagggttatattgcggaaaactggtgggctcactggtattcatgggtgtggtcgaatggcggtcagatctttgatgaacaaggcaaatatgtgctggaccacaatgaaaagggcaaggaagccttcggttttatgtacgatatggtgaaaaagggaaatgcggtatatctcggctcgcttcccaaagggcaaggggctgacgcgatgttcatgtccaatcaagtcggtatgctggcggcgggaagatggctggaacccttgtttagccaaaataaaagcctcgacttcgattatatttactggccttccaacacaggcaaaaatgaacctgtcgctattccggttgcctatgtagctgtgaacaaaaatagtccgcatgtgcaagaggccatgaagttagcagcattctacgtctctgtgaaggggcaggaggcccggctggttgaaggtgggaatgccatgggtacgcttgctgccgcagatgagagcattatgaaaaaggcgacaattgagcattcaagctatttgaccgaaggacgtaacatagggcatgctcatggatctgcactggcctatgatgctcaggtgccagggctgaactcggatatcacggaaaccatcgacctgatgttcctgggcaagcaggatgctgcggcaaccattgaaaagttgaatcagatcatatccaaggcggtcaagtaggcacgggatgggccgtgaccggggaggaaggtgacaagatgcagaaaaagcatcaagcgctgtggggctatctattcattggcccccagtttttgggtctgttatgtttttcgctgttgccgttgctatatgcgctttacttaagctttgtaaactgggatggatttggcgtacccttgtttgtcggcttggacaatttcaagggccaattatctgatcctgatttttggaaggcactcatcaatacgatgtactatatggtgttggtcatcccggcggggattatattggctctgctcgtagccatcatgctcaacaaagtgaagggcaaggaaatttatcgcttgttctttttcatgcctgtcgtaaccagttcggtatccgttggtgtcatctggatgtggatactgaacggcgaatttggcattttaaatcatctgctgcgagcgattgggattacaggcccgatgtggcttaccgatacgcagtgggtgattccgtcgattgcgcttttgagcatatggctgggactgggatataatatggtcatttttctggcaggactccagggtatctccaaaagctattacgaggcagccgaaattgacggggccagcaagttccagcagctaaggtatattacattgccgctgttgtcaccgacgaccttttttgtgaccatcatgatggtcatcagttcttttcaggtgttcgatcaggcgtttgtcatgacgaatggagggccagctaaagcaagttatacactggtgtaccacatttatgatcaggcgttcattgacttcacgatgggagaaagtgccgcggcagcaatgattttgttcgtgatcattctcgtatttacactgttgcaatttaaaatgcaaaagaggtgggtgcactatggagattagttccagaggtagggtattcctgcgccatgtgctgctcgctgtcggctctttagtcatgttttttccattcctgtggactgttctaagttccctgaaggatatttctcaaattttcgtcgtcccacctcaatggattcctgatccgttcgtatggagcaactatccggcatcgctggaggcgatgcccttcgtgcaggcgtatatgaacagcttttacattacggtgatcatcgtgacagcgacactgattagcgcgtctatggcggcgtatgcttttgctaaaatccgatttccgggctcgaatatactgtttatcttgttcctcgctacgatgatggtgcccaagcaggtgacgatgattccgttatatttggtgatggatcgcatcggttggctggatacgcattggtcgctgatcgtacctggagccttgtttaatgcattcgcagtgtttctgctccgccagttcgtcatgggcatcccacgcgatctagaggaagcggcggtaatggatggggcgggctacattcgtatttactggagcgtcatcctgccactcattcgtccggcattggcggcaatagggattttcacctttttgggtgcctggaacagctttcttgatccgcttatctatctcaatacaccggagaaattcacggttccgcttttacttaacaatttcaaagggttatataccgccgattggtcactgatgatggcgggtaccaccatttctgtcgtcccggtgctaatcgtctacatcattgcccaaaagcaaattattgaaggcatcaccttgacgggaattaaggggtaggggcatctctctactcctttttgtatttttttcggtactgtagtggggtgtgcccggtaaggtgcttgaatacacgaccaaagtgagcgatgctgtcaaaacccgttttttcagcaatggaagtcactttccagcttgtttctcttaaatacgcccgagcctgctggacccgcacatcctgaagatattctactaaggtaaaacctgttgtctgcttgaaaatacggcataaatacgtgctgctaatataaaaatgctcagccagccgatctagcgacaggctctcgtcataatgagcatgcaggtatgcgatgaccgagtacacgcgctgctgcttttcgctacgttccggtgcaatggtatcggcagtggccgattgtatgcgccggatacggataaggagctggagtagcaagctctggagatatagctggctgtaggcatgttcttggtggtattcatctagcatttgccggaataggtgttccagctcgcattgttcttccgcggaggggcgaagcagaaagcttttctctggcagaagaagctggttctgatcgctggagggagagacggtcattgacgaggctgcaaattcttcatcaaagttaatcaaaatccgttcatggctaccgctacccttgttactcgtacgatgaaaatcatgtttgctgatccaaatcagatcgcccttctggagggcgtatacccgttgattaatgtagtagtagcgctctcctgccagcaaataatagatttcgtgcgcttggtggacatggtcggcggacatgctgaatggcaccttccgcaacgcttgctcgatggcaaaacggggtgtagcgatcatatcgatagtctcctttagtgaaagaatacataaggataatatatgtatattttacggataaaatcataataaaagcgaagattttgctctttcttatactataaaataaaagcaattcatgtaaagggtgtgaaccaattggctaaaatcaaatatgcacttgtgggtaccggaggaagagccgaatttttttacggtgaagttgttaccgttttcaaagatacctcggagctgatcgcgttctgtgacgtcaatcagacgagaatggattatgccaatcggctgctgcaggagaaatacgagcatgagccgattcctacctataaagctcacgagtttgatcggatgatcgcggagacgcagccggatatcgtcattgtcacgaccattgaccgggtacatcatcggtatattatccgggcgatggagctgggctgtgatgtcatttctgagaagccgatgacggtggatgaagataaatgccaagacattttggatgccatagaccgcacgggacggaagctacgcgtcacctttaactaccgctatgcgccgcataatacgaaaatccgtgagctgatcatggacggaacgctcggagaggtgctgtcagtcaatttcgaatggctgctgaatacacagcatggcgcggattatttccgtcggtggcaccgggacaagcgcaatagcggcggtctgctggtgcataaatcgacgcatcattttgatctgatgaacttctggcttggctcgaaaccggagacggtgtatgcgatgggagatctgaaattttacggccgggaaaatgcggagcagcgtggcgtgacggagttttatcaacgggcttacggcagcaaggcagcggaaaatgacccctttgcgctacatctggaccgtaacgagcatctaaaaagcatgtatctggacgctgagcatgaggatggatatgtgcgggatcaaagcgtatttggcgacaatatcagcattgaagatacgctgagtgtcatggtgaagtatcagaacaagacggtaatgaactattcgctgaatgcttacatgccttgggagggctttatcatcgtatttaacggcacgaagggacggatggaggttcgggtatccgagcaatcctatgttaattccggtggcagcaaggcagatgagggtgcgctaaaagagaagaccatcaccatctatccccactttgcagcaccttatgaggtcgaagtggaggaaggccagggtggtcatggcggaggagatccagttatgctgcgtgatattttcgataagccggcagaggatcggttccatcgtgcggcctcacatattgacggtgcatggtccattttaacaggcattgccgccaaccgttctatgcgtacaggtcaaccggtgaaggtggaggaactggtgcgcttgtaatgagcagtaaatttaataccgaaaagccccctctaactagatgaatagagggggcttttggggtgtatttatatatagaatgcaccttacatcttacggcactttattttattatttatcggcagtcagttcccgggttcccagttgttgtacaggacgatggttatcgggaaaaatggcagcaaactggttgatttggtctgcggacatttcaataggctgctccagcactgtccaatttacatgttctgtgcatggcggggtagtcagcgatccattgtagcgaacggagtgcaggtcttttggcagcaacgcagcgagatctatttcttcatctagagccgccgcttcttgggaattatccttcggtagtttggaccaaatgcggttgaaagccttgttttctttgccactttggataaggactcctaagacagctgtacttccgttgtcgctttgatggacaaaatgaagctccatttcagcatttttaccatctatttggtgttcgctcgggtgatgaaaatgaaactgctttaaagtgaatttagtaccgtccagcatgatgctattgctggcatcggcaacattgatttgcacagtgtgcccattattcaaaatggatgctttcgtattagtgtaatgaacttgcagcggttgctgcgtttgcgatgcttccaaatgggtatgctctatattgacaggagattgttcgtggccgttaccacaagcaacaaaatctttttccagctctccccaatgctccggtccctgatctccttcataggaccagtgtgggcctttctgaacgactgcatgagcgttggtagctgatgaggatgaagtgctggtggtactagaaatggcgggctgtgaattgcatcctgttaccgacacaaccaagataatggcaaatatgctgaacaggcaacctttccagttttttttcatgtttctttatccttcttccaaatagagtatgtgaaactttttacattgtaaattattgtacaaagttcctacaagggtccaaggacttagaaagaagcatttttcgattaaatagttttaagttagtaagttagatttatatttgtccttttcgggcaaaaattactataataatggagtgtgcattacaaaataattccatattatttaaaggagagatctacatgaaagcagcaattgttacaaaagacaagaaagtcagtgtagaagagaaacctttacgctccctgaagcatggggaagcgttagtccaagtcgagtattgcggagtttgccacacagatttacatgtaaaaaatgcagatttcggtgatgtcacaggcagagttctggggcatgaaggtattgggaaagtcattgaattaggtgaaggagtaaccagtcttaagattggtgatcgcgtaagtattgcctggatgttccaaagctgcggtcactgcgaatattgcctaaccgggcgggaaacgctgtgtcgtgaagttaaaaatgccggatatacggtagacggtgcaatggcagagcaatgtattgtcacagctgactacgcggtcaaagtaccagatagtcttgatcctgccgctgcaagtagtgtaacttgcgcaggggttaccacatataaagcagttaaagtaagtgaagtcaaaccaggacaatggatcggtatcttcggcattggcggcttgggtaacctggctgtgcaatacgccaaaaatgtattcaatgctaaagttgtagcctttgacatcagtgatgaaaaactagaactggccaaacaaattggtgctgactatatcgttaacagcatgaaagaagatccggtcgctcgagctaaggagttaacaaacggtgctggtctggatgcaaccgtggttactgctgttgccaaaacacctttcaaccaggccatcgacgttgtgaaggctggcgcgcgtgtcgtagctgtaggtctcccaaccgataagatggatctggacattccacgtctggttctggacggcattcaagttattggctccttggtcggcactcgtgaagaccttaaagaagcgttccagttcgctgcagaaggtaaagttgtccctcttgtacaaaaacgtccgctcgaagacattaatgagatcttcgaggagatggagcagggcaaaatccaaggacgcatggtcattgatttcacaaattaaaatgatgtccaattcgtaacccttggaattcggagagagaaagcgcctgctgatgtattgtaggcgctctttttggctttacaacttattcagaatgttatcttccaaaaccgcagatttatccccgtattctttaataatatgtctttctccccaagcacaaagagaatctaaaatgcctttcagactacatccatattcactaagctcgtactccaccttgggtggaacctgattatagctaatccgattgacaatgccgtcttcctctaattcacgaagctgctgagtcagcattttttgggttatggaaggcatcatccgttttaattcgcttgtccgcatctttccatgtgtcaaatgacacagaatgacgcatttccatttccccccgatcacctctaacgtcgcctcaacagagatattgtattttttcttccccaatgccgatccccccatgtgtatcgcttctgttatacataccttaacagcctgttttaattaaaaagaactttatttagggtactttttagtacctatatcactaaaaagtacgtactgttcatatttgcttgaataactcataataacatctgctggtcgaagatttctatagataggagtgaaaaacatgtcgccagaatcaaaacgaagtatctggccattactggctctagccgtaagcgcctttgcgattgggacaactgagttcatcagcgtgggactgcttcccctgattgctgaagacttgcacatatctgtaacgatgtctgcactaactgtaacgctgtatgcattaggggtcaccatcggggcacctgtcttgacctcattaacatcaagtgttccccgtaaaacgttgctgctgtggatcatgattatatttattgcaggcaacagcctcgctgcggtctctagcggaattgccttgctactgattgcacgtgtgatctcggcgttcgctcatggggtgttcatgtctatcggttccaccatcgcggccgatcttgtgccggatgatcggcgagcgagtgcgatttccattatgttctccgggttgaccgtagccacggttacaggcgtacctttgggtacctacattgggcagcaatggggttggtgggcagcgtttatggcgattgtggtcgtcggtgtagtggcactcatcgccaatctgattctgctgccatctacgctgcgcaaagggaacaagactcctttccgcgagcaggtcaaactggtcaccaatggtcgcttgctactcgcatttatcattacagctttggggtatggaggcacatttgtggtatttacttatttatctccattacttcacgacataaccggatttcagcaaagtacggtaacgtttatacttttgctgtatggaattgcgattgccatcgggaatgttattggcggaaaagcagcaaaccgcaagccgctttcagctttgttttacatgtttctgattcaagcagtgatcctgtttctcctgttgttcacggcaccttttaaaacggcaggactgattacgatcttctttatgggattgcttgcgtttatgaacgtgcccgggctacaggtatatgtcgtcatgttagccgaacggtttgcacccaaagctgtcgatgttgcctctgctgttaatattgcagctttcaacgcagggatagccatcggagcttatgtaggcgggattgtaacggattcactcggtctcattcatacggcctggctcgggagcattatggttttcgttgcggttttgctcacaggctggagtcgtatgctcgaaaaaagggatacaacccccattacaggttaaagcttttaaaaaatagagaggaagattcaaaatgacacaaaacttacaaagcacaacattgttaaacaacggagttcgcatgccttggtttggcatcggggtatttaaagtggaagaaggttcggagctggtcgatgctataaaggttgctgtaaagcatggctaccgcagtatagatacagctgcaatctatgcgaacgaaagcagtgtagggcaggctattcaggaagcccttcaggaaaataatctgtccagagaagaactgttcgtcacgtccaaagtgtggaatgcagatttaggctatgaagagacacgagcagcttatgaagccagtctggacaagctgggtctggactatctggatctatatctgattcattggccagttcaaggaaagtataaagaagcttggagagcgttggaatccttgtataaagaaggacggattaaggcaattggagtcagcaacttccagattcatcatttggaagatctcatgaaggatgctgaaatcaagcccatgatcaatcaggtggaattccatccacaattaacccaagccgagctgttgcaattctgtcaaaagaacgacattcaaatggaagcctggtctccgttaatgcaaggccaattgctcgatcatccggtactgcaagacatagcgaccaagtatggcaaatcggtggcgcaagtgattttacgctgggatgtgcagcagggagttgtcactattcccaagtctaccaagccgcatcgtatcgtgggaaatgctgacatttttgacttcgaactgacgcgcgaggatatggatcgaatccaggcgttaaatgccgatcttcgggtaggtccagatccggataactttgatttttaaaattacgttcatcatgagacgccgtttccttcttcactgaagggacggcgttttgtttgtgcatgatgggtctggggctacagcaatccaatcccgccatatggtattatagggttatgaaaagagacgttttggaagcttgtgaatacgaaaaatcaccgggggacttcatgaataagacgattgcagatatagcccaaatggctggcgtatccaagagcacggtatcccgttttttgaacggcgggtctgtcagcgtggatacgaaacgaaaaattgaaaaagtggttaaagccacgggctatgtgcccaatgcctttgcccagagtcttaaggcgaagcggaccaacatcatcggcaccgttgtgccgcgtctagattcttttgcgacatctcatacgctgatggggattgatgaggaactgcgttctcagcattatcagatgctgatctctaatacgagccaggatgtacagcgtgaaatcgaagccatttatgagctgggaagacaaaagatttcgggtatcattttgctggctgctcaaattacagacgaccatctgaccgcgattcgtgacattggtattccggtgttgctggtgggccagcagcacgagcagcttcatagcctgatccatgatgactatcgtgcaggatatgatatcggcacgtacgttttgtcacagggacatcacgaaattgcctacgttggtgttactgaaaaggatgttgccgtcggtgtgcagcgcaaggagggttttaggcaggcggttcgcgatgcattgcctgcggagtctcatacggacgatgcgatgcgagcagcagggtatgatatcagatactatgagaccggatttaaaatgtccgatgcacggattgctgcatccgccattttggaccatttcaagccaacgttaatggtgtgtgctacggataatatcgcgctgggcgtaatcaatgcggcttattccagagggattgtcatcccgtcggatttgtcggtaactggctttgggggatacgatattacggaggtcattcaccctgccctgacaaccgttcaatatccgtatatggaggctggacgtgtagcagcgcaaaatattatgcggctggtagaacataaatcggtagaaaaagtgacggtcatgaattattctcttatcgaaagagaaagcgttgacaaacgctgaacaagtggattataatttctacgaaaccggttccatagcattcgggcacaaatggaatcggttgcaaatccatggatgagcatttttttaatcgtatgggaaccggttccgatagaatttttttcattgagttggaaccggttcctgaagcgaaagttttaataaaaatgaggtacacctatgaaaatgacaagagaacaaaagtatcgaatgatcgagcaggcagaacccggtgaaatagccggcttggaggagaaagtggagcaatgtcactggcggcaggcgtttcatatccagccaccgaccggtttgctcaatgaccccaatggattttcttattaccaaggtgaataccacttattctatcagtggtttccgctcggaacggatcatgggatgaaatactggtatcacctgaaatctaaagatttggtcacatggaatagtgcgggcattggcatcgcaccgggggactattttgattcgcatggggcttattccggcagcgcactggagcatgagggcaagttatatatgctgtatacgggaaatgcacgagatgaagactggatcagacatccttatcaatgcatggctgttatggacgagaatggtcacattactaaatgggagcaccccgttatttccaatgtgccagaagggtatacagaccattttcgtgatcccaagctatggaaagacggcgatagcttttactgtgtgattggtgcccaaagaacgaatttaacaggctgcgccgtcctctaccgatcaaccgaccttcgtacgtgggagtttgagggagaattgtgcacaggcctggagtcgtttggctacatgtgggaatgtccggattattttgaactgaacgaagcgggagtcttgatcttttctcctcagggcttggagccttctggggatgaaaaacgcaatatttatcaatcgggctacgtaatcggcaagccgttggataccggaacaagaacactggagcacggtgcattccacgagctcgatagaggctttgacttctatgcgccacagacgatgattgacccacaggggcggcgtattatggtggcatggatgggcctgccggatatcgaatatcccacagatccgaacggatgggctcattgtctgacattaccaagggagcttacgcttcatgagggcaaactcttgcagcggccgatccctgagctgactacgctgcgtagaaatcgtgaggatcgggtagctgacacgttattttcagagagcaaaacctatgaaggatttacaggtacggcctatgagctgatctgtgaggtagatcttttgagcgctaaggtgtttggtattgaattccgtgcgagtgagactgagaagacggtgattaaatataatgccgtcagtcgcaaacttgtattggaccgttcgcaatcgggtgagcctgtagccacttcgtatggtgaggtacggcagtgtccatgggataaagatcatatcaaactacatttgtttgtagatgcgtcttcagttgagattttcgtcaatgatggggaagaggtgttcaccagtcgtatttttccgcatccagagagtgacgaaatacgcttttttgccgacaagggagaggctctcttccaggcggtaaaatgggattttacatgagtaggctaaaacatcaagtggttcgttaatcatcaaatataacggaatgaacgaggggatgaacatcatggcggaaaacagagaaatagctaaagaagtgatccaggcaatcggtgggcaagaaaatattgcatcttttgctcattgtgcgacgcgcttgcggattatggtgcatgacaaggagaagattgatcagaaaaaagttgaggagatcgacaaggtcaagggtgctttcttcaattccggacaatatcagattatttttggtacaggtacggtaaatcgaatttttgaagaggtcgaaaagcttggcgtgaccggttcatctaaagaagaggtgaagagtcaggcgaaaaaggaaggcaacgtcttccaacgctccattcgtacctttggcgatgtgtttgtacccattattcctgtgctggttgctacggggctgttcatggggctacgtggcttgctcactcagccgcaaattctcgctctactcggcatgacgccacaggacatttcacccaattttctattatacacacaagtattaacggatacagcctttgcttttctgccagcgttagtcgcatggtcagcctttagagtattcggcggtagtccagtgctgggtatcgttctcggtctgatgctggtaaacccggccttgcccaacgcttatagtgttgcggacggctcagcccatccgttgacgatgttcgggttcattcctgtagtgggctatcaaggctcggtattgccagctttcttcgtgggcttgatcggagctaagctggagcgggcgctgcgcaaacgggtgcctgaagcgctagatctgattctcacaccgtttttaacactgttgatcatgatcactttgggattgtttgccatcggtccgattttccattcactcgaagaatgggtgctgcacggaacaacgtttgtgctggatttgcctttcggtattgcagggattgtcatcggtttcttgcatcagattatcgtcgttacaggtgtgcatcatatatttaatttcttggaaattcaactgcttgaaaagaacggagtaaatgcctttaacgccatcattacctgcgctatggctgctcaaggtgctgcctgtctggcggttgggctgaaaacgaagaatagcaagctgaaagcgttggcacttccttcctcgttgtctgcttttctggggattacggagccggctattttcggggtcaacctgagatacatgaagccttttgttatgggccttatcggtggggcggttggcggctttatcgcttctgtcttccatttggcggctacaggcatggcagttacggtcattccagggacgttgctctacatgaatcatcagcttccgctttacattttggcgaacttggctgctatggttgtagcctttgtcctgacctggatgtttggctataacgataaaatgttggaagaggtcaaaacagcgggttcctccaattaacaccaccaagtaatgcgaatacacgcagatttatacgcgtaattataaatatgatggtcgttctatatggaacgctcttggtccctaatcaaaaaggactgctagagcagggttccaggtagaacgaccatttttattaactataaaattccacccagatcatcaaactaaacgattgaggaacgttcatccagaaattcggacggcgagcagcctgtcaaccgtttgaagattcgatgaaaataggaaacatcactatatcccacatactccgaaatttcacgaatcgttagccgggactcggtcagcatgtagatggcggttttaatacgttgcgtatgtacatgctcgctgatcgtttggcgtgttacctcacgcagcagcgtcgcggcataattgggggttttacggatggcgtcaccaagctcctccttggttaccttttcccggtagtggttctggatatactgtttcatatgttccacatgtcgctctcgatcgcaagaaatggcgcctttgtcccattcctgattcatatatatcattgcctcggtcagcagacagtcagccatcagggtgtagtagcttgggtgttcagtccattgatagtacatcgatttaattcgttcatgcagcatatcgtagcatccaggtttgatcaacaacggcttgtcagtattcagtatgggaagtgtgctgttcgtacatgttttgcggcaatgtatcacatacttggtatgaaaaagcgtaggaatgctcttgccatagtaatccagatgaccgggtaaaagcagtgtttcacccttaccgagaatgaatttgcaatcgttcacccaatatacacatttgccaaaggtgaccaaaatgaacagtaagtcatcgttgtcgctatttgcaccagccttttcataccagtccacaccgttatcctgccgtatatccaccaatgtaatcatgaaactcactccccgatgtcttcaacattcattatactgtagtacattcatcatactatagttcatagtcttggtgcacgggtacaggtagaatagagctatataagtttaatgtagatagagaagcaaagtggaatagaaaaccatacagtaaagacattcaggaggatgacattactatgcttaaaacgaaaattatttgtactatgggacctgcctgtgactccattcatttgctaaaagaaatgatccaggctggtatgactgtagcccgcttgaatatggctcacggggagctagaagatcacgttaaacgtatcgaaaatgtgcgtcaggctgcgaaggaaatgaatacctttatacctgtcatgatggatattaaaggaccggaaatacggattggcaagctgagagaggcatcttgtctgctaaaaccaggaagccagctcattctgaccacagaagagattctaggggacgagcatcgtatttcagtgaattacccggatatgccgaaggacatcaaaccaggcgaccgcattctcattgacgacggtttggttgatctgactgtaacctccatcgaaggtacggaaatgatttgtaatattgtaagcggcggtattttgaaaccgagaaaaggtgtaaacctgccagggattcatacgacccttccaggcgtgacggagcgagatgtgaggcacatccaatttggggtggagcagcgtgttgagcttattgcggcttcttttgtgcgtaaaggcgacgatatccgtgaaatccgtgagattttgaagggacatcatgctgagcatgtacaaatctattccaaaattgaaaatgctgaaggcatggaaaacctggatgatattatcgaagcttccgatggcattatggtagcccgtggcgatctgggtgtcgaagtgccgattcaagatgtgcctgtgatgcaaaaagaaatgatcgacaagtgtaatctggtcggcaaacccgttatcgtagctacccacatgctggaatccatgcaggtgaacccgcgtccgacgagagccgaggttagtgacgtgtttaatgccgttatgcaaggagccgatgttgttatgctgtcgggcgaatcagctgcgggtaaataccctgtcgagtctgtacggaccatggccgctgtagctgccagagcagaatcgcaattcgattatcaggagcagtttgataagcgcagagcacgtcaaagcaccaacatcaccgaagtgattagtcagggtgcggtgagttcgtctctggagctggatgcgaaagcaattattacatcgactgccagcggattcacggcacgtatggtatccaaatatcgtccgaaggcacctattattgcggttactccgaataatacggtattcgctaaaatctgcctgttatccggcgtattcccgatcaagggggataaagtagcaacaacggatgaaatgttcgaatcctccatccgtaacgccctcaatgcaggatatatccataaaggcgatactgtagtcctgtcagcaggtgttcctgtcgctgaggcgggcaccactaacttgatccgagtatatcaagtgtaatttacaaccaaatatagacaagccaaaaggcgctggcccccatgggttcagcgcctttttcacattctgtcatgtcactaacttacagcccgaacacacttttagcaacgacctgtgtcaattctgccttatgggcttggtattgctcaggtgtaatgctcttattggccagtcgctgatccaactgctccgttaactgagctacctgtaaatcaacgacagcctgtgcgtcctttttattggtttgtgcaatatctgccaaggtttgaccgttatataacgcatcatacaattgctcatccgaggatgcgcccagtgttttcaaaagttcatcatccttggaagcttcattatcctgtacctgaggggctctctctggagccagtgtagcagcattagcccgacttccccaagtagaagactgcccaatagataacgccaacaacagtgtacagatgactataattcgttttcgattcatgagtgtaaatctcctttgtgttcattcaatttctgacaaggtggagccttatatggatatccaacgggagtaatgtttatgcctttagccgatccggcttatgtagttaccagattctaatatacatcatacacacccaatcttagcgccagcttaatactcgtttaaaataaactaaaagaggaggatataaacaggtaaaaccaaaaaaattcacagctgatgaataatacatgtgatttaccctttggattctgctggatatgaaaaaaacctccttcacaaaagtgaaagaggttttagacaaaaccattacagtttagggtttttcccatacttattgtcgctaggctgactgtcttggcagaagaatacaatcaaaataattgaccctacgagaggaatcagactgattagaatccaccatccgcttctacctgtgtcatgcagtctacgggccataacggccaaggatggcaacaggacagcaagagaataaatcaaagtcaatattggtgataagcctacaaggctatcgatcaggctgactacaaagctagcgattgcactaaatagtacaaacatccaatactctgtacgtcttgctctaccttgaaaccctacatagttttttaatgcatttaaataccattgcatatatttttcacctccttataaaatctaaatgtttctatacacgtaaaattgttcttttaggtatatcggcaggaaacatatagaattttagttgtaaaattataactttaaactagaaatttacgcaatacatttattaatgttaataattcgatgaataatttataaaaacataaaattacatattgaattttccatatccattgaataatatagaggtacggttaaccgccaggtttgaatcgtccttcttaatagaaggtgcttttatttttcaaatcaattgaaagcgctttaattcaaaataggagggatgaccaacattaaattcgagggtgaagaagttaatacaaacataatcctgaccgctttctcaagatttttttatgttatcagggatgttcaaaatgagaggagattgatttatgaagcaatcatttgttcgtaaagtaacggcagcttcactcgcaggtgcgctgttgttgcctgcttctttggtaggcgcggagctaacactcaattcagatacagatggaattcaaaatgtggggcaaacttctgctcaagacctagaaaacttttcaattcaaagtaaaaaggctgtctctttcaaggagacttccgtacatgatccatccattctgaaagtgaaagacacattttacatttttggctcacatctggcggctgcaaagtccaaagaccttatgaattgggatacgattgctacaggagtggcgaatggtaatgcattgattcccaatgtcaaagatgaattaaaggaagcactggattgggcgcagacggacacgctgtgggcagctgatgtcattcaactggcagatggcaagttctatatgtattataacgcttgcaagggtgactccccgcgttcagcgatgggcctagcagttgctgataaaattgaagggccttataagaataaaggaatttttctgaaatccggcatgtgggaccaaccgagtgaggatggaacgatctatgatgcaaccaagcatccaaatgccgtagacccggacaccttttatgataaaaacggcaagctgtggatggtatatggctcttactcaggaggcatattcattatgcagatggatgaaaaaacagggaagccgctccctggtcaaggctacgggaaaaagctgacaggcggtaaccatgctcgtatggaagggccgtacatacaatacagtccgcaaacggactactattacttgttcctgtcctatggtggattgtcagcggatggcggatacaacttgcgggtggctcggtccaaaacaccggatggccctttctacgatgctgaaggcaatgatatgatcaaggtcaaggcaaatcctgataaaccactttttgatgacgcttccattgaaccatacggtgtcaaactgataggtaattacctgattccaagagaaattggtgatccgggtactggactgggtgcaggctatgtgtcgcccggacacaactcggcttattatgatcccaagacgaaaaagcattttgtcattttccattcccgtttcccggggagaggcgaacagtatgaagtgcgggtacatgaaatgttcatgaacgctgacggttggcctgtggttgcaccttatcgttattcgggagatgaggattcactgaaaaagctgtcagaaaaggatgtcctcggtcaatattcgtatgtaaatcacgggaaggaaatttcggcaaatattaaacaagccgttaacgtcagtctggatagcggcggcaagctgtctggtggagtgaacggtacatggaagttgggggcaggcaatcagctggaaattacagcagagggtacgaagtacaaaggcgtattcctgcagcaccgtgatccagacacaggtgccaagacgcttgcttttaccgcgttgtcctcaaagggtgttgcggtatggggttcgctaaagcctgacctgaaggccagcaagattgtagctgctgtgcagaaggatctgagcctgggcgatacgagcaatgttctttataatctgacgctacctactcaagcagcacaagataccactatttcatgggagtccacccacccggagagtatttctgtgacaggtgaagtataccgtccagaagccggttctcagcctgtaacagttacattgacggcgaccatcaaaaaggacaaagccacagctaagaaaagttttacagccactgttcccggacaggcccaaggtcctcagcttgcacgctattcgtggagtgaagatcaaggaacttcggttgtcgacagcacatacaatcaattcgacggtaagacctatggtggtgctgcatgggataaagacgggaagcttggcggtgctctcggcctcaacggtaaggatggttacgttcaactaccaaatatggtaacagatgcgaaggattttaccttttccgcttgggtgaactggaagggcggtgcagcttggcaacggatttttgactttggcaacggccaagcccggcatatgtttcttaccccttcccaaggaagtggtgtgctccagtttacaatccatgagggtacggatcaaagcttgctttccaaatcatcattacctctaaaccagtggacgcatgtagcggttacactggaagggaatacagggaagttgtatgtaaatggtgaggaagtagctgttaatgacagcattacctttaatcccaatgagttgctgacgagcgaggcttatctcggcaaaagccgctttgcggccgatgcttacttcaatggcagcctggatgaagttcaattgtataacaaagcgctgacagcagaggaaattaaagcgctggcggagttgtaattcaaatgaactaaaatgagcaaataacgcaggagatgagcttttagaaagaagttcgtctcctgcacaatgttttgtatatttatttcttgattgctggtataataggaagcaactgcggatataatgttttaagtaggcgttaatgactcactcccgccgaatgaacacagctttgaagcagcaatagagaacataagcactctgcataaattaaattcaccagtgcttgcgttttcaatacacttatggtaatatgagtatattgaaattgtgacctgagattcgcatattgtagagggctattgttttaggttgaaataaccttgtgcaatatgtgaatttttatttgtaaaaaataaaggtcatataaatacattttggaggtaattccatgcaaacaggtacagttaaatggtttaacgcagaaaaaggtttcggtttcatcgaggttgaaggtggaagcgacgtattcgtacatttctccgcaatccaaggcgaaggtttcaaatctttggacgaaggccaacgcgtagaattcaacgtagttgaaggaaaccgtggaccacaagctgagaacgttgtaaaactgtaatttaaaattacagcctacttcagatgccccgaacatagcgtttggggcatttgtttttatctgttcacaagaccgtttttgaactgattacatcttatcgctttataaatcatgaagaaagagggatgtttatgtacaattcacggaaaaagccaatggatgagattcctgaggaaattacaactgtctggaattgcgccagcgatacatgtaacggctggatgcgggataacttcgctttttctgtcgagccgacatgccccatttgcggttctgccatggtgaagggcgagaaaaagctggcagttttaaataatacgagcttcaatcataccaaacaatcctaagcggataaatgtttgtagtgaaagatgccccatagccattaacggcgctgaggcgtctttttgttttttataaatataaattatacataagaatgaacaggctttcaattatggtgtggaggatggggctagtatgctcagtaagatagaattaaattcaggtagcgcttcgtaaaatacaccgtgcccgctacgttcgaaaggaataagttttgatccggcaattcctttttgagtttggacagccagggggaaaggacagacccgatccagcttgccgtgtagaatccaagtaggcacgtgtatacatggcaaatcaggacgcaaatcagagtcacgtagtgaatacaaagtacaagccatgctatgaactgaagccgcaaagccctgatcacgtaaccagtcgcgtaagctctggctgacgggattggcaaacaacatttcgccaaaagaagttaccaattgtgggcgatctgtataggcttgtttgatgagtttatctacctctgtgacaggagtaccataagggaagtcgctggttggggtgaaccggggtgtagctgctccgatcaagatcaactgattgacgccaaatccccggtgcctgctcatgtagcgtgtgaccacagctccccccatggaaaaaccaatgagccggacctggtttaactgaagcgcctgcataacaaccagcagatcgtccgccaatcgatcataattgtatccatgccatggtcgatcagacttgccgaaccccctaagatcaacctgaatacagcgatacccgtaagcaggcaacaaggcgacctggtattcgtacattcggtgatccagcggccagccgtgcaccatcagaacagggatgccttctccaatatcctcaacatacagcttcacgccgcgttccacctcaatataatatcccatcgtgttcacccctctagaaatcacgtcatttcattctctctcacatatatgtagccagggcttagctcattcgaaaaagggatgagtctgtcacgatataagcatataatatgtcaaaaaatgtatgtcatcctgtatagggataggatataattatggaatgaaacagcatcgggagagtggaacaatgacaccatcaaaaacattaaaatggattacaggcggattggagctatttttagctattcccgttttgggcgggctgctcatcgtaaattccgcgtatactatattgttctttatgctgattttccacattgttacgttggtgctatcggtgacgaatagagagtcttattatggatctattttagggatcgtgacctcggttattggatggattccgattgtgggctggttgatgcatttgctctcaggcatatttttgatgattaccgcagctcagcagccgcgtgatcagtatcgcaatcgcaatccttatgatgattatcgctactaggggatgtgtggcgatgcaaagatgagagatcctgttgaacagggtctttttttatttatgaaatctccccatgatgatggtgttgtagtatttgccatctgaaagaaccttatcgttttttaataacccttcgatttcaaatccatgttttttataaagctcaatggctttatcattcgtttccaaaacttgtagagtcattttcttgatgccattggagtcagcccaggaaatagatttttttaaaagatttgtccctatcccgtaaccccaaaaatcctttagtacacaaacgccgaattcaactttatgagagaatctgctcagaacatggccctcacatcttgaaaatccgacgattttatcatgaactaccgcaactaaaaataggtttctgttattctctgtatctgactcaatgagctgttcaaaaccggatgtacttataaacgcttctcccttctctctatctaaattttcagtttctccatcaatcagcaagcggatttcagacaaattcttcgcatcttgaattatggctgatctgatcgtatagtgtattccttgcacatcaaattcctgttgatttattttcattacattctccttattatgaattagagtgaaaaatgactctggatcatgttagtctaccacatattatcttgtttacatgacaaataagcctgtctccttctgttgtatcgcagcaggggacaggtctattggtttctctatccgtacagggaggccggatggagatttattatacataggtggatgtgtcagattaataaatggtttttatgaatgcgacttatcgagctacagcttttggaaaacaggagctgtagctatttctgcttagcagaggctttagctgcattggttttagcagaagccttggctgcatctccctgagcaggagctttacctgcatccgctttaccgccatctactggtggtttggatggtttcacgccattcaccatatctgtcatcatttgcttcagattagagacacgttggttatattcggttgccgtaatcttgccgttttgtttttccgtagccagttttgctttcatatctgaaaccattacatcaataacggaatttacgctcacgccttgtgctttggcgatcgtagcaagggatttacctgctttcaactgtgtatccaactgactggaggacaatttcaataatttcaggagagctttgttctcagcatagttacctcctgcgattttagggccattagcatcgccgggattccccttaggtgcctgtgctttgtctgcgatgggagccttctcaggtgtagttgaagcagcatgggctgcgcttgtggagtacagtgccccgcctcctaaaaatgccaaggccatcgttccagccaaaattgctttcttggtgctcttcatcttcattttccacctttcggttatggtttgcttggtacgtgatacatcataagggatcaacttgaatgctatctgagcgcaagctgagcatttactgaatgaaatttgggtggcatgactaaaatttcagctaaagtaaacttgtattatgtgtattaagtgatataatacactacaggcacgatagatgcagccgattagggggaaacacccatggaagagcaacgggttggctcgttccgatttttaattgactttagccagccattatatgaacaaatattaaatcaagtacgaagctccattgctaaaggggagatcgaaatgggaagcaaaatgccatctgttcgtgatttagcgcaggaattacgcatgaatccgaataccgtgatgcgggcatatcaagagctggagcgggacggattgactgagaagcggcgcgggttaggtacttatgttacttcgtccagtgaacggattgccagctttcgggaacaattggctataacgtatatagatcagtttctcggacagatgagcagtctggggttatcgtgggaagatgtacagcagtatatacgaagcaaacaggacggaaatgacaaggaaggaggcgataaggcatgacggagtctgttgtggttgcgaatcatctggtgaagcaataccgcagtaaaaaagcactggatcaattagatgtcatcattccggcaggacgtattgtaggcgtgcttggacccaatggctgtgggaagtccagcttctttcgagcaatcaccggattgattcagccagatgggggcgagcttcaggtgctgggccgacagcctagttgggaaaccaaccgggatatatcctatcttcctgaccgggcacgctggtaccccaatcatacagttcagcagacgctggaatgggggaagtcttttttgcctggcttcaatataaaagacgcgtataaacttgctgatcatatggacgtcgagctggaacttaaaatgactgggctgagtcgcggacaggaggcacgtgtgctactgattttatgtctggcacgtgaggttccactcatgatcctggatgagccgtttgcgggtattgatgttctctctagagaggcgattgtagccggaattattgattatttggaggggcggcagcagtcgatactcattagcacgcatgatattcaggaagtagaaggcttgtttgactacacggtcatgatggaccgtggacggatcatatggtctggtgattcggatgatctgcgtgcagagcatggctcgctgaatcaggtgttccgcaatttgtacaaaaaggagtggaaggcgtgaattcatcagggctgttcaaagatttgatacgccatgaatttcaaaataaaggaagctggagaaagcagggccgcagtcgactaccgagatcgtggagactcgtgtatttctcattatttctaattgcggcgttcgctatttccttgtacttcgcacttcacaaccagctcgaattaacaaggctgtggtatgtcaccctgggcctgccgtacatgatcatttttatgggtgtgggaagcttgagaagagaatgggaaaatgatacctacggatggtggctgacccttccctatccgcgcatatggctgattagcgccaaatggattgcggctattttacaaaccatggtcgtaatattgcttctgtttgtggtgggttctctgtacgcgttgttcatctcatcaaccatacagccttatacgtttgcggatgcagcgtcttttattatggccggattgaactggtttgtgatgattatcgccttcacgccgttggttattgcgctgggtctattgacggccagtaccaaatacagcaccttgcggccgcttaacccgatactgtggattcttttgatgggtggcgggagtgtcttttattggtcgggcgatcaggggctttatgagcagtttgaccatgctcaaacaggacaatggtttccatttacctggcatttcccgattgcggtgttgatgagttggattgttgcgtatgtattaatccgcttgagcgcgtatctgctggagaaaaaactgtcgatttaggctagcgtatctacaggatctatgaggaaggagttactacaccatgacgacgatatttatatatgtattgatggctgttctggtggggctgatgatctggttaaggaccaagagacgaaggggaccggtaaaaggaaatggaatccggattctgctccccttgtttatcgctttcccgcttatgatgatgtctgtgtaccaattaatgcatattcccggtcaaacgtacgagctccccgccttttgggaactgctggttgccgggctactaggggctctgttcggctatgttattttgctgcatacggcgtatgaaagacgggatgacggtcttatttatcccaagccgaaccaatattttaaatatattattatcgctattatcttgattcgcgtcgttttgacccagtatctcagtagtttgggtacgaccgaaattagcatgctggcgattacgatggcgctggtgtatatctcaatctggcgaatcgggagctttatcaagtttcggaggacgttatccgtataacaatagcaatggggttaacacagcagcttactattcaaaaagcgttcattcgcttggcgataggagccgcttttttttgagttttggcattagcaagttatcacacattgttattgctccccatatcctttattctaaggcttgtggcttgcattgtagcagtacaattataaatttttgaaaggagggttattgaggtttcaaaagatttaaatggggtttaaagttagataggcggggaaaagttgtttcttgcgattaggtgtaactatattagttacataaaaggaaattgttttccacattttattttacatgttgagaggggttcacatccatgaaaaaacatacggttactgctgcactcgctggtctgcttgttctgtcttctgctgtaccggctttagcagccgaggtaaaacctactacgggtattcaggtttgggtagatggcaagaaggaggcttacaaaattgcgcctatcgtgagaaataagcaggtcttaattcccttgagacaattggcctccagtttgggaattccgatggatgccaagcatattacgttcaatacggcgcgacaaagcacgaccatccgatatgatcaggcgacggttgtactggtgtctggcagtccggaagcgcaaatcaacgggattaaggtaccgctatccacctcgaccctattgaccaagcagggagtaacctatgtaccggttgatgtcgtcaaagaagcatggggcaagcaagtgatttgggacccggccagccaaacggtacaaatcggggtgagtaataaggataaggtcattgaaatcgtgaaaagctttgaaaccggagacacgaaagtggccgagacttggatcagcaaggatcagtacattcagcacaacctgagctttgctagcggaagagatgcgttgctgcaagggattagccaggcgaagggagccaatgtacaggttgaaatccaacgtgtaattcaggatggtaatgatgtagcagttcattataaagagtccattgcagggaaaacgagcattgtttttgatattttccgcttcgatagcaatggtaaaattgttgagcattgggacaacatgcaggactcggctccagccaatccaagcggacacaccatgattaatggaacaacacagatcacggatctcaaccaaactgagacgaacaaaacactgatccgcaagtttgtggatgatgtcctggttggcaaaaatcgtgctgcattggaaagctattataacggtgaccattacattcagcataatcctctttttggtgacggtgtatccaatttgaaacaagcattttccgcagcaggaagccaaggagcttcttttggatatgatcaggttcacatggtcattggagaaggcaactttgtgctggttgtgagtgaattgacatcgtctaagggaacttcagccgctgtctatgatctgttccgggtagagaacggcaaggtagcggaacattgggacgtagttcaggaggttccagctaaaacagagtggaaaaatacaaacggcaagttttaagaaagtgcatttgtggtatggcgtgattggcatgctttcctaatcgtcctcttcctgttaaaatgatgcaaacttataacaggaggttggacgatggaaggcttgaagcaacgtgtgggctgcctgcatgcacatcactcgaacatagcctatgtggaacgagcttttgcttcttatgaggtggaactgatacattttgtggaccctgggcttatgcgccggatctcgtcagacccgcatttttctgcggacgatgcgagtcgcaaggtagaagagcaactgagctggattgcccaaagcgacatagacgttattttgataacgtgtacgaattatattgttttggcagaaaaggcccaattgaccctgtctacaccagtaattacgctggatgagcccttttttcatgagatatgcgatgatttgctgccacggaccttggtattcacgaatccggctactgtagagggaacgatgaagcgtctttatcatacggctgctctgttaggcaaaccggatatctcttcttggatagaggttaaggtggtggaggacgcttttgaactgattatgcagggacgtgaagacgagtataaggaattgctggttcgttcgctgtatgagctaagggaggctgatccaagcagggggctggctgtagcacagttgtctatggttgatgctgcgttacaggtggagctggagacggggcaaacgattggtaatcccttacggtcgttgtcgaattcaattgaggatttgttaggttaaataagtataaccaaaagaacttccaccccgtgttttgggcctgtggaagttctttttttgggaggaggctggcgggcaggttacttctgcgttgttcatcacagactctgttgatcttgggtgatgaatgctgcgcctgccgattctctttggacaagcgtaacgtataaacgttcatgctccacgtcttccccagcaatgattttgagaacctgttcggcagctacagctccccattttcgcttggaatagtcaatcgttgtcagtcggggctgaatatattgcgccagctcgatattatcaaagccgacgatatgaatatccttgccaatcgtcagctctgactgagccattcgattgtaaaagcccactgccatttcatcattgagacaaaatacggctacaggttccgaacccgggctaacgtgttgctgcaaaatgatctcagccgcctgttcaccgcccgatttctcaaaatcgccgtcaatttcgatcatttcagccacgccgctacgctcaatggtctgcttgaccgcctgcatccgttgccatgaatcgtaagaaccttctggtccggtaaccacatatagcttacggtgtcccaattccaataaatgttcgattgcgagagcggcgcccgctttgttatccagcagcacctggttaatgttaggatgattcagttcacggtccaacacgacaattttatgtcctcgctcggcgtagttcagtagctcctgactatcaaacgtctgatccagcacaatggcgccgtcgatcatgcgttccggcaacattcggtgagactgcttaccgctgcatacgatgagatcatagcccttgcggttcaaaatttccttgatgccatacagtaaatctccataaacgtctccacggaaatcagttaggaaaacgccaataattttggtctgccttttcttgagattacgtgcggcggcattgggcacatagttaagctctttggcaatggctaaaatacgtgcgcaagtttcttctgttaccttatcgctaccattcaaggcatatgaaacggtagatatggaaacgcccgcctgtttggcgatatctttaatgctgaccacatcgtcacctccttgtcgtccatcttataattgctattgtatattcattattaaccacatatctattccaaatgtcgtagtcctacacataagcagcaaagggcgatcccgcaagatcgccatccctttgttgcctataccagattcagcattaaaaacactttataaaataatctccagacggtgtacaccgtcatgttctgccaaggcttgctcgaaaatctcgcgtttgatgcgcaaggcaccggagcggtagcgattatcatcggctggcacgctttccagtggtattccgttcaatactgtacggccttgctcaccgccagtatgctcttgcagcatgcggtagacgaaggtaattggttttcctgcaaaggaaaattcaaattccaacccatcgagatgatccggtagcacggggtctaggatcagatcttcgcctgactgacgaacaccaaggacgttcgatatgagctgattcatatagattcctggaccactggaatagattctccagccgcctttgacgggtacggctccttcacgcagttcaccaaaccgttcctgtgcttcatagcgggtattaaatttaccatccgagctgctgaaataggcgttgctttggcgccattcggcattcggtacggacgcacggatgccgaccggattgatgagcttcaagctgtgccaagcgtcgtccttgcgtcccaatttggccatcgcttccgcaaagcgaatatgggcatgcacatattgcagcccgacctcacgtccgaagttggccgcttgctctgcacgcttgaagtgcgagctcacaccgccatcatactgtgcagggcggttcatcagacgcacgccatccgggcagaggaactgctcacggatgagttgctcatgagccaatgcttgctcaggcgtgagcagctggctgatcatgctgcgtgtcatcggcagcaaccgataatggattcctgtctcggtgtcagacggatggagcatcagcttaggttggccgggctcttccatatacacgaagcccggaataattccgctctccagcatgtagcggttaaagtctttacggatgccattggccatctgatgtagatcttgtgcgatcttgtcggcttcacttactacacccgcgggggcctgctccaaagcagcagcaaagttactaataacttgataggtgagtgcaaccgtccagctgctcgccatgtattgcttcagctgagcattggctggttggagggtatcatcccaatcgccgtcgccataggccgacaaatacgtatcatgcaggaaattctcgcgaatatattcgatttccttcagggtatgttccatgagagtcgcggtctgcttggtataatcgaaagtatgccgatgggtgtaaggcacattttcttccagaatactgtaatcacgggtagcggtcaaatagtcgcccagtaccttgagtggccagacgataatatctccatggctttcttcttgctgcacgtgagtatagttgtcaaacataaaccattgcggccagtttccgctgtcctcgtactgatggctgaaaacagtcagcaaaatggaacgaacctcatcgaacttttgcatagctgagaaatattccacaggcccctgacacacatcacgtgttccccaggctgcaccgccgtattgctccagaccgtgaggcacggagtagtgaacgagcatattgtgggtgtaccaccaagccactgcgttcacacggaatagctcgctcgtttcgtgttgacccagcgaaagatggaaaccgttcataagctcggcaaaatatgcccgatagcgctcgcgctcatcttcaaaggaagcatggcgctctttgtgcgctgattcttgcccagctgaaagcccattcagccaaccctgcacggtgcaggtccattcgctgctgtcacccagctccagcacaaccagagacgcatcaggagaagctttcccctgtagcagtgcgtgagcgtcgctcacatgctgtaatggagcgccctctatgtgcattcggtacagcaggtctggataggccttggcgctcagggaagcagagtctgcccggaagagtagggcgtcaccttcacgttccatatgaaacgggagctcatattcgttcacatgcatagacatttgctgagtgatgaggaacggataggttttgccactcgccgcacgcatgtgaagccgtacttctgggctatcgacattcgtatggtttgtaataatgaatgtatcgtcagccgttttgtaataccagcgcacataattgaagccaatctcgaacagggaaggcatcgtgagcaggcggtatttcccttggattccgacataaatacgttgaccggatgtcttgggaatattgagcgcattacgcgcgttggtaatcattttgttgaaatttgtattgccgattacgagttgggaattgaacaccccgtacatataggaggtggttgtaatggtttcttccttacctcctgagtaatgcccacccattaaaatgtgcccatggggacgctctacacgaagctctttggatttgagtacgacatgctcatagctgtccgtgaaaaaggaaagtagttcatcgccatcccgttcttcttcctgccgtttggggaaaagctgattcacttcggcatcggttaagtccagcgtgcgcagcggctcaccgatggtttgagctggagccacacgccctgcctgaagatcacttgccgcgcgtaccggtatgatggtatcggaagcgtctactagaatggcagctacttcgtcacgtgcttttgtcaccagttcctgatactccagctttgtcactgcggctggatgattcggctggaacagaccgtaaaaagtaaagcgagcttccccagccagtttcacccgctcagattgcaacgcggtataggcgaattcgtattggtacacttcattggcgagcgagtcgcgacagagtgcttccggctcattcgtttctttgtacgaaagtccaaagaactgaaatccgtcagtcgagtaaccaacagtgcgggttaacgagccttgttgaatgtatgggaattcctgactttgaggctggttttgacgtgagcaaacggtgtagcctctttgttcatcatggtagacggtgtggtcaatatattgagacaaataagcttcattactgcgcacagcagcggtatcggcaatgccgatatcctgaccgtacacgacatctgcttccacgtcatcgccctgtagggttacatcccagaaccatactcccaggcggcttagcgtgaaggtcacctgatagcctacaccagcggtgaaaccttcccaaataatctgctgatccgtttgtccgattactcccggtgagcgaaccccaagcaggggagtgatacttacaccggacggacgatacaatctcaagtacagattgttcaaggaaccgtcgactgaattggtcaacagttggttgatcatcgttgagccgtgggcgatcttatacacatcaccactgctcaagaaggtaaaagacaggtcgccggcccgcagcaaaatattttgatccagacttgtattcatcatagggaacgcctcactttcctgtttcttttactaaccgaaaacggccttctgtagtatctcggctgttaggtcctgtaaagacggcaaatttaccgctgtcactgtcaaagctcaaatctgcatgatgatagcgcagctgaggctcggtcactgtaaattccacttcccggctttcgcctggggcaagcaggactttgcagaaatctttcagttctttcatcggacgaaccgtatcaccgctgatatcacggacatagaactgaacggtctcctcgactggacgtgttcctgcgttcgttacctgcactttaacggtcagttcctgaccgggagtaagagtgtcgccggaaagctgtacgctgtcataggctacattggtgtagctcagtccatagccgaacgggaataaaggttcgttcggtacgtctaggtattgggacacgtagcgttcttttgtattcggatctaactgcgggcgtcctgtattaaaatgattgtaatacacgggcacttgtccgaccgattgcgggaatgacatggtcaggcgacccgtaggttcggcatcaccgtataacaaatcggcaatcgctgcgccgccttcgccaccagggaaccaggcttccagtacagcgtctacttcttcaataacaccgtgcagatccaacggacgaccattaaacaatacggctaccataggcttgttcagcgtcttcaggcgcttcaccagttccaactgggcttgtggcaagcgaatattggaacggctgcctgcttcaccactcatatccgagcgctctccaagcgccaacacgataacctctacttggctggcagcttgcagagcttctgtatattgctcctcagtcatatcgtcgatagagcaacctgccgcaacggtgagcagcgaggaggatattttcgattggaacccgtcaacaacgcgaatagcttcctcctgcgaaccgctccacgaccaagagcccagaatatcaccgctctctgcaaaaggcccgatcaacgcaatatgttgattgcgattcaatggaagaacggaatcatttttgagtaacacgcaagatttaatagctaattctttcgcaactgtgcgatgagcgtcgcagaacacaacttcacgttcacgctcagggtctgcgccgcgtagcgggttttcgaacaagcccagcttttgcttgagcttcaatatacgcatcactgcttcatcaatgagcgcttcatccagctgtccgctgcgaaccagctcaggcagatgcccgttatagcaggaggtcatcatttcaatatctacgccagccagcaatgctttcttcgctgcctcgcgctcatcctcggcgatgccgtgagggataagctccttgatggcggcccaatccgagatgagtacaccatcaaagccccactcatcacgaagcaaatcacgcatcaggcgcttattgcccgttgcggctacgccttctacggtattgaaggatgtcatcaccatttcacagccttcatctaaagcagctttgtaggaggggagataatactctcgcaactgccatgcggatacatctacagtgttgtaatcccgtccgccttcgccagctccatatgcggcaaaatgcttcacgcatgcggccacccgatcggtatcgttcgtcagatctttaccctgaaacccgcgtacaaacgcacgagcaaattcgctgttgaggtaagggtcttcccctgtagattccatcacacggccccagcgcgggtcacgcaccagatcgaccataggggcgaatgtgacgtgaacaccggatacagccgcttctcgggcagcaatggtagcgctctcttctgccagctgcatatcccatgagcaaccaatagccagcggtatagggaaaatcgttttgaagccgtgtacaatatctgccataattaaaagcggaatacccagacggtttttactcaaatgagcctgctgaacacgaatcgcttctttagcccctgcgatgccaagcacggaaccgacgttatggacatttttttctgtgatgccgagagaagccataggaccggtaatttgactatctgttcccacttcttcaaagaaggcacctacaagctgtagcagttgatcgactttttcttcaagcgtcatgttttctaaataggaattcaggtgttgttccatcataatcctccataagctgtattgttggtggacagctctctttttcagattcatgagattttttggataaagatgattcaaaaaagtgctgaacaggctaatagctagtatagaagcataatattctgtcgtattattaatcgaaacgtttctattgttgaactcagttggattatatacgctttcaaatggagagtcaaatccaattcagcgggtttttataggataaatagcgtaataaagatgataaaaacgaaaaaaagtcaggattccgagtgaataaaaaataatattgctattgaatacggtttcaatttgttctataatgactatcgaaacgtttctattgacgggtatggtccttgtgctttgaacataagtgttatagcggtatgctttaatcgctatgtatttacatgcatcaggattttgcaaaattcgattccaatcaattattgtatttttgcaaagtcctcgtatttgaatccgttatcatattgcatgatcggtaagccgatcatctcgggaggaatttgtatgatgaaaagaacgttggggatcattttggcaagtaccttattactggggggcgcgctggtaggctgctcgtccaaggatgattcgtctggcaaagatgctaacggcaagacgaccatcaccatgtggggcatgggagcagaaggaaaacttctgcctgaaattgtaaaagattttgaggaagaaaatccagatattcacgttgatgtacaggcgttgccttgggataacgctcacgataagctgctgacagcagttgcttcaaaatccggtccggacgtggttcagttaggtacatcatgggttcccgaacttgcgtctgcgggtgcattgacggatattaccccttatatcagcaagtatcctgaactggaatcgaagaatttcttcgagggtgctgtaggtacgacaaaatttgaagggaaaccagtcggtgtgccttggtacactgaaacgagagttttgttctatcgttctgacctactgaaacaagtcggatataatgaagcacctaaaacgtgggaagagctttccgatgctgctcaaaagctggcggctcggggcaaaggcaaatatggcatctcctttagtgcaaaggagcagtctatgggctttatgtttgctctccagaacggttccaagctggttgacgagcagggcaatccgctgttcaatcaaccaccgtttgtggatgctgtgaagtatgtgaatacctttttccaaaatggctctaacgcagtggatattggaattgattctgttcaaggtttgcaaggcgagggtatcgttccaatgtttatcagcggtcctttcatgattaaagaaatcaagagcaaggcaccagaattggaaggtaagtggaatatagcggagcttcctggcaaagtaaacaacctgtccgttttgggtggagccaacctttcaattatgaaattcagcaagcacccagaggagtcggccaaattcctggcttacatgagcaaaccagaaacacagctgaaatggatggatctgtccagtaacttgcctgcaactactaaatcgtgggaagatgccaaactgaagagtgatccgatgcttcggacgattcgcaaacagttagatcattccgcagcattgccgcaactggccgcatgggaagaggtttctcaacaattcatcaagagcttcgaacgtatttaccgcggtcatgccgatgtacagaaggaaatggatgactttaatcagcaggctgcaagtataatgaaaaaataatgatccatatccgtcattgtcaaagggagtgaaggcatgaaaggaagctcgcagaagcttgcgccatacttgtttatcggtccctccatcatcctgttaacgctgttttcgttgttgccgatactactggcgctcgtgatcagcttcacggatatggatctgtccggactcgttaattatgaaagtattcgctttataggattggaaaattacacgaacgtgcttttggacccttcctttataaagtcccttggtaataccctgttcttcgtcatcatcggtgttccgttggtgctgatattttcgcttagcatcgcgattctgattaacatgggtaaatcacgtgctttcaaagtattccgcgtcgtgttctatctgccgtccgtaacgaatgtggttgcggtcgcagtggtttggagttatctgtataatccgacgcttggattattcaactacgtacttggtcagatgaatttaggtcccgtcccatggctgaccgatccaacagtagcgaaaatttcgctgattgtgttagcggtttggcggggcatcggcttaaacatgattatttttattgcggctattaaagggattccgggctcttattatgaagcggcacagcttgacggggccaatacatggcagcaaattcgttatattacgcttccgcagcttcgttacgctattttcttcgtgtccatcacgacgatgatcggctggctgcaatttttcgaggaaccttttgtcatgaccaaagggaaaccgctcgacggcacgctgacggcatccttgttcatttacaataacggcttccaatttagtaaattcgggtatgccgcggcgggatcgttcattctgttcttcgcgatcatcgcggtaacgctgattcagttccgtttgcaaaataaatcggagtcctgatagagagaggtgatgaacgtgaaaacagctgttcagcaagcccgcgccaatacgcgcagtggtgaaaaaacatttcaatggttcgtggcgattctcctgaccgtaggaggtctgttgatggtgctgccttttgcgtggatgattctatcctcctttaagacagagggggaggtaaccaaaattcctccgaccatctggccgcagcattttacactggataattttaaattactattcgatagcatggcttttggaacctatctgacgaatacgctgattattgttttagcttccttctttggattgttcctcaatgccatggcgggttatggctttgccaaattccaatttaaaggcaaagggtttctgttctatctggtactggcaacgatgatgattccaggccaagtgacgatgattcccgtctatttgattctgaaccagatggggttgaccaattccatgctagggattgtcctgcctggattggtaggtgcgttcgcgatcttcctgttccggcagttcatgtccgatatcccggaagaactgctggaggcgacacgcctcgatggagcaggggagttccgtacttttctgcaaattgtactgcctatttcgacgccaattatcgcggtacaggccatcctgacctttatcggcggatggaatagcttcttgtggccgctcattattgcgaacgatgagaagctgtacaccttgtccgtcggactgtcactgctcaaggggcagaacgaaagtcaatttgcccttcaaatggcaggctcgaccttcatggtcgttccgatcatgattatcttcattgttttccaaaagtatattattgagaactatacgatttcggggattaagtagtagtgtaatacgcaaaatgataaaaacacaaaacggagaacttcttagtttaagtcaaagaagttctccgttttttgtgtttttgttttatagaaaaataggaaatccagactagttgacattcattcttaaaagctgcatcaggttttgtttatatatgagaacgggagaagaaagatttagaatacagattgcgtgttacgaaggtgaataaaagttacgacctccagaatcattagggtatgcattacattaacaacgaccagttttttttagcaaagcgaattatacttttattatatttaattgaatatatttcaaaaataatatgttaacaaattttatacaattttttttaaaaaaagtatagaaatgcaatgaaaaactgactatattggaaaagaaataacaaaatataaaaaatgaggtgaatcaaattgttcgatcctattaaccaagcagctgaaggtagtgtttcccctatgacttgcgttttttgtgatacacgtgatcgttgtgtaggttgtgatgctactgattggttttgtagcaaagaaagtggtcattggtgtactaataatgatagcgattaattgaagtaaaactcgcagcgataggactttcaaacacagatagtcaattaggaggtctgggaactaatcttcttggacttcctcttattttgttaactttgaaaggatgattactagtgattagtgctccatttgaaaaaaatcccgtcaaaatcatagaacaaaatgaaaagttatacttatacaatataaaaacaaatgggctttttcagattgatgatgtcgtagtagatatatgtaatagcgaaggtaaggaaattgaagaaatatatgaattacttaagcatcgttctagtagagaagaggtagataggctattagccagtctggaggaagcatcggttatatataataaagatttgtctattcaaaaggaatgtaaaagttgcaatgatgagcaagtaagtctatcatctataatccttatgctggttcaagagtgtaatctaagatgctcttactgttatggaggagacggagaatataatgaccgaggacggatggacacagagaccgcattaaaagcagttgattatctgtttaatcattctggcgaagaagaagaactgaatatttgcttttttggaggggagccacttctgaacattgaagttattaaagaagttgtagcctacactaagctaaaacaagaaaaatcaaataaacgtgttacatatagtatgacaacgaacggcaccttgatttccaaagaaattgaaaacttcttattagatcatcatatttctattcagataagtctagatggtgatcaaatgacgcacgatttcaatcgatattatcagaacagaaaaggtacctatgaaatcattttaaatagaacagaaagtttaagaaaaaaaggtgtcataacagcaagagctacgatttcaccagtacaattggatataacacagacacttacacatttaatggggattggtatccgccatgttgcgatgtatcctgcagtcgagatgcttagtgaggaagactttgagaagtatgcaaaggaattcaccaaattggttgttcattttgaatctttgcttcaagctaaaaaatatggggaagcacgtcaaatatcgaacattctaaaatacttgaagatgattcattcttcttctaagcgagattatttttgtggagcggtctcgcatatgcttgccgttgatgtgcatggtaatctttatccttgtcaacgatttgttaatgaaaaggattattctttagggaatgtaagggaagggatggatgtaagaaagaagagtggcatgcttagtgagatgcgtttagagaagagaactgtatgcggagaatgttgggctaagaatctatgtggtggaggttgtcctcaagaaaatatggtgcttagtggttcgattaatgagccagtggataaatactgtaactttactcgtagtgcaataatggattgtatggaattgtatttacgattaactaaagaagacaagaaaaacctgttctctgctaagcggcagcgagagcaactattggaggatgtctcatttgacaattgatattcaagctttaagtaagtcatatggttctcaccaagtacttaacgagcttcatttccacattgataatggtattttcggactgctcggagacaatggggcgggtaagaccactttaatgaaaattcttgccactttacttagattcgaccgaggggaagttgaaatattcggacattctttgaaaaaagaacctgatgctattcgttccttactagggtatttgccacaacatttcgatttttttccaaatgtaacgattatggaatctatgcactattttgcagctttaaaaggtattcaaggtaagcgtcatattcaagaggagacatctcagcgattaattgaggtgggacttatcgatcaagttcataaaaaaataaaacagctgtctgggggaatgaagcagcgcttaggaattgcccaagctatgttaggacaacctaagttgttaattgttgatgagccgacggttggactggaccccaaagaaagaattgcttttcgaaacttgcttcagaattatggagaagagcggattatattgttatctactcatattgttcctgacgtttcaagcacatgtgacaaactactcgttttaaaagaaggccgttgtctgtatcaaggggctatagacgatatgattcgaactgtcgagggtaaagtatggttggttgatgttggcaagcatcaattggaacaattaagccaacaagctcgaatcacctccattgtgcggaaggaaggaagaattcaggctcgattattgtgtaactaccctccagattgttgtacagaagtcacacctgaaacggctaatcttgaggatgcgtatttatacatttccgatccggaggagagttagcagaatgggacaagtaatcagagccctagttcgatttgaagttttgcttatgaagaaaagtgtagtgttttttatagcactaacgttctcttgttttttaattcctttatttttatatctaggagcagggaataagaataacgagttatggatatttttgcatcatggacaaatgttctttaccatattactaatgccgttaatgtattctgttctttatgatggcgagaagcaaaaaatgatctcttctgttattatgcctaaattgcttaaaggagcccaatatttttattgtaagagttttgtattatggggagtggtttgcttatttcaatttgtcgctttagctatgatttgtgtagttcaatggtcgactcatggtaaggctccattcttgatactgcttcatctaacagtagcaggtttagcaactatgggatattctgttcaaattactgtcatattgaacttgctcttacgtaaacaactgtatgtgaacattgtaatgctcgtttaccttttaatcagtattactatcaactttccctacatttcaatctggtttaacccagactggattatttccaatttcttcacacagtcgtttgcttttggtagaatattcctatttttgtttatgtgggtattgatgaaagtcagtaatcatctatggatggcgagggtacaagaatgaatggaattatagttcgtttctggctacagcttttacttcgaagagaacaagcagtaaccttgctcgtttcctttagtgtggttattttattcaatttaataatgaatgaaggtattgcaataacttatagtgttaacttgttatttgtagcttttttttctttacagattgcgagtatacataatcgtaatcatacagagccgtatatatatatttccgtctttcctaattaccgtctaatcacttaccagctttatgtttctttaattctttcgtttcctctcttgctcatgatgataggacttttatggaaatcattcgctgatgtatcattatggaatttggttatcattgtgtttttttctagtgttttttcgtcgatgttgggtctcttgttagggcaggtagtaaagcattatgggttggccttcacttttctcattgctttttaccttcctataggtttagtttcctggtcttttaatgaaaagttacgttacatatctcctgtagtgaatatattcaacccctatatgatcaactggcgaaatctctttggactcttaggctgtagtttattattttatggattaggcacattgttatccagtcggcgcggagggggcaaaaagtctataatcccttggattagtacggtccttgcttgtagtatactgattggcgtatggggatatgagaggctatttaatgagaatctacagacttcgtcgtttcaaaaaataactgtgggacaaacacaagtagagtataaggggattagttcgtatcaggcgaggcaatttgccaccctctttgaaacgctgtatcaagtggctaagaaaaaggagacacacccggttcgctataccctggaaatcacccgaatacactccatgtcatcgttcgagccgaaaataatagtgcaaaatcataataaacttcaaatcaatatttattcaaataagcttttagagtttaatttcggaatggattgggcgagtaagtggattgattacattttgccccaatcgacccacttatccaatgagcaagttgacgcttttaaacacctcaaaaatgacattattatggaagttagaaagaaaaatcccgaaaatgtctatacaattcatggggaatgagagctaaaatagcgaggtttcatgaagaacgaataatagtagataaaaagaaagggatgggatgcatggaacgtgaggcagaacatttgaatttcagagctatatttcattcattccaatattggccgaagttaactaagttattatggagtacagaacctatctactttattatcattatttttggctatctactaaaaggaatactcccgattgctaaccttctttccatacagtatttggtttctgaattagagactagcacggtatggcataagcttcaaataagtgcagtgttccctgtaattatcgtgatgttttctagtttgcttatttcaagtttaattgaatattctgataaattatttcaaatttcactgataaataaattacaaacattaatagtatcacaaacatcaacatttaaccttgcggattttgaaagtccgcaagtacataatcagctcaaaagagtacaaaacgactcaatagatagacctattcagatctataaagaactcattaatttgttaagttccatggttacgttatgctctagtattgccattttaatagcattcagatggtggattttactgattcttgttgtttcccccctagcatctttttattctttactgaggttcacacaaattcaatatgtagccaagaaaaaacgggctcctttacaacgtaaatccaggtatattaattacttattgactaatgagaagtcttttaaagaaatcgtattgtatcaacttagtgactactttacagcaaaatataaggacatttttgatgttttctacaaagaggataagtatttagccaaaaaacgtattgcgttatatttgtcttttcaagtaataagtacattatttatagccattgctttgattatgattatacaaatagcttggaaagaagtatttctcgttggcagtatttatgcattagttcaagcagtattattagctaatcaaaatattaacacagtatctcaaggattgatttcattgtgtgatcataatctgtatctagatgaattattcgctttttttaacataaaacataaacaagacagttctagtatgttgctaagagaatcaggtatacaagctgattcgacgatagaatgcatagaatttaaaaatgtttcatttgcctacccagatcaaaaagaattggctctcagagatataagttttaaaatgaagcgtggtgaatctcttgctctagtgggcaggaatggatcagggaaaacaacagtgataaaacttttaatgggattatatggagattttaaaggggatattttaattaattctatctcgattcgaaattatcataaagaagtactttataaaaaaataggtgttatatttcaagattttgttcaattcgatttttcagtaagagaaaatataggttttggtagtatagaacatcttgaatttgatactaggatatggaaatcggcacaacatacaggagtagataaggtaatacgagatttgcctaatcaattagaacaacagctaggaagaaactttgaagggggtatacagctttcaggagggcagtggcaaaagatagctatatcgagagcgctcttcaaagatgctgacgtttacgtattagatgagcctagttcatttcttgatccagaatcagaaaaacaagtatttcgccaatttcaaaattttgttattgataggctttgcctctacatttctcatcgttatacctctgttctatatgcaggtaaaattttagttctggataaggggcagattatagaagaaggaactcaccaagaactaattgaaagtcgagggctttactatgatttattttctgatgaaattaatacattccaggaagcgctagttactaatgatacacgctaactgtgtatagggattctggcatatatttggactgtgaacagtattgttttttacctaaagaactagactaagtagaatatacaagtcagagtcacaagaacgacagtggagcttctctttggaagaggggctccgcttttttgctttacatggatatatttatatatgagttagacaatattgatgggataatgtacgaagttttcttttcagtctatagattcgagtcgttgtagccgtaaccgaaatattatatttgacagcgaggaagggtacaggcggcgtatattgcagtctgatcgggctattatgtgtatagtacaattaggagggtgctttcagacgaatgctatcgttcaaagaagcacctccgtttactctaatggaaatatgatcagcaggacaactattactatttagaaaagggttattcactcaataagtttgtttataaaacgaaatgtttagaaatacgtaaccaattgcttatcgtttattcttaatgttaataattttattaagtatttaataacaatgttgactatgataaatctggtgtgttatattaaaaccgtaaataaaacggcttcttagtcttggtggtacaacggattttattttcgcattcagagaggatggtttaggtggcagcagctgtaaaagcaaagatgatcgtagacaaatcttttcgtattgctgaagtcgataaacgcatttatggctcttttgtagagcatctcgggcgtgccgtatatggtggcatttacgagcctactcattcaaccagtgatgaaagcggtttccgaaatgatgttaaagagttggtaaaacagcttgatgttcctattatacgctatccgggaggcaactttgtatccggttacaattgggaggacggtgtcggccctgttgcgtccagacctagacagttggagctggcgtggagaacggtcgagccgaatgaagtgggtacgaatgaatttttcaagtgggccaaggatgtaggttccgaagtcatgatggcggttaatctgggtacgcgcggaattgatgctgcgcgtaatctggtggaatattgcaaccacacaggcggctcttactggagtgatctacgtcgtagtcatggtgtagagcaaccacataagattaaaacctggtgtcttggtaacgagatggatggcccatggcagattggtcacaagacagcagaagaatatggccgtctggctgttgaatctgcaaaagccatgaagctgattgatcctgacattgagcttgtatcctgtggcagctccagttccacaatgccgacgttcccggaatgggaagcaaccaccctggatcatacctatgaggtagcggactatatttccttgcaccaatactacggcaatcatgataatgatacggctaattatctggcacgctctatggatatggatcattttattcatacggtcatttcgacttgtgactatatcaaagcaaagaaacgcagcaagaagaaaatgatgctcagctttgacgaatggaacgtatggtaccactccaatgatgcggacaaaaaaattgatccgtggtctgtggcaccgccgcagcttgaggacatttataactttgaggatgcattgttggtaggtagcatgttgattacgttcctgcgccacgcggatcgtgtgaaaatggcttgcctcgcccaactggtcaacgttattgcgccgatcatgaccgagaataacggaaaggcgtggaagcaaacgattttctatccgtatttgcatgcctcccgttatggtcgtgggatatcgctgatgcctgtcgtggattcggaaaaatacgattccaaggacttcacagacattccttatctggatagcgctgtagtttatgatgaagagggagacgcactgactgtctttgcagtgaaccgtcatttgtctgaatcgctggagctgacagtagatgtacgcagttttgaaggctaccgcattgtcgagcatactgtattggagcatgatgatcttaaagcgaccaacagtccagctggtgaaaaagttacgcctcacaacggcggcaatgctaagcttgaagacggaattgtaaaagctcatttgggcaaagcttcgtggaacgttatccgtctcgctaagtctcattaattctcttctgtaaaaggtccagcttcgactgtatctaaataagctcgcatttctctcttgtaagagtattacaagagcggcaatgcgagctttttgcgtaaaatgagccatttgtccctccatagatataggtttctaagagaagggtggattttaaataaatattatgtttattactaaatttaactagacaaagatgatccttattcactaagtgctcgtactccgtacatttttatgaagttaattagacccagtgccagacttccaaggtgaaaaaagaccctattatatcgttgtcaacgtactgatatctgaaatgcagggtgtgcaatccgacttaaatccacgttatactttaaaagacagtttatttaaatccaaatggtggttgtagtatttcgagaaaggaatgatctgtatgagtcaaacagatgaatatcgttttcaagtgaacttgggcggtatgattgatattttggccaatcatttatatagcagtccacgagtgtttatacgtgaggttctgcaaaatgcaacagatgcgatcacggctcgcaaggagctgcggaaggttgctgctgaaagtaatgtattacaagaagacaaggcccttgaagatacagcttctgagagtaacgactatgagggtaaagtcatcgtggagttatctggttccggggagcatcaggtattgatgattcaggataacggcattggattgtcagaagaagacattcaccgttttttgtcgatcatcggtcagtcttccaagaagggagccgatttgctggcttctgaaacttcgtttatcggacgctttgggatcgggttactatcctgctttatggtgagcgatgaaattgtagtgctgacccgctcggtgaaggaaggcatctccatggaatggagagggaagccggatgggacgtatacaattcgtcgattggaaaccgagctgcctgtagggacgcaaatttatttgcgctgcaagccgggaagtgagttttattatgagccagcgcatgtagaggagtctttattctattatggggcgttgctgccgtatccggtcatgctgtctgtagatggggagacgaagcacgtcaatcttccctcgacgagctggatgcaggacccagaacaattacggagtcgccgtagtgaggtactggatttaggctatcgtctgatgggcgagcgcttcagtgattttataccgttgcggacggcatcgggcagaacaggcgggattgcattcattttgcctcgcagtgttaatctgaacagcaagcggctgcatcgggtgtacttgaagcatatgctggtgtcggacaaggcggaaaatgttttgccggaatgggcattcttcattaaaagtctgatttggacagatgaattgcaaccaacggcatcacgtgagtatttttatgaaaatgagcagcttgacgatgttcgttctgaactggggacctgtattcgggaagaactgctacgcatggcacagtatgagccagaccgcttgcagcactggattcgtttgcatgagctttccatgaaggcgctcgccgtggaggacgatgaatttttgcggataatgtaccgttggttttccttcgaaagtacatttgggcggcgtgagctgaaagaactgatccaagaggcggacggacgtccactgcattacacatcgacagtagatgagtatcgtcagattacgcatgtggcggcggcgcaatccatgttggtgatcaatggcggctatatttatgattcagacattttggaaaggctgcattggattgactctaacctgcaaacagagcgtcttagccctgaggaggtatctctttcatttaccgggctaacgcaggaagaacgcgagagttattacggtgtgctacgtgtcatggatgctgctttgcagccgatgcgttgccgcgctgagttgaagcgttttgagcctgcgagtttgccagtgttgtataccatttctcaggatgccctgaccttgcgctctatggaaaacacggttgaggagacaacctcacttttttccaatgtgcttgatagtctgaaagcaggagttcagcaaaattcgtgctattccaccttatactttaatctgaacaacccggtggtggcgcggattcttgaagctaccgatacgcagatggtcacagcagctacagaaatgatgtatgtgaatgcgcttatgatggggcattacccgatgaaccgcagtgagttgggactgatgaatcggagtgtgctgcattttatcaattggggattagggaacggacaaaatgcgtaattgcgtaattatagggggagccaaatggaagatacgatatatgaattgatggaacaggcgcaggatctgcccgggggtgcagcaaagctggcgattctggaagaagctgtccgcttggcagacacatccgggttgaaagaacttgcttatgaaatccggggagagattgtggactgcgctatttttaacggatatccattgaagtcgctgattgctttttcgtggcagctgggccaatttgatcaaaatccagaggaatacgacgcagatgagctgttgtggaattacaaatggatactcggtaaggtgtgcagcttttccaatatatcgaagactcaaatagaagatctggcggaagatatgcgcagacgttatgccgaatatgggtataatgagcgtccatattactattataagttccgcatcgcgatggacatgggtgaactggatgaagcacggcgatatctggataccttccgcttggtcgagcgggatagtatgagtgattgtgaggcctgcgagcagagccagatggtgcggttctattatttgaccggagaagacgagcaggcgcttgccgtggcaaaaccgattttgtcgggacggatgaaatgtgcagaagtaccgcatgtgacgctctcgcaggtgctgttgccgctctatcgtcaaggcgaggttgatcaggcaaaggacaatcatcgcaagggctatcgcctaattcgggatgaccgcgacttcctgaaaacgatagcggagcatatcgaatatttggcgattgctgatccgattcaaggaatcgaagtggtagagcgtcatctacatatggcgctggactatgagagcgggctggagcagatgtatttttacgcgacgatggtgagtctactgcaaaagttggatacttcgggagaaaaacggttgatccggttgccggcttccttggaatgggctagagaggatcgcacattggcagaaatcattgcgtattttaggccgctggcagagtcagcggcggctgattttgatcgacggaacgggaatacgttttatttcgattggatcgggaaaattgttcaaacggcatagaagaagtggtagctgtgacgaatattttatacagcccaaacaatgagcaggtataatgttcctgtgaaatgacaggaggggttatgttgtgactgtaaccgaaaaggtgattaatttcgcacaccgcggagcttcaggtgtatgtcccgagaatacgatggcggcattccgccacgccttggaactgggagcaacaggtatagaaacggatgtgcagcgcacccaagatgggcatctggtgctaattcacgatgagtcgctgaagcgtacgacaggttgctcactggatgtaaaggatattacgctagaagaattaaataaactggatgcgggcagctggtttgatgagaaattccgaggtgagcgggtcccgatgctggatgagctactggaactagcccagtcctcgaatacaattattaatttagagttgaaaaatagcatttatctctatcggggaatggaggaagaggtcattgctgccgtgaagcgttttgggttggaacagcgggtaatcatatccagcttcaatcacgaatcgctggcgctctgtgcgcagcttgctcctgaaatcaagacgggggcgctgtatatcgaaattatggttcgtccatcggagtatgccacccaattcggggttacagcacttcatgcctacaaacaagttgttacaccagaagctgtatcagaggctttggcattaggcgtcgtctaccacccatggacggtgaatgaaccggaagaaatgaagcgtctgctggaggccggggtgaacggcatcatcacggattatcctgatcggttggcgcatttgttggctgttcgctcttcctaagtcgaaacacacagcggaactgcgacttaggtttgcagggatatgactgtggctatttattgaagcaaaaaagactctcctgtacgcactcgtttttacgaggcgagggagagtcttttttgccctaagtcgaagagcgtatcatccacgatgaccttgattcctttctacttgatgccgagccgcatccgatagctgaacaggatatctagtgttctgccctgaaaatgattctctaccagcttcacgaagcgggctatatcgtcgtcaagcgctcgattgccaagtttgaagagactttgaatacccccttggctgagagcgagccctgtataacgagctgcgtcacactgctcacggttgtgaaagacaatctcccgggtatatcggaattgtccgctgcggtgcagattagctaaatgctgatccttgctccatttatgagcttgctgctctactggggcttcctgttccaaaagggtatccgctttggtgataagctctgtataagcttgctctatctgccactgcagcaccggaggccagtcacagtcaaaggccgcgaacacgccgccccgagccaagaccctgcccgcttcctgaagtgtgctctcggggtccatccagtgaaaggattgagagcaggtgatgacgtctacagttccgtcctcaaagggcaggttgttggagaatccgcttttgaaggaaatggttcctgccattgtcgttcctgctgtctccagcttgtgctgtgcttttcctctcatgtccgggttaggctcgataccgacgatttgccgagcggcgttttcccgtatgaaagttgaaagtcctgtaccgcagccaatatcggcaactagctctacgtttcgctccagatagcggctgatgatttccacgacgagtgacggcgcttccgggcggtgttgatcgtagttgtcggcaaaaccgttgaaacgatccacattactttgcagatttccctcagggatcataggtccttttcctccttagtttcgaccgggcggccgtgtagattcaaatgctgctgtactcctatattgtacaagtttacatattcatccatctactctcgtgatttcacagcacccgtcggatttcggagggaggaaattcccctattttatcattgaagcaagtgcccactcgcgcatcatggagtcaagcatcggacgcaaatcttcgcgttgcatacccatgtggagcacggcttccagatatccagctttatctccaatatcataacgtgtgccttccagctctaatgcgagcagttggttctgcaatgctacttgatgaagggcatctgtcaattggtattcaccgcccgctccagtggacaggttttccaatatagagaaaatggaaggctccaatacataccgaccaatgactgcctgccgcgaaggagcctctgccgaagaaggtttttcaacaagcccaccgacttcgtgaatgagaccgttctggtgagtggagtcaataatgccgtatttacttacatcctgttcttccactgtgcgcacgccgaccacttgcttgccagtcgcttcgtaaacatccatcatttgacgaatcgccggggtggaggaattcataatatcatcgcccagcaacacggcgaagggctcatcgccaatgaactgacgagcgcagctgaccgcatgtcccaggccgaggggttctttttgacggatatagtgaatgactgctttgcccccgatgctttgaacttcacgtaggagatcgtattttcctttgctctccagtacctgctccaactccacagacttgtcaaaatgatcctcgatggcttttttattacgccccgttacgataatgatgctctcaattccggacttgatggcttcttctacgatatattgaatagctggcttgtctacgattggaagcatctctttcggtaaagctttcgtagctggtagaaaacgggttcctaatccggcggctggaataacagcttttgtaatttttctcatagaaactcactttcctttcgggatggggaaccgaatacccagtatcggctcccgatataattgatgatcattccggctgcggtggcaatcagcttgcctaaagcaagtggcaactcggttccagtgtgaagcacctggagtaataaggaggttacccccaatacgatgaggttgatgacgataaatttaggtaattgacgcttattagtgtcgtttgatagttgtttgttgaatgtccatttgctgttcaaaatataactgttagctgtgccgcagctgtacgaaatgatctgcgccacaatgaccggtaccccgacccaagccaacagcataaaaatgatataatctacacccgtattcaccagacctacgataccaaatcggatcataggaagcagctgggccatgcgacttttcatgggttaggctccatgaccggatttaggtccggtatataccgcactgttgccgcgcactgtgcgtcctgccgaaatcaggctatcacggactccttgcatgtacagggattcacggggttcagggactttcatagcatgtgtcggaccgttttcgtattgtccacccagatgctcacggacaatgtaaagcggacgtgctttggtttcgtcataaatccgtccaacatattcacccataataccgagaatgatcaggatcaccccgtcgaagatcaggctgatgctaatcatagacgaccagcccttcattacataggagtcggtgaaaaagttgagaaacagtacgtacatcagatacaggaagccggacatggatagaagtgcaccgatataccctgccagcttaagcggtttaatcgaaaaggatgtgatcccgtccagactgagcttgatcattcgtttcaacggatacttggtttcgcctgcgagtcgctcgtcacgctcatattctacagcagtttgtttgaacccgatccagctgaccagtccacgaacgaatctgttattttccggcagccgtttcaattcttctatgaccttgcgatccattaggcggaagtccccggtgtcgactgggatattaatatccgttgatgctttaagtacacggtagaagaggctggcagaccattttttgaagcgagtttcgccattgcgtttgagccgtttggcgtagaccacttcatagccttccttccacttgttagccatctcaacaatcagttccggcgggtcctggaggtcagcgtcaatgactacgaccgcctctcccaccgcataatccatcccggcggtaatcgctagctgatgaccaaaattgcgagagaaatcaatcaatacaatggtgtcatctctgagactgaattccttgatcaattggacgctacggtccgaacttccatcatttacgaagatcagctcgtagggctcacccattgagcccatgacttgtttcagtctccggtaggtttccgtaataacggcttcctcgttgtacatcggaataactatggaataacggatgggttcactcattcgtagttcctcctcatttataatgtgatttcgtataaagtaccgcttccgccacgttcgtctccgccagggccaccttgaccatcctgggcgtttgcattgctgtttgtggtgtcgcttccgctctcggtagctttaacgtctgtacttgttgcacctgttgttgttttccattcatctgtagggatcactctgccgtgttctttgatccatgcagtgacttcagagttaccgccgtccggtccgccgcctccaccagaaatcatgaagtacttcacttggccgctttcgaccagcgccttgattttatcgacggtatagactggatcggaagatacaaaaccattcataataattactttttgtccggcctcgaccaggtaaggagcagccgttgaataattacttgctgcgaaaaggtaggtttcacctgtgttgtttttttgcaaatagctcaacgttttttgatctaaactttggctgccgtttggtcctcccatccctctagagcgggtagaagatttttgttccgtgtctgtacttgtttgtgtgcttgaagtatttccatcaggactggaattctctacattattggtctggttattcgtttgaattccttcggcttgttgtccattagcgctctggcctctattgcgatcattgccacccggcattcccccaccaccgccgccaaattgagtcggtccggcttgtggaatcatgctgttccccccgtagacgatcggtgtcaatgcccagtacacagggccgataaacatagcgagtacacttgcaatgatggcgaatcttgtgaacttctcagatttcattcgtgctactaccaatagcagcgtgccgatgatccctaggatcaataccgcgatggaccagccgctaccaatggtatcgttgtaattttgcaaaacaaaccagctaaataccgaggttgccaatactgcggcgggtaacagccaggagagccagttggaacgctcacgatactgcttccacaattctacgaatcctgctccaaagagcgctgcaattggtggtgcgagcataatcaggtaataatgatgaaagaatcctgctacgctgaaaaatgcagctacgggaatcaaccaggccagccagaagatgacctctttgtgcttttgtgtgatattacgacgtcgaatgcttgcaagcagaccgatggaagcaatcaatgcgaatggaagcagccagctggcttgacctgacagggaagattggaacaaccgcaaaggtcctttttcgccagtgccgaacatgccaccaccggaatttcctcccggtccaccgcctggtccactctggccaccttgcccatctccagaaccactttgtccgttgccgccaaatccacccggtggcatttgaccacctgcaccgaatccgcctgttgccatgttgttggcaccagggtcatccgtagtggtagtgctgtccgatgatgtagtcgtctgagcttgatctgtgttcgtattgctgctattcgttgtagcgatattgtcccgatctgtgcgttcaccgccacgagtgccacctgtaccctgatctcctgtcaaacgggacaggccgttataaccaaaggccaaattcagcacagaattggtaccgctacttcccatataagggcgttcatctgccggagtggagtccactacgactgcccaggagagcgatacgatcaggaggacaactgctgatcctaccagtgttactgcttttcgcttccagttaaacttggaggccagcagatagaacagtcccaaagcgggaacgatcatataggcttgtagcattttttcattaaaggcgatgcccacgactgcgaaagcagcaaggatcagcccggttttgctatttctaatgcctctgaacaatagccatgtcgcgagcaatagtgtgaaaaccaacatagcgtcgatgttattcgtgcggctaaccgctacggctatcggtgtcgttgccatggcgaaggcggccaatcgtgcggccatcgtaccgaagctcggtttgacgagcaagtaaacgagcaagaccgatccgacctgagctagcgcctgtggcaagataacgctccatccgtgaagcccaaatatataggcgctcagtgtctgaatccagaacaccacaggcggtttgtctaccgttactgatccggcagaatcaagtgaggcgaaaaagaagttgtgaaagctctgtagcatgcttgctacggccgtcgtatagtaggtgtttacatatttgtcttgccagatgttgtatccgttcaaaaatgcggatatcagcataatgatgatcagggggatgtccgccctggtcttaaaccatttcttaatcatgttcattccactccctgtgaaaattctttgtatttattccgttgttctagccgctatcttcaggactgcggaatgaccagtcgcttctgatcttggcccggtgaactaccggcttgctattatcatgtcatacgtaccttaatgggttctgagcgctccctgaacgttagctgaaagctgagcagaggtgctttttttgcgacaggattcaggtatattagatacaggtaaaaaatgaaccgacttttttatgagaaaaatgcggcaacatgaaagggaagattaaataatgaatccaatacacggagttaaaattatgctggcagatgatgagcctcatattttgcaatttttagagcttggactgattaatgaaggatacgaagtcagaaccgccgagaacgggagtgaagcgctcgatttgacaagagagtttcgtccgcatgtagcggtgctggatgtgatgatgccggaaatgaacggttttgaggtgtgccaaagtctcaaggagacggaggataacatcgcggttattatgctgaccgccaaggatgatgtagacgatcgggtaaagggtttgaaaatcggcgcggatgattatgtcgtgaagcccttcagttttaatgagttgctggctcgcattgaagcgcgcttgcgcaatcagttccccgatctgctgggcgaagtggttcacggaccctttcaagtggatgatcgacggaaggaaattcgttatcagagtcaggtgctggagctgtcgcctaccgaatatgaactattgaagtttctggtgctaaaccacgggattgtgctgagtaaaagtcgtatactggaccgggtatgggggtacgattttgggggcgaggataatattgttgaagtgtacatccgctccttacgtgaaaaactcaaagacaaggagcaccgggtcattcgtacgctgcgcggtgtgggataccgggtggatctgctatgaaggcgggagggaaaagtcggaggaaatatgcgctccgttctctccgatcccagcttttagccagaacgttactcattttggctttactgctcgtattaattggttttctacaatattttctgatgaaagattttctgtatcgcagtcgggcagaagctatggatacgcagctgaattcaattcctgccgatttattgattaaggattcacaggagcagagtggggtaaccgctccccaagaacaaaccaatcggaggaataatcgaccggggccgtttttgttctggccggatatgtcgctcgcttctatagatatagatggcaccttccagagcttgtccaacgaaaacgggcttaagccgccacgtctcaccattgagcaatatcatgcgatgcagcagagcaaacgtatgcgtcacggctatcaattaatcacggatgctcaggggaaagagcaactggttgtattccgtccgctcggtccacctgaccgttcgtccggtttacttcaaatgggcgtatccacgaattctatgcaagagcagttgattaaccagctccgcacctttattttattgtcactgattgcgcttgcgattgggttggcgcttatgcttcctgtgctgcgacgcacgttggtccccctttccaggatggtcgaggcagtcaaacgtattgatgcgggcaatctggccgagcgctttgacgcagagcaggggcagtatgaggtggatcgtttggcagtttcatttaacgggatgctggaacggttggagcattcgtttgctgccgaacgggaattgcagatgcagatgagacgatttattgcggatgcttcccatgaactgcgcaccccgctcacatctattcacggtttcttggaagtgctgcttcgtggagcagcatctaatccgaagcagcttcaatcggcactagaaagtatgtacggtgaatccaagcggatgaataaactggtctctgatttactattgttggctaagctcgaccgaacaccggagttgaagctggaagatatatcgctagatgcattgctgctggaaatgaagccgcagctccttatgctggcaggcacacgtaaggtagtttttgatatgacggcaggtatacgggtgttggcagagggggataaaatcaagcaggtagtgctcaacctgtttcacaatgctgttcagcatactgatatggaaagaggtgtgatccaggtaaacctgtctgcaggtaagaagttgttggatatccaaattcgtgataacggaccaggcatgagtaaagaacagctggagaggatatttgagcgtttttatcgtggagatgaatcgcgtacacgtagctcaggcggggcgggccttggtctggccattacactgtctatcgtggaagcacatggcgggagcattacggctgaaagcacaccgggaacgggaagtgtgttcaaagttacgctacctttagcgggaacagtatagtttttaagattatggcgtaacataaaaatagccccccgaaccgcagctttggttataacacggctcgggaggcttttctattgttagttaatcagcgaagctttttgtaagagcacatgcagcaccttggcggatgcctcacgggttgtaggtgcattcggctggaagtaggaggagcctttaatcgctgctccgttgataatacctgctgcacttactttttcaatactgtccttggcatagcctgcaaaggatgaagcatcatggtacggtgtgcgtgcaggaccatcgactgctgctttgatttgaagcagatctacagctttacccagcacgacagcaatttcttgacgactgatattagcgttcggatcaaacttgtcgctgctgcgacccgtaatcaaaccagcttcataagcggctgctacatcgccggagtaccagctacctgccgggatatcactgaatggtgcagcagtacccggtgtcaggccgagtgctcgggttaccagggctgaaaattctgcacgtgtcacgttctttttcggtgagaaagttgtgtcagtcgtgccgttaatcagcaacttgttcgctagcgattgaatttccgattgggcatacgacgatgaaatatcttcaaagctaacgggacgtgtcgccgctgcatacgtcgagaagcccggacggcttaccttgacgacggtagatccatcagcctgcttggtgaagacggatggaaggggatagacatttccgtttgccgtataaagtacaccggctgtattggaatcaatttgaccaggtaaggtaaaggatctgctaataaactgtcctggagcaactttgagtgattgactcttgccaccagtgacaacattagcttcaaaccctaccggggtgccgatcacattggagcctttcagcttacttgtaaaagtgctgctcgcctctgtctggctgctgattaccacttcaatgcctgcaccagcaggaacatttttcagagcggatactggcaaagccatagaagagcctgtattgcttacaatcaagctgcttcctgctgaagccttgcccaacgttaccagttgtgtggaagtgagcgataccttcgtcgtttggcctgcttggctagtagccgacagtacaatagctgtcgggctggaacctgctgctgtcacggcagcctgcaaatctgcatcggttactgtcagcgactgtacattattgttcaatgcaacggctgtagtgatagttttaacagcctgtccttgtttcacaacgctttgaagtgaaggtgcagatgtagggacaggagtggatgtgttcgttgtagcagaaggtgtagtattgcttctgccgccacctccaccacctccgcctccaccactaccgctagatgcggcgctattatccacgcgaatagctttagtggcggtgaagagtttaggacctttagtagtactctcgacttcgccttttgcattcagctccggagcgctgacttccagcttgtatacgccgtccttcaaatgctgaatcacgggctgaccgttagcatccagaacagagtttcccttgtcatctaattcgacgtaacttccgtcaatgcccttaaaggagtagacgccttgtttgaggcgtgcattgtcaccttgttccttggaggtcgtaattccatcgattagaccgattaacttgtcatctacgccgtacacatagagcgcgatcaggttcgttttatccgtagtcaggcggaatgccaaatctgttgagcgttgagcacctgtacgactcggataaataattgggttggtgacactcaagtcctgcaagccaaagccagttgtagggttttctttgccgacatgaacgacgaacggcagatgaagcgttggcagtccggcgcttttcagaataacttccccttcatatacacctgtggctgcacccgaatttggttgtacagacaggaagaacggttgcgatttacccggttctgccgagattgctccattcgcgccgacaccttgcaactgaacggcaatgttgctcacgtcaggtgtagcaatcggttgagttggatcagaagttacattatcatgtaaaacggtgctggcttcatattgcacagtgttagctgacaagtttttgagttgaagctgaatctgcttagcatcactaccaggtcgtaacaccccgaagctggcagaaggattataattcacaacctcctgccgattaaagtttttgtcgagaatcgtaatcttttcgacggtttccagcagggctggcgtctgaatcgcattagcgatgtttacaaggcctgcaccttgggaatacacatcatattggattttatcctcatcaaagagtgtaaccgaagtgtttgccagagcagcgcggatatcaaacggtgtccagtttggatgctgttgcttcagcagcacagcaagtccagccacatgtggagacgccatacttgtaccgttgctacgtttgtaagcctgctcatacgatgcatctggatagaacttggcgaaagcagggtaggttgataaaatgccaacacctggtgcgctcacgtccggtttgatactgagcagttcatctccgttcggtccgcgggagctgaaatcggccatggtattacctgcattatctgtgcgaatatagtctgctccaaaggaaactgagaacttttctccagcgttgtctacgatttgtttagccagtgcacggccttccttacctttcatgtcaaaggttggaataaagtcaaagctgtcacccaaattggaattaacatagtcatcgcgacctgaaatactttcccctaaatcagctttggtgatgtcgcccgctttcgtattcccattaaaaacgataacagccttcgcgccgttttttttcgcatttgtgattttatccacgaatgccaagttgccgcgtgaaacgaggacgatttttcctgctacgtctttcccttcaaaatcatcaggttgtcccagattcgcatatacgagctcataaggggcagttcccaaaatggaggcaaagtcttctctgcctgtctcccagcccatcaaattgaaatcataatgtgcataagcatcattagttacggtctttttcaattcaccgttagcctcccaataggtgtcacgggtgaccgaagctgtacccgagaagcttttgctcggcgaagtagctgcaccgacggaaatcgccagctgtgatgttgcgggagaacccatggaataaaaataggggccttcctgtgccgcattaccattcgctatgaccgcgactacgccggaaagtacagcattattaatagcaatggaatctggggagttcgggtccttttcggaatcagagcccagcgacaggttaatgacgttcataccatctttgacagcgcgttcaatgccatcaatgacctgtgcggaggaaccggaggaacgacccgtcttggtattgcgtccaagcactttatacacgtataagtccgatttataggcaatacccttttgtacaatatctgaggatttatttgcggctttaccggcaatcgtgccggagacgtgagtaccatgtgtcgttccgctaaaacctgtgccatatgggtcattctctttttcaaggaacggttcctcgtaagggtcgttgtcctgttcaaaagagtcatatccgcctttataggcttctttcaaatccggatgctcataatcgataccggtatcaataaccccgaccttgattccctcgccattcaatcctttggcccaggcttcaggaacaccaatctggtccagcggtgcgttatcataagtggcttcactggctgtaagtgttggcgggtcctgtacggggatggaataatacgttttgttttcatgaatggattttacgcctggcagtttagccagtgctggaatcttattggccggcaatgtgacctccaagccgttaagcaccgtgttgtactggtaattcacctggagagaaataccatgctcagcggcttggtccacgaacgtagtttgctcggtggcaatcgcggattccgctttttgctcagattgagctgtgaaagcttggacgcctgaacgtgccgcatatttgtccacggctaagggctcaccatcaagttgtacgatgactctgacctggcgggaagagtctgtgcttagctctggcgaaatgaaggccggagccgcctcaatagtcaatgcttgctgagcttccaaaaatgagttgagttgtagatctgcggtagcagcagaactgacagacggcagagacaagcttaccgtcaaggcaagagcgagtgatacgacaggtatttttttcaaaatgatcggctttttcaaagatttccctcttttcaatcaaaatatgatatgtctacatactaggatttgaagccactgccgttgttctcacgcctcccttaatatctaaaataatagaattgaccactggtgactaacttgccagttttgaggcatatcttaccatattggtgggatatattactatatgttttttatatttttagaaaaaataagggtaacattacatgtagattccatggaaatgttatgaatttactagattatttttgaaaacaatcaaaggggaatgggagaatgcgagatttaatgatataatctgcattggaattgttgaggtttcacaatcatgtaaaatgcctaaggcaaaggagtcgattatgttggcaaaaacgttgattttcgggcataaaaatccggatacggataccatttgctcagctattgcttatgcagacttaaaaaccaaactaggcgcggacgtagagccggttcgtctgggcgaggtgaacggggaaacgcagtatgcactggattatttcaaagtgagtgcgccacgtctggttgagcaggttgctgctgaaacggacaacgtcattctggtcgatcataatgaacgccagcaaagcgccgctgatattgacaaggtacgtgtaactgaagtcatcgaccatcaccggatcgctaactttgaaacaagccagccgttatacttccgcgctgaaccggtgggttgcacagccaccattttgaacaagctctacaaggaaaatggtatagcgattccgaaagaaatcgcaggtctaatgttgtccgcgattatttccgattccctgttatttaaatccccaacctgcacggatcaagacgtagctgctgctcgtgaactggctgaaattgctggtgtagatgcagatcgttacggttttgacttgcttaaagcgggagctgatttgagtggtcataccattgaacagttagtaagtctggatgccaaagaatttcagatgaatggtcgcaaagtggaaattgctcaagtgaacgcagtagacgtcaacgatgtgctatcgcgtcaagctgacctagaagctgcattatcccaaaccattgaggccaaaaatctcgatctgttcctgttcgttgtaacagacatcgtgaacagtgattccattggtattgccctgggaagccaagcacaagcggttgagaaagcctataatgttcagttggacgacaataaggctgttctaaaaggcgttgtatcgcgcaagtcgcaaattgtgcctgtattgactgacgcttttaacagtttgtaatgataaataataagcctcctgagcccgactgcataatggcagtggaagcaggaggcttatttttatttcttcagttctgccaggacatctccgatgcggaattcaaatgccaatttcaactgatcgctcatcaggtgccagacgttttcagctacagcgagatcaccgctatgagtaaaggcatgtgcggcacccatgtattttttatacttcacggggacatctgcttcaatcagccgtttggcatacaactcggcttcgtcagccaaggagtccaactccgcggttatgatcagagcaggagggagattatgtagtgattctgcaaaaatgggggaaaccaacggatttcgcgcctcatctggtgagttcagataactttcattaaagatttttgctactcgtggcggaatccccttctcgaattggggcttcaatttgggatctgtagcaatatccagtggtgggtaatccagtacctgatatacaatcggaaattccttgcgctcccgggccataagacacagcgccgccgctagattgccacccgcactgtgccccccgaccgcaatgcgttgaggatctacgttaagcacatcaggatgcttgtacaaccattgggtcacctcatagctttcctgtagcgggatagggaatttatattctggggccaagcgataatcgacattaacgacgacgcaattggcacgttcagcaatgaccgggcaccagggatcatccatctcggcgctacccattacaaaaccgctgccatggaaattaacgaatacagggagtggatcagcagaccggtgagaaggttcatatacaatcaccctagagtcaccaatagaggtggggatgatcctttctttccgatgtactttgggagaatgcgaaggtttgaaatcggacgcagctaccattctgccagccgatatgcgggcaagtttgacgaacagtttttgtctcagtcttcgcaccatttttctctctcctctctggagtcggttagacgcgaacctttaacatcttcaaacgcagaacgtacgcgtgacaaataggtttggaactgacagatttccgactcactaaagtctgacatcagacgtgaagccagccctacgaaaaacggatccatctgttgaattttacttcttcctttatcgttcagggacacgaacactccccgcttgtcattgggatcgtcatatttattaatgaatccctcttgttcgagagaaataaccatagaactgattgctgcccggcttacacccatcttatcagccaaagcagaaggagatgacatttcatctctttgcgctgaaagtacacaaagcgcaatatattgcccgtaggagagaccaaattcacgtgaacgtttttccatatttttgcgtatttcatacgttatggaaaataaatctaccaaaacaccaatcggtttattgccacctggaaagagattataggccagttgacgaatttcggagtccaaaaaaaagaacatgcgatccacctcgatgtagttaattagttaactgtaatttaattaaccactggttgcaatgatttatacaaactttgttctgcattttttaaaaaatatatctgcaaaacgtcatatccaggggccgatacactgatcgaggccctgattcacaaaggcttgtatggagggctggcgcagggtacgtccttcttgccatcgccactcactatattgaaccttggcggtaaacataggttgtacccaaaatgcgtcttgatgccgatccggtctattgctaaaaggtcgctccgatatggtatgtggcagcaggcgctcggtaagctgacgccaatcttcccgagtcagcttacccgtacccacatgcccgatatagcgcagcattccttgtttatcatattggcccagcaacacagcgttgataatgcctccgtttagggtatagccaccgataacggcaatgatatcgccataatttttgaccttgacccatcgtccgtcttttccgcccaatgtgtacggactatccagctttttacacacaatgccttccattccttggctgcacatgacctgaaatagagcttgtccatcaggatgagcgggagccagttgaatccgttcattcggtatgatgatctgatgcagcagttcaagcctttcctgtaacggtttaagatgaacccactccccgttcagataaacaatatcaaacaacatgtaagtagcgggtacagcttcataggcggactgaattcgatccgttcgacgaatcagatcccttcgcataatttcatggaacgatggcttaccgtcggcaccgagtgcgatcatttccccgtccaatatgaccgaatcagctttacagtaggaggggaagagagcaagctccgggtataaaagcgttcgttcgtgctgtttgcggttgaacagacgcgtgctgccctggtcgtgatacgtcaaaattctcgtaccgtcccattttatttcgtaacgccaaaggcctgttgcatctacaggtactttttcgctcagttccggttcaaacgggatgacaggttttaattccgtacgcaacgcagcacctcccttgcctttattggaataaatatagtgtcgacgatagatcttattttatgtatgtgatgtttcgctgattcctaaataggggaatgataaggatatcttgcgtcggcatgaagtgattgcagtaattcgttagcatggaattgtaagggatgttcttcagtcagaaaggagattggtttcatgagacaaattcgcgaggaggaccatgcagtagtcatggtggatgatgggcaggtagttgcagaagtaggctataaatccatagatgaccactcattggtcattgaccatacatttgtatccgagcagttacggggtcaaaaaatcggcaaggagcttattgaccgagtggttgatatggcaaggaatgagcataaaaaggttattcctgcttgctcgtacgcgcttgctctattcaagcgccatcaggaatacagtgacgtatggcagcaatgaatatggatcatcaaggctgcttaattgcataatcgatacaacaccggagcgggtaatcagaccttcccggtgttttttgtgtgcataaagcttgtaaaatcaatgcattctaccgttgatatagggaagtaaagggctattctcaaatgttaaatcatattttccgacagatggctatgaaattgttcatactgttgtcacttcacaggctgtccatgagttctatataatatattatggttatgactacaacagtaacgaaaacctgaatttaacgaaggagacgctcatgatgaataaagcgagtgaggacaagcagtacgttccaacgagcaatcgtaattttacagccttgattatcaccgtttccataatagccaacgtgattattttgctgctgttcttttcgccgatcggataccagggtagtgtgagttttgatctcaccattttcccaaggctgaatgcgatttttaacagcttcacatttatttttctggtggctgcactggttgctattttcaaaaagaacattaagcttcataaaacctttgttttgctggccttcgccagtaccgttttatttttattttcctatctgacctttcactacatttcgccggaaactgcaaaatatggtggggtgggtatccttcggccgatttactttacgctgttgatttcgcatagcatactggctgcgattattgtaccgctggccctgttcacagttgtatggggatggacgatgcaggtagcaaaacatcgtaagattgcacgctggacgatgccgatttggctatatgtgagcttgactggtgtactggtgtacgttttcatggccccatactattaatagattaaaccctttgcgggttgatttagggaaatggcgtctctgctgaagagacgtcttttttgtatccaataaaagaaaaattattccttctaaatttattttattgaaaaaacgttccttctttagcggcatttctgctataatttgccttaatcaactaagaacaagggggtcaccatgtgacaaagaaagcgaaaggcaggttacgcttgcttgtatctatgctagcgctggttgtactgctgagcagctgcggtggtggaggatcaaagtcggaaaaggttgacggagggaaagtaacactgcaattttggaccattgcactacaacctacatttaccccgtatttcaatcgggtgattgccgattatgagcagaagaaccccaatgtcaaaattgactggaaggattacccttatgacgcagtaaccaacaagctgttgacaagtatcgctagcaacagcagtccagatgtagtcaatctcaatacagaatttgctagtcaaatgggcaccaagggtgctgttgttgatatgaatgagcatttgtcgcctgaggaaaaggctgcttatttcgagggtatttataattctacagttattaacggtaaagcttatgcgctaccctggtataccggtacagaagtgctttacatgaatacaaagctggtcaaagctgccggattggaccctgcccatccgcccaaaacccgggaggaattgtctgaatggggccgtcagatcaatagaaaaattggcaaggcaggctatgctcagcagcttgtatccaagcttttcgctgtggacggcattcctatcctaaataaagaaaagacagcagcggcgttcaacacaccagaaacagtcactatgattgataatctaaaaaaacagatggaagatggcattgtactcaaggaagacgctgaattctcacaacaagtgaaatattatgccggcgagcaggttgctttcgagctggcaggcccgacgttcatcaattttatcaaaacggcagcgccggatgtttataagaacacaattgctgtccctgtcccaaccggcaaagccgatgtgcggctctccaactccatggacctggtcgtacctgctaagtctgcacatgtggacgaagcggtgaaatttgctgttttcttgacaaacgcagagagtcaaacagctttttctaaagcggcgaatacactaccttccacgaaagactccattaaagatccatattttactcagtctgacaaatcattagaagcacaagccaaggtagtatccgcgcaaagcttggataaggcgacagattatatggtcggtgtgcctaatgccaaagatgtgaacagtgccatcgcgcgagctttacaaaatatggtattaaatggcgcggatacgaagcagacgcttactgccttggagcaggaagtgaacgatattttaaagcaataggtttgacaggggagtaagtgaatactcccctgttcatttatcaaaatcaggtggtgatgcagcatgatcaaatggttgaggtcggagtcctttacggcctgggcctttatgacgccgggactgttattgcttgccgtctttgtattttggcctattatttacagcattccgctggcattgacggactactctgtcatatcagacacccattttgtcggcttggataattttgaagcggcgtttaaggaccgtaactttcttatttcgatttggaactcattgttgtacgtgctcattgtcccctttcttcaaattttctccatcctgatggctgtgcttgtgaatagccgtatcccgggaattaaaatatttcgtacgacctactacatccctgttgtgacttcgatggtagcggtagccttaatttggagctggctgttgggcaataacagcatagtgaactacttgctcatgcaggtcggcttgattagcaaagacatacactggttatcggacagcaacttggctttgtatgtactaatgttcatcacaatgtggaagggactcgggtattatatgatgctctatctggctggattacaaaatattccccaagatctgtacgaagccgctagagtcgacggagcaagccgatggcgtctgattgtccatattactcttccgctgctgagaccctacgttctgttctgtacccttatatcgctcatgtcagctattcgcgtatttgatgaagtatatgtactaaccaagggtgggccgggaacggccacgttgacatccagcttgtatatttttcaaaagggcatggagcagtttaattttggatatgcttccgcgcttggcttaattgtcggtgcaatgattgccgtacttagtattatcgtattccgattcaataggaaaggcggtgtcaatccctattgatgaatctaaaggatgacaaaatgctacgctcatctcttcctaaaaaggaaagcagccgcatcatgcgcagtcttgctcgaatgctgagaatgacggtcatctacgtgcttctagtgctactcgccctctttttaatgggaccgttcctatggctgctcagcgtatccctcatgccaggccgcaacattttttcaacgccacccgctatttttccgacctttattgatttcgacaactacgttcaggtgtggcagttcatgaattttccaaagtatatgctgaatacggtcatcattacggtgttgggcgttgtgctcaatgtggtgctcgccagtctgacaggatatcccttggctgtatttcgttttaagggtaaaaatctggtgtttacgctgctgattgccacgatgattattccttcctacaccgcatttattgtgcattatctgaccattcaagggcttcatctaggcaatacctatttaggtgtggtgttgcctggggcagtctccgttttcaacatttttctaatgcgacagacgtttatccatattcctaccgatgtgcgtgattccggtaaaatggacggcgcttcggagttccgaatttggtggcagctggtgcttccgctggtcaagccagcgctggctgtaatctctctattggaggcgatgtcgttctggaatagctttctgtggcctatcgttattttgaacgatacggagctatatccgctggcagctgcgctcacgtatctcaacggtcaatttgcctataacttcggctggattgctgcaggcacaatgatttcggtactgccgatcattatattgttcctgtttacacagcgctactatatggaaggtctggcgggagcggtaaaaggataagccagtagttacggctacgaagagcctgtgaagggaaggagacgattgcgatgaaattgtccaaaggaatggggcctcattcaggtgtagggctatcacggcaggagatacaatattattttcgtgatgtgtatgacagcggggaaaggctggttatctccgaaccgcgactgatctgtgaactgtcctctcgctttgcaatgaatcaggagtatgaaggtgtgctggaccctgagggaccgatcaagctcattgcacctccaggaccgggtgtaccgactgaaacacggggaagcgtacagttggcgctcgaatatgacggaacgcttgctgcagacggatatcggttggacattcagaaggacgggcggattgaaatccacgcttccaataaaagagggctcaaatacggcatggatgccctgcatctcctgcttcagttggaacaggagcgatgtgctctgccggtgatgtctattcgggatgagccttcctttccggtccgaggaattattgaaggcttctatgggaaaccgtggagtttcgcggatcggctggatgccgtccgttttatggctacgcaccggatgaacacgttcatgtatgcccccaaggatgatccatatcatcgtgagctatggagagaaccgtaccctgaggatacgtttgaccagattcgcgaattaaaggaagcctgcgaacggcatgagattgattttcattattgtatcagcccagggaacgacctgagctttggcagcgatgaagatttcctcaaattgacggaaaagctggcggccgtgattaagattggcgtacgtcatttttctgtattaatggatgacattgactatgtactcaaaggggaaaatcgacatttgctgggccgctcgggtcacgctcatgtctttttgacgaacaaggtgcatgcatggttggctgaacgactgcctgaatttacgctgacggtctgtccttcggaatattggtcatattgggataccgaatacaaaaaggatttccgtgagcggctgcatccggagattaaggtgttctggacggggtactttgtttttgctccacagattagtcgcgagcacgccgctgataatcatgcatactttgggcatgagctgtggctgtgggataacatcccggtgaatgattgtgaccatgatcggttattccttgatccgctacgcggacgatactccagactaccggactgcggacataccggtatggtggctaacccgatgaatcagtgggaatgctccaaagtgacgctcatcacgatgtcccactacatgtggaacagtgaacggtatatgcctgagctatcttgggaatgggctgcgcgggagttagcgggagagcgtgcggatgaactgatgtttttctgtcgtcaaaataggaacagccgactaggcggcaacacgtatgaggacgtggaccttgctttgaaaatgcgcgatatccctgcgctggatatgtactttgagcggctgcttcaggcggtgagcgtcctacggaacgtgcctgccgatgatctagccgcagggttcgtgtcccaggccgcgccgtggctggaacgtgccgagctggacgcgggcctgtggcaggtgctgcgtcaagctgcgctcagcagcgagcgacaggacgatgcacagtcggaggagagcagcacgccgagcgaagaaattgacgggccagagccgtcgcctctgacggacgaaatcgcaggagaactgcgacgcggtatcactgcttgcttagaagcggaggctcggctgggtagcaatccggcgatccgagctgccgcgcagtggggttatgtcgatcaggatgaacaaggcaaatatcggctgatcttgtaagtgtctgcgatggattaagaaaccaaggcagcatagctgccctgaaaataatcatttgccgttaggataacggtaattttcaggagaggtggaatgtacggtgaagtcaaacacccgattactttttataccgctggatgagcggccctgtaattatcaatttccttatttactggcacaaggcacagacttggaaatggagcggcccccattagaatggatgggacaaaagaaaacccctggcgatacgaccagactatgggcatggctcgaagaacgcgcagcgactgctgatggagccattgttgcgatggatacgttgctgtacggaggaatcgtaccttctcgactacacggtatgtcgagcgagcaggtcagagatagagtgaatcggcttcgcaagctaaagcagctatatccgcaactgactctgtatgcatttcaactgattatgcgttgtccgcaatactctttggctgatgaagaaccggattactatgccgattggggtcgtgagatattcagaaagggcttcattgagcatcgtcaggagctggggatcgctaccgcagaagagttgcttgaattagttgatattaacgagcgtttgccaatggaaatactggatgattacttggggcgtcgccatgtgaatttggaggccaatgaagttgcattggatctcgtagcagaaggtatcattaattttatgatcatcccacaggatgattcggctccctacggctataccgccaaggatcagcagcggctaagaagtcgtatttctgagcttgggctggatttgaatgtatacatgtacccgggggcagatgaagtgggttgtacgctgctggctcgttgggttaacaagatgaataatgtagtcccactggtgtatcctcgattgtctgctttgcagggggcattcgtagttccgctttttgaagatcgctatttttacgaaaccttaaaatatcagattatggcggcaggtgggctaatagcttcctcagcaatggaggctgatttgattttgttggctaacacacccggtgacacgatggcagaagcttcatcccagcagcgtgcaatgaccggatatgatgtacatcggaatgtagtagagctggttgagtacggttcttatatgctgcaatatgtaggtcaaaatgttgcagttgctgatgtgggctacgccaacggcgcagatctcaagctaattagactattaaagcaaaaaggactgctttttaagctggcgggttatgcaggctggaataccagttctaacacgctgggcaccgtcattgcccagtccatgctgtatacccactatggctctacggaggaacatttggattttctgtcgctgcgctacaccgaggatgcctgttattgcgctgtggtacgtacggctatgaataacgggattgtggagcagatgggttttaccaagtttatgctcgatggaccgagaggctcggttgctgcggttattcgcagacggctggagcaggcgctcaatgaatatgtgaacgggccggaaggccgcgtggaaattacagattgctacatgccgtggaaccgcacctttgaagtcggattaaccgtacggcatcatgccgagaagagagggtgattcctatgggaatggaaggtgtgttatccaaagttcagcacggactgatcgtatcctgtcaggcgctgccaggcgaaccgttgcatggagcagattctatggtcaaaatggcgcttgccgcacagcagggtggagctgtagcgattcgcgccaatggcgcatcggatgtacgtgcgattaaactggcgatttctctaccagtcattggcttgattaagcgggattatgatgattctgatatttacattacgcctacccttcgtgaaatggaggaactggtagaggcaggcgcggatatcattgcgctggatgccacattacgaccgcgcccagcgggatgcaagctgaagaggctcatagattatgcccatgagcagggggttacttccatggcagacatttcgacactggaggaggcgcttcatgcggcctctcttggcgcagactgcgtatccaccacgttatccgggtatacaccgtactctactcggattgagggtcctgatctggagctggttcggagagcgtcagaactggttcctgttcctttaattgcagagggtaaaatctatgatccggcgcaggttgaggaagcattccgaatgggagcacatgcagtggttgtaggctcggcgattaccagaccccaattgattacgcagcggtttgccgatgccgcaaggaaggcagtgaaatgcatctatggagatgaacgaccgaattaacacatattatccttcattaacgaaatcggagcagaaagtcgccttgtgcgtactggagcatcccgcagacatcatatatttctccgtgacagagctggcggattttgcaggtacaggcgaaacgaccgtcatgcgcttttgccggaagattggtttcaaaggttatcaggatttccgactgtccctggcgcaaaaccagacttatcgtaaaacagatatgggcgaggagaacatcgacccagatgacgaacaagatattacgcgtacggtgtatcacaacatgctcgatattttgcactccagtatggggctgctggaccattcagagcttggtcgtgcgattgcgtgtctcgatcaagcgggctatgttcaatttttcggtgtaggcgcttcgggaatttctgcgcaggatgctaaaaaccgtttcttacggatcgggcgtcgcgccgaggctgtggcagacggacatattcagtcgatgatggcggtgtccatgaacccgggtgatgtggctatcggcattagtgtatcaggaagtacgctggatacaaacgatatgctgcataaagccaagcaaaacggtgcaactgttatcgcaattacgaattatgccaaatcacccatcacctccatagcggatatcgtgttgctgaccgcaggcaaggaagctccaatagaaggtggttcaatcggcgctaaaatctcacaactattcgtgattgacctcatctgcgaagggcttgctcgcaagcatacgaatcacaccaaacagatgaaggaaaaaacagcgagggccgttattgaacgaagctattgagatttttcagttgtgaattgaaaacttgtgctccgacagttcaatgacttgtgtttgtggtgcttatgaatggctatttcaagtattgctattaatagaaggtttgtacaaagagctagtaagcttttatgtggggcaacaaggaggttggtgtggtggtagctgctgtgaacagagtcattggaatcgacattgggggcacatcggtgaaggccgccatagtggcacgggacggatcggtgcttgatgaaatccggctggatacggacgcttcccgtggacgtgaatgggtgttgtcgcaggtgtcagaatctgtgctcggactgttgcgttcttttggggataccagcatcggtgcctatatagatataggcgctctaggcattgctactgctggcagagtaaatgtggagagcggcgtagttgtgtatgccacagataacctacctggctggcaaggtacatccttagtaacgtgggctaaagaaaaactggctttacgagcggttgctgataatgacgcgaacgccgctttacttggagaagcgtggcagggagcggggaagggcaagcgacgtttggtgatgctcacgttgggaacaggtgtcggaggtgcatatatggaaaatggccacttgtgcagaggggctcattggagcggcggtgattgggggcacagtattctattccccggaggacacccctgtaattgcggaaaaaaagggtgcgccgagcaatatgtatcggggagcgccctgttacgtcgaggtagggaacacgtcggtaaattgtaccgctcgggaaacgagattgtgaaagaggccgttcacggtaaccaggaggcaatccaggtactggatgattacaccgcagatttagctgtacttctagctaacatctcggtgactcttgatcctgagggaatcattgtaggcggaggagtagcggacacgggagaggtctggtggcctatgctggaaaagcatctgcaccaatttggagttcaaacggaagtaagtcgggcattgttgggcaatcgcgctggaatcatcggcgctgcacggcttgccttcgaaatgaccgagtcctagtacaagaatgaaaggggaacgaaccatgacgcaaaaacggcttgataccgacattgttgtgattggcggaggtctaggggggacatcggcagctcttgcggcggcgaaggctggcatgagagtcatcgtgacagaggagacggactggttaggggggcagttaacttcacaggcggttcctccagatgagcatcgatggatcgaacaatttggttgcacagcaacataccgtgagttccgtaatcgtgtacgtgactattaccgtcagaactatccgttaaccgaagaagctcgaaataatcccattctcaatcctgggaacggttgggtaagccgtctggcccatgaaccacgggtagctctgcgggtgcttgaagatatgctcgctccttatttgaatacggggcgcgttcatgtatactatcacaccgtgcctattgccgttcagacggatggggactgtattacttctgtaactgtccgtacctcgaatagcgctgatcataagtgtggatttagagtgctgcacggaacgttttatctggatgcgacagagtgtggtgatcttcttccgatggcgggcgtggagcatacgagtggagcggagtcgcgggctgctacgggtgaacctcacgcactggagtgtgctaacccttttgatatgcaatctatcacacatgtggctgccgtagactatattccccaggaaagcttcattttagagcggccgcaacaatatgatttctggagaaattatattccgtccttttcccgttttccgattttgagctggtttgctactgacgcggatgataccagtaaactaaaacagttcacattgtttcctaacgatcagggcattgtatccttatgggattatcgtcgtattgtagatccctcgatatggagcaaaccgctaaatgatggtgaagtaactcttttaaactgggcgcaaaatgattattacctagggccattgatcggtgttaccgctcaagagcaggcaaaacatcgagaaggagcgcgtgagttgactcgttcattaatatattggcttcaaaccgaagcgccccggttagatggagggttcggctatccgggaattcgaccacggggtgatattctcggcacttctgacggtctggctaaaacggcttatattcgcgagtcacgccgaattcaggccaattatatgatatctgagtttgatgtaagtcgtgagcttcggggagaagagggtcctaagcgatatacagacagtgtaggtgtaggtagctatcatttggatcttcatccaactacggtatctcagcgaacattctacatccctaactatccctatgaaattccattgggctcatttattccggtgagggtgcgcaatttacttcctgcctgcaaaaatatagggatgacccaaatagccaatggctgctatcgattgcatcctacagaatggaatataggagaatcagcgggaagcctagcggcttactgtgtctccaacgaagtatatcccattgaagtgagccgatcagcagagcatcttggatgttttcaaaatgttcttcttcgccaaggtgtggaactacactggcctgcagaggtatttgagccagaggaagtcatcagctaatgaaggggcaactagcccctcgactgattttaaatgagctgaaagatgagtggatttattctaaaataaaaaacaaaaaaagtgcttgctaagttgctggggtttatgatatattatttgagctgacaacaaaacagcagtttcaaaagcgaaaagcttgggtgaaatgatcttcaaaaaaagaaaaaaataacccttgcatttttgaaacgaacatgatatgatcttatagctgctgaaaaacgcggcgaaagagaaatgtttgatctttgaaaactgaacaacgagtgagtaaaatgattttgttcgcaaaatcaaacaagagatattttatctcgtcagtttcaaaatgagcttatcgctctttctataaaccaactttggttggtctttaatggagagtttgatcctggctcaggacgaacgctggcggcgtgcctaatacatgcaagtcgagcggggttatgtagaagcttgcttctacata

SEQ ID NO: 2638 - DNA, 287396 bp, Unknown
  Kingdom: Bacteria, Phylum: Firmicutes, Class: Bacilli, Order: Bacillales, Family: Paenibacillaceae, Genus: Paenibacillus
  misc_feature (287042)..(287214): n is a, c, g, or t
tccatatcttacgacatgacttgattctcttgaaggtgttttgatttgtctcacgttatggggtcagttcccttaaggttagcagagctttttaatttatttagagtattcacttacttcaaacgtcaggatacgatcatatagcatataatcctttcggctgctgaatggtcctttattgttatcgtgcttattgattgcgtatgaagctgatccagaaccagcctgtttggcttcataccaggcaataaagtcattgacctctttcatactcaaatcaaattccttctctactcctgttgtcatagtgaccaccaatattgcacgatctccagtagttggctctgggtcaggttgactgcctcctccttgtggcattgcagaggcctcatttgagtattcagaatcagcaccattcacctcagcacacacaacaaagtagtatttttttccgttagtcagacctggaatgatgaagtttccataggcatcttttgttgctgtggcagtttcagtgtatttgccggattctgttccgtatttgaccgtatagctctcggcatcattcaccaaatcccaattcaatttaacctggctatctccacctatagcctctaaatttataggaacgttctgttctatcaaccttccatcttcattaatgtcaattgcatcgacataaaattctttggcttccttattcgttataattacatggtgaatagaatctgttaatcctgttttctcaaagttcaatgtttgatatagcactccacttgtatacatagacatttgttctttgacaccgtcgattgagacttccatgttcttagatgcttcactgtaaagaacccctataagtctcatcttgtttccataaaatttaaactctattgaatttccagtttcattagcaactttggtagtatttctgtaatatgagctattattagaatagctagaccagttcccattatatttaagtgcagtttctgtatcatcatacctttgccatcctttctctggttcagtaagcctttgtcccacggatgccgcatataaatttgaatttaaaagtatccctgttgtaaataagaaaactccgaataaaacacttacttttttgatgaacttcatcttcacaaaatttccccctaagtaatctgttgaacagatactaaggtaatatattcctcagaacttgtctaaacataaatttgaatatatagacattaatgtttagacattccttttttattcttatattcttgtaaaacaaaaaacacaaaggggaatatatatgaaaaaactatcaacactatttttattatctataatacttttatttagttttaatcaagatgtttatgccgcaacagtaggtgatccccttacttccccagaggaaggttggaatcggtacgatgacaccgactccaatattcaatatgaaggtaatggatggcttaaatctacaaacggaaccttttataatggctctgagacattaactaatgacaataatgaaaaattcattaaatttaatttcacaggaacaaaaataagactcattactaccgtatctatttggaaaactcaaaattataccctgacacttgatggagtcaaatatccttatacacagtacaataaaaaaagtgcttttcaagctatttcgtttgagaaaacaggcttgccacaaggagaacacacattaataattaaaactaatggtgctattggaatggatgcatttgatattgatgggatattgaaaacttataacccagatataaaaactactcctggtcaagatacacctaaggatatcggccgagctattttagttgtcactatggatactggtcttgaaaaagagtttgatctgagcatgaaagaagttaacgattttattgcctggtatgaggctaaacaagcgggtacaggtacagcttcctatccaatcaataaacataggaataatataggtccttttagcaatcgcaatgactatgtaatattcaataaaatccttacgtttgaagtaaatgagtattcaactaaataataaacaacaaagggctcatactggttacataccagcggagtcctttttcacatctactctaaattcaaacttattacagatgaaataggtaccgttaatcttgttggcttctggtgtaatattctccactgctccaccgtaatccacaatatctatcaaaccctcgcccaacggctgaaccacatatactcttacctggcttaatgcagcagcaaatagttctaaatccgattttagcactttatatgtatggttcatgctgatcacctcgataattcattcggtgaacggtgtggtaatccttcagcgacaaagaaagactcgctagttacctagcagagccttttgggtttgccttcaactagttccacaactttttagttaacctttacgttttttgagcatcttaattctaggcttggcaaaaacgcctatatcgtcgcctgctagtagcatactatccttgtttatttcaggccacttctgacctcttaaattactgactctaacaggtatttctacctccgtatcatgactacttgtgcaatattgagtaagctcatcaagaccttcgtattcattaagatctgtgaccaaataagcaatcggaaaatatttcaacatgctgaacatcccatgttttccactttcgggaccaattactttcatcatagaaaaatcctgcataattttcacattattataagggtatacccaatagaaaaccttatatccattaggaactgtcatttctgaatttaaaatgtattctctaaaagctttatcttgattagaatatgacaagtttccctttgcagcaagcaaatgccctaaaacagccttaacgatcattacaggcttagttttaaatcgaattactgccggaattgtaagcgagcttttcagatattgccctatttcctcagcaaaagaatttaatataggatcatactttgcccccaaaaggctattattacactgctgacataaagtcctgaactttaccccgttttgagatggtatgtatttcgtatcagttggtccaaccatatgctgcattacattccattgttcaacctcagataattcaatcccaccttttggagggatgtgatcccaagaaagttttttcttttgtaagcatatattgcaaatatcaacttcatctctcttaaatttcacatagttagccatttcgcttccccttgtaataagttgattcatcgataacaaaaaaggcccttaacagcacaagctggcagacccttttaccgatgctttcgtattgctctcggatagccgatgtgtcaccaaaattatacagaggtatggtataagttgtaaatgagattttcgaatgacctacttgatttgaaattgggtttattcctttccttcttctgctatagtaaaatagttccagtaacctaatgcacaaggaggagaagttatgattttgatgattaatcatattgatgagtatattaagagttacaaagaatattatgatatatttctcgacaactatcgcaagagagtaatgcaatattatacagaggagtacaaacagcatcctgagaatttccgccttatgaataaggtaagaatcacgatgctattccgcactggtgaattctttgcatacttttttgaatcaaaatccggacaagacgaatatataactattaagtcatatttcaaagatgaggaagaagctaaatcctatcttgatttaccaaaacatattcaaaaagatcagtttaataagctacttattgacaatgggtattatagattactttgattatgaaacacactggtatggaatggatgatgaccctcatccagtttgggatgaggatgtcccggtgattagaggaaaaggaaaagctgactctgactatgataaaaaaattgcttcctcgaaaaccatagctaatatttttaatgtagaagaacttgtttcaactgttaacgatgaagactttcaatatgaatatgaagaggccctaagggcatatcaagaggggttattcttagcatcatcagtaactgccgctgtcgcacttgagacattattaaaaatagcatttgtaaaaactttctcaatagaagatttaccaaagatttattatatcttaactttagcagacaagctaaaagaaagcggaaaaatagacgaaaggctccaccacagaatcaagtcagtgaatgaacttagaagaggcgtcgctcatagcaaatcggggcatgtgagtaaatgggacgctgaacaagtaattggttcaataaaagtgatcgcaaattcactgttttaaaatttcagtcctttttagaatagattttaatttttctaaaaattgttcttcagatccattcaatccaaactcagactcgatagattccaatccagtaataatcagttccaattctttatcggtcacattaatttgtttcataattcaacgcctcctagacttctattatatgcaacgttatcttgaatatccggaattaaacaggcaaatgaccctttctaaagagttattcacctgtttgtttacatatacggctaacaaataagaagattctaaactgagattggaaaatgataaaaacaacataattcccttgaattttgctggattgaagtcctcccacactctctctctgtacaggctcctaccctttcaccagtccagaccgatacaacacagtcagcaagctataaaaatcatagctgcggcctactgtcttttcaacaatgccagcagccttagccgccacacatgcagccttagcccacgctggaatctccggcatggcattgtatttcttcagttcctcaatcgtagctgactgctgtttggccgtgacctgtaatgcctctaacgccttcttctctgcttctgtcataggttcatcctccgttttaagtgaattaaacttcgccagcatagcgtcgagctgcacttgagttgggcgcttttctgcccggaaatctgccgttgaaagtccaaaggtcatttgaaggtggggcatgtccttaaagctacgccagtcgcctccccactcaagcccgagtttctttgcttcttcgacgatctctgaccagtccggcaatgaatccttatcatcgtccttcagcgtgtcccaggaaactgtacggccatctcgcaacagcagagcgaaatcggctgcaaacccaaagttatgattgctatatcctcccctggcttttgttactttgggacgcttatctccattccgtccctgggcaaagagcgcgtcctgctccgcgtatgtccgcaatccctgcgtaattacaatccacacaccacgggcatagcagcgctcaattaatttttccataacaattttaaaaaccggatgaagtccgatcagtcgtttttcagattttttctttacttgatccggcgtcagcatccttgccatcccctttctcgttaagctgcttcaagaagctttttagcttgaacggaagcgggatgcctattgctcccaagttttcagctagtgataatccttcacggccagcgtaaaagtaaaaatggctgctgtcctaaagaggggagctcctggttgtaaccaatcatccatttgtgcggataatccaaccaccatcagcacagtaactttgcggatacctccccaaaacatcacgtcactgtccatctttttatttttcaaagctgcgattacgccagaaacataatccaacaacattgctataagcagcacctgaagcggcttgtcccacccccaacaaaaaaagcgaccctcattggctcgctttcccagcaattatatttaataattcgtattagtactagtccgaactccgagctttccagacatggaaccagaaccactacttaaactaacataaaatttccctgcggaccatgccttgcttgaatttaatatttcatcgaatgttttaccaggttttactgttccactgtacttttccgcaccagatacacttccctgattcacagtaaaagttatagtagtgtctcccgtgtttctcaagtacattcttacatatccgtatcctggtttaatgtcaaaatcagcagaatcattaaatccagctactggacgatcgacaatttgtccatcagtagcttgtggagtaatgacttggtcgccagtagttgttttaccagcatattgggtcgccgtagtggatgtatctgcaaaatcagttcctgacacaccccatgttgtgacatgcacaatgtcaccgttagctctccattgtatttcattatttcctgagcgcagcccttgtgaaaaagaatttacactatcccaaagcaattttttatgagcgccaatagtcttaacaatatattgttttccactgtctgtatgcaccaggctaaaggtaatggttgaaccacctctattattgacaaaaattttaagatgcccgtatccaggatctaatacaaaacgtgatactgggtcctttttgtcaaaaatgtcatcaaaaacatctcttgatttttgaggagttatgacatggtcactaatagttgatttaccagcttttttggtcgaaatactggatgtatttgcagaatcagacgcatctgaacttacacagatcacactcggcacaacaacagcccccaacaaactaatagataaggctgatgaaaaaaaatatttttttctttttcaacaaatatcatttctcctttgagttataaacgaagcaaggaaagcttcaaaccgaatggcctgaagctttccttgctttgttgcagtataagtaaaaccttccccaatcaagcgagctaccagttagcttttcttatacagaactttatggcttggtttaattaaagttcatctggattagtggctgatatagcccatgctgaggcgtctacataagccccaccagcacgccactgtatttcatattttcctgagcgcaatccgcttgaaaacccatccgtgctataccaattaaaagtatcaccagcacccacatacttggtaaaataatctttcccactgtcgacatgctttaaagtaaaagtaagcgtcgcttttgtgttgtttcttacacgaatcttaacatgaccatatccaggatctatggagaactctgttaatggcgacttgccgtcaaggttcacattaaaaagatcttttgttctaaaaagacccacatcatgattaccaggtgttttcacctcatcatgggtcgcgtaagtcgatgtacttgcagaatcagttacacctgaatccgcaaagatcgcactcggcacggcaatagctcctcctagcaaacctaaagataaggcagacacgattaaatgtttcttcttcataatacttctattcctccttatatattaaactacctcctcatactactaaaagattccatctttctaatttcttttacaataaaatcataatactgctttataaatccatatttatgaatcaactagcaatattattatgagcttttacagctcatccttttgaagcttaatatccaattcaatcagacgatccaagtcctgaaccgtctgcatttttatatttccagcctgtaggtctttgacccactgtgcgattcctgccttaacaatctttcggtactgcgccttggattcgaggattccctcgacgatctctatctcacgttgtagtaatgcatcttgttgttcgttgtctgttcccattgtcgtatccctcggctttcctatatactggaatgcgagatagcggatgttgcaaaatgccacgcgtggcgggccgctatctcagccgggggataccctggatgaatggagggacgttagcgcgtcctcctttttcctatgctacgggttcagcccgatgcaacaggaccggctcaataccagtgctctctaggaaacgtttcttaattacatcgcagaagatcgggtccagttccaacgtccggcatgtccggtccatctgctcacatgtcataagcgtggagccgctgccaccaaagaaatcgacaacctcgtcaccacgctggctgctattcttaattagaatagccagcaggtcaagaggcttctgagtggggtgaacatacttgttcacatcgccccgtgagacctcccatactgtctcggggagcgggtcctcaacagataaaccagccttccataccgttgtctgtgtccgatcaccgtaccaagcaggggatttccctttcaggtgggcataatagaccggctcatgtttgaagcggtactgtgcccagccgaaggtggctgcattcttaacccagacgcattgtgtccggatgacgatgcctgctgcgttcatcgcatcctcgaactcccgctgataggttgaaggatgaaatacatatatagctgcagttggctgcatcaccactgcatagttggaaaaaacggcatacaaaaagcccgcgaagtcctcagcgggcatattgtcgttcattatggaaccacgaccatcgtcagccaaacgggcagaggtgctctccaccgcaacattataaggcggatcagtaacgaccagcgctgctttggctccgtccattacaagtgctacatcatcaggattggtcgcatctccgcacactaatcgatgccgaccaagctgccatacatctccgcgcccggtctccggctccttgatttcatctagagcacgctggacgtcaaagtcatcatcggtaaccggaaggtccaaggcttcatcctgtggcacagcaaactctgccgctagatcctcgaactcttccaaatcgaaaccggacagggccagatccgctccactcatctgcagatcatcaagcaatcgataaagggcttgatcatcccatcggcctgaaactttgtttaatgcgagattgagaagcttttcctgctgatcgtccaggtcgacaacacttacagtcagctccgtatgacccagctcgttaaccatgatcttatagcgttgatggcctccaaccatgttcccggtgcgctcattccagacgattagctccacataaccaaatgattcgatgctggcttttagcttctcgtattctggatcacctggctgaagatcaacccgtgggttatatgctgctgcgttgatttgctcaattggtaggactctgatttccacttgtacgacctccttattttctagtgctttctaaattgaaactcccatccaaattgctttctaagcatcagcaccttggaacaagaaaagacgagccagtagtagctcgtcattgttactattgagtttaaattgtttggccaattacactgtactcataaagtcgaatcttcagtaacctgttgctgagtcctttaagcattacaaccccctagtattacaagcagtataaatagtatgagattaaccccgacactggtaaacataccgccataaccaactccatcagtcccactatttgtatggggatgagtttttcaaattggttaatatcggtagtctttctcatctccagtatttccactgtacctatgagcgtgaggaattctaccgtttactgttgtatacccttcaaaatgatggtaatgcccaccacctgtcgagtgaatggctggccctgtagttcctctaattagatgcgtatgttgatcgttaaatgatgtttctgcataataattatgaacatgcggaacaccacttggagctggttctgttactccagcgtaatggtggtagtgtcctacatcaagtgatgtattcccattaaaaggatgtacgtgaacattaactggtctaccgtcccacgaactaataaaaagcttatgcgaatggttagagtcggaattactggaatgaacaacataacctgttattggtatttccatcagtagccacctctctttatcaactgccatatactatgaaagaggtagtgtaaatgttcaaaaggctatttgagttgagttggtttccactattcgggtagcaggctaacaggctgtcagagcgtgtgtatgccctctctctactttctgcagtactccttccggcattcgtctgagtaaaataaagcaggctcagaatagctcacattctgtcgtatgaggacaaaagaaaaagcaccccgaaggatgctcattttgaaagaataactacgctttatacacaataagcgctgagaagtaatcttccttagcagaatagtttatggaaacaatatcttcttctcttttgaacttcaagaaatcatccattgcccattcaaactctttgatgttagctttactgattactttagtaaccatcttcatttgatatccctcctttacgccatatttcgacaattaggaagaattatcctctttaacacatggtctcaaacaaaactgtttaacaccatcccatctaccccatacacaacctttgcattttttcggctgttttggtgggcctttcatgtatagcaaaattcctttcttctgcttcttcttcaaaccattcaaacctttcaaggcaataaaaaaagccacccaaatgagtgacttgtatctgcctatgtatttacagcaccaaataaactaaggcgcttatttaaaacccgaaaaaagaaacagcgataggttctattcccgcaagcgggatgcaaaacgctacgctgttgcataaaagcatttgtacttagtaactagagaagagagataagaccattttacaaattgctaaaaatgaccgtcaaagaacaaaaactggacaataccggaaaatgggcaattaaaccattataagctggcttttgctcactttctcgatattactcgctattaagtaaaaataaagtcttagactgccgctgttatcattcaactaacgttcttcgttagcgtagcgcattacttgaccaaattcgatatgttgccggccaataacctacgttttcgtatgattactcagcatagtgatgtgtaggtgcactaacatatcaacagtctcttaaatcaaaagcttcttctagtgcggcagtatcttcgaagatttgaaaaaaccttatcttctcctgttctacttcgcaaataattgcccaatcactctcgaacactttcccggttacattgaccttgatgcggaaattcccccatgcacacgctgcttcctgattaccgatgagtttgtgaaggacaaaactctctatttgttctgcttcttctaataagtttaaataatttctaacaccttcttttccatgaaatgtaccgtataaaggaattttattagaaggctcttttttaagaataataaatttcgcttcatcatgaaccaattcgatcactttatcaatctgtttgcttcctaatgcttgaaaataatttgttagcacctgttgagcactttgcatttctactaatctcccttcgaataggcggaataagctttgcacaatccaataataacatattttatctaccatcctgcccgttggcttaacgccgccgctgccagtctagaactatattttcacggtctaacactttatttccatcaaacactcgtcccagcaattctctcacccagtttatcctcatcaccggacttcatggtttcccagcatgtatcacaaaaggatgcgcccattgttgtgttctccgggttcggattagggtcattgcaaagcatacattttcctattttcggactctttttcacagtaacacctcccatcaaaattagtaaaagacacgctgcggaattgaaccgcgccaagggttctgaccagatctgtatggcatttccgctggttaactggtgccttgccgcctgcacgtgtcatgaataatgtggacgggggccactctcccccgcatggaatgacttaccgtttaaccgcaatttgcaaactgtgccgatctaccgctgtgcgttacgggtgcccctaagtgaagcaaggaactatccttgttcgcggccacataatcgggccttcccttgcgcgcactggtcaatgccactgagcagtatgtccctctatccccttgcaggagtcattgaggctatcaactatcatctgcaggtgtcatcctacgttgtagcgtctctcttccgccaccacattcaaaaactacagaagctctgctgcgagttgcttgagaaccaacggcgttgggatgagttggtcgtcacctttgttgcctttaacgtaagccttgtcctcataggcataatacacaacgccctgaccctcaacgactggatagccgctcttgtcatcagtcaggcttgtttgtacgtgcttaccgtgctgcgaagcgtgctcttcatcatgaagacgcaagatgccgtccttactcaaaaatgcgaaacgtggatttgtagacatgaataattcctccgaatatggtttattaggaaaattggcaacaaaaaaggactggcgtattcgccagcccttcgtctgttaccttcatttccacgctatcaatatatcatggggaaaccgtcatgtggtgttcaatttaggggcaggttacgttcacgtagtgctcactttagagtcaaaaaatctgcgcatattccccttaacccagaaccgcaaatctcttcttctcaaatcactttctatattgagagcttgtacatcgtcctaccagctccctttagggtaggagggaaaagccctcaataatttataggagatgattatatgaagagatttatgttttggttatttattaaagtaatgttttacaaagaacaaattgcagaattgtttattgacttagccacatcaggaactatcctggatgtggctttttattgctcaaattttctttgattgtctgggtaaagagcgggaataatccgctcttaaaattccgcgtcgtcttgttcgaagaagcccataagcttcaacgtattcgccatgctctcagctccatcactcattttgcgtcggatagtactgtcactgagactacgacggaagaaaagtaatgtctctttataggtatagctctgaatgtatcggtactctaccgctttacgggcgtcatcatccttaatcaaactgtgcgcccggcgaagctgccacgtataaaaatcatacctgctgtgacccaacgctgcttttcgatcagaatcgtggcatttgccgtcttatctgcatgcagatcagtccgatcgatgcagcgagctgcttcgtcatcaatacctacttgctgaaggtcctgctcaaacaacatcacttttgaagagttgtcagaactttggataaaacattatagtaagcacgggaagccgaaagcggaagaaacaatcagaattagaaataacgagagggataatctactcatccatttggctaagcgaaaatctttggatgtaacgccggaagaatatcaaaacgcgttactacgaatgaaaaggttgcttaagttagccggaatcaatcaggaattaacacctcattcacttagacacactcacactttactactagctgagatcggcattagcttagaacagattatgcatcgactcggccattcgaacgacgacataacgaaaaggatatatctgcatattacaaaaccaaaaagaaaagaggcttcccataagttcggagaactaatgagagcctctaaaaaaacaacggagcgttaacaaatcaatatagcaatcacctaaacccttgttacagcacgggtttttggctttgttacatcatgccgcccattccacccatgccgcccatgtcaggcattgcagccttttctggttctggcttgtcagcgataaccgcttcagtagtcaggaacattgctgctacggaagcagcgttttgcaaagcataacgagttactttcgcagggtccacgataccagcttcgatcatgtttacccagtcgccagtagctgcgttaaagcctacgccaacttcttcgcgtttcagacgctcaacgattacagagccttcttcacctgcgttagcagcaatggtgcggattggagcttccagagcgcgcaacacgatgttcacgcctgtttgctcgtcgccttgcagttcaacagctgcaactgctttgtatacgttcaggagcgctacaccaccaccggatacgataccttcttcaaccgcagcacgggttgcgttcagggcatcttcgatgcgcagtttgcgttctttcaattctgtttcagtagccgcaccaactttgatgactgctacgccgccggacaatttagccagacgctcttgcagtttctctttgtcgaactcggaagtagtttcttccagttgcgtgcggatttggctaacacgagcgtcgatgtcggctttgtttccagcaccgtcaaccacaatcgtattttctttagtgatacgcacttgacgtgctgtacccagttggtctacggaagctgttttcaggtccagacccagttcttctgtaatcacttgaccgcctgtcagggcagcgatatcttgcagcattgctttacgacggtcaccaaatcctggagctttaacagctacagcgttgaatgtaccacgcagtttgttaacaacgagcatagccagtgcttcgccttcgatgtcttcagcgatcagaacgagtggcttgccttgttgtacgattttttcaagcaatggcaggatttcttgtgtgtttgtgatttttttgtctgtgatcaggatatacggattgtccagtacagcttccattttgtccgtatctgtaatcatgtacggggaaatgtagccacggtcaaattgcataccttcaaccacttccagctctgttgcaaaaccgcgggattcttcaacagtgattacaccgtctttgcccactttttccatagcttcagcgatcagttcgcctacttcgtcatcagcagcggaaataccggctacttgagcaatggattgtttgctttcgattggtttggagatggcttgcagttcagcgacagccgctttaaccgctttgtcgatccctttacggataccgattgggcttgcgccagcagttacgtttttcaggccttctgtgatgagggcttgagccaaaacagtagcagtagtcgtaccatcaccagctacatcgttcgttttggttgctacttctttaaccagttgagcacccatgttttcgaacgcgtcttccagctcgatttcttttgcaatcgttacaccgtcattggtgatgagcgggctaccgaatttcttctccagtacaacgttacggcctttcggtccgagtgttactttaacagcattagccaatgcgtcaaccccgcgcaacatagagcgacgagcgtcttcactgaatttaatatctttagccatttgtgataaacctccctatggattatgaatgatttgtttcaattcctatattcaggtcttgtccgggttccggttaaccgatgatcgcgtggatatcgctttctttcataatcaaatattctttaccttcatatttgatttccgttccagcgtatttagagaaaatgacacggtcgccttcttttacttccagaggaatacgggcaccgtctttcaatgcgcctgcgccaaccgcgataattttgccttcttgcggcttttccttggcagagtcaggaagtacgatcccgaaggaagtcgttgtctcttgctcaattgcttccaccaatacgcgttcacccaaaggtttgatcatgaaaaaatagcctccttattaagtgttttatcctgtaatttggttgttatgttgtatgtattagcactcgacagtcgtcagtgctaacaaccaactttatgatactcaacttgggattgaatttcaagtccctaatgtattttttatgggaatttttatggacagcccttcccgattatatccatctatctgaaaaataaccgttaactcaaggctaatggttatttttaaggcagctaagctgctgctgttatgctctatagatagccatgatataaaatgccattcattatctgcaattgccatgtagcgcggacccgaataaattgtttactgagccattcaggtcctgctttattattctgaagctacacgcaattgggcctcacgttcctcctgtgcacgcagctgcctgcggtacacgaccgaagacaaatacacgctcacttcatatagcaccagcaacggaatcgccaccaaaaaatcggaaataaagtccggcggggtaatgacaaccgcaacgaacacaagcagaaaataagaaatcttccgccatttgcgaagccgcattggtgttaaaacatgaatccccgtcagaaacatgataagcagggggagctcaaacagcagcgctacaggtagtacaatattaaacataaaggtgaaatattgtgcgatcccgtacgtttcctgtaatcccatacttttggtaaccgacgatgtaaactgaattgccatcgggaaaataatgaaataagcgaaagctgtcccaatgatgaacaaaagcagcacataaggcacataccgcaaagtcgcacttcgttcttgtggtcttaagccggggctgacaaacttccacagttgatagcaagcaaacggtagcgccaccgcaattccgatgatcatggcgatcttcatgtagataccgatcccgtcccaaaaggaaaacgcgtttaactgaaaagcttgcgccgaaccggagcgaataagccagtcatagacaaaacccgccgctaacagaccaccagccagtgccaatacaaatacaattagcacatagataattctgcggcgaagctctcccagatgttccattagcggcatttcatgctctgatggggtcaagtccactcctcctttctgaacggcacgcagcagcgcctcctaaaaaataaagcccttcactgaagaagaggcttttgtttattgtacaagatcaagaatcgatcactaaatctatgacaagcgtttatcctcaggctgaggttgaacttctgaagacgtcgtttgtgatgctttgaccacactatctttgctgtctttacgctcagtccgttcatcttcggataaaatatcgcgtgccccgtttttaaactcacggaatgtacgccctacagctcgacccaactcaggcagcttgttcggaccaaataacagcagcgccagaataatcaacaaaatataacccggtgctccaatattgggcatgtgtagtaatcctccttatgttgacggacaaaataacaatctttgtccgtatacggccttataaatccttataggtatcataccacacacgatgtgctgccttctaccggaactggcctgtcaccataagcaacgcttctggaagttggtccattatcgctgccaaattttcatgcacacctttgggcgttcctggtaaattgacgatcagtgtacgtccgcgtattcctacgattccacggaatagcatagccgctggatttttctgcatcacgatcattctcatggcttccgccatgcctggcacttcccgttccacaacccgcctagtcgcctccggtgtcacatcacggatcgccagctcggttccacccgtagttagtaccaggtctgcatgaaaataatcggtcatttcgattaaagctgcaataatttcatccggttcatcgggaacgatccggtattccacaatctctccgcccagttcttcttcgatgagttcccggatgacctgtgcgcttgtatcctcacgctctccccttgcccctttatcactggctgttaggatcgccgttttccacaccataagatcacccttctcctatcatgaaagaatactttctcttctgaaaatcagaaacagccacgctgcatcctccatcacatcacagtaccctctcggcgacaatgttgtctatgtcaaggttcccggtggtcctccctttgaaaatccccatgcttgccacctgttttggattgcagcatggtagggccgatgatcatatctttttgcagcgccttgcacatatcatacacggttaacgctgcggctgaagccgctgtcaaagcttccatttctacacctgtcttaccctcggtcttcacttcaacttcaatatgaagcacatcatgtccattatcggaaaaagtaatgttcacgcctgtcagggccagtggatgacacatcggtatccagtctgacgtttttttcgcgccttgaatccctgcgacctgggccacagcaagaacatcacccttgccgattcttccttcttttacagccgtcaatgtagccggattcatcgtaatctgagtcacggcaactgctgtacgaatcgtagacgttttacccgaaatatctaccatccgagcccgtccctgttcgttaaaatgagtaaaggaatccacgactccctcacaactcctttcacatacccaactttacttcattcatcatttgtcaataatcacaatctaagcgtccatccagagtaaacagcacgtccactcgcaaatcccttggctccatgggcacctgtgtcagcaattgtcccggcaacagcagcgagacataaagcggacctacatggctgttgttacgcttctctgcctctacctgtacggtaaagcggtcataatagcctccgccgtagccgatcctgcccccacgacgatcaaaggccaagccgggcacaacaacccagtcaattcccgtccacatttcaggcgaccattccttgcatgtcaaagcaggctcagggatgttccagatgccgggtacaatatctccgtactgatccatctccctcagctccatagtccgagttaccgggttcactcttggggccaggacacgatctccctgtgaccagcaatgctcaatgaggggagtcgtcgaaatctcgctgccaaaagagagataactaaataaggttagcttatctccgtttctgtctattctaagctgctcccatgcctcgattgcatgccgacaggccacagccgatgccttctgccttgtcagcgggtccatggagtcacgcgcttcccgttgctgcaaacgcagcgcgttcttcaaattacagacatccatcacatccgccctcccgcacaatcgtcgataatctttaaaacgttactattgtcccatttgtcagtaagtgctgtacgttgcaagtttttttcattctttttcacttctcgtttaagtttatcattgtttatacaaattgactacacgcggctcaagggtttacagggtgaaagcagtgcaatagtgggtaatttcatgtaaactggaaggaaggtacctgtgaagaaagcaggtagaactgtgcaaaatgtaatggaggaacgatacgctatgctattgcaagtaaccggaattactaaatcttatggaattgagcccgttctggacgggattaaccttcaaatattggaacgtgaacgtattggactcgtaggtgtgaacggtgcaggcaaatcgaccctgctcaaaatcattgctggtgaaatatcctatgacagtggacaaattttcaaggcgaaggagaccagcatcggttatctggcgcaaaacagcggcttgaattctgaccgttctatctggggggaaatgatgctggtgttcactcccctgattgaagcggaacgggaactgcggcaaatggaacaggacatcgctgacctggccaatgctcaaaacgaaaaacgctacgcagatctgctggaacgctatgcacgtcgttcagactggttcaaggatcacggtggttatgaaatggagacccgtattcgcagcgtgctgcacggtatgggctttggttcatttgcacctgaaacgcccgtagctactctgagcggaggacagaaaactcggcttgcgctagcgcgcatcctactgctcgcaccagatgtccttatgctcgatgagcctaccaactatctggatattcaaacactgacctggttggaggattatttgcgcggctactccggttctctgctggtagtatcacatgaccgttatttcttggaccgactggtaacgacgattattgaaattgaacgccatcgttctactcgatatacaggcaactacagccgctacatggagctgaaggctgccgagtacgaaacgaatctgaagcattacgaaaagcagcaaggagaaattgcccgtttagaagcattcgtacaacgtaatatcgtgcgggcttccacgaccaaacgcgctcaaagtcggcgcaagcagctagataaaatggagcgtatggatcggcccatgggagatttgaaaaaggctcatttttcctttgaaacagcccatatgtcaggtaaggaagtactggaggtacgtgacctctctgtggggtatgaaggtaaaaagcctttattccagcatgcatcgttcgatttaaaacgtggagataccgtggcactgattggtccgaacgggatcggaaaatcgacgttgctcaaatgtctgaccggatcacttaaacctgctgctggctccatccactggggcacgaaaatcaaaatcggcctgtatgaccaggagcagacgaacctaaaccccgccaataccgtactggaggagttgtggagcgagtaccctcatatggaagaagcacgtattcgtacagtgctaggtaatttcctgtttagcggtgacgatgtacttaagaaggtagctgcattaagcggaggggaaaaagcccgtgtatctctggccaagctcatgctgcgcgaagccaacgtgttaattctagatgagcctaccaaccatctggatctgtttagcaaggaagtgctggaagcggctttgatggactatgacggtacgctgttgttcatttcccatgaccgttatttcctgaacaaaatggcggaacgtgtcatcgagcttcatcctggggggatagaacatttcctggggaattatgatgactatgtagccaaaaagcaggagttagaggaaattgcgcaagaagctctggaggcaaatcaggccacacgcggcaaaacatcggctacctctgcatccgtgacagacgagaccacatccaaatcacgcgccgccacctatgcggcagacaaacaagccaaaagcgaggaacgtagccgtcaacgcaagctggaggcattggaaaaccagatcaaaacgctggaagaacaaattttagggctggaggaacaaatgaccctgcctgagatttatcaggattacacagcgcttcagaatattcaggcacaactcgacacccataaacaggaattgactgaaacctatacctcttgggaagagctgttagaagaataaaaactactgcataaaatcttagccttaaaaatttcacattttcctcttctatatttttgtacacaagattatccacagcttatgtgtatgaatgagattgaaaaatggccttttgggccatttttttattgataaaaagccattttcaaatgaaaaccaaatttatccacccttttatccacattatccacagatttcacaagaactaaaggtgttacatatcccccaacttgctatctccaaaaagtcttagcctgcttgcttcggactcggttatccacattcaaagcggtatatgtggataactttgttcacaacttgacaaatcacatcattattcgggcaatatcaaaattcctgatttttttgatggatcatgaaaaatcgtgaacaattgtgacgaataatgcgagtgaatgagatgctgccattcatttgctcaaactcctgtattttatcctcttgaatttatattttatgatagttatggagcggaacaaaaaagacacgactcaactgtgccgtgtcttgctcattcttcttcaattaagtttggacagaccattcttccagagacagccctggatcagccttcatatccaatgaggtaaattccccgcgcttccatttggcgtaggccgcagcgccgatcatcgctgcattatctgtgcaatatttcatcgatggtacaagcagctcgattccttcgcgctcacagcgctcccgcaatgctgtacgcagtccgcggttagcagccacaccgccacaaagcagaagctgcttcgcaccgtattcacgcatggcacgaatcgccttttccaccagcacctcgacgaccgactcttgaaagcctcttgcgatcgctccgacatgaacggtttctccgcgcattttagtctggttaattacattcagcaccgcagatttcaaaccgctaaagctaaaatcataagaatccggctccagccatgcacgcggcaaagtaaccacttcctccgattcatgagccacacgatccacatgcgggccaccgggatacggaaacccaatcgctctcgctactttgtcgtaggcttccccaaccgcatcatcccttgtacgaccaatgagttgaaaatgaccttcggactccatcagcaccagctctgtatgtcctcctgacacaacgagagcaatgcacggatatacgatatcatgctccagctgattggcataaatatgtcccgcgatatgatgcgtcccgattaatggcttgccgaacgccaaggcagcactcttggcagcgacaattccaaccaacaatgcgccaaccagtcctggtccttgtgtcacggcaaccgccgaaatctcacgaggggtaattcccgatgtttgcatggcctcgtccagcatgtaggtgatgctctccacatgtttgcgtgaagccacctctggcacaacaccaccaaaggctttgtgtgtttcaatctgactggaaatcaaatttgagagcacctctgtaccatttttcacgacggaaacagccgtctcatcacaactcgtttccactgccagtatatagcaagactcgccggaggcggagcctgtacctgctttttcctcttgcgtcattgcttctgcacgcttccttcctgttcaccggatgccccatgcgcgggaagatccgcccacatgatcacggcatcctcgttattatccgaataatagcctttgcgcacacctgcgggcttaaagccttttttctcatacaagccctgagcgatccggttcgttacccgcacctccagcgtcatacgttccatccctaaataagaggcggtctgcatcagctcatccaacagcttgtccccaagcttgcgtccacgataagcctcacgaatcgcaatattcgtaatatgggcctcatccataatcgtccacatgcctgcgtaaccaatggctcgtccgtctagttccataatcatatatttagcgaaatgattcatcgtcagctcattgcggaatgcttcctccgtccacggcagcgtgaacgcttcatgctcaatctccagcacatcgggaatatcatccagttgcatcaagcgaaactcaagtttctcttcccgctgtatgttctttgccatgttgttcaccgctctcttcagcgctgacgaagcagattggcttccgcctccgccagctgggtataattaggaaccagcgtatgtagctcgtcatgttcttgacgaagcagcttatccgccccaaggcggccaacccatcttccctccagctcataaggtatgatacgtagctcgctccaagcacgcaggcgctcggctgtttcggcgtgaaccgccgtttcaccgactagccaaatgaccggaggacgctcttcagagggcaaagcctccagccgttgcagcagatcatcggtccaagcagtcattaagcgaattgcatctggctccagccgttgcggactctcgacgtcgtcaactgtattcacggcgaacagccccgtgtaaacctgaccacggcgcgcatccagcacaggcacaatccagtctgctgcctgcgctccggatgaaccgttattcacagactcatttttatcttcttgtcccttcatctcgataccacgattccaaccaccccacgccaaagcgtgcaaagtggatatggacgtcaccgggataccccaggcccaagcgagtgttttggctgcggtcaccgcaatccggataccggtataagaccccggtccaacaccaactgcaataccttctacatcatctcgtgtcagcccttcttcattcagcagtcgttccagctcggtaatcacatgcacggagtgattacgttcgccatagacgttgctttctcccagcaattctcttccattcatcagagcggccgccatcacggtcgtcgctgtatctaacgtcaaaaaccgctcacgcggctttacattcacatctgtatgctctctttgcatggttcaaactccattctcccgcaaactgcggcaccattgttcataaggctcgccgtacccggtcaggtgaatcaagcgctcccccacatccgttgtttctatatacaggtgaagccgctgctccggcaatatatccggtataatactcccccattccaccagacatactccttccccgtaaaaatattcgtccagcccgagatcctccgcctcgtcctgggaaatccggtacacatccatatgatacaaagacaatcggccctcgtactccttaatgagggtaaaggttggactatttacgatgcccggcacacctaaatggccggcaaaagccttggaaaaagcagttttgcccgctcccagatctccatccagcacaatcaccgttccgggaaccgctttggctgccataaaacctgccaatgacccggtctgtgcctctgagacagaacggaacgtaaactgctcctgcgaaattgtcatatattttaatcacctttcgtccgaatcggaccgttccaacttgttctttattatatagttcaccttatgtcgccgcaaggcatgaagacatgctattgtaagttagtgatacacacagggagggattgaaacgatggggcaaaccgttttactcatgattgatgttcagcaggcgatgttcatgtatgatgagaagctgtatcgtgaacaggaagttgtaacgcatttgcagcagcttttggacaaagccagagctacaggtacaccggtgatttttgtacagcataccgatgaagcggatgaggatttccgagaaaacagtgtaggctgggccatcgccgacgtagtgcgtcctcttcctcatgaacgaattgtccgtaaatcatcctgggacagcttctaccaaaccgaattgggccatgtactgaaggaactgggggccgatcaactcgtaatcgcggggatgcagaccgagttttgcctcgacacgacttgccgaagcgcctatagtctgggatatcagaacaatgtgctcgtgttggatgcgcatagtacatttgatagcaaggtgctaagcagtgaacaaattgtagctcatcataatgggatgcttggcaatcgttttgtgcgtttacttgcgacggaagatgtacatttttcgtaattgttgaagttttatgttccaagccgattgctttcaagcaagtcggcttcttttttagttcatgcgaaaaaccgccctttcgaggacaccttgagaagcaagctggcacaataggacgaagatcatgaatattgaaaggcaaagccgtcttcagaaaattctggaggcttttttttacccagcgatgagttagaagatattggtcgaagaaaactttttcacctatggattggaactttcttttttaacagaaaattcaatttatgatcataattttcagaaaaattaagaaattaacagaaaacgttagaatggcctatttattgtggactatatggccctataaacatctgtacatagatatgtgtaaatatttggacattgagcaaaatctgcattagaactatgataaaaatggttttaatttccaatgagagaaggcgatcgaaccgtcacactcactgtcttaggcaccatgatatgcccgcatgcaaatgtatcttgcagtcgctacatctcgtaggttaagagcggaaattacgaattgaagtgcaatcatggatgtattgtgttttgaacacagcgaaaggaatgtgagtttttaatgaaaaaagtagctttagtaagcccgttgagaacagcggtcggctcttttaacaaaacccttgcgcctctaagcgcttccgaactgggggcaactgtgatgacagcatgccttcagcaaagtaaattagagccttctttgattgatcagatttatttgggaaatgttcttcaggcgggcaatggacaaaatcctgccagacaggcggcattaaaagccggtatccctattgatgtacccgaaacaacgataaacacggtttgcggttcaggacttcatgccgttgctttagcttacaattcaatattggctgaacaaggcaacatcgtcttggccggaggcatggagagcatgtcgaatgccccttacctgctaaggaatgcaagaaacggctacaaacttggcaacggtgagttggtagactccctagtggccgacggccttacgtgcccgatcaaccattaccatatgggaattaccgcagaaaatgttgccgagaaatatggaatttcaagacttgaacaggacgaatttgcttatcaaagccagctaaaagccgtagaagcaaaaaacaagaagctttttgaaaagcaaattgttccggtcatgatcaaaaccaaaaaagaaactatttctttcacagaggacgaacacataagaggaaatacaacgcaagaaaaactttctcaattaaaacctgcgtttaaggagaacgggacggttaccgccggaaatgcttcaggaatcaatgatggcgcggcggccgtgcttgtagtgtcggaagacaaatgcaaggaacatgcattaaagccattggcatatatcaagggttattcacttgttggcgttgaccctgcatatatgggaatggggccagtgaaagccatttcgacacttcttaagcagcaaggtatatccatcgatgccattgatctttttgaaattaatgaagcgtttgcctcacaagcattagcggtagtgaaagagctaggagtcagtccggagaaggtgaatgtcaatggcggcgcaatcgcgatcgggcatcctgtcggtgccagcggtgctaggatattgactacgttggttcacgaaatggttcgaagatcttcacgctacggcatcgcctcgttatgcatcggaacaggaatgggaatagccatgctggttgaaaatgcgctcatttaaagtgcgtgttcaggatgacttttagaactatctcttaaaaggaagggagatcgctatgaatcaaaaagatgtactttcactccaatctatgcctgcggctagcggtagctacgggcgcccaccataccgcttcatcaaccgggaattttttatcattacctatgagaccgatcctgctgcgattagacaggcggtcccagagcctcttgagccggatggaagcaatacggtctcctatgaatggatcaagatgcccgattcatccggtttaggatgctatgaggaaagcggtattgtcattccgtgtacttttcaaggagaaccctgcaattttgtcgcccaaatgtatttggataacgcgcctgctattctggggggacgcgaagtctggggatttccgaaaaaatgggcaaagcctcgcctgagcgtggaggaaacggagacgctgacgggtacattgcattataatcacgtcctggtggccacgggaactatgcctttcaaatataacattcttgatgaaaaagaaacggctaaagccatcgcaaaaacgcaagttaatttgaaattaattcctgatgttgacggtacccccaaaatcgctcagttagtagcgtataatctcgagaacattactgtaaaaggcgcctggtcagggcctgccagattaagcttgatcccccatgtcaacgctccagtggcagatttgccggttaaagcttatattggcgggaaacattttattgctgatttaactcttccatatggaagagtcctctacgactatctccaataaagtttgctttcctaaaaatatatatatataaggagaaggaaccatgaataacaaagtaatctccgctgaagaagcagttaagaaggtcaaagacggagacacggtgatgttcggagggtttctggcaggaggctttccagaggacctggttcgtgcgcttgtcgacaccaatcctgccagcaatcttacgattgtttccaatgacacaggcacaccggaattatctatctataaacttgtaaaaagcggcagagtaaagcggatttttgcatcctatatcggctccaatccggaaacgggaaggctcctgatgacgaaagaagcggaggtccaactcttcccgcaaggcacgctcgctgaaaaaatacgcgcaggaggagccggtttgggcggggttttaacacctgtaggtgtaggcactgttgtagaggaaggaaaacagaaaatcaaaattgatgaaaaggaatacttgctcgaactgccgctcaaagccgatgtggcattaattagagcccataaggctgatgaagcggggaatcttgtcatcaacggctcttcacgtaacttcaatatggttatggctacagcggcagagtatgtagttgctcaggtagacgaatacgtaaagacgggtgaaattgaccccaatcatgtcaacgttcccggaatatttgtcgacgcaattgtaaaggtgggtgaaaacgcatgaataacagagaatttattgctcgaagaatagcccaggaattcaaaaatggtgaagttgtcaaccttggtgtcggattgcctacaatggtagtggactatatccccgaggacattcatattatgctgcaggcggagaacggaatcctcggtgtaggccccaaagcggctcagggaaaagaaaggctcgattgtatcgattcaggcggaaactacgttacaactatggaaggagcatgcttttttgacagtgcactttcattttccatcatccgcggagggcatgtggatatcaccgtgctgggtgctctggaggtcgatgagaaaggcaaccttgcaagctggatgatccctgggaaaaaggtgccaggtatggggggagccatggatttggtagttggagccaagagagtgattgtagccatggagcatgtgaacaaaaatggggcgccgaaaatactggaacaatgcaagctgcccttgactgctgtaaatgttgtaaagaccatagtaaccgaaaaggctgtcatcgatgttattccgggtaaagggctgctgctaaaagaaattgctccgggtttgtcggtggaagacgttcaattagcaaccgaggctaaactgatggtttcaccacatttgagggccatagcagtataaaggtcatagaaaggaaccagctgtaccttcaaattaactggtctggcgcttaacttgtcccctcgaccgcatttattattacaaataaggttcgctaattgctcattgagcaattgcgagcctttttttgttggaatgggacctttcaagcagcattctgtgatgaaagactacagctgtccaagatctttctacagctataccccatactatggaaaaaatctgttttggtgctcctcttctattgttcttccagacgatctacacggacggtttgggtattggtgggtctgctgcctatctgtacagtggccataccgttcgcttcgtctacatgctcaatccagatcggtttaccatccaattgtacggcaatggtatcgggcgaatcataaatagcttttgctcgttccacattcatgctattcttcccctcctgattgttgttgtctgcattcattcagaaatatagttcacctagtcttcatctataatccgttcaacatctaatgaagggatgctatgagaaggcgaagttgaaactacagcctccaaatccacatgagccacagctatgggaaaaggcggttggattccatgggaaagagcaaactctggcggcaatgcatcctgttcgcctccggcgggtccccgaaaggcgacatgattttgacccacacgatgcctgatttgccgaggaaaggattttccggacataaattgtgtacctccttttgaatcggatatgccttactatgcaccaaaattgttgtaaccatgcgcaagcagaagtaattcgcagtcttcatttgcacctcatacaatcacttgtacgaagcatactaagtgaaaaatcatatgctcatatcccggggtgaccggaatcgaaggtgcaaaatgcggatttaagaaaagggggactggcggtatgcatacggtctggaaaggcgcaatcagcttcgggctggttcatgtgcccgttaaaatgttttcagcgactgaggataaggacatttccatgcgttacattcacaaggagtgtggaagcccacttagctatgtacgaaagtgtcccgtttgtgacaaggaggttgaatgggaggaaattggaaaaggctacgaatatgaaaaaggaaaatttgtcatgttcgacaaggaggaactggagcaagttagcggacaagcggataaaaatattgtcattttagattttgtagatttgcaggaaattgatccgatttactttcagaaaacctattatttgtccccggatcaagctggctccaatgcgtataagctgctcatgaatgcgatgaaggataccgggaaaatcgggattgcccaaatctccatccgctctaaaagcagcctggcggctattcgggttttggatgaatgtttggcggtggagacgatgttttaccccgatgaaattcgccccattgctcaagttcctaacttaccggggcaggaggaggttaaagagaaggagctaactatggcaaaaatgctgatcgagcagctatctacaccttttgatgcagcgaagtatacggatcagtaccgcgagcgtctgctggatctcattcagcataaagtggctggtgaagaggtgcgaatcgccccaacacagcctcagaccaatgtagtagatttaatggccgcccttcaggccagcatcgaggcagtgcaacctgtcgttaccgatcccggccctgctgcgaaaaaacgccctgcgcgtaaaccagcagccccaacagcacagcaggctgttgcaggcgagaatatctctccgactccagtcaaaaagaaaagaagcactgccaaacgtaaagaaacttaagctgagttcagaaaaatctggctaaggggtggcggtgagactgctttgatacgatagtagctgactgaacgccccccgctcatcttgttccagttggcggtagttcccctgctgtatgacctcgccttgatccagtacaacaatttgatctgcatgtctgatggttgacaggcggtgagcgatgacgatcaacgtcatttgacctttcatccgttccagtgctgcctgaattgcggcttcatgctcaccatccagcgcacttgtcgcttcatctagtataagtaccggaggatgatgcaagacagcccgtgctaatactagccgttgacgttctcctccagacagacgaatcccgcgatctccaatgaccgtgtccagcccttcgggcagtctggatacaaagctgtctgcggctgcaaaatgtaacgcctcccatagttgctgctcactagcatccttatgtgccagcatcaaattttcgcggacagtcgcatgaaataaaaatgggtcttgtgacacgtaaccaaacgactgccgccactggggcaacaattcgtcgtccagaacaagcccgtctattgtaatctgccccccagttggacgtaaaaaacccatcaggacatcgaccattgtacttttacctgctcccgatttccctacaatggctgtcattccccgggcgggtatgaacaaattgatacgacgcagcgcaggctctgctgcaccatcgtagcgataacccagatgactgcattcaattccatgacgaagggacaggggttgccgtacagctgcagatgatagattgaataccgatggatcggagaaagcttcgcactcctgttgcaccttggtgacactttcaaaagcggagatcatagacatgatgtattccagactcgcttgaataagggcaaatcggggccataagcgggaaaatataagaatcaacacaatcagtttttcagatgtaacatgcaaccattgcaacgaaataaatatgacacaagcgacaaaaacagctgccgctgtacgatggaaaaactgtgtggacgcattttgccggacaaattgggtcgtattatcctccattcgttgtgtcagggagcgaaaccaatggatattcgccgcttccaacagattgcttttaatatctttcatgccgttcatgtgatccgtaattccagcaaaataaacctgcgacagctcagtcgtacgatcacctaattgtttggcatttcgaatggagcggcggaacacgacaaacagccccaatccactcagaaataccagtccggttaaagagggggataaccaaaaagccagcgcaatctggatcagcgtaaacatgacggctgtagtcagttgaagaagcaaattcgttccctgactgacacgcgccagctcagtcgtcatcacatggctaaaatcagatttacgctgacgcaaataaaaagcccactgcgccttcataaaggaagtgtacacgtctactcgcagagaacgcataaaacgctgctgaatccgcgaattcaggatggattggtaacgctgaagcaaagcctgccctgtaagcagcactacaaaaaccatcaacattcccggcaacagccagcttttaggaatgaacggcaaaaaatgatccaatccatcagacagaaatggcatccctgaatgaccgacaaatacgccgatggccgccagcataggaacaagcatataaatgccaaaaccctcaagcaggctaacaataatcatacatccaatattgagaaataacgcaccgccgttcacgctatacagctttgtcatatataatcgcaggtgaaccataatgcacactccttatcgagtcagtgctttgaaaatcgccgcttcagccaaagaaatggacgtaaagggatatacaaaaaatgcagctggcgaggcagtggaaaaacggccgaatcccccgtagaaggaaataaacggctgatgaggtaacttagtctgtgtcttggctcttttaaggaaagcaagtaagtgcggctgaccggctgatgggcagccgccgtgtttctggtcatgacttggctggaggcgacagctggagtaatgggggcacaactggtagctgtgctcatcgggctatagtcgtcgttactgacaccttctgtgatgctagtaacgccactggtggcaagcatggctgcttcgccacaggtactacacaatgaaggaccgccatccggaggggcggcctccgcttgctccgccaaagctctgctgtgcagcagctctgatggagcaagcctacctgtacccgacccgtgggcaatcgggtatggtgcgggaacgctggcctgcatgaaggccagcgcgctcagcgcgagcctgtgcgcctgccgggtagccgataccggacgcatcggctctggtatcggcgtacccaacagcgcaacggcgagcgcccaggcctgcccgccagcaggcaggcccccgtagcggcgcatcatcggcagtagcgcctcccaatcgacagcacataccgcaagcctgtcgatgtcaaccagccagcgtagcctgaaccagccgtgacgcgcaccatgcgcactcaagtacagaaattgatgctcgctgccaagcgtatacatacaggacgtcatggcagtcctgttgtcggcaggtgccaacggtaccatccgactggctcctgtagctttacccatttgccgacagctccacagctcgtcaaaagagggttccccacccccatccgggtgaagacgccaatgcaactctatctctacccgtttttgcggatggaggtaggatgcatgatggtccttccatttccaactgccaaggacacgcacttctccgctcttggacgcatatccggcttccttcatccattgctcagcctcatccatatcgtcaggggcaatgagtaaatcgatgtccttggaggtacgcagagaaacatccccgtacaattgctgtgccagagcaggacccttcagcataagcacacggattccatgagttatgagcagcctggtcagacgcccggcttctgcttgaagatgaagcatgcgaagcgtgtttcgatgatattgcgcctgaaggtttcgcaacaattctgcgggaatgaacggatgattcaatgttttcagttggagatacaccgtaggtaccactcgatggtgctcggtcagacgtaaaaagcggacccaatccatcccacgcagctgggtagcagcagtcttatcctgccaatgagaaacgtctttccccaatagagagagtaacaacgttaattcctgatcctcattccaattcgcaagttccaaaacagacttggtgggcatgcattcttctccttcgattctttggacttcttttgtctcatcgcgttaaagtaaagaactacctttatctgccatatttgtacttgtatccgtcacagcacgtctcccgaatatccccaccaccgtaaatgcttccatctcccgtttccccgtaacataaatcggtccgctacgtacccatgcatgtgcggccaagcggccagcggcatttttggctgtgcccagatacagcgtgcagtccagttttctacgtcccagcaatgtcattgccgcagcggcttgtacaagacaactactgcgccaaggagtataacggcttgccagctccacagcgtgcgagatctgcttaatggacttctcctgcctgacatcacactgccatggagtttcttccatacttatgccccaaatccttgagtaatcccataaagaacgacgctggcgtagcctcgcccatcccagctccagccaggcttccggcaacaatctcctgacctctggggacaggagaagaagccgttgtatccgcatattataccgactcccgtagaagctttagcagtccttcccgctccaactcagccacaaaggtgtgtacctgctgtctgcactgttcctcgtccacctcatattcgttcgtcaggacagttacgatatcgccaagtgaaggaccggattctgccagttcccagattcgtcctcctgtgaagcctaagttgtaatatttaccagtgttaatgctcatcatcactttttccccgtccatatcactgacgtagacctcttcaccgtaaatgacgcgataatggtctttagctggattagtggctaccataactcttctcctccttacgaatgatatcaagtacccgttgtacaacctcggacgcagtaaagacggaactatccctcagcagccgccagccctctattttacgagccatcctagccgctgtatcaaacgaccattcactcaaacccattcgcggaataatcaccctacgatatgtatgttgtagtaatgtatgcaagcactccagaacgttcaagggctgttccgtaactgccactaactccccttcgcgcatcgacgcacggattggagaatctgccactagctcaaatacgccccctaagggcagcggatcgttaaaaaattcatctacggcgggtacggcatatttattcagctcatctgcaagcatacgcagatctctgtattgtggcattacagaattgccatccgttagggaccgtatgtggtttaatgtgcgtgcatgcttgttctcccgtaaagcctccagttggagcaagctatccaaccccagcttttgctgcggataagctggatacacgatggctgaggaagccgtagcttctacagcaatcacgtcatcactaaccatctgataacctgcctgcctaaaagtagcagccagtgtcgatttccccgtacccgattcacccacaaatgcgtaggccctccccccaatgacgaccgcacttccgtgaataggtaatattcgtctttgcatcagcagaacacccatgcatgtacccagcacaaatagccgcacggtgtcaggatcggccccggagaatatgcttacctcgatttccttgccttccctgacggcataaatggccgtgcctggtatttggaacataaatcgttcatccagcatcacaaaattggcctgttccagctgaccactccatgcagtcaaatcagcctgtcgaatgactacatcctctactgcttccggtgctgccaggagcagctcaggcagattcagttcactgacaatcctgagtccaaaggctgtatatttcgtccaactaacatttgcactcctgtcatgcacggtaggactcactcctctgtccttaaaaatcccgtctttatttcttgggcaaacctctaacccgaaagaaataaagacggctctgtattgaatacgagtccaatggattatgctattttcgttcattcaatcgttatcggccgagctgtttggcttccagtccaacatcggctacatgtataaccatctattagcttggattataaatatcggcatcgtggtcggacacccaatcaatctgtctccagcctttccccgccatggtctggctaatatccagcacctctatcgtcggttcctgccattcttttttactcatttcatcacctcccctccaacgaatgacgaactgtccgtccggatcaatctgaatcagttcaatccacagagaaaacggtacacgatcaggctatgcattagtagtcgtatatttggatcagacgcctgttcagggcgggggtggcgaagtttcgccatagccgtctttattaactcaatattgagatattcagccgctcgtaaatcatgacacatcagttgaagctcccccataaacgtatcccagcaaggaagcatacgatgtagccaatcggcaggctgcacgccgcgtacccgctggttcaaccgaacgtcatcaggtagatgatcacgcatggctttacgaatgagggcacggtcccgaccgttttgcacatactgctcaaaaggcaccgataagcaaaaacgaattacccggctgtccccggtcggatcacgttcccatagtccataacgtagtgaaagtttggtcgcgaccacaccatttttgttggcaatcgccaaatttgagaacttctcttttctcgtctgatcggcattttttatccaacctgttccgctcaatacaggaatatcttctacatgcatccgtttggcaaactccgggtgaatcagggaaggaacgggacttcgattgctacgccgcaaccatgaatgagattcaagtgaagtcgcttttttcaacattacggggagtagatgtgacatacgcctgcccgtaagcttgctgtaccgccacaatccctgaaaggattgcaaccagtgcaaacgacgaaactgccgggcataatagtctagtgcagggccccacgatacggtaaagttgcctcgtgccccggtcaacagtacaccgacattgtgctcctgtgctttttcgtaaaaacctctgatccagaaggagttttcaaaatatttgtagggtgcttccatgagttccagccaaatatcaatttctgaaaacggacttttcccctcaaaatccatataattctcgtgaatgttgcccacatagcgagccgtagactgaatatagcttcgttcgttcgccagcaatgtaggcggtgtccagtctgtaaaatcttgaacaggcacatagctgtaggcatgcagcggcttttgttgcaagtgcagcgatggcgcggcaaagctggcaaccgctccagaatccagccctccgcttaaggcagcccctacagcgcgatgcgtccgtagtcgggcagtgaccgcttgtgtgaacacctcgcggaaagcttctatgtactcgccccctgttttgagccgcagtggctctacctcatccagacatgcatatttatgaagggttcgctttccctcctccatcgtgaaccaatgtgcaggaggaagctggttgatatgcttgtatgcggtcgttccgatatcgacggattcctgcatggctcggatggacaaaaattcggccagccatggctcatacaattcttttcgcaaagaggacagggccaaaaggggagcgactaccgtgctaaacgcgaatcctcggtcatgctggtagatgtacaacgtacgattgcctgtcatatctcgagcaccatataaccgatgttccttggcatcccaaataacaaaggcaaaatcacctaacagataaccggctgcatccactccccatttgtcatatgccagcaaaatcagctcgctgtccgtgatatcttgtcgccgttcctgctcaactcccagccgttcaaacagctcggaacgattgtcaataattgcatccgctgtgattgccaaatctcttagctcatcatggaagggaagacgctcatgaacagattccggggtcacatgctgggcatgacaacccaaaaaaatagagccttcacaccaagcgcatacgcggtcagcgggatattttcgcagggcttgcatcattttcccgccttcttcggtgcatacggactcatgcccaaagctatagattccggcaatcgcactcacgttcttccccctttttcttttcctatatttgataacactacagacgccaaacgcccgagcttacgggcaaagaggctgcgatatcggagaccttgatttgggcgttgatagctttggagctgagcgataagacggttccgctcctcacagctatgtgccaacctgttttccagggattgaatccgccgatcgttcatgatctggttcacatgcatccttgccggatcttgaggtgcagcatgacgggttgcatttatcatgagttctctgttatctgcatcctgttcttccagcatccgataagctgccttccattcaaagccgctttgctggaggaattgttgtgtacgtcgactcagcaactctatatccggctcatcctcaaagcggactccagtcatctgctcagcctgctccagctcttccgcgtaaccaagctgcttaaacatgcgggacccaatgcttctgcaatacagctcaatttccgttttactcaacaagtgttgccagctatgtaccgaatcttgatgcgcctgctcatgctctcctacgaagggatcacccgctcccatactataaaaaagactggatttgggcgtatccgcaaagtccccgtacttttccatccccagctcgtacttgattcccagaaaaccgcacagcttctcgatctccatcgttggattggatacgagttgttcatatctaagcgggtatgcaagtggatgaggtgtagcaaaataatgagcataacggaataaaccaaccgtaatatccgtcattttcatattaaaatgcggactccccagttcttccagcagttgaaaacgtccattccgtagctgattaacctttttgaatgaggccacaatggccaaaggattccggataagccatagcctacgggcagcagggaataaacggtctataaattctaaaaccgtatagtaacgcggggatttgtcgataagcatatctgctgttgttccttgaagcagaccattatatatttcaagtgcatacgaacgggaggcctgctccaatacatcgggggggaccataccttcaaaaaattgccgaagtatccctgttcctccatatggccgtgcatgtgactgaggaagatcatataaactgagcagaaaccacatttcctgcgtggcaaacaggcgggaatggttttgcaaaatggcggtaagcagcgagcttccactccgagggacacttaacaggaataccagccctccgccttgcttttcaatcaagcaaactcctcctctacctctgctcaagacactttgatagatacatatcgtattttttattataaatttatgatacatagtgtatcttgtcaatccctttgatggataaattcagcacttcacgttcatgttaaaccatatgtagatctatgagctcaacaatcagcctataaataaagattttgctgcatattaaccaaaggaggtagcactatgggacaagctgttaaaggcacaattaccattgaaggtcaggaaattcctatcacaaacccagataaaccgctgtggcctgaagcaggcgtgactaaggcgctatatcttcgcaagctcgcggtattggctcccttcctgctcaaatattgccatcatcgtctgctgaccgtcatccgctggccacatgggattcatggtgattttttttatcaaaaaaatgccccacgtcctcggccggactatattgaaaccgctctgcatgacggtattgaatatattgtgctcggcaaattgccacaacttctctggcttggtaatcaggctgcgttggaattccacccctctctacatgaagcgggaagcaagctgccctgtgaatggatgatagaccttgatccatccagagaggtggagccacgtattatggaggccgcctctattgtcggtgaagtactggcttcgcttggtttggattccgtccccaaaacatccggggctacaggtgtacaaattatcgttccgatccgtacaggcataaccttcgacgaacttcgcagcatcgggctattagtcgggcagtttgtgacagaaaagcacccgcatctgttcacactcgaacggttaaagaaggaccgtggaacagccatctattttgattatttgcagcattatcaggggaaaactctggccgctccttataccccgcgggcacgccccggcgctacggtctctactccgctaacctgggaagaggtacggcaagatgtatcaccacttgactaccatttgctgaatattgaggaacgactgaaccaggtaggcgacttgatcgacaaggttcctccccagcccgtagaagacgtcctcaagcatatgcgcaccaaggcacaccgaacctgatccatgcttggaagaacaaaaaaggggacgaaccccgcagccattaggctgagaaattgtccccttgcgctagtgtattccttttttcttaaagcgtccgcccttcacatcgtgaatgttaccgatcgcaacgaaagcgtgcgggtcccaatcttcaacgatgctcttcagcttcgcttcctccagtcgggtaatgacgacaaaaatcactttcttgctttcgcccgtaaagccgccttcaccttccagataagtgacgccccgtccaagacggtctgtcagggcatccccgatatcacggtatttttcactaataatccagaccgatttggactgatccagaccttcaatcgtaatatcaatcattttcatggcgatataataagcaatcatggaataaagggcatttggccaaccgaacacaaaacctgcacttcccagaatgaagatattaacgaacagtacgatctcaccgaccgaaaaaggagttttttcactgacgagaatagctacgatctctgtcccatccagcgagccgccggaccgaatcacaagacccaccccaacaccgagaatgacgcccccaaaaatggcgccgagcagcggttcgccaggagtcaatgcacttacattgtgaagtaacgcggttccgatggacataacgacgataccgaataatgtggataaagcgaaggttttaccgatttgtttgtagccgataagtaaaaatggaaggttcaacagggtcaggaaaataccgagcggatagccagtaatcttggaggccatgatggaaatacctgtaacgcctccgtcaataacgccgttaggaaccagaaatatttccaatcccactgccatcagagctgcaccaaccacaatcatggctgcacgctgaaacaggcgttttactttgttcttcggattagctggaattttgctgatcttggtcaactctccggtcacatctgtgatctcagacagattttggacttccttgctcactacactcatatataaatccccccgttacagtatggtatattggaccgaaaaaggggctgctatccgcagtcccctctcctttaccgcgcttgtgttatatgaatagtataccataaaactgcgattttgcgcaaaaaagttagcaaagagcacataaatcacaataaagtgggattatagcgataaaaacgtcgaaaatcgcctttaaaggagtggagagagcatgcgagttagaatttcagctgttttctgagatcgaggccgtctgcggaacacgttcaaatcaatgcgtgaggagttggaaatgtcctctacaaaatctgccgaaagccgttccagcgctgaattagcaaaaactacagcggtcaactcaaaattatagaaaaagctgcgcatgtccatattggcggtcccgaccgagccgagtaaatcatcgacaatcactactttggcgtgaataaatccttttcgatattggtagaactccacccctgtctccaacagttcttgcacataggataaagacgccagatgaaccagcttcgagtcagattggtagggaataataattttcacatctacgccactgactgctgccagcttgagcgcctcatgaatccccggatcgggaataaaatacggcgtcgtaatccaaatccgctttttggcaaccgtgagcgcaccaaaacacatttcctgaatcgtatcccatacctgatcgggaccgctgctcaaaatctgtacttcctcatccccggtgcaggtatgtggaggaaaaaaattcacatccatcaatctctcccctgaggccagcttccagtcgctaagaaatgcattttgcagaaaatagacgctatctccttcaatctgcaaatgcgtatccctccaaaatcccactttggggtattttccgagataatcgtcgcctatattaatcccacccacaaatccaatcatgccgtccaccaccacgattttcctgtgattgcgatagttaatccggcgatccaaagtggcgaaaaacggaggtagaaaataatgaaattccactcccgcctcactacaggtacgaataaaggagtaaggcaaattgtaacttcctacaccgtccacaatgaatcgtacctttactccctcacgtgccttgcggatcatgacctcttgaaactttcttccaatttcatcggcccgaaatatgtaaaattccacatggatatgatgtttcgcttgttccatcgctgccagcatagcctcgaaggtttcttcaccgttcgtcagcacacgtgtgcgattacatccagtcaacgggttttctgacatgcgaattaactggttaaacagacgctcctgatgcttgaaatgaggattatgcatttgctccacctgttcaatcactttggattgcgcccacagacgctcgcgaaattcacgaaacagctgcgaccccccttttcggaccattttgcgcttctgataatcctgtgcaacaaagtagtacacgacaaagccaatgagcgggaagcaaaacaaaataaagagccaggctaccgctttggacggcttgcgaaattcaaagagcaggatcgtcccggtctgaaaaataaaaacaattaaagccaacagcaaccacagcatgtctaagcctccttatatatcttaggattttgcaaaatcctcatctacgttttatactaagctccaatttttttgacatgtttgcctctttagctgaatagatagtaaccaagcactataggagcgatgtccggaaaggagcgattatgaaaaaaggaagcctaaatcgccggatgaccctgcttgttattcgggatgcacagcaaccgcccaagcagctacaatgctctacagccgctgtcattctcgtcccgactcttgtgatcgcgtctatctctacactcgtgatcgggctgcaaatccgttcttcccatattatctcccaaatggaaacgaatcttgctgtccagagtttgcagatggaggtcacggtagcggacaaggatgcagccattgggcgactacggcaggaagtcatggaactgacgaatcaagccaccaatattcgtgaacgccttcagcgcgtaacagagctggaacaacaaatgcagcaattcattcgtaaacacggaaactcatctgccacaagtaaccataaaaagaccatgacgccgctctcctgggatgcttccggccatattggaggtgaactgatcgcagtgcatgaaaatactgccctcctaactcgccaggcaatggatgattttcaggagatcgaatctctgttggacacggtggaacgtacggttccccgctctattcagcaagcaaatgccgtgcagcagaatctggagcgcaaacaagccgcacagctactccagacccgtaggctggctcttgccgaacaagggaatccctccgtttggcctgtaggttcacggcgaatgacctccagcttcggctatcgcagcgacccttttacgggtaggtctgcctttcattcaggcgtggacattgccggacaaaccggtgatcctgtctatgcagcaggagcaggcaccgtcttggaggctgcttctagcggagcccgcggcaagtgcatcatcatccagcatcctgacggactccagagctggtatatgcacctgagcggcatgcaggtggctccgggagatcgtgtccacaaaggacagaccatcggtctgttaggaagtaccgggagaagcacgggacctcatcttcattttcagatcgtcaagcataaccaacctgtcgatccattactgtatgtacaatgaggacttttcaaaatccttacaataaaagattgggggaaaaccatcatgttcaaggaatccaaaaaaaagctctccgccccagctatggatacactgctcgctaatggcaccagctttgaaggtacagttgaggcagaggccaatattcggattgacggtcattttcagggcgatatccgcagcactcgtactgtcgtcattggagaatctgctgtggtacgttcggacatcatcgcacaagacgtcattcttgccggtaaggtgttcggcagcattactacagaaggacgactgaccattacgccgacaggtgaactgtacggaaatacggcgaccgctgcattggtcatatctgaaggcggtgtactggacggcacaagtcaaatgaaccgaacaaaggatgtagagttgtcaacttctacagatgagtcaaacgacgaaacccaatctagtttcagcaaaaacagggaggacagccaagccgatctgcaatccgaagcaggataaaatcaatatacactcactccattaaacccagtgcgttctccattcattccataatatcctccactctgcgttccaaaaataattggtacaccttacgtatgacaatttttccgcacatatacaatggaatcaccaaaatgatgcccagaatcccgagcaggtcgccaccaaccaacagtaaaataacgactgtcaacggatgaatatccagctgcttgccaaaaactataggtgacagccaattatcctgaatttgctgtgcagcaatcaccacgaccagcgaccagagcgccatcgaaggtgattcgagaaatccaataataactacaggtatagaagcagccactgcccccacatagggaataaaattaagaaaaatcgaaataacggcgagcagcaaggcataaggcaaacctataattaaaaatccaaggaacatcatcacacccaacgcgacattgatcagcacccgactcacgataaagctgctgagcgcgctatcgatatcttccatgacctctaacgcgtctttgtgatattttttaggaaagaagtttagcattttagggccaaatttgctcccttccttaagcatgtaatagagcaatatgggaaaagtagccaatacgataaaaaagtaggatacgaacgataccagctttaccgagtaatcagacagtgtcgaaaaagcttcgttcaacgtatctgacagttgtgacagcgggtcttcacccggaggcagcacttgtctcaaggattgattatgccgccattggctcaattgatcaaccagacttttaatgagcttcggcgcattttcaaataaattggttacctgatcacgcagcgtaggccacacaccccatgagaaaacaaacaataacactccaatgaccaaataaatcagcaaaatggagatagatcgtttgatttttctacgttccattacatctacaatcggcctcaataaataatagaggaaaaaagatagcatcaacggcacaaccagcaagctgaccaaagatacgagaggactgaatataaagcttactttggtgcccaagtaaatgatgagtaatagcatgacaataccagtagtcaggcgaaaaaaacgattattttgcagcatatcatgcggcccccctctgttctgttctctctacctctttaaacgcaaaatgaccctattgattgattgttgctgaaaatagattacaatatacccctacactcagaatgtgtagcaaaaatgacatagatacaggataaaatagtgttaaatgaggattttgcaaattcctgaaataataaaaggacgtccaaatgctaggcatttgaacgtcctttgtgttactctatggcacttccatttaggtcgaaacatcccgttttacgaaaaccacccaggcaatggcgataaaaatcacataataggcggccagcacggtgagcgaaaaggttagactggaacttactgtacccggcggcatatctagatattttttcagatccatatgtgtaaatagtacgtatttagtccattcataacgatctgtgctgaacaagccaatagagttatagactgttttggtgaacatcatgaacaacgacagcccaatcgccaaggcactggaacggaaaactgcggatagcataaatgcaaaggccatcgtcacgaataaggcgatatagctatacaaaaagttcagcgttacataagatatcggatcactgaacagcggaacagaacccgctggtgcatccttggataacatcagccatgaggacagcgtaaccaacaagatcaaaatgatcgttccgagcaaactgaacaaaatcacggatatatacttggacaacaatattttgctgcgagtccaaggtcggatgagcaacaacttaatcgttccccaagtaaattcaccagccaccgaatcagcggctacaatgaccgtaaacgtcgtattgaggaaaaatgtaaacaacgtcgtcaacgcaatcccatcccacacgctgacctgatcggaaaccagggaaatcagcatcggaatcgcagccgtgatgaccgccagcagacccagcataatccatgtgcgcacacgcaggtaaattttcagattttcgttatgtaccagcttgaagaaatcagccaatgaacccgcctcccgtcacttccaaaaattgatcttccagcgtacgggcaatcgggcgaatcgcatatactttaattccgtttgcagccagcaggctgttcatctctgcgatctgttcccgctccaagtgaagcagcagttgattgccttcgacgcgccctgctccagcaagcgcataagcttgctcggcatcatttacctcaaaagcaatttctgccgtctgcacttcctcccctgtattcttcagctgcttgatatcaaccagccgtccgctctgaataatggctacacggtcgcacatcagctccatctcagacaacaaatggcttgatacgaacacggtaattccttccgtacgggtcaattgacgcaaataatcccgcagttctcgaataccctgcgggtccaagccgttggtcggctcgtccagcacgagcagcttcggtcgatgcaaaatcgcctgagctaccccaagtcgctgccgcatcccgagcgagtaggtttttactttatcatgaattcggtttccgagtcccaccaaacgaatcgcttcatccacgcgctctggggtcaccccaggagacattcgcgcaaaatgctgcaaattttgatagcctgtcaaaaacttgtacatctccgggttctcaacaatcgcgccgacatgggaaacggccttctcaaaatcggtattaatgctgtctccacaaatatgaatgtcgcccttgctgatcgaaatcaggccaaccatcatacggatggtagtcgtttttcccgcaccattgggtccgaggaaaccaaatacctgtcccgccggaacctccagcgtcagatcatccacgatcgcttttgaggaaatgattttactcacaccctccatacgtatgacgggaacctgtcctgtcgcttgctgcatactatgaaactccttccatccggagtgaagctgttatccattttactgtacatttccggttttggaagtattgtaccatatttaaccttttagaaacaccacgcaacctctattccttgtccttgtatatccaaagcacccgccatttctcatcttcctgtgtcacataacaaggctgtacgatatcaaaattaccgaatcgggtcttgtaatgctgagtgaccgtaatacggtaaaccttccctaactcttctccattcggatcggtacgaatgtcatactcagcctgcggctcccccagttcaaacgtgaacgtatccgtccccatatcctgcataaaaacgtgcgcacgctgctgtacatacgtagatttctcgaatttctttttcatttgcgaatgaaaaaactcccatgaacctccgaaatttcccgattgctccatagtgtaaaactcgttcagtgcttctaccgcttgatcgccctcgcctgtagacatcaccccacgcagacccagccacagcagccataacaatccacatatgatggcaaaatataatagcttacggacgaacgccgaagccgctctccttctaaacagcacacattgcccctccctctgttggactataccgaattctctacagatgtatgtgggacaagccttgtttagaagtctttagaagaaaataacgggtgacctcccaaatagggcacccgtctacataaggcttacctaaggcgatatggccgtggtaagcatgtgcttctccagcactccatggagacgctggcgttcctgctcctccacaatgtaataatatacaccgttgattttacgcccatgtcccttcagttcaacggtatccgtctgcttgagggacggaccgatccgggtcaggaaagtggtcatatcgtcaaaggtaatgtctgtgcgaatctgctcccccgctgcttccagtatcggctttaccctcaacagcccttccttgctgatggactgggccagaatttgcttgagtagctcccgctggcgggcatttcttccgagatccccacgtggatcatcgaatctcatacgggcgtaggccaacgcctcagccccgttcaagttcaaattaccctgcgcaaaatgatggccctcatattgaaaatcaagtggattataaacctcgactccccccataaggtccaccattttcgcaaacccttccatgttcatctgtacatagtaatctatcggatggttcaaaaaatgctctaccgtacggatcgacatatccacgcccccaaaagcaaaagcgtgattgattttgtcctcacgccccctgccgatcaactctgttcgcgtatcacgcggaatgttgaacattaacatagagccttcggcagggttaacagacaagacgatcatcgtatccgatcgtcctggatcgtgaggccgccgatctacgcccagcaccagcacggtgaacggcttgaactgggagatggctgccggattgggtgtacttgatccaatgtctgtacctacagatcgccctgctccgcccgttgcaagggtagaaaccgccccaggctgcacgatgctgcgcggatgatacatcgcattcgccgctgttttaaaggaatgatacacataagcggtgtaggcagtagcccctacgagcaataacgccgcagcccccaatgtcaccttcagccatcgtttcatacgcagcctcccctttacggattcactacagactgatgacgatctacatccagattgttcatctgtggcctgccgacagaatagtatgcaaaggcggattgtctgatttgctcctcgctgtacacattgcgtccgtcaatcataattggatacttcataagctcattcagctcacccaacccgatatcaccaaactcttcccattccgtcaatagacacagtgcgtcacatccctctgccgcttctcgtgcgctatctgcccacgttacttccgagctgtccagcagtctgcggaagttagcggtagcgatcgggtcatacgcacgaatttgcgcccctgcctccagcagcgactgcatgatatccagcgccggggcatctcttacgtcatctgtattcggtttaaaggccagtccccatataccaatcgtagctccctccagatcacccagcgcctctttcagtttacgaatcaagttaaaacgttgcccctgattcacttccaccacagatttcagcagcttgaattcatagtccacgttacctgcaatttggatcagagcttgtgtatccttgggaaaacaggaacccccatagccgataccagcagacaaaaaggaggaaccgatccgctgatccagtcccataccgtgtgccacgcgtgtaacgtctgcgcccaccttttcgcaaatatttgcaatctcattaataaacgaaattttggtcgccaaaaaagcattcgacgcgtacttgatcatctccgccgaacggatatccgtggttacgatatttgtcgtcaacggctcgtgcagtgtagtcagcacagcggacacatgcggatcagaagctccgatgatgattcgatctggctgtagggtgtctatgactgctgaaccttcgcgtaaaaattcaggaaccgaagccacaccaaacggataatttgtgcggctcgcaatccaattttgaatacgttcgttcgttccgacaggcaccgtgcttttggtgacaattactttgtagccattcatggcgtctgccacctcgcaggcggcttcttcaatataggacaggttcgcttctccgcctggcagtgaaggcgtgccgaccgccaaaataacaatttcggctgcctccaccgaaacagccgtatctgttgtaaagcttagtcggccttgttctacattatctttaattagagcctttaatcccggttcataaatcggcaccctacctgcacgcagctgatgaattttatcctcattctgatctacacagacgacggtattcccgagtgcggcaaaacagacccccgacaccagcccgacataccctgcaccaattacacataacttcaaagcaactcccccttttacatgctgtctcattgcatcctgcttttaccgacttcacttctctatatctcttcctgcaagccgattatgataaagcataagccgtttgttttgccgataagattttagaaaacggtatacatacatcggattgttataggcatacctcttccataatcgcttcggttcacagatcagacgatacagccactccagccccagcttttgtatcgctagtggcggtctacgaacctttccagtgatatagtcaaaggccgcccctactccaatcatcacgccatgaatgcagtctttattacgatgcatccatatttcctgcttcgggcagcctaagctgacgaatatgatatgcgcgccagacgcattgatttcatcaatgatccgctcctcctcatctgggtgaagctcacgaaatggtggtgaaaagctgcccgcgatgcggattccagggtaatcctgctctactctttcttttaagctatccagcgtatccggcgtactgccgtaaaaatatatacttaccttcgtctgtggcgcacgttcgcacagcttgagcatcagactgggaccatctacccgatcctgacgctcaaatccgtacagcttgagcgcccataccaacggcataccatcgggagtacacagatcggcttgagtgagcgcttcgtggaactcggaatgattcccggctgtgacaatggaatgcgtgttgcaaatacaaacatagccgtcctttcgttcgactgcccattgttctagcatgtgtaccgtctcctgaaacgtaagtgctgcaatatctgcatccgcaatccttccgactctatattggggcagctgcttcataatcacgctcctccatcgcctcgctatatatcgccatcagctgcttcacattcacttcttccgtatagcgtgcagcgtagttttccgacaccttctgtctcatagctgcatagttttcatagactactgcacagcgaatcacagtctttatattttccaaatcatcatgttgaaaatggaaacccgtcaccccgtcctccacgacttcctccagtgcaccgagccggctgcataataccggagttccaacagaaaaagactctacaatggtcatgggaaatccttcataccaaatggaaggcaccatgacatacatggcccggctcatgcaatccagtaccgtgtctccatcctgcttaccgagaaaccgaacatcttcctgcggataagcagcggtcaattcagccttttccggaccatccccaatgatgaccagtctcaatccctcccgatcttccaactgtgaccaagcttgcagcagattgcgaacccctttttcagctgaaatccgccccacgaacaataaataacgatcattcgggtcatactgggttttcactgttttatgatggacaaaatttggctttaccgcgatacgatccagtggaataccgctttcggcaaatttgtcccgtgcaaattctgtcagcgcaatatagcgacttaccttgtgctgccatgtgccgatcagatcgttgaacttaatcatcgccgctaccggaatcgtctgaagctgtgaacctcgatagcatccatgacggatggaatgcagcagcgtgccgtgcaggcatttttcacaaaccttattccctcgcataaaggttgccgccggacaaattagcctgtaattatgcagtgtctggacaaccggaatccccagccgttcacaggcatgatagaccgaaggagatataaccgggaaaaaattatgcacatgtaccacatccggcttcacctgtaaaagcagcttcttgattcttttgaattccggcagggaccatgccgcctctaccgccagctttgccatgttcgctagccctctgctttgaatgctgtcgttgtgcacatagtaatgctctgtctctattcctctggaacgcagcatagctgattcttgctcgacaaccttgtcttctcccccgctttgctgataaaagttatggatgatcagcaccttgctcacaggagggctcatctgtctgctgacctgttggctcacgtggttgcccctctttcctgcgttgattgcatagtgtggttcgaactggtaggtttgatcccttgatggcttactatttcatccgcaatgcgatcccacgacatacgctcgaccgtaaggaaggccttttccgccatacttcgtctcagctcagcattatccagcaaatcgcctattcgaccagaccattcctcttctgaaaagcttctcagcatcactccgctcactccgtcctcaagcaaggtaaccgagcccccgtttaccgaagagataatcgggacgcgaaacagcatgctttccagcagcaccataccaaaaatatcgtattgggtcggaaacagcatcacatccgccgctccgtaaacctgccacagatgacgttgctccactcttgaaaaatgtataatactgtccgttattcccagttcatgagcatatgtccaatagcggtctgtgtccgccttccgtccatccccgaccattaacaaaaggcaactaggatgcttttggagtacccttttaaacgtagtcagcataaaacgtatatttctccgttcctccaatacaccaacatacagtagcaccggacgatctccgattcgacgcagctcatttgcgacctcacggttttcctcacattctccgcttatgtcttcactgttgttactggtgccactatcgaatgctctctctactttactgcgatccagtccgaccccaatcgtaaccacgttgtcaaaacctttattctccaaatagcgtttggcaagatcggatttgacataggtacggcgtagagattttgctaccttcggcagcagcataatatcgtatagtttgcggatcagcgcgtgcgtgttatctcggtatgggccgtgatacaacgccagcttatcaggacatttgcgagaaagcagataggtcatgatctggttgtattctgtagtaatgaccagaccataggcatccagaaaagaatctttgagaacatctctgtagatgctgttgcttaagaacttaaacccgtggagccagataatacgcaaggtgcatccttcgtgacggtagacctgttccagatgggtttctttacaatcgttatagtaaacaatatcgcaatcatagccttttcgaacgagtgctttgcccaaaccgacttcctgtaaattgtatgagcccccgttcactttgctggcaaaattgcggagatacaatattttttgaatcatcatcagggctcctgccatttcatattggattagttatggagcacggagggttcagagaacgctgcgcgttccattgatcttccgatcgctgttgcagtgggattcctggatatataaaacattccgaggtaagaatcccactgcaaaggcgaacgctagcgcttcttcagattcaaatggaccgctccgctactgaccgccgggtctataaagtcaccccattttaaaaaagggaatgctgaagtgcccccgctgcgcggatatacgcgagcgaatgcacgcaggcgttgacttcgcgctaccttgtataccgatcacattagcgataaatgattgaacagcatagagctactaccactgggctgacacaagaccttaacgatggctagattgtcgcctgctaaaagattgctatccaccaaacgctgtcaccctgacagagaacggtacagagcactaattacgccgggatgcatgcccggcgagaagttcgcggcgatagggcgaagctatcgccaaacgctcttacctttcccaccctaggggctgggggaaattcttttgcggcggtgggtagcggagggtaagggtttgaatctggagaagcgtcagcgttcgcctttgacgtgggattccgacctcttacagggcctattcaatccagggaatccctcgtcaacagcgatcggaagatcaaatccgtcccgaagcggccttccatccacaatagttgctccaggatcaaacccgccccgaagcagtctctcccctccaaaccgaatgctcacgctgcctttcctccgtcatctgcatattaaaatgatctgcccctttgagctgggcagctgccatatccgccactagagacacactcgattccatcggcacaaatcggtatttgtaggccgtaagccgatgatccgtttcgtgaaataaaatatcctgagcgtaattcccccatcggtccttgggcatcaaatcaatggtcatgccggcatgcgcagagggcagcagcatattagagccgtggataccgattactaatcggctggctgcgtatacctcgcagacccgcagctcactttcccggtcgaagcgtgtgacacgctcatcagaaatccatgccgggaagctcccggtacgcccaagtccagcgactgtaaaacgatgatctgggaagctttcttttagcctgcggaacagccatatgattttactgcgctgatgataaattagcggttttagcccacgtttgagctgcggaaatttctgtaccgctcttgcgatatgatggctgccgctccacaagcgatcttccctccatacgaaagtaatgcgcggctccgactcacgtccctcgtcatagcgggaaacacctgtaaactgctcaatatcaaactgattgggatgtgaatatgccgggctgacatacacctcatcaaaacgcatcagttcctcaatcatccgatgatgtagtacaggataaaagttacgtgccctgctgaatggcacatcaaccgtccaaatttcagacacatatgctggcaccatccactccagcgacttttgcacaatgacgataattcccaggtccggggattgctcgtattcgcgttgcacattgagcagcttgagcaatgcatgaccatacaaataatccatagtgttgacgatgattacacgtgtagaagctttcattttatgcacggtcatgccgactgctaagtcataggaaggattcatcaacgattgccgcaaaggctctccgagccattttctcgacttcgcatcaccggtcaaaatatagtcaggcatttctacacgataaggtgaatacgtggcatgaccgaccctcatgtcctcgagatattcgcgtccgcacccctcacacgcagtactgacacatacatggattccctgccacagcacctctccaccacgtaccttacctccacaatgcgggcactgttcctcatgccgaacaaacggtttaatgggtatcatgattgttctctccaactttcggtactgtaatttgaacacgccagaaggtcaggatggactttatcatccaacctaaattagatttaacttccttaaacagcaaatctaatagaaatacagatatcgtaaaggacaagattgtcgccactaacgaccctcggacaccaagcaaagggattagcgcgtaattgaaagcgatattcgtaaccgcccctaccaccgaggtcagcagcgtgtatctaaacaaattttcattggtaataaacaagcttttagcaacactgaagttggtgaaaaacagacgaatcgcaaacagagacaacagcgaacctgcttcggtaaattctctcccatacagcacaaccactacccattgggatacaaaaaataaaggtaccgaggtcacaagaaagcatataaacatcagccgatacaccttggacaatgtctgcctgtattcgtcgcttcctttctgcttggaacgcgtcaccaccggagcataagccgtcgtcagaacgaccggaatgaagcccagcacttcgatgagtcggagtgcaacggagtattgcccgaccgcagcattccccagcagttcaccgataatgacttgatcgatccgtgcctgtacatatacagcggaggatgacaatataagcggccagctgtgattcatgattcggcgagctgtggttaagcggaacgtccatcggttcacacgtcgtccttccttatggaagaaatacagcagtagcaagcttcccaacagaaactctccatgagcacacaacgctaccaaccatatcggaacaccggacaacaacagaatgattttgatggtggagccgagaacaaaagcggtattcttggcaacgaccgtgtatttggacagcatctgcgcacgaaaccagtagtcgatgatatcaaacaattgaaatatcgaggccgtagccaggatcagattgatcaaccgcactgaactatcttccggtctgagcagtgaaatgaaggaataggacagtacaatggctatcagagtacctaccaatttcagcagaaccgccgtccccaatagctcatgctcatccttggggtctttgacaagatcgcgtactaatatagaatcaaagccaagggtcgtgaaaatcagaaacatcccgaaaaaggattccgcataattccactttcccagttcctcaggtcccaacactctcgccatgatgatgctgactgccaggccaaacaccatgcgaatcattttgtcaccgaacagccaggatgtattcaccagcaaacttctgcgcggtttggcgcgttttttgactaatgtcataggttttactccatcttaaaaaatgacctttcgcacagccttataacctgctgttctgtcaatgcagctgcaatcatgtacagcgaagagacccccgctcaggcgggtggcctctccatctcttacacgacgacagaagcttcaactgcagcctgcctttttacccgctccaagtctgtatccaccatcatatgaatgagctgctcgaagcctacttccaatcgccagcccagcttttctttcgccttggcacaatcgccgagcaataaatctacctctgccggacggacaaattgaggatcaattacgacgtaatcctcataatttaaacctacatgggaaaaggcaatttgcagcagttcacgtacagaatgcatttctcctgtggaaatgacgtaatcatccggttgatcctgctgaagcatcagccacatcgcctttacataatcgcctgcaaaaccccagtctcgcagtgaatccaaatttcccatgcgcagctcctgctgcaaccctagcttgatacgagctaccgcatccgacactttacgcgttacaaattccagtcctcggcgtggcgattcgtgattgaacagaatgccagagcaagcaaacatatcaaagctttcgcgatagttcactgtaatccaatggccgtacactttggcgacaccgtagggactacgtgggtaaaacggagtcgtttctgtctggggtgtctccagcaccttaccgaacatctcgctgcttgacgcctgataaaagcgcgcttccggtttggcaattcgaaccgcctccagcatattggtgacagatagcgctgtaatctgccctgtagccaacggctgcggccacgaggccgctacaaaggattgagcagccaagttgtagacctcatccgggtcggactgacggacggcttcgatcaatgaagccagatcggtcatatcgccggaaagccaatgaatgtcattctggatatgcgctacattttcaaagttcggtgtgctggttcgtctgcgcaccccgtatacctcataatccttcgacagcagcaactcagccagataggacccgtcttgtccggtaatccctgtgatcagcgcttttttcattccaattcccccaccgttttttattgttcaaccagatccaggccttgaaatgcctgatacacagactttaatccctcttctagtgaaatacgcgccgaccagcccagtccggaaatacgggatacatctaccaacttacgcggcgttccatcaggggcggaggtgttataggtaatttctccctcatagccgactacattcttcactcgttcagccagctcacgaatggagatatcctcacctacgccgatatttacaatttcatttccctcataattgttcatcaggaacagacaggcttcagccagatcatcagaatgaagaaattctcggcgcggcgtaccagagccccatacttctacagtcggagattgattcagcttggcttcatgaaacttgcggatgagcgcaggtagcacatgagaggtctggagatcaaaattgtcgcccggaccgtataaattcgtcggcatcacagaaataaaccgagttccatactgacggttgtaagactgacacattttaatcccggcaattttagcaatcgcataggcctcattagtaggctccagttcacccgtaagcagatattcttctcgcaacggctgcggagcaaatttaggatagatacaggtagagccgaggaataacagcttgcctacattcgcccggtatgccgcatcaatcacattcgtttgtataagcagattgtcacggataaaatcagccggatattcgttattcgccaaaatcccaccaaccttggccgctgccagaaatacataatccacaggctctgtttcaaaaaaatgatctacggcctctttattgcgtagatccagttcacggcttgtgcgagtaataatatgacggtaacccgcattctgaagcgctcggacaatagcggaacccaccagtccgttatgccctgctacatatatgttggaatgaagatccatacttatcccctaccttctttgtgaaaatgaaagactttaatacgcatccttggagcctagcagcacacgaaatgttttcagcataatgatcatatctgtgcggaaactgcgtctggatatgtactccaaatccagttctaccatctggttaaagcttagatgattacgaccgctgatctgccatagaccggtgcagcctggtgtaaccgtcagacgcagcttatccctcactgtgtaattatggacttctcttggcaacgggggtctgggtcctaccagactcatctgcccacgcagtacattgaacagttgtggcagctcgtcgatgctcgttctgcgaagaaagcgacccacacgggtaattcggggatcgtcccgcattttgaacatcgcaccctcaatttcattttccaccagcagtgcagacaatctggcttcggcatcagacaccatggaacgaaatttgatcatgcgaaacggacgctcatttttcccaatacgtacttgataaaataatgcactgccttttgggtcctccagcttaatcagcagaatgacaagcagaaataccgggcatagcacgatgattccaatgaaagacaatataatatccatgcttcgcttcacgaacgggtatacgttccatccttgccgccgttcaagcccatgagcgaccgaatatacatccactgacgcacccagcacttcggcctcgttcgagcgggaagaagacacgtctcatcacctcgctccttattgataattattatttatacattgttaaaagaattttatatactctcattctcctcctttttattcatgtcagattgcgttcctccatacccctctcggcgcgggtattcgaacgcttcacattattaagtactacacccagaatgcgcgcctttactctttccaaattcgcttttgcttttttgacgacatcctttttgaccttccctgcctgcaccaccagaatgactccgtcacacatagcgcttataattaagccatccggaaaggacagcaacggcggcgtatccattaagatcacgtcataatgttcttttagctcaaccagcagagcattcattctacgggaactgagcatctcggacggattgggcgggttcggtccggctgtaattgcatgcagatggtcaatcccggtttcctgaaccacatcctgccatgcctgttgattggcaagcacccgtgtcagccctgtatgattacgcaaaccaaacatatggtgcaaggaggagcggcgcagatccatatccataatcagcacctttttcccctcttgcgcataggttacagccaaattgctaatcgtgaccgttctgccttcacccgcctgagcggacgccaccatcataacctcaatcggctcgtctatagaagaaaactggatattagtgcgaagcatgcggtactcctccgaaacggaagactgagcatgtagggatgtaacgagctgattattgattaatcgcggcatattgcccttcacctacctgtttaggagttgtagtggagctgtcagagcgtttatcttcttttttcattttcgtaatcagggatagggtaggcagaccgagttctttttcaatatcctcttcattcttaaatgtatcatccagtacctccagcaaaaatgccaaacctattcccaacaataaagaggtggcaaaagcaataaatatctgtatagcgggattactattcacgggaactgctggatcattcagactggcttcgcttaggatggtgacattgtccattttcatgatagagggaatttgccgtttgaatactttggctaccgcattgacggtttttacagccttcgtatacgataaatcgcggattgttacatccatgacctgtgaatcacctgcggtgttcactcttaatttttgcgccaaagctgacggagtgaccttaaggtcggggaagctggcgaccacctgatccataatcgccgaggagatcataatttgcttataggagttcgttaaggctatattcgtttgaactacactgtaatcaacgacacctgcacgatccggtcgtggcgtctggttgataatgagctttgcggtagcttcataaatctgcggggtaaaatatacattttttatgcccactacagtacataccagcagtacgatgctaccaatcaaccacattcttttacggatcaaacggatgtactctttcaactgcacaagaccagtcctccctgattgacttgttttcgatgcaataacgcttgtactgatcctctgcataacggggaaaagaacgatgcatgaccctctaatctatagtaaaatgttgtataatagcgcatagaaggtccagccagcgaataagcacaaaatgctcaatcatcggtggcctcttagggtatataaacgaagacataagtgaaaactatgaaataaagatacgttatgtaacttacataactaatttatgatacaaaacgtatcttgtcaagcgtaaaattgcttttttacctttcttaaccttgccttcaggaggaaaaacagatgaattatggcacccgcatcgctgaattacgagaacataagggattaaaacaagaggaactagcgcaatccctcggaattacgcgggcagctctttctcactatgaaaaaaataggcgcaagccagattttgagatcctgaccaagctcgctgatattttcggggtaacgattgactacttggtgggacgtacgacccatccggcggcaatattggattcagatgtgagggaatttgtggaccagcttgaactgtccgacgaggatattctgcaacgtttcaacctgaccattgacggacgtaccttgtctgaggaagaagccaaacgttttattgcatttgtccgaatggaacgaatgatggaataaagaaaccttccgattgcttcacgtctcgctcaagtaagaccagccgttggaatttactcgcgcttgtccttccggtatgtggttccatcagcgtcgttttctagccattctggcatcgtgaacccacattggagcaaaatgtcccggatgtccaagtcgatagcggctttgtctactttccgtgcgttgttttgaaaaagagggttgttcacccctaattctgtctccttgttcattcagcactaacctcactttattattcttggtcaccggaaagagatttcctacaaaaccatgtatgtatagtcatgaacaaaactattatatatgaatacatacctgcaatgttgtcgtcttatgacgagaatataaaaggattttcttatttttttcttcattatacgtaaagtattggcaaatcagaacgattttccaacaaaaaagaacctgtcaggtcctattttctcctgataggttcttttttgttttatttcgaaatgatgttaggtattcgttaactcaggtcctatatacattccgatctgttattaagcgacctcggctgcctgggaaacctgagtgcctccggtcgcccggactttgtagacatagtggcctccagcttttactgtgcggtctgtatacgtgcttcccgctacttgcgaggcaatcacctgataggccccgtcggtcccgtcagcacgcagcacatcataggaagatacgccttctgcctgaagccaattaatctttaccgccccatcctgaacagaagcagccttcacccctgttggggctgaagctgcggtctgatctgtactttttaattccaaaatatattgtaccgcttcgccaggacccagcttttcttcaaaatcaagggcaggagaagccttgagccctgatatggaacgctgtgcctgactgtaagtagaacccgctccaaaacgttcacccgtgtacaaaccggctttcggcatcgttacccgtacacgaacggtctgcggggtagcttcgaaattcactagattcaccagcaatttgtctgaagtagcgccgctacctgccagcggtttaagcttggacgtatccaccgcacgaacatagaccatcttgtccttggtatcctctggattcagcactgtatacgtcagaggttttccatgggtggcataggctaagctcaagcgtctcatgatcttaacgcgggtgtcctgtccttgcccgaacggataaatttctgtgttggccgggttatgactttgcagatcgaagcctgttttaaacagcgtataatctttataaaaagcagcgtgctggataaacatatcggcaaacccgatttgcgaacgcataatccgatcgaatgcggctgcttgtggctgactagccccgtaatctggattgtctcgatgcgtatcattggtgccgaactctgtgttcagcatctttttcgccaatccattgctcgaaccgccgaaggttttcaaattttggacgaagctgcccccgccctcttcattatacgattcaccataggcgtgtccattggtcaggtcggtgacttcctccagctgtttacgttgcgccgggtcccgttcccatccatctgggtcaccgcatttttgcgtaccactggtttgatttttgcacgctttggtagagtacgttggccagtaggcccagcccggtgctacggttttgagatgcggtgccaattgcttgccttctgtattcaaccacttggccacagccagatttaccgccttggagcgattaaataagccaggttcgttatctacttcataatattgaagataagaaccgtatttttttacataatcgcgcaacttttgcttggccgtctctggcagagaaccatctttttgcagcttaatatcacctgtatataaatacaaagcagacgattgcatattatactgctttaacgtttgatagtaatcatccacgtctgtacatgccttgcccacattactggcacaggtcaccctcatgacgttgccactataagcaatgcccagccacttgagaacgtatggtaaatgcttaactgcaccctgatcataataaaattctttattgttcacatttgttccggtcagtatatatttaccgtgtaccggttcggccgcaggtgaagctaacgtctccaagctcaagtcatcccaagtccaccacacatttttatcttctgcagaggagcagtataggcagcgcgctgtctttagcttgagtacgttaacaccgctttgcaattgctctttgggtatatataactcgtagttgtttttgaaattaaaagcactcccagtaccggataccccggcaatctgaataataccggacaactgatgatttgaaaatacagccatttgcgggactgctttgcccgcatccaaaatccgaacacggaatatcataccattgggaggaatctgattcagcttatactggagtgtcagttcagggttcgtggacgcattcaaaccgggaggaatatctccactgctgagcaataccggaactgttgtactctcttctgctaccgacaacgctgacaatgctcctttagcagacgattcggtagaggcagctgctgtagaaatgtcgatattatccctaccgaccatacctttgaattccgctgaagagtcatccctctgacccagcttccatactggactggcagccgctactttatccgtctgcaattctgcgcttcttgaaggcgtgtatataaaccaagcgatcatcgctatagctacgaccgctaatagtccagataaaacgattgtatacctatgggataaccatttttttatcatatgatccaccctctctcctcatatttttagaccgggaaagagtatcaatcaaggaagaaacaaagcgtttccgggaatcaccgctttcgcttcatgctgactttcccacattagacgtgccatcgcgtcgcctttttcatcatagtattccacttttaaatctaccattttgcctgcttccaaagtaatactgcctttacgctccgtccagctttgtttgaaccagctgtcaatcaccaacttgccgtctacccatacgcgaataccatcatcggatatcgttgtgaacgtataggtctcgctatattgtggtttgattttccccgtccagcgaaccgagaactgatcggcattcacctttggatcagctgcaatggcgcgccagttgtagtccagcttgctatctgtacggatcaaagcaggacttccattcaaattcatattgttaaaatattcgccctgcagcccgttcacatataccacatcagggacggaaggaggagtcggagccgggataggctcactttgtccctcgtccggtaaggtcggtacatctgtcccaggttgttcgattgctgccagcccatttttcacatcatcccgtgtcaaactcttcgaatcattcatataatcctgtatttggtttgttgtgttattctcggtcagcatcttgccccaagtcatggagtatacccatttaggctgagcctgcaacacctcagaactaggcatctcaccgtgctccccaatagcaatcggcttattccgtgccagcccgagcagaccttcgtaatgactttgcttaaaatcattgttgtaaatgtctactgccaaaatgtccactttgtcatcccccgggtatttcggggtatacgggacggtatacgaattgggcgcattcggactccatacccacagcagattgttcaattgatgtgtgtttgtaaaacggtcgtacatgatattccatagctgattaaaattagttttgtttccccaccagaaccagtcaccattcatttcgtggtaaggtctccacaaaaccggaacccctgcatcacgaagctgctttaatgatacagcgaccttatccagatcggcaatgaggaggttatactgcgtagtacctggggtcacgtatttgttgaactctgcctgacttactttcgcctgtacattggcccaagtcagtggcctacccggtagcgcttcatgaaaagtcatcgtcacaataccaccggatctgctccaacggatagcactatcgacgacatttttacgttgtgctgcttctgtagtgtcggattgaccagagatggcacccatctcatagccgtgcagaccaacatatgcctgactgattttttggaccttgttacttaattcatccggactttccaaataatcatgctgaccggtgactatttttttccctgagatgttgagtaaataattgtatagttcacgggcctgagtagaagcgtccgaattaacaggttgtaatgaagcggcattcgccacagacagagaatcaccaaaaccgacgggcaacaatgaaaaaagcataacaacggggagtacatgacgtatcagtcgatacagaggaataaaatagaatctcactttcgctcttcctttcggtagccaggctgccatccttgtagaaggccctttagctttgcgtacctgcctttcgacagggctgcgtttatcgttggaaggagtttggattccttcttaccctaagtatcgacttttttttaccaaaatttaataggtcatgttcatgaatttacaggttttcgcccaatttcgacagttcgggctatgaattttcatgaattcgtctttttttcgtttttacgaaaacaattatgagataaattggtgacgggaaatttcattccaatccatacaaaagcgtacaatatcctcttcaaccaattcagaaccagtctgcacctcaataaaatccacatcggtcacagccaaaatgctatgcttcgttccttcaggaatgcgaactacatcaccagcttttactttgtgcagcttctcattcaaaataatttccgcctcaccactaataatggtccaaatttcactccgtttgaaatgaagctgatagctgatatttttgcctttccgtacgcggattcgtttggtcaatacctcgttaccctcgtcatatttgacataatccacaacccgatactgcccccaacgacgttcttcatacattggacgctgatcatgagccttgagcacttccttaatgcgaggactttcagccttattggtcacaagaataccatccgggctagcagctacaatcagatcattcgttccaatgatcgccacaggaatgtctaactcgttaataagactcgtattgacgcaatcctccgttactacacctctgcccacttgttgattagacatttcttctgtgagcgtattccaggtgcccaaatccttccaaaaaccatcatacggaagaactacgatatccttttccttctcgactacttcatagtcaaagctgattttttccagagatgcgtattgcttttgcatttcttcataattcagcggcaaacccttggatgccaagatatccagcaaataacttaatttgaatgcaaaaaccccgcagttccatagagcattgcgttcaatcagacgctccgcctgctcccggtcgggtttctcttgaaaatggctcacttcgcggtagccagtgctaccttgggtggcatcgtttttcggaataatgtaaccatatttctctgaaggataggaagggacaaccccgattaaagcaagcttgccttcactctcctggagtgtatgttccagctgggctacggaagcgaagaaagcatcctcaacataaggatctacaggcaatatagctataatttcatcaggggaaacaccagcaatggaatatagataagtcgctgtcagcgcaatcgcaggaaaggtgtctctgcgttccggctcaacaatgatgcgcgtattcggcccgacctgactctggatcatttcgacctgtgctctccctgtcgcaataaacgaggattctgataatccgttgtctcccaattgtctccatacccgctgtaccatggattccgaaatcccctccgggctctccagtaccttcaaaaattgtttggaacgggaatcgttggacaaaggccataatcttttaccggaaccaccagacaaaagtacgagcttcataactctccacttcctctctatattggttggatgatcggatggggcaaagttgagtagcccgctacgggctggatttgatcttacgatcgctgttgccgtgggattctttggattgtgtaagacatttatatgtaagaatcccaagtcaaaggcgaccgctccgcttctccagattcaaatccatccctgcgctactcaaaaatgtatcatgccgatcataccgtttattgcaaaaggcacgaccggacattattaagtccggtcagcctgtaagacgttcgagaactcagagcttgcccgctgtgcttgcaagcttcaagtaatcgaggtttcgtaacgccttgcccagattgccttcggcaaccgcaatggcgtacttgatcggaaggagcggcttcaaccgcgccgctccctccgatacgcccttcctactccccccccataaggtgggagtttaaaaactgtgactccacggcggaaagcagcggagcggtccatttgaatctggagaagcgctagcgttcgcctttgcagtgggattcttaccttggaatgttctatataatccagagaatcccactgcaacagcgatcggaagatcaaatggaacgcgcagcgtctccaaccctgccacagccactttttaatcggtcacttcggtcactttttaaacttccactttatctctgttccacccactcatccgcggacgacccacggagtagtattccagcccggagccttggatctgttcctcagcgaatacgttacgaccgtcaatgagaaccggcttgcgcaaaatggaggccagttgtacgagatcgacttttttgaactcttcccaatcggtcaacaggcacacagcgtcgctaccttcagcggcttgctgtggggatgagcaccacataatattcgggtgatccacgcgctccttgaatttatccatcgcaatgggatcatacagtttgacaatagcgcctgcctgaatgagcgtttctacgatttccagtgctggagcttcgcggatgtcatctgtatttggcttgaaggcgaggccccaaatgccaatggacacaccgttcagttgacccagcgattcgcgcagcttggatacaatcataaagcgctggtcggtattcacctcgaccaccgatttcaacaacttaaattcatagtctacattacctgcaatttggataagcgcatttgtgtcttttggaaagcaagagccaccatacccgatccctgcttgtaggaaagaggagccaatccgtttgtccatccccataccgtcagccacacaggttacatcggcgccaaccttttcgcaaatattagcgatttcgttaatgaacgaaattttagttgccagaaacgcattggacgcgtatttgatcatttcagcactacggatatccgtcacatagattttatccgtgaacacctgatgcagagtgaccatggtttcacgcaatcctgtattgtccaaaccaataatgatgcgatccggataaagcgtatcattgatggctgagccttctctcaggaactccggcgcggagacgatatcgaaagacaaactcgtgtgacgagccaacacgtccttaatcttttcgttcgttccgacaggtacagtactcttggtcataataatcttatacccgttcatggctttcccaacatcagcggccgcctgttcaatgtatgacaaattcgcctcaccgttagccagagaaggggtacctaccgccaaaattacgatatccgagcggcgtaccgcatcgaccaaatccgaggtgaactccaaccggcctgcttccagattcaacgcgatcaattcctcaatacccggttcataaatcggagattctgcccggttcaacatgtcgattttgtgctgctccagatcgacacaaatcacctcattacctttttgcgcaaaacatacacccgagacgagcccaacgtatccagtaccgattacagccagcttcattccgttcatcctccttttagaaagttcacataggcttgttctacatacttttttaattgatccttgaagttttcttcatcaaatttgcgggcatgggtaatgatatcgtccacattccacgcatgttgctcaaccttttcgacggcctccagcacatcctctacttgatgcttgcggaaaaatacgccgttcacatgaggaacaatcgtatccagcgctcccccaccctgaaaagcgatgacaggccgtccggccgcattcgcctccaaaggcgtaataccgaagtcctcttcacccggaaaaacgagcgctcggcattctgccatcagcttgttaacctcttcatcctcaagcctgccgaggaactcaatgttcggggcagccataccttcgagtcgtttacggtccggtccttcacccacaatgcgcagcttgagaccgttacgtttgaatgcttcgatcgcgagatcgatgcgcttgtaggacaccaatcgggatacgatcaggtagtagtcaccgatgtttgtagcgcgtttaaaacgggatgtattaataggtgggaaaatcacatccgaatccctttggtaatagtgcaaaattcttcgtttaacaaccgaagagttggcgacaaactggtctacgttgcgagaagttttggcatcccatgttttcaaccggttcatgtacagcttgagcatgtttttgagcaggttggatttggactgccgggccatatatgtatcgtaatcccaggcaaaccgcatcggtgtgtgacaataacaaatgtgaaacgtatgtttgggtacctggatgcttttcataaatgcactgctggagcttaaaacaatgtcgaaatccctaaaatcaaaatcacggatagcaatgggatacagcggcagcactcctttgaagttgtccttcactcctgggactttttgtagccaagtggctctaatatccgcatccttcaagttacgcgacaggcggtcgtcgctgaacaccgttgtgaagataggagcctccggatacatatcgtggaatacctctactaccctttccgctccgcccatttggattaagtaatcgtgtgctatcgctattttcatcagaatcatcctttaacgcgaatgtcggtcagactcctgccaacaaacccttatagtaatgaactatatccttaactgtgttctcgatgacaaaatgcttcttgacccgttccatccctctctcacccatctgctgacgttcttgtggatgctccaacatccagcggatggcttcttccagcttagccggattacccggttcaataagcagcccggtttcatggggtaccaccgtttccttgggtccaccctcattggaagcaatcacggggagacccgcagccatgccttcaataatgacctgaccgaatggttccggtgtaatagaggtatgaatcagcaaatcacaacgctgcatcaggccttgaatgtcatcgacgtgtcccagcagattgacgttagccaacccgtattcgcgcatcgtggactctaatcgttgcttgtattcctcttctccgaacaacgcatctccagccagccagaatttcacgcgctgatccggtaaaaaggagcgtgctgcttccagtaaaatatgctgtcccttccattccgccaatctgccgaccaatacgacgttaaacgagtcatcaccacgtacatgggcagccgtgtcacgtgctgtaattgctttagcaaaagcggaataaacaacaagcgtctttttgtccgggggtaactccaacgcactcagcgtggacttggaattagcaatcactccattgggcaaaaagcgggacatcagccgaatccctttggccacaatcggcttcaggtacggcggaccgatgtggtcacggatatgccagatcaagggcagcttcgccgatttggcggctactgtaccatacagtgcagacttgagcgagttcgtgtgaacgcacacgaccttttccgcacgcagcaagggcgcaagttttctaccgtaagccagcaaacgaaaagctgctgcaggcgcacctagattcacggcattccgtccccgattgcgaatcgaatcgtccaatggaacgatgcgcacatcaatatcacgctgccgaagccgatctgccaaatcgccctcctctgccaaaataacgagcgggtcgatatgttccccgatattcgtcagtatgttgtacaaagcgacttcgccgccgctccatcttgccgtatggtcaatataagctactctcatcatttcgccgccgcctttctatcaaggacctgtcggaacacctcttccacctgctccgctacatgtccccatgtatatctgctcaggacatggtcccggcattcccttgcattcggtagaagttcacgatgatccagcacacgcagcaacccttcagcaatggcttcactatccgttcccttaaacaaaagctcgggacggaatcctcttaaaatctccttgttgccacccacaggagtcgccagcactggcagtcccgaagccattgcctccaccgtgatcagaccgaaaccttcaagcgcctgtgtaggtacgacgaacaaattcgatgcttggtggtacaggggaagctcctcatccgacacataaccgagcagccttacatggttatgaagattgtattccgctaccttggaagccaattcctccatcaaggggcccttccctccaatcagcagcagatgatcaggatgacgctcggttactcgtcgccatgcttcgagtagctgtagcagtcccattcgattaacaagacgacgaacggttagcacaatcgtcgcattttgcggcaaattcaggcgcttccgcaccgcttcttgatcatctgccgggtggaacctttctacattcgccgcaccaggaataatatgaattttgctgagtggaaccttatagtgctcatgcaaaatatcccgaaaagtctcgcttagcactataaatttatccgacagaccgtaggccttcatttcaatggatttagccaacgtcgtttttagaaaatgcttgatgccctgtccttcaatcttcatttcctccgtccacggtccgtgaaaggtggtaactaccgggattcctctttttttcgcctccagcgctggcccgacactatagggggcaaaatgggaatacaatatatccatcggttgcttgtcgaacaactctgctgcatatttttgcattagctcccggcgcttccagatggattgctgcttgctgccaatcgtatgaatccgaatacggtcgggcgcttgcggctgctcgtcactacagattagagcatccaacgtattgcgctctagcgtaagctgctcacagatcgatttgaaatatgtgttgaggcctcctggctgcaaagacggccagctcaaccccgttgccgcaatacgaaatccgttattgtacgacatagctggtttctcctttctgctcggtatgtccgtcatccacgatttctatcttttttcgccgcttggttagctcataatgcttgaagcagacgagaaactcatacatcacccagaaaacggctacggcaaaacccgccaatcccttgcggtataagccttggacaaaatacttctgcacaaagcgggcaggaggccgccacaacagtctggtaatccgaaaggatcttcctttgttaaatgccgtctctgcttccagatctgtatatttattaaaacgggtcatatgatcactgatgctgcggaagccgtagtgccataacacgccctccagattgacaatctgggaagaggctacatccggcatttcatgaacaagactattcgtaatgccataaatacgacgattgtacaaacgaaccagatattcgcctttattcatccatttgccgagaaaatcgccaatccgaaatacggaatatgctttggccggatcgtggagcgtttcctttactttcaacaagtctccaagcaactctgcatccactacttcgtccgtatcaatcaggaatatccaatcaaattccgctttttcaacaccaaacatgcgctgcttggcataacccggccacgggttagaaaacacccgacagcccaaggattcagctacctgaatcgtattgtccttgctccctccgtcaatgacgacgatatcgtccgcaaagggcttgcaggatttaatggcggctgtgattcgagtgccatcatcctgagcgataataactacggatatccggttgtccgcgggaacgctagacatgtggttcattagcgggtgcctccttctttatctaaccgttaactggctttttccggatgtagtgtgacatcgttgatcggagccattgaaaatcttgtttggaaataagcagtcttggaatcttcatttttagaacgaatttaacattacataaaatgaaaatgaaccgtaaaatccccgaagacagcattgctatccctgcacccgtcaatccatatctcggcacgagtatggacagcaatggaatgacgagcgccaatccgacaccctgtagaatggtaaccagtttgggcttacccaacgccataaattgttgtgccagcaccatggtccctccactgatagcaacctcaagcaccaagaaccggaataccgtgagcgcttgtttaaactcttgaccatataacaatgtaaatacaaacggagcaatcagcatcagcatcgccgcagccagaaaggttgccgttgatgtcactcgaaatgcccgaaatgttatggccaccgcctcttccttattcagaccagaggctttgggaaacagcacgacaatgatcgaggtagaaaatacattcaccatcctggccaagctgaccgctactgcatataaaccgagatcagcgggtctgagcagacccgcaatcaaaatctgatcaatataagtggaaacctgccccatgagatcatttccgtatgaacccataccgtaggtaaagagatttttaaattgcgtccagctgttctttacctttggtttgtacagccgaatcattcgtatcgtgacaccgatataaatcggcaagcctggcagtaaataggccaatgccgaggtgtacggattcatatttccggttaagatcagaatcgctagacccagcagtgtactcagcggtaccagataccggaataaattgtactgcttatattccgagcgaacttgaagcaatgcattattgatctgtgaaatcgctatgagcggacacatcatcatggagcactgcgcgaaaagtatgaccgatgaagaaaaagagcgcagccaataaggaattagaaaaactccgacgagtgtcgccaagcccccgaacatggtagccagcagcaaggccagaccatacagcttgcccgtttcctccggtttccttttcgcattgtaaatcaatgcagacgggacaccgaagctcatgcagaaggcgagaaattgggaccagttcaccatcgctgtctgttccccgcgtccagtaggacccaggaatcgtgccgttagcacaccagtcagcatattcacgacgagaatcagcatactgaatatcatcgtttttactgctgcagagctgttatccttgcttttggcaaaccgaatcactgtggaccatagtgtccggacaggtgcggataatgcttgtaagttttgcacagcctttaccttctttccgcgatgacatcttttgcccatagtcctattccgatcatcatccagatcagatagccgcgcataccggggaaaccattatctgatatgagactggctacagctccggcccacgtagccaacgccagtctgatataaggctgactggcatctcgttcggcaatacgggcgagaaggcgcttgatgataacgaacagaccaccgaagaaaaagaatgccccgaaaataccgaaggtgaggaaaatggcgatatatccattatccataatcccaagttcgccgagatcgccgccgttatcaagcttggttccgattcctacactcccgatcccctgcccgaccggattgctagcaatcgccggaagcatcgtatgcagtaaatccaaacgttcattgtacgaatgatcctgctgaatatccgtcagcgtctgcatgcgagccaccaaaccttctgcccctggaagttttggaacaatgatgtagagaagaaggccaactagagctagttgaaacaaggttttccactttcccttggaagatgaactgagaatgtaagccagcaacatgacgaaggcaattagccaggctgaacgtaccagcgtgattaagagacaaacgaccgtcagcaagattccgatccatcccaatgtgccgcgccaacgtttttccattagcatgggtacaagtgccatcgccaggaaaatagcgcagggaccgggcgagttcatggaagaaaatactctgatttgaagtggttctggaacaccaatggaattcatttctacatgattcatccaaaatgcatcccacggaggcaccgacaagtactggataatgccgtaaattgccacaagaacagcaatgttggcatatgaatacagcagtcggtccagctccttcgccttcatgggcttaatcgcaagataaggcaacaggatcaaaggaaccacataattggctaaatcataagcaaaaacaataccatttttgaataacccgaccacacttccgtaggccaattctatgccgaaaaatacagcaattcgggtcaagggtttttccgcctgatgaatgcctcgcaacacaggaataatcaacatactgcttaccagcagcggtgccacgctcaacaaggaaaccgagtgatatgttccctccatccaatccgcaatgcggcggatttccgggcctactgcccacactgccagtgtgtaaggaatcagtagccgcgattgcaggatcgccagcaggaaggccggaaaaacgagcgccagcaatatggctccctgctggctcatggtgggattcatcttggcgctgacaaatccgatggcgagtggcagtatacaagccagcaatcccatgccgatcatgctgattccacgccgatttcctagccaaacggaaatctgctgatctgccaaccgactcatgtttctcacccctgacctcccttcatccgcttccgcttgaacatctccttaaacagcagaacgagaaattgggaatcctcaatcaaatatcttttccacaatcgtttaggctcctgagacaacctccagaaccattcaaatcccgtcttctgcatcagctccggtgctcttttcacatttcccgacaggaaatcaaaggtcgctcccaccccaatcgaaatcggagcacggtaagtctcataatatctgtagatccatttttcctgtttaggtgcgcctacacctacaaaaacgatgtccgggcgagcctcttgaagcagttgaataatgtgcctattctcctcctcgtttttctcaaagccataagaaggagagtaacagcccaccacattcatgttcggataagattcctggagattgagcatagccttctcaggaataccgtcagctgcacccagaaaaaataaacgatagcctcgatcctcaaaagcctctcccagccgagtgaacaaatctgacccggacaccttttgtttgaggggttttttcagtaacttggacgcccatatgataggcatcccatcggccactacagctccggcatccgaatacaccttgcggaattcatcatccttgcgaagcttgatcacatgatcgacattacaggtcaaaatgtaggaatgacgctgatgttcaatagaagtatctataaattcgagtagatcattaaaatcgtaattatcaaagttgacatcgaacatgttcactctgctcatcgtatcacttctctttgcgaaaatcggtttgagtagatgtctggtataacgcgttcaaataccagcaaaatggaataatcatctgaaccgtcgacaacgtattatctgaaaacgagtagatcagaaagcctgcaattaagcttgcaaaataaggtttgatagacttggcaagcgaccggtaaatgagagcgaacacgatcagcaatgaaagcattaatagcccgcaaccgatatatcccgtgtcaaaataaaagcgtatatactcgttatgcggtacaacaaagccattgaataatgtcccgtcgttcgcgaccgttaccgcgccaagacctctccctgaccaagggtaatcatgtactctgttcaaaaaatattcccatgcctccgagcgtcccgacaggtcaatgcctgtatcggtctcccgttcgaaggagcgtttttttaaattgttccattgcagggccaccgcccccagagcaaccaaaaacgatccggccagcggtagcaaataattgactttccccttgaggtactgacgggcaatatcaaacagatacacagcaaacattaataacaatgccagaatcggtccacgtgtaccggtggcgatcagaatcagaaagttcagtgccaacacagtgtaataaaaagcggcttgcttgggtttacgcttgacctcaattagagagacagcaattccgagaaaggagagcattgccagatgcggcggtatattcgctccttgtactctgactgcgcccgtaaattctacatccgtaaacgaatgcagccctagaacctgcaaacccagtccaatgaccacactaataatgggcaacaaactgatcagtcggatatgcttttctgccacatcctttttccactggatcagtaaaaaaaagaaagggagtgataaaccgacgaacgccttgacggcaatcgaggtcgttaacaaaggcagccatgctgaaaatccaaatgtgatccccagcatgatcaccaatgcccagaccggatagctgaacttgagacgtatgccatacacgagcatgcacggcaccagcagagccaaaatgcccaatttgtacaatgacaaaatctcaataccgaacacgccaccctgatacagagaatcgactgagactgctgtacttagcaaaacagcgtagctgatgcgctccggatgatgtatggaaacagccagcaagagcagtaaacataccgccgcaatactgaccaccggctgataggtagccgcaattcctacagcaagagcccccagtagaaaaataaaaacatgctgtatggtgtttattctagtagtccaaggatagttactcatgttccatctttcaccccgcagctgactcgcttttccggttgcgcagtgtatccagcgtcccacggatactttcaagcctgcaccggttcaacagcttcctgccctcactacgcgccagcagggaatccacagtgatgtataacactttggctgccgtcttcgccatcagcatcgcgttaccgcgcagacctacggcctgagcagcgttagacatgccctgacaatagtagcggttcatgatccattctttcgttaaccgtgaagccggcacaaaatgttccacagacatgtgtggatgatacataatcgttccaccatttttacgaatttgctcgaaaacccacgattcttcaccagatagaaggatatctccctttctgcctagatgaagcgggaacataacggcggcaaaagccgttttgcgcatcgccatattcgctccaaatggattcagtcccgacggatattcacgaacggctttgcccagatcaataatcgtgtaaggcagttcaagcgggcctgtcagccaacccggtcgttccgtctcaaacatagggtcaattttcccacccatagccgtcagctcaggattgttcccgaatgctgacataatcgtttgcaaccatgtaacacacggaattgcatcatcatcgagaaaagcaatgacttccgctcttgataacgtaatgcctgcattacgagcagcagacagtccttgttcgcgctcataatgatatcggagatggatattctgaccatgggcgacggtgaaccttttgatcgtcgctgctgtatgatcagtggatcggttatcgaccacaatgatctcagccagtgcaaggtcttccagttccagcagggacattaacgttttctccagcaggtccgcccggttataggtgcaaataacgacggacactgcgggacatcgcttgaatgcatccatcagtaagcatccttggagaacagcattttaacgcctgttttcatgatgattttcaaatcgagccacgtattgcgaacatgaatatacttcaaatccatttgcaccatttcttcgaagcctacactgttacgtgcgctcacctgccagtaacccgtacatcccggtgttacaatcaggcgttgcttatcataatcggaatattgttcgacctcgctgggcaacggcggacgcggaccgactaaagtcatgtcgccgatcaacacgttccacagctgcggaatctcatcaatactcgtcttgcgcagaaaactgccaattttcgtgatccgaggatcgtttttaattttgaacatggcgccgctcacttcattcagctccatcaagtcctttttcagttcctcagcattggacaccattgaacggaatttatacatatcgaataacttctcattcttgcccacccgagtttgcttgaaaaacacgcttccctttgggtcttcgagcttaatcaaaacgcctaccactacaaaaagcggaagcaagacgatcaagcccacgaacgacagcagcatatcaaggaggcgttttgtgaccaggtaggacgttttatcctgaatttgtgtatttccgtatggcatgtaaaacgctttacctgacatgacagcctcgccgtcctccggtaaattttccatgctcatgctgacgtaccccctctcaacctgccgtggttgctttctcggtctttttcaaccattcattcatggcctccataaccggatacttcaaatcatcgctggcaagtgcaaattcaagtgtggttagaatatatccaagacgttcacctacgtcataacgtgtgccttcaaaatcataggcgtacacacgctcactctgattcagcttttggatcgcatccgttaactgaatttcgccgccagctcctttttcttgaagatcaagatatttgaaaattttcggcgagaacacgtagcgacccataatggccaaatcggatggcgctgtgcctggagccggtttttcaataaaattattcactcggtacaagcgtccgtcctgctgatccggttcaatgatgccgtaccggttcgtaaattcttgcggtacccgctgcacaccgataaccgaattttgagtttcctcatactgatccatcagctgacgaaggcaaggcttctgacctgttacgatatcatcgcccagcagcacaccaaacggctcgtccccgataaagcgtcttgcgcaccataccgcatgtccgagacctttgggttctttttggcgaatgtagtgaatttccactcccgatgaacgctgtacttcctccagaagcttcagcttaccgtcctcgagcagtttggattccagctcaaatgcgttgtcaaagtggtcctcaatggcacgtttgcctttacccgtaacgataataatgtcctcaataccagaagcaatcgcttcttccacgatatattgaatcgtaggcttgttgataattggaagcatttccttaggcatcgcttttgtggcagggaggaagcgcgtacctaaccctgctgctggaataatggcctttttcactcttttcgtcatcgcactcattctccttgcttcatcgaattttggtgttgcttacttcacctgattcatcacaattccaaccagcgtcgcactggcttgctccatgagttgctttgttttacgtagatcttcccgtttggtacgaccatgtctagcaacgagaatcacaccatccgttaagcctgcaatcaggcgagcatccgtataattcagcgccggagccgaatcgagtaaaatgatgtcatattcacgtttgagttcttccagtagctcagccatacgttcgctaccgagcagatctgctgcgttgtacagggtgtctccaccgggaacaaccgatagctccagaccaccatgcctaacgatagacttggaagaagtcccaccgcgcaaataagccgatagacctccggtattctccattccgaatatctcgtgcagcgctggtttatgcagattgcaatccaccagagccaccttcttgccttcttgtgcaaaggaaactccgatgttggcgagcagtgttgttttacccgctccgctttccggcgaggtcaacaatagaaccgtgccacggtccttttgcccaatcacctgctgccggatgtatgtacggagggatcgaaatgattccgagatatacgatgatggattactttctgtaatcaacatgtcattcaatcgcagcatatttacgctcccctacccgttctttggaatttccggctgctccatcgacgtccttcttgcgaatgactggaatcgatgcaattaccggaataccgatgtccgcgtccgcttctttctccgagcgcagcgtaccgttaatgctttccaggaacacaatcgtgcccaatgcaatcatcagcgatacgagaaaactaatcgcaatattcatgagtgggttcccattaatcgggtcaggattggcctgagggtccgcttcatttaaaattttcacattattcaattccatcaatcccggaactgtctgtacaaatttctgggttaccgcgtttacaaccgctgcggcctgtggatagctccctgcctcaaacgtcaaaccgataacctgacttttatccgaggatttaatctgcagtttctctgccaacttctgctgcgtcaaaccgaactcaggatgagcctctacaacagcgtccataattttaggtgaagtgagaatttgcttgtagctttccaccaaattaagacttgtgttgacgtcgttcagattgttgctcccctgcttggcggaaatatgattaaccagcagttggcttgaagcggaatagactggcttcacgacattgtcgctcacaaagtatgttgttacacatgagagaatgacaaaaattgcgatcagccacaatcttcttttgatcaggactagataatccaaaatggttttctccacaaaaatcctccctcctacacaatttctcttcatatttaagtatgactttattgtaacaattggctctgtgaacgacatggaaccgaatggcactttctccctcactatggggggagggaaatgtatactttcggatacggcatggtatacttttgtaccatgctttgtcgattatggaaaaataaatcgaaaaaagcctcaaaatcacaaaacttggtgattttgaggcttttctttccactcgcacatgaaagtgcagcgtagcttatagagtcagcgcatcattgttggctcgtacttcgccagaccgatggcattggcatacaatgctgcctgcgtacgatccgccagccgcagcttggccagtatctgactgacatgctttttgactgtgaactcactgataaataaccgggatgcaatttcacgattgcaagctccttgtcccagctcgaccagcacttccttttcctttggcgtcaggtcgtcggtcagattgcccgcatcttcacgcagcttgttttcgagaatagccggatcataatatttgcgtcctttgttgacaagatgaatcgcgtaaattagttcctcaggcaatgcttccttaagcacataaccgtccacggaagcttcctctgcttttagaaaatcttcacgtgttgcggaagaagtcagcaaaataaatttgcttctgaaaccgcgtccgcgcgctatcttgataatatccagccccgattcatcagctagtttcaaatccagcagcaccagatccggatctgtttcctcaatcaccataagtgcttcctgttgattctgggcctctcccgcaaactgaacattgggctgcatggatataaccgcagcgagtcctttccgtactaaaggatgatcatcgacaatgacaattttcatgattcggcctcctgtctacagttcaggatttgcataatccctatgtatccgattgttaccgcagattttgtattgcagaatgttcacacattttattcgaggattttgcaaaatcctcattcataagcatttaccggaatggacaatcggatctgtgttccctctccgattcgacttgaaatatcaaattcgcctcccatcgattgagctaaatattccatattcatcatgcccaggcccccgcctgcactgaccgcctcacctcctgctaccattctcgccgtctcaaaccctactccgtcgtcatgaatagacagtctaatcacttggggcgtcaattttaacttcacatcaatccgcttggccaatccatgacggattgcgttccccgccgcttcggaaatgatgcggaataaagccttttggtacaaatacggaagtgaataatgatcaccatgaatgtcaaaatcaatttgtacatggttcagcttggagagtgtatgaagatgacttttcaccgtccctaaccaagttgagcctccgctttttttcgaacttaaactatgaatcgcccctttcagctctctaaccgcttggttggctgattgctgaattagatcaatttgctcctccacctgctcctttggctgatgacaccaggtttgccggagagaatgcgttgcgtacacaataccaaaaagactttgagaaacattgtcatgcatttcatttgcaatccggttctgctcattcgtcacaatcagctgattttcaatacgctccagctcatagcgctccaagaacacagcgctcagctcagccaagaatatcagttgttgcacgagccagcgtcttcctgtcagactttgatccgggcccagcttgaggccaatcgtcgctacaaaacgggtcgtcatcggtacggtaatcatgaggaaatcgccccattctggcagatgtctaaaaaatggttcacgctcttccctgaattcctcccgataattccccagctcctcgaatagctgctcctcctcctctaccgtccagcctgtctggctgctttccggtgcatcctcctcctgactatccagccagaaaaatgcacggctctgcttggttagcttgaccgtatagtccgagatgacctgaccgagatttaaagcctcattgtggctggtcgtctccatgatgtggtaaatcgacttgatatgatccatcgtctcattggcttgttctttagccaccttcagttcgtccttcatgacgccgataacctgcattgccatcgtagttgcgatcagtaccagaaacaaattgatgttctgcaatataagatcccacaaaaaatattgacctggtgtaaaaaagatataacaaaatgtaagcaccaagccgatataagaaaggaggagtgtccaactgtatctcatagacagatgagcacaagccaccagcatgggggtaatcacataccatttgaacgggctatccatccctccggttgggaacaacaacaaaatgattcctgctgtttctagtgcaatgctacatttcaataccatatcatgaagtctgtatttacggtaaatccaagtaaatgctgtaacggataaaaatagaaaaccaatcagtaatagcttctgccacacgattaatctagatgattcgaacagaaaaacaagtgacgttaaagatagtgatacataacggtataaaaaaatcatttggtcttctgctgacttcctcaacttcatcctgtcaccctattctgtgttttgaagggacgatgggcatattaggtttgtttgtgtttgtgtactctaaaaaaatcataaccaatccaaaaataaataacaagacataaactcttacgtaaacggttacattccaaaaaatttggtactttttataacatatttaccgtttcaggaaaacattttgggggtaatgtcagaatttatgacgtttgtcaaggaaataaatcacattttagtaacctaaaaaagacttgctggtaccaccgtgattataacagtggtattcagcgagtccttttttagtaaatttggtagtctacattttaacccccggcacgcgccaattcacgcatattggcttcaaatgctgccaacagagcttcatctccgctcaaaccagttgcctcttctttttggatctgttcaaccatacgcttgtaatcctttggaatcactcgtacaaactgctgaatcgcagtctgccaatcatccaaaatacgttgtcccgcttcactacccgtgtaagtgacatggcgttgaatcaagccgcgcaaatccgctgcttctgcaggatcttccacaccttccagcaacaccatttccagattacaacggctcaggaacgtcccctcagggtcatagacataggcaatacctccggacattccggctccaaaattccgtccggttccacccaatacagctacacgtccgcccgtcatatattcgcaaccatgatcaccaacgccctcaactacaatacgtgcgccggagttccgaacggcaaagcgctcgcctgcgattccgctaatgtaagcttcaccgctggtggctccatacaaagctgtatttccgataataatgttctcttctgccttaaaggtcgctttgtgagactttttcacaataaccttaccaccagatagccctttaccgacatagtcattgctatcgccttccacgctcagcgtgatgcctttcggaataaatgccccgaagctctgacctgccgatccaataaagttaaagcgaatcgtatcctcaggcagacccgccgctccatacttacgggtgacctcgctgcccagaatcgttcctaccgcccgattcacgtttgtaataggtaaggtaccctcaacaggctttccgttctccagcgcttccgcagccatcggtacgagctgttgcatgtcgagtgtttcttccagaccgtgattttgccgttgtacgcggtaacgtacactaccttcttccaactcaggaacatgcaacagcaagctcaggtctacgcccttcttcttccagtgcgaatcggcgttcacggtatccagacaatccgtacgtccaatcatttcctgaatcgtacggaagcccaattccgccataatttcacggacatcttctgcgatgaaacgcataaaattcaccacatgggcaggatcgcccatataatttttgcgtagctccggattctgcgtagccacaccaaccggacatgtatccatttggcatacccgcatcataatacaacccaacgccacgagcggcgcagtagagaagccgtattcttccgcgcccaacagggcagctactaccaaatcgcggccagacagcattttgccgtctgtctccaataccacgcggtcgcgcaggttgtttagcatcagcgtctgatgcgtctccgccagacccagctcccaaggcatacccgcatggcggatggagccttgcggggaagcgcctgtaccaccgtcataaccgctgaccagaataatgtcagcacggccttttgctacccctgtagcgatcgtgcctacgcctacttctgacaccagtttcacgttaatgtcagcacgcggattggcgtttttgagatcatagatgagctctgccaaatcctcgatagaataaatatcgtgatgcggcggtggtgaaatcaaacctactcctggcgtagaaccacgtacctcagcgacccatgggtataccttacgtcctggcagttgtccaccttcgcccggcttcgcgccttgcgccattttgatctgaatttcgtcggcattcaccaagtaattcgatgttacaccgaatcggcccgacgctacctgcttaatcgaactgcgacgagaatcgccattggcatccggtatgaaacgtgcagggttctccccaccttcacccgtattgctcttgcccccgatccgattcatcgcaatcgccatatcttcatgcgcttcctgactgatcgagccaaaggacatggctcctgtcttgaagcgacgcataatggatgcagcggattccacttcatccagcggcacaggctcaccagcaggcttcaattgaagcatggagcgaatcgtcaaatactgttcagattcaccctgtaccagcttggcgtacttcttgtaaagctcgtagtctcccgagcgtaccgactgctggagcaaatgcaccgtttgcgggttaaacaaatgctcttccccatcgttacgccattgatagtcgccgcccgaatccagtactttgtcgttgccgtccttgtcagtgaaagcacggttatgatgaaccagcgcttccgtagtcacttcctccagaccaataccgccaatgcgggaaggtgtccaggtgaaataacggtcaacaaaatcctgcttcagacctacagcctcaaaaatttgtgctccacggtacgactgaatcgtggaaatacccattttggacaatattttaacgacacccttcgttgccgctttaatataatttttaactgccttttcgtgcgagatgccgtgcaacaagccctgctgaatcatgacatccagcgtttcaaaagccagatacggattaaccgcgctcacaccgtagccaagcagcaccgcataatggtgaatatcccttggctccccggactccagcaaaatgctcacacgtgtgcgtgtaccctgcttaatcagatggtgatgcaggctggaaacagctagcaacgccggaatggccgcattttccgcatccactccacggtcggacaaaatcaggatgttatgacctttgtcaatgacacggtcagccgcctcaaacaatccttccagcgccttgcgtaagccctcagcgccttccttcgcttcaaagaagatcggaatcgtcatcgatttgaagccaggacggtgtacgtggcgaattttggcaaactcctcattcgacaacaccggcgaatccaaacgaatctgacgacagctttccggttctggatgcagtaaattgcgctctggtccaatcgtggttgcggttgacgttacaatctcttcacgaatggcgtcaatcggcgggttcgtgacttgggcaaacatttgtttaaagtaattgtacaaacgttgcggacggtcagacagcaccgccaatggggcatcgtaccccattgaaccaatcggttctgcacctgtaagtgccatcggctccagaattttgcgcagttcttcaaacgtatatccaaacgcaagctgaagctgatttacattttcatgtttaggctccggctgttccagtgcttccggcagctcatccagatcaaccaagtgctcatccagccattgctgataaggttcctcggaagcaatacgttcctttaactcttcgtcagaaacgatacggccttcttgagtatcaaccagcagcatacgacccggacggagacgatccttatagagcacattttcaggagcaatatccaatacgcccgcctctgaagacagtgcgatcagatcgtccttggtcacatagtaacgtgcaggacgcagaccgttgcggtcgagaatcgccccgatttggataccatctgtaaacgccatcgcagcaggtccgtcccacggctccatcatggtgctgtgatattcataaaatgctcgtttcttcgggtccatggtttcatgcttgttccaaggttccggcaccatcatcatggctacatgaggaagggaacgtccgcttagatacagaaactctagtgtattatcaaacatggctgtatctgagccatctgggttaatgactggttttaccttcttgatatctccgccaaacgcttcgctttcaaactgcgcctggcgagcatgcatccagttcacgttgccgcgcatagtattaatttcgccgttgtgaatcataaaacgataaggatgcgcacgatcccagctcgggaacgtattcgtgctaaaacgggaatggaccagcgcgatcgccgatgtcacccgctcatcctgcaaatccaaataaaatttgcctacctgctcggttgtgagcattcctttgtatacaaccttgcgacatgacaaacttggaatatagaacgactcaccgttctcatcctcttggttatagcgaatagcaagctctgcacgtttgcgaatgacatacagtttccgttcgaagtccagctcttccttcaaatcgctactgcgaccgatgaatacctgacgcacgcctggtttagctgcttttgccgatttacccagcatttcgtcataagttggaacatcgcgaaaacccaaacaattttgaccttcgtccacgatgatatctcttagcttctgctcatgcacctcacgaacttttggatcattggatacaaaaagcatacccacgccataatgtccggcctttggcaatttaaagcccaatcgctccgcttcctcttgaaaaaacagatgaggaacttgaatcatgatccctgctccgtcaccggagtttggttcacttccctgaccgccccgatgctccatattcacgagcatggtcaaagcctgacttacaatattgtgcgatggttttcccttgatgtgggcaacaaagcccatgccgcaggcgtctttttcgaattggggatcatatagtccctgtttgggtggtaaacctgtctgtctcatggaacgcaacctttctgttataaagtcatgctggcctaaatacaggcggccgaatagaagacagtggcgacaagaggtaactcaaagaacaactacgaggaatgggggacaaaacacgtgacgtattcaaggcggtacggtccgccgaatgcgtatgtttttcaataattatgcaatggcttgacttgaaaaatacgtcgattccactgatgaatctaattagttctatcattttatcattgacctatcatgttagcaattcaaagtttttatgattgtgataataaatcttttacattacagcttcaacgtatcaatgcaaaaatatctcatttttatgtataaatattcacttttaaaaaacagcctttcctattcctctaaggaacagaaaaggctgacaaaggagatttgatgagtttatagaccatcaagtgtattcccgtaaattagatatccgtattaaaattcgagactttcgccgggcttcaatgctttcccttcaataccttctttgtgcagacgatcgcagaagccgtctccgtcctgctcaatacccgggaacgtattgtaatgcaccggtattacgcggcttgcacgcagccattttgctgccagcagtgcatcctccggtcccatcgtataaccatctccgatgggcaataccgcagcatcgatggagttagtttcgccaatgagacgcatatcgccaaacaggccagtatcccctgcatggaaaaaggtttggcctcccatggtcaataagatccccgccggctctcccatgtaaatggtttgcccgtccaccgtcaaagatgagctgtggaatgcaagcgtgaatttcacatggaaaccgtcaaagtggtgacctccacccagattcataccgtgagctttggctcccaaggatgaacaatattcggccagttccgcgaccgcgattactggacaatcattgcgcttggcaatttcaacagcatctccaaaatgatcggcatgaccgtgtgtcaacaacacggcatccacctgaatatcctcggcctgtacggttgctttaggatttcccgtcaaaaaaggatcaataataatccgtttcccctctgcctctaccagtacaactgaatgtccataatatgtgattttcatatcatctacgcctcctttgtcactttcattattttggttactttcctttacctattatacctcttttgcatactggcttcaccagtaccctaaaattcgttcacaaagctgaaccctattgtttagaaagggctgttatttgtagaaggtatgatgaccgatagttttcaccttcgtacgcgaatgatgaaccgtaaggtcctgggccaacgtaagcgacaggaaaaaacaggtgttatcaggcacggctttatggccgttcaaagcagcagtaaccgcacggatgctgtcctggttgggctgaacacgacgaagacgcccgttcgcgaccggactaaattgcgctttttgataaatcactgcctgaatcgtatcgggaaatggggctgaccgcagccggtttaagacaacgttggcaactgccactttgccttcgtacggttcgccttctgcttctgccatcactattttttgcagcaggagcagttctttagcggagacaggatagctccaggtagacaacgccttgtcatcctgcgtgagcatttttgtcttcgtaaagtagatggttgtaggaggggttaggattgcggacttgctatgctggacctcaggctttttcttgcctgtagcaacgttattccgggcttgttccgcctgcttcatctgggaagcgggtaacggagtcggcatgatttctttccagcttgactgcccatgagcagcgacaaagatggggcttgtcctgtttgacccgttatgggtccccatcctgtcgccatatgtaggagacgaagagttccctgaccagctcagagattgcataggtgtatttttatgatttttctgtgtttgctgaacctcagcgtagaggcctatccccaatatacaaacaagcagcacactcaatagaggtgcaaaccaacgatgttctttaacgatttccataatgttcctcccgttaactataagcacattcctcagatatgtaacctaaaatgcgccttttgaataacgctgaaacactatatcactaaattcgctgatagatcaaggctttcacctcattaatgggaatgtttgaattatttggtacattggtttttgacccatccgggttgcatataaaacaaattctcccacttcccatggctcgctgcatcggtcatttggctgccaaatagacggtggaataggctgttctcctgtgtacgaacgtgctagggtgatatgaggtcgataaggtcgctcctcgggtttaaaacccagcggttcggtagcctggagtatggactggtacagttgatccagtgaatcacgctgcccggtcactcccctccacagtacacgcggaaattcttcacggccaaaaaaacctgcttctccgatgctgagtgtgaacgggtcatgctcagctgcagcttgaactaaaacctgctcaagtttcggtataaccgaggtctccacatcacccaaaaactgaagtgtcacgtgataatctctgaaatcactccatttgcgaaaagtcaggttttttaaatcctgctccacccaataatgtaacttcttcttatgctcattcggaagagcaatagctgtaaaaagtctttgcgattcatttttcatcaacctattacctcctttcctaatagataattgtggatatctcaaaaagtagctgtttggtttgtccctgatcagggtaaagccatttgttgttatatattgtgacactgcgagcgcttttttaccctccttatgcaattttttcggcaatctgttattcttgaaaggatggttcgccagaatatattggaaactccaaggaatcaaaaatcgaggaggctatgaactatgggaaacattttaagcttacatcaacttacggaagagcaaaaaaaacatgttcgtgcaacggctccgggctacgagttgattattggcaaagctccggaattggagtctaaacaaattcgggaggccgaggttattctaggctggtccaagcatattgccgaagaggcattacatccagacagcaagctgaagtggatacaaacctggtcggccgggattgataaactaccgcttaccgaattggagaagcgtaacattttactaacgaatacaagtggtgtgcatgcaattccaattacagagcagatctttggcatgctgctatcgcatacacgttatttacagcaagcagctctcttgcaacgtcagaaaacatggcagccaccgaaaggccaactgacggaattacggggcaaaacgctgttgattacaggcgttggcgaaattggccgtgaaacagcgcggattgcagaagcctttggcatgcgggtgatcggagtccgccgttctggcaaagaagctccccatgtagagcacatgtatactaacgaacaactacacgaagcattgagagcagcggatatcgtggtaaatatattgccattcactgaggaaacccatcacttctttgacgaaaaagcatttgcagctatgcgtaagggtgccttcttcattaatgtaggtcgcggtggcaccgttcatacggatgcgcttgtacgctctttggagcaaaagcatattgcctttgccggactggatgtattcgaggaagaaccgctacctgcttcacatccgctatggagtctggaccatgtcttgatcacaccgcatattgcaggcgatacggacaaatatgccgaacgggcggtggatatttttcttactaatttgaatgcctatgccgctgatcaggagttaccgctgaatttggttaactacaaaactcagtattaatacactacttacagatccagatttcccgactcatacctatcttatgtatgcggcattgctccgtaagggtccagcctgactcggataacaatgtttccatcggctccgtgctcacgaccactgcccgcgcggccaagcgtctcagactgcgcagcatcttcttttgttcatcagccgggagcacggagcacaggttatagggcatatccaatatggccgcatcgtatgtgccttcgagcatattcatatccccgagcttcactagatcttcttcatatccaaaatgacgcaaattcactcgtgccccacgcaccgccaacgggttgatgtcacaaccgcgaatatccttccccatgctcaatgcctcaatcattacattgcccataccacaacacgggtctagcagtttcaatgagcctgactctccctttgcggctgttagatcagttcctgccaaattcacaagtgccctagctaccagaacgggtagtccagtagaataattttgcggcttctgacgacgctcctgccacgatctgtcgctatactgacacgtgcccagtagccaccgttctcctatccgaataacaccaagggtgatatccggtgtcttcatttgcgcctggccatgaatgcgtgcacccattcggcgttcgatcccgcgccgctcgtcatagtcggcctcatggtcaccttctttaagacacaacaccttgaaagtctttccttcctcaagttgtaacatagaggctgcttcgcatagctcttccagtgttcccgcatctgtcattacatccagccgaagatgaataaacgggctggtacccggctccagccgccgatgggacaataggatggaatcctgtacgggcggctgaccgaacaagcatttcaattccaaaagacacaactcacgctctgtttcatgacacgcataggtatatatgtagcttggtttcatttcttcgatattcgttttctgtttattcatgtcatatctcttttcatttggaatcaaggctaaaatttacagcctccgctattagacggtaggagtgaagccgctgctcataatctggaatcggtgtgaccaacagaaactcatcattatcatatttaatctgcaagccgcgtaaccgttcggcaatatccgacggcgttcccactagccagctggctcgcattgccgggtcgcccaatgaaatctgagcagcccattgctgcgccagttcattcgtcaaggcacatactgctcctacagccaccatggtacgtggcttgtccatccgattggatggctgaaagccggagcggtaaatgcttagcatttcttccgtttgctgttcactcataaactgaccgaatacatagcctgttgaatactgggcggcatattcggcactttttcggtttgtacctagcatccacactgctggcggctgttcaggcatcggccgagcaaacacaggcacctgttcatattcgtaagtaccttccagcaaagccaatagagcttccatcgtctgtggcagctccgtcacatgttgaagaaaattaccgctcagtgccatcgaagcatgaggtcccccaccaggtgctctccccaggcccaattcgactctgccaggatatagagcggccagtagatgaaaccattccgcgaccttgactggactataatgcgggagcaaaatagcgcccgcacccagtttaatggtcttcgtcactgccccgatatgcgacagcagcacttccgggctggaggaagccagcccctccatatcatggtgctccgaggtccagtagcgtgtatatccccatgcttctgcctgtctcgctagttcaccagctcgttgaaccgcctgctccggacggttaccgggcagcaacggcaccatatcgagcacaccgagattcaacctttttatagataaagaccgagattgcatagacacattcctccctcctgctatccattacaaaccagttccttctactatataggggaaatttaaaggtcaatccagatcataaatggaacccaccttcagaccgtataactcattatagattttttcagcaaaagcatcggtcatacctgcaatatagtctatgaccatatgctcccatgtccagatcggtttcgccttggcttggtcgcgctcatagcgctggagccagtcgcttgggataatcgatttggacgtttctgggtccagaaacgccagccacagccgtctaagcatccactcactccgtttttgcagtcgctgtacgcgcagatcgcggatcatcgtaacccaagcaaagcttttcaacacactcacagtgcgcagcatatccaaatcttcgcttccatcccgcacgaaggttacctttttccaatttccatcatcaattacacccaagctgctgacaaacaggctgacccagtatgccttcacttcacggcgagtacgggaatagtcgtgttcacacatcggcatcttgccattccacaccttcaaaaattcgctcagcacagccgctaccttctgctcaatctcagccagttgccagccttgccagaagctatcctctaacgtggtgattttctccgtaatcagacgaattaaatacggatcatataagaaatgctcgtgcacctcgattttcccagccttaattccatcctccagatcatgcgcagaataagcgatatcgtcgcacaggtccataagctgggcttctagcgtctttttgccatcagggataccccaatcctcgcggatagaacgtatgtattcccactcatgcaggtacaacccttttttgttcagaatccccgggtatgggtatttgttgatccccagtaacacagcgtccgacaaattcaaaccatccacgttctcacgcttctctaaaaacataatcagtcggaaattgtgcgcgttcccttcaaaatgctcataaatttgtcgctcacgcgcataggcctcctgtccacgcttggactccggtgtgaagcctccggcagaggatatcttttctacctttgtttcaatcagttgatccaaaatcccgtccagcacctcttctcccttgtgtccgaacggtggatgcccaaagtcatgtgcaatggaagcacattctaccacctcagggtcaatgatcagtcctgcgttatctgcctgttccagctctacttcgggatggcggcgcagcaagcttcgggatgcttcacgcgcaatttgcgctacctccaaagaatgcgtcagtcgtgtgcggtaataatcgcccgtgcctgcgccaaatacctgtgatttaccctgcaaccgccggaaagtcggtgaatggatcaaacgggagtagtcccgttcatatgcggcccgtgaagcgtcgcttcgtgtctgttccgcaaattgccgatgctctctcttgtcctgccatgtcataaagcccactccctacgtactcaattggagtgattatacatttttttcgcgcctcaggaaagctcacatgactttcagctgtaaaagttacttttagcaccactgcgcagtcggatggtgctttctactccaatacaaaaaatgtcatataaaaaaggtggtccccagccatttgcttcaggccagagaacacctctttactcaactttttatacctcatcacttttgctctaccgcttcgccctcgggtccaatacatcccgcaacccgtcccccatcaggttaaagcccaatacggtcagcatgatagatatccccggaaagataactgtccacggcgcgttctggatatattgccgcgaatcggacaacattttaccccactctggctcaggaggttgtgcacccaagcccagaaatccaagcgctgccgcttcaatgatggccgttccgatccccaacgttccctgtacgatgattggtgtcaggctgttaggcaaaatatagcggaggatgattcgtgtattattggctccaagcgctctagcagaagtgatatactcctccgttttgacacttagcaccttagagcgaactaaccgtccatacgttggcacattgacaatggcaatggcgtacaacgcattttccaatgaaggccctaaaatggccacaatagcaatggccagcaaaatccccggaaatgccagtaaaatgtcgaatagccgcgaaatggccatatctgcccattttccgtaaaatcctgcgattaaacctaaggctgttcctacaatcattgaaccaataacagacaagaaaccgacccacaacgagattctggctccatacagcgtgcgagtcagtaaatctcgaccgagatcatccgtaccgaaccaatgctccgcagaaggaggctgcaaacggctcaccaaattttgctctttatagtcaaaaggagcaatccacggcgcgatcaaagcaatgatgacaaagaagataataatgctcaggccgacgaacgccattttattgtgacggaaagccctccatgcgtccctccaagggccagtcacgacaggcaaatgcgccaatgtgctgcgtgtcgtcggtatgttgttgggttccattgaaaattgtgacatcggacaagctcccccttgaacaattgacgacttgattactgataacggatacgccggtcgagcaccgcgtacagcaaatcgacaatcagattaatgatgacgaacaggaacgctatgatcagaattccgctttgaataaccggatagtcacgcgagctgatcgcttcaaaaatgtaccgtccgatgccgggccaggcaaaaatggtttctgtcagtaccgcgcctcccagtagtgatccagtctgaagaccgatgacagtaagtacggggatcgcagcatttttaagcgcatgtttgtacacgacttgaaaagatgccagccccttcgcccgagccgtacggatatagtccgcatccataacctccagcatgctggaacgagtaatgcgcgcaatgaccgccattggaatcgttccaagtgcgatactgggcaggatcaaatgcttgatgacggtccatacctgatccatacgcccacctataaacgcatcaatcacggctaaatgtgtcacagcttccaccggatcacgggaattcatgcgtccgatagaaggaagccaatgcagtttattcgcaaagatccactgctccatcaagcccagccaaaaaatcggcatcgatactccgaccagtgcaatgaccatgctcacatagtcaaaccaggaatttcgcttccaggcactcacgatgccggcattcattccgactacaacggcaaaaaacatgcttgctactgtcaactccagtgtagccgccagataagggaccatttcccgggcaatcggctgcttggtgcgaatggaatcgcccaagtccccttgtgccagctcacctaaataggtcccatattgctgtaaccacggcttattcagccccaattgctcacgtagcgcctgcttggactgttccgtagccttatctcccagtatggtttccgcgggatctcccggaatggcatgaataatggaaaaaacgatgagcgtcatgcccagtaatacaggaatcaatatggccagtctttttacaatatatgagttcatatcctattcaccgcctgcttgcgtttgggctattcaaaataaatatttccgtacgcttccatacctgccggagaaggtacaaaacccttgagattcgctttacctgccatcagcggggtgctatgaaccaatggaatccacggggcatcctgtttaataatcacttgtgcttctttatacagttccgcacgcttgtcctgatcgacctcaacctgcgccttcaccaatattttgtggagttcctcattcacataaaaactacggttattgcctgggatcgtatccttgtccagcaatgtataaaggaaattatccgggtcaccattatccccgttccatcccagcatatacagatcatcctttttccccgccttaacatcatccagatacgtagcccattccggggattggatgtttactttgacgcctattttttcaaagtcggcttgaatggcctctgccacctttttgccgtcaggcatataaggacgagataccggcattgcatagaaggttaaaggctcgggaagcccgttaggaaagcccgcttccgccagcaaagatttagccttatccagatcataggcgtagtcctgaatactatcgttgtacccccataacgtaggtggcatcggattgaccgcaggcttagcctgccctgcaaacaatgcatcaataatagcctgcttgttcactgcgtgattcagtgcctgccgcaccttgggattattgaatgtttttttctttaaattaaagccaatgtacgccacattaaaggagggacgttcaattttcaccaattcgctattgccgtctaactgctttgcatcatccgggttcaaatcctccatcaggtcaatttccccgttttgcagagcattaaatcgtgcggtattgtcgggtatggagcgaacaatgatcttagccagcttcggctgcccctctttccaatagtttggattcttctccagcgtgatggtatcgttccgtttccattccttaaatacaaaaggccccgtgccgaccggattactcttgaaatcagcctttttctcctgaatagccttgggacttgaaatactaaaggatggcatagcgatattttgtaagaatggcgcctgcggcttgtttagtgtaaactggacgctgttcgcatctaccgctttaacctccttaatcaccctacttccttcaggaccgaacatagaatcataatagtcaaacgagtcaccttcaaatttgtatggacttttcggatcagcccagcggtcaaagttaaacacaaccgcttctgcgttaaagtcacttccgtcatggaatttcacaccctgacgcagcttgaacgtatagaccagtccatccggtgatacttcccagctctctgcaagccccggttggatctccgttgtattttccttatattccagcagtgtgtcgaacacttgcaatccgatttttagcgactcgctttcagtcacaatggcaggatctagcgccacggaatctccgccgcgtccataaatgagcgtgtcctgcacgccctctcctgctccgcttggtgttttccctgcctctggttttgctccttcacctaatcccccacaaccggaaagcgccaaaacagctcctagcgcaagcaccagcagaacggtccagattttgtgttttgcatactttttgctcatgcagcaaacccctttcacaccttatatattgttaattcgttgataccggatgaatgccaattcctttagattgacatgacaagcttgtcctcaagctgtggtcccaaattccgagttcatcaaataggtgtagtaggacagaagtgttcataatctagtggtgtaagagatgctgtagggtaatgaatagatgtgatgtaataaatagaaagaggagtatgtcaggtcgtggtgaaagtgtgatatatactcacaaacagtgaatactatgctcaaacaaagttgattattggatactttactataaaatctggaagcagacaagggggtttttcatacattaccatatgtttttatacatcatgtcaattaatattacaaaccaatttacacaatcatatcaaataaatactcctgcttggggtcttcaacctccaagcaggagcatgatcttacctcaaaaatgtattcagcaccaaacctacagatacggcttgggctccttttacaatagagaaatggtcgccaggcactttatgcgtgaacatttcccccttacaatacaattcccaacctttatatcctaattcccaggtatgttctgaaataaacaaacatacaggggcctttacagctcggtccggctggtaaacatgctgcattctcacccaatgattcacacttttaaagcgttcgagttcagcttatgtagaaatcatgaagaacattactttacaataagtgcaggcggttgcctctgaaccgcctgtcaatttacgtttcaggtgtatggcttggtttacatgaaaataatcccttccgggcatatgatttgcaaaaggtcatttattttttttaaacacatccagacggttcagtacgaccattaagcgataaaaatcgtaactgcttggcagtttcgcatccacaatcgggcttgccggattaaatgcaacagcggcagccatcgcttccttcgcccaggtcggtacaggcatagcctgacgcccctccaattcagctacccgctgatccacctttttaatataagcgctttgttcattcaacgtctgcttgagcacatctttgctgttttcaagagcggcgatctgctgctgcagtgccttaaatgccgctttttcctctgctgtcattggctcatccccctcttctcctgcaaatgcttggcgtagctcggcctctgttccggcgtatacattcaggtcaaccggcccttgaattccatcaacccgtccactatcgctgtattgccaaaagtcccagttcttccatgctgtggtgtcgccgggcacccgtgtactataacgtgcaatccacagcttataactacccaatggcgctttgaaatgggcagcaaaagcattccctgtatataccatcggcttacggccgcttacccgttcaaattctgttaaaaatgccaacgcaacctcatgaatcgcggccgagctaagccctcccggattattttcgtaatccattaccgctggcaagtccagcgctttcgcaccacccacctgatccagcacctcggcgaaatgcctggcttcctcttttgctgcgtttacactggttgcatctacaaaatggtaagctcccagcagaatcccggctgccttgatcccttttgcattcgtgataaatgtcggatcgacgtaacgctgtccttgactcgctttaataaatgcaaacgatttaccatcggctcgtacacgcttccaatcaattgttccctgatatcgggacacgtcaatgccttcggcagcgttagggctgcgattctgcataaggcgttccctccttatcattcataatgttgtagctcactttgtctctgttatccatatgcttggaccatccatacggtctgggcttttccacttttacaccgaaaaaagggcaaaaaggtagtctgcctattttgtagtggccactggtggtactttatgaagctttattttctttgtcggaagggtcggttggctttattttttctccactcgacttggactcaaaaatagctactgcattccgcaaaatatccggcatcggcactcccattctgcccacattttcaataatggacaacagctcgttcgctaaataaaagaaaacgacggcatcccggaagtaatgtgcatccccgagaataccgtcgattagatgagctaccgtaatgagcaaaaacacggtaaccttgcgaaaaataccgtaatacccctggcggcttttgagctccccattaatccaggccgctgcccatccggtgaaaaagtcgatcacgaccatccaccacagcaacgtcaacattgtggtccaccccccaaaaaaataaccgatcaaggtccccgtggaaagccccagccaaatctgatcgatcttttcatgcatgtttgttcccccttttgaacctaggtgtaaaatgaatgcccttggactgatccaagggcataaaataacacgatctgtgtggcatcatttagttgttacttagctctgtccttattcgaaagcataccattgataagcttgtattttaacattgttagatatataaacggttgcactgatattaagattaaacccacccggtactcctgaataagaaacagaagcatctgcacctctataagtgcgaatacctgcaagattgctaatataaccgttataatcactagtactactggaaattgatatgttaaccaatacgatgctaggtgtaaacgacaatcctgagactgctaacgataacaagggattcgtagatgttgcggatacctgaccattaaaattcccgcttccagattttttggtagataatccacttattgcttccgctaactgatctccggtcataccagagttggcgctgccgcctttgccagtgatagcgttagcgacctttgatttaagatcactggcttgcgtaaaagcctggtctgcccgactgtaagcttcattcgctcgatcattagctgcctttaccgcactcggagtagctgcctgatctatggctgtgcttcctgtagatgtattaagctgcacaatccccctcgcctgtgttgatgctgaaggcaaatccgatgctatatgactatgttgcttaggagcagcgtactgatctgtatacttcttggcattcccctctgctgcactccatgctgcttgcttggctactgtaacatggaggtctgtattgctggcgtgattgtccaacgcttccttggaagcaacaccgttcccagccgggtcctttttgatattttcaacctgtgcggccaattcctgatcgttagcataaagcgtatcaatcggtccattcaggacgtctgcatgtccctggtcggtagtaacaaatctgcgtggctgttgtatgctcatacttcttcatcctccttaatagatgtcttcaatttcaaaaacaaactccatatcactatctttgatcttgttgctcattgtacggatggccgtcagcttctccgctgaatctaccaaagccagctcattaatcgtctcacccaccaattcattttctgccagtgagcaagtataacgaattgttgcaggagcaataaattcaaagctcgtaatatccttttgaaccagttccttttttaacacctgttctgttccatccaaaggcagtggcttccctgcttgatccacaccgccgctaccaaacgccatttttactacttttgtcagcgttcctccctcagcgcgggcacgagccatttgttcccttgcatatgcagtcgtaactgtcaaaacttgttctaccatacttaccatcctttctatctttaaataaaagttatattggtttagactgaaataactttctcagttgagcttaacatctgactaccgtccagcttcatacttccatctaacttccaataatggtctcgaattatcattctgccttcctgatgatgatccattcgatgcttgatgaccatttttgtacggtttaaatagcgcataggttcctctgtccacccggacaaagaagctgttccgttcagtaactcgacaccatctaaataccatggcttcccaccaaaaaagcgaactctcgaacgtaatcgaatacgacaaaccatttcattctcatgaagaaatgcaagccttgttttgttattcatataaagagcaagatgagcaggcttaatatcctcgatgatctttttgaaatcaatcatattttcagggattctattttcaaagcttataccaaacttatactcaaccggataaaaatacacttccccatcgacaccaaatgagctcatgattttccgtattaaatcccctgaaaatttgccgcttccacgaagttttgactccacaacagatcgccgctgttccagcggcttttccaaatggatcgggatacccaattccatttcccagcgttcaagcccccaagtggcggtgcgaacaaaaaactgggctaacgtatcatctagcgcaaggtatagagcatctagttcgctaccctttgcttccatatcgacatgcataacacgagatgcttcgtaataggcaggaagataggaaaatagctccggtccccgcgaactgaacattcgtttactaaaatcatcggttacatctcggataacagattcttttttttcgtcaatatccatccatactcaccatccccagctctaccccctgaccaaattgaatcgttataaaaagattgctttgtctgttcattttcagcttggagaaacccattataatcagatccattctttcatacatgctcgctcctcctttgagtacaggcatttttgctctctgctctataccgtttttttacgaaaaatagagctataccatttaaccggttctcgctgtgcactggaaacctccatagatgacgattcctctacgttatccaataccagatcagaacgatgggataaaatcatttccttcacttgtttacgttgtttttcatctaaagcgtagcatccaatgatagctgctatattaccttctccccggtcatagcgggtaacacaagcataagcacaaatacgcaattgagtctctgttaaagcagtcatagttatgacttcacctctttttaaataagaattttgcgtctaaacaggagtcagtacatggttattttcctgtgttaccaagcatgagctgggtcagcgttacttcgagatctgcaatacgctgcttcaattgatctgtctcacttggctgttgctctgctttttgtgtcagttccttaaccgcttcctcactcaatccttcactccaaaatgtcgtcgggtctcttcgttctggagtcgaaaaagccggagcagaatatataggttcgtctccacgttcgttttccagcttgttttgccattcaacatgcaacttctgaaatgaagcttgcgattccttactaattttctcgtacttcttttgtgcctcaatcagagtttcgttatattctgcttcataggtcaaccagccttgaatatcaaacagaggatgatataagctcggtggaactagaataccaaccgtatagccagcagggctggtttctgtattctcttcatcaatggcactcgatttatcggtagtacgcacatagatgtcttgttgctggtctgtgtcagatagtatgagtgaagatggagcataaaaagggacgacacccgaaaaggcatcgtccactagcttgtcctccagatagaggccatctgtatttactttaggtactgctttcatatattatcctccttaaacttctgctataaattgaacggcatctaaacgtatccaaccatagccccctctgcctactacttcaacacgtccgtcagaggatattgcaattacggcagttttgtcagcggacaccgcatcagatgctgcgcaggttaataccgttaggattttaggcctgtatccttccggcaacctaaaacacgtgacggttgcattagaagtcggtacctttattgacccgtgcatcttaataagattatctgacattttaaggtactgaggccacatacccactgaggatgtttctgctgtaacgccattaagcaacgtgggtgtaatccaggaagggctatccttgtccgcctttttgttctccaccacagacaggcgcaaatttgcttgttgcacgcagtctatcaaatccaacagcagtgtcttttcgttggctgcgtagattcctgtgaacggcacaacgggtgagagaccaaccataaagtacgtgacactgtaggccgatgctctgtcgctatccgatgcattcaaaagttgcgataacgtacccgcactcgtgatccatccgacgcccttagtccatcttgtgtctaagaccccatctttgtataccgtcaacggttgtatagacctgttcctgagcaagcgcgcgctaaagctggcgttatttatgttcatcctgttgccgaacatagttcctgtctccataaatacgtcggcaggctcgcgcaacacaattcccgtacctacttcaacctgattgtctcccgcaacgaacgttagttgtccttcggatatgataggctctgctgtaggcgttgcgagtttgtatacgagttggtatgccgaccaatttccatatcttacgtacgacaaggatgttatcgctgttgtcggcaaagtagttacgtacagcgttgctgcggtcccgttcgaatcgtagatagaatcaagcggacaccacgccttccctactgcctcattgttaaacggcttactaacgtctccttgaccagccaaatacatcttccagcccataaaatacgcctttatttcgtctgttgtaggtgtgtagttatctccccatccactgtctgcgctagaaatggacagacccacaacaccagattctgggctaaggtgggattgatccggcccgcttaacgggaaaacatgctgaaccaacttaccgtcaaactttgttatcctctcactgtcaaccattccattagtggcaggtatccgtacaactttgtagcctgcggctgaatcgaagtaaccccagggtagcgagccgtcaagcgtcatactgtgccaacgtttgcttttataatattgcccatcacattcaaacactgtatcagcattagcccctgtaactggatcggcgtataggtctgtttgcagtgccagcatggagtcttcatgctgcttgaatggtttggcaatactgccgatgttgaacataaagtctgaaatcgttacttcggcagtggatgtgcccaacaagcggatcactacacctttagtacctgccggaactgtgaatgtataagatataattccgctacctgttacactaccgataaccgcagtctcgttttgcatatttacatgtattctacccgttggtccactcgactgagcggaaaccgtgtaagcctgacccggaactaatgggtagatggaagatatcattatatttgaagaagaaacaacaacacttcgatcatctttaataagaggtgttccgaccgcagtgtcccaagaataaaaagagtgtggggccaaattctccccataccggaccgcgtatggattacgtacaggcattacactatctacataaggatatttgttgtcaatttgatcgtcggtcatcgttgctaatgctgcatattctgctgcagaaatctcatagatacgcgcagcctcaaaataagaatactgtcctacagtaccctgtgttaccaaatctatgttagtaataatatcgctagtaggtgccagcctaaaccaagccgtagcaaagttagtcttatccgtaactacaactttcgattctaccagagcattcggagccgagattcctgcatctatagcgttacctactttagctcttacaattgcaacatagtatttcccagctaaaaatttaaaattactataaaaccccactccaacggtatatccaggcttgatcgttacttttaacgaattaggcattgtccctttattcaaagtatctagcgctatatcagcttgatacggtgttaccccccttaagctactcaaattcccccatcttcccaacaaattcaccaacgtacgcccgctcagccccgtcagcgaaaatggggcagccttttccgcatgaacaatttgcaccccaggttcgagagttaccgccttacgctctgttgtatccagacgcttcttgatctcatttacaccatcattcacatcacctgcgaaatcgtctacagctcgccagttttgatccaaatacttctccaggtcaaaatacgtggttttgggcgatgtgcggtcaatttgatttaagccaagatttggtgtcttttcgcttgccatgctatgcgccacctcctaaatatctatcctgggttgtatgttcaatttcatagagggtcatagactcaacttcagcaatggtcaggtagcgtaatttgtactccaccgccatgtgagcgggcttgatctcctcgatggctgctttaaggtcttccacgttgggcggaatcccaatggtatcgataaatttgaccgtaaatccccattcggcgggatgaaaagtgacatctaccgtgcctccgtcgtacgcttcagctacatttttgacaagccggccggaaaaggttcctgcccctcgcagcttcgattccaccacagcacgccgttggtccaatggcttcgccaggtcggtttcgatccccagctccatttcccagcgttccaacccccatgtggcggtacgtacaaaaaactgtcccaccgttgcatccattgcaagatacaaggcgtccaattcgcttcctttagcatccatatcggaacgcatcacacgtgaggtttcataataggcaggcaaataggaaagcagctcgcgtccccgctcgctgctcatttggcccactgtatctccctctatagttacccgattaacaaaagtgtcactacggtttgcacgttttccctggtctgggttattcaataaatcttcaaagctgttcgttccattgttactcactgacgctcaccgtccccagcactgccacctgacctgatccaatctcaatattctgattgctctgtccattgattttcagttcagagaaatcaataataatcggaatgtccagcagcacagcagaaatccgggtatatcgtaccaacggatcttccttgtaaaaagcaagctgcttcaaatagttccgcacaccgctttcgatcagctttttgatttcatccaatgtggacggcttctctttggtacgctgtaccttgactgagatgttaatttccacttctgtcgctggcatgatcgtcaccacaggacccgctggtgccagcccttctccttgcccatcctgcgtcggatcaatatacttttgcaccgcagccacgatatccgggctggctgctcgtttgtccgtatccagtacatataaccctacggttccaggtcctttccacaatggaacaacctctacaccgcccactccggcaatttcattcgcccactgggtatactgcgccttgttgccgcttgtgccctggttccgcaccttggcataaaaacgctccagcaacagctgatcgctctcaacgtctgtgccgctttttgtttcctcggtattgatcacagaggccaccccgctaaccggggttgccatcacttggatgacacccgcaggcacattgccgctacgcccgggattaaccgcccgaatagctgcttccccggcaccttgttcatccagcgtgaccgatgccgtggtcgcatattcaatggaagcttccccggatacatcatctgccggggtcgccaccaaggttcccgccgggacagtcgttcccgctgtgcccgtgaacgtgaccatacctgaagcggcaaccgcttctcgccgtgtcaccccatgctctgctgttcgcaaatccagctccggcgagcgaaaatccgggttgtcgctggctgctgtgctggcaaagccacgtcgcagcagctcttgcgcccagattgccgcttcggatagcataaacgctaccggcgcctgcgcatcccaaataaaagagccctcggacttatccatgtccgaaggcactttttccagcatccgatttaaaattccctcttccgtctggtctaccaaatattccggcaagtctgccattagatcaccacactttccacaatttccgtttcatctcgcacgttcgtaatctggcagctaaaatggcacgcctcaccttcccagcgaaacgtgaattgatccacagtagccgtacgtgcatctgctagtaacgcctccgtgaccatgcgtttaatttcactttcctgcacaccgtgcccatagctgctactaatcagctcctccagctcgctaccatagtcaggtgaatagatcacatgccggtagcgaggagtgcgaatggctttttcacaccactgtacccaggcttctttctcgcctgtagtcacgattttacggctagggctcataacaaactctccagcttcaaaatcaaaccgccagcttcgcccaaatactgcgcggttatcctccagcacatccgggtcggtcatatccgtgtctgtccagatcatatcatctgtttcgggaaataaattagccacgtccactcaccaccttacacacaacaactacatcgttaccgctattcacccgaaccgcaagtacacgatctccgggcttaagaccttcgttcaaactgagattcacatcctccagctcgtcttccccgatataaaaggaagttttcagctctttgccttcccaattttccgattccactgcggttgaggtgcctttgtacatatgtcgtggtacagatagcagtcccggcaactccgcgaccagataatcctgaagctcatgtttaaaatcgtccagcttgagtcccgtcgaggtgatcgttcctaatacggcgcccactccactcagcgcttgccgggtgtgtcccgccatagacgattgcattacacttacaaatgcgccataggggtctttactcaagaaaatacctccttttaaccatatcgaaggaagcgagctctaaagtcatatttcccgggtttcccaaatcccgactgaccgaagtaacaatcaactttaatccttgtaatatcacagcttcaccagcacgtatggtattaatatctggtaaattaactgtaaaagtttcctggattccagttaaatgacttttagcaagcttactggctccgccagctgctttcacttgatcatcttccaccagcttttgcaaagtacctagcgctttagtatccccttctgctacagccagcaccttagacggcacctcttgtccgcttcctgcattttcatcagctgtcattactttgactttagttacggctccctcaagtgtccgcaactgcgtaagatcaataaatcgatctaacacatagggggaaggattgctaccgattttaaatagctccaatccagcacttgtcatgcgtaactggtacaaatccccgcccaattttgctgtctctttcaaatcagcaagcatcatggaatatagagtctgggcacgataaataccttttcctaactgtactttcgtgtcgggtattgagggaatttgaaacttccaatccttcgcgtatttacgcaaccgttgtgtggccgtttgtcctttgggaaataaatattcatcctcggatttatccaaataaatcgtcctgtcatataccaccagagagaaacgttttgtaccgctgtttgagctctctacttcccacacaacggcagggtggagaagtggtacctttgcgttttttccaaatggaattccactgacacgaataggcatccctggggtaatcgacggcatatcctgagaagcagctacacggatgctggcctgatatgcaatttggtttagagcatcttttaaagttattttttcgaccagaggggtaagatcatatttatcttgaaggattacttggtagctcatggcatcaccagcttttggcccactttaatcttattcggattgttgcctatgatctttgtattcatttgatatatacttttccatttggaactgtcccccaattccagctttgctattttagaaagtgaatctccagctttgacattatacgtcttagatttggttttaagattcgtacgtggaaggttactagagtttacttttttgggggaatcccctttccgcaacactattttaggttcacgccatgtacgcaaagtaatttcaaagtatatatctcctgcctcgcctccccgaaaggtcgtattatgagcaatgataaaaacaggaacattaatgagcgtattcgtaataataaattgatacggcttctctgcttttaacattgcatttaacttgttcatcgcttcgttaggatctgggatatttttataacgacaataggatgcatcgtacaccttgggaaaaaaagaagaaaaggtgatttctttcaccttttctccttgtggaaaatcaaattccccatgtgtaagcatcgtaactgtttcataccctttttgccgtgaaatattcacctcttcgggattaactgggaattgaaacacgctttgaccattaatcagaaaaaagtctatacccatagcctccctcctttctgctgtgatagatttacgttagactagtacagctttatcctttttaagggaactattgtcccctccacctctattaataattgcctgtcgtacctcatttacaatccggtgtcctacttgaagtgccatcgtgtcgaaatcaatagaatcttcttgaaccgttacctgtactgctccaggaggcaacgttacactgatttggttgttcgtttctgtcttgaaatccttgagaaagcctgaaaggctactcatttgttcatccgttatttgcacgagctgtggagctggttttcctcctttcgccgtaggaatttgtgaaccacctggccccataccctgaatcaccttggaacggttttgggcatcctgaataaaagatggtaatggaagccccggatcaaccgaagggaatcttgacagagctaatgacgctcccggtgcagttgaagcgggattataagattgcgaggccttatttacagaaacagcaggttgtgatttttcaggttcatttgaataaccaaacaaattagagaagtcacttttcaaactttctgtttgactagaaaaccaattactgacatcagatgctttattactcatccaatctgtagcttgggaagctttttcaccaacccaatccttcgcaacacttgctttctcgccaatccaatcctttgcaccaatagctttttctccaacccagtccattgcagaagtagctttttctccggcccaatcactcatttcagagaacttttgagctaaccattcacctgctaaactatctactacagcgcctacaattgcaccaataagaccaccaattacagtacctatacctggagcaatcgctgtaccaatagctgccccagcagtaataaagccacttcctaaaagcgctgatgtaatagcagccggacgttcttccggcgacgctgtagcaatgtctacaatatctaatactatgctaattgggccaagcagcttcttgccccccttcattgctcccttacctatctttttaagcatatttcctggattttcaccaagtatttttttaccgaaatcaaatatctttccaaacttccccttacctccatgcggagttggccgtcctcctgggactcccggcttagagctaggttttgggttaaataaacgttttgctttttcccacagcttaggaagtcctcgttttttgccaggactttttttgttgttcttatttttctttttgtttttaccatcaggtccatcttgttcagcaatgcttcttttactttttccttttttcccacagcaacaacaattacagatcaccttaatttttggagaaactcgaataggacctgtttttacgttgatcttaggcgcatattttggagctgcgactctaatattcaatctaggtggttttaccttgatatcataattaaagttaaagtcaaatttaggatcctttatttctaaatttgcagtaacactgatagacttgttcacaatatttgaaacatttaaattatttccccggttgccacccttagctttcttcttatttgtatcgtcttgatcaatgcccgtttttgcacgtgcaacaatataggcatccttaagactttttagctttctgataagcgcttcgagcactggagtcgccttatcaatcagaaagacttttggcctaatgcgtagccggctaagacgaacagctaggctgtaaatatttccaagatgcctatgcatatacttaagttccgtattcagcttaatcaagctctgataacgggcacgtcctaggcgatcagaaagcctttgtatctgctcaatatagcgacttgtcgctttaagttcccggtttgtaatgattaaatcctctacatctgtaacaatattaactctatagttacttgaacctgccatctactcacctccttgcgtatctattattgctgtatttgttttgacaatgcgtccagttcctcttctgcaaaagcgattaacatggatttttcccctctgtttaaggaccaaaactctccgggacggagatgatgccgtatccacagatgatacagcacagtcgtcattccgccggagcgaatcagttttttagatcatcaatttccacaccgaagccggacagttccagaactttgtcacctaccgcatccagttcccctgccagaagcatacggcgaacagcctgttcaccaccggacaatttaagcctgctagtaattcgcggatcaccccatccattaatttgcagaccttttacctctagaccagccgtagcttcagagataagcaatgcattaaatgtttctgtatctactttttcatccacacggcctttaatggttttacgaattgtgcaccgttcacggatactatctactttgttggacgtcaaaccacgaagtgtgagaagcatatccaggcgctgaatacgaacagtttcctctggtaatttatctgcagcttcaaaaagactatccaaaatttgttcttctgacatattttcaggcaaactcatattaaatccccctaataatttttttgaaaattaggcccggattactccaggcccaccataaccaataaattattcagcaacaatcggatcaagcagctcatagccttcgaaggtgaaagtagtttcttctggcacttcttcccctgcagtccagttagccaattgaattttatccggcatgcagcgaatcaaacgaacacgttcatgtccaaaagattcgggatcgtccagcttggaaataatatcgaatttctcaaaaccgcgacgaatcatatcggaagttactttgtaaccactcatcgttccagtaccttttttagctccatttttatggactttccacgtattacctaccaaattcagttctctcttatcaatttccacgctagcttccagcttgttaatatgtgtctgccataccccatcaatatatgcctgaccatacgtacctaaaatgactcttgaagcatccaacatttctttttcctcctcaaaataatccataatatagttcgggatttcataaaatcctcgttgttaacaagctacttcatttctgccgattgcctgcaaaatgcttatacacgtaaaatgcttatttattgcacataaaatgtgccgaacagctgctccatcacgtcggtgagcttcacgttccattgcaggaacacttgatccggctccggtttgatgactggtgcatcgccgtagtaagccgggtcgagaatgacatcgtagccgtctgcttcgatgacgttgctcagcgacagctgtgccaggtattctttgattgcaccgataagcgccagacgaccttccaccgtgttgttgattttgccaatgtatgtctcttcggctgcacgctgcaagtcagcgttaatagcgtccataacgcggatggaacggattttcttccatgcgttgttttgtccggcagacgggtttaccaagctgttaatcccacgcagcgctttgacctgacgtccgtcgaagaacagcaggaagacaccattacggacagcctgctcctgctcggaacgtgtccagcggcgggttacatcctcaaaaggcgtaaccgcatatgttgccgattgattcagacgttgacctgcgatcagtccggctacataagcagccgtttgggcagaactgtagtccgtacctgccagacgtacgcctgtaccgacgttcacgatgccttcatggttcagtgccagggaacgtgcagaggccacgctgacggctgttttggacacatcgtctgccgcagaaccgccgaatacagcgattacgcctttaccttcgttgcgaacacgcttgatccaggcagcgaagctttgcagcaatgccagatcggctgcataatccagggccaagacattaaattcctgtccttcaagtgcctcctgcatcgcgatgtaatcggcattaaccagcttgctattgccgctattgccgccagtgaggtgtacgccgctgacatccaccggaatgccgccgtcgccgacaacctcagccttcacccatacgttttcgctgttctcgttcatggccttggcaatagaggcagccgtaccgtcactacctttgtacgtgccgagcagcttggttccttcataaaggcgcacctcacgtgcttgctcatcacccaaagttggctgtacagttacagcaaaaccattaccgcggctacctgtatacaaagccttaaggcgcagcacatccgctggggtctcaccgccgcttttcagcgtcacagatgcttcagcagctgtatcatctgccaaacggtaggctaacagctttttcggaccacccagcaaagccagatacagcgtcgaatatgcggtcgccccgtccagactgtcacccgaaaagatttggctgattgccgtttcactgccgatctctacaaactcacgtacagggccccaattcgccttaacgggtacaacgactgtaccacgcgacccaccttgaatcgctgaagctgctgctgcctgaaaattcatatacaaacccggcaataccggtttattcgtgttttcccatgttccgcctgccataattagtccaccttcgctttcataaattgttcgattttagtgtgtgcttctgctactgtaaacagcttgtcctgtgtgccaaaaaaggcgcctgccagcacttcttctttcacggaaaacaattgttctgcgtgctcctttagctcctccagcgtatagcgagggccacttgcttcctgcccggcatgtacctgggccttctcatggttttccaaggtcactcggaccacctcatttcaaaataggatgaatttccactctgcgaatcaacgccgcttcctcagctgggcgcatacgccgctgtaccagcattagccgaagctgaccatctaaaatggcatccgcctgcacatcggctgaagcttcagctgtagacatataacgccccttgtcctgatccagaggaagctggatttgagcggcaaagccctcgatcagtacggaagctgcgcggttttcctcggtggtgtccggggcggtaatatgcccgatgaaccgtttgcgcagctcatacatggaggctcccgccatcctagtttcgcagccgctcatccgccatagtacggcgtgccgtcccggctgtgcgggccaagcgtcggcgtataccgaccacgtttcgcccagttgcttctgcgtccagcggaccagcgcggccagccactcttccggctgtgtagcactgtttgctggagcggctgaaccaccttccgtctcaggcacatacacgccaaaacgcagcgttctataggccttgcccgtaacagtgtccagcttttctgcatctcgcacgcccaaatagtgcgcggtaaaagccgacgtgtcctcacctgcacctgtcactggttcccggtgcagcccggcaatcagggcattcgcccatacatcagcctgcgccagtccggcttgtcctgcgtacagcttgatgcgaacaacctgccgatagccggcccaggaagacttccagatctcctcgcccagcgccataacagcatacggctcctctgccgtctgcgacggtggctgaacatcgtatacacgcccttgcagcgctggaataatttcaatgagcttttgcttaaaggcttgtctcatcctgcggcatgccacctttgcgtcccctgcgttcgcatgttgtggctgttcagccaggcttttttccacttccgtgttctcagccggcgtagcctcgtactcatgcattgcagcatcccttgcttaggcaacacgactcctcctttctattcaacgaattcccgggaaccgacagagacgatcaccgcatgaaaaaaccggccctaatggccggctaacgtttgactgtgtgtgtcttcggtatgtcctcttgtcttgattcccgatgatataatcttacaccctaataacgaatgcgttgccggggaaatggacgataaaagcagagactagggatgaagttaggaggttttttgagaacatgtgttcccatcataaaaaaaggccttgatccctgttattacaggaaatcaacgccttttaggaaacgattttaaaatagaaatgataacaagtggataattattacatcaccccagttttcgatccgcgcccttctgcaagcctgccagattcaaaacgccttggtccgccagtgcaagcgccattttgtaaaaagcacgcgtacgaagcttcgtatacgtatccttgctgactggcgggtctaacacataattgtaaaccttgtaatcaaacacatcgtcatcctttaaataacgttcacggatgagcagttgttcgcgttcattcaagcgactcactaccgcatccaccatttcgcagtaggccaagcgggcggcaggagcatctacattatatacggctgtccgagccgttggatcgcttgtcacattcgttggtccgttcgggcgatccgtatagccagcagtaataaagctctcccgatccataaaagtaatcgttttataaattcggtatttctcaaacacaccctccaatgcattctgcgttttgcgacggtccaattcgggtaagttatttctcatgtaaagcaacactccttatcttatgccttttgacaatgatgtatttttaaatgaggattttgcacttcgaagcgactggaatcgaattttgcaaaatcctgaaatagaaaaacgctcgtgtttacattttgttccccttttgttcgtatcttgagtataacataacattatttaggataggtatccatcgtcaaaaaaagcagtatagctccaaaaacaggatattcgcttcattttcctatgccttttggcatattacgtgcttttactatttacctaatggtataataaaactaatatctatgattctcttgcagaaaggagcccccattgtggaacagccagcattcggaacttacttaaagcagcagcgtgagcacaaacaatggagcatcaaccaattggcagatgccgcaggtattagcaattcacaaatttcccgcattgaaaatggactgcgcggaattcccaaaccctctactctccgcaaaatagcggacgcgcttagcgtatcctataccgaaatgatgaaggccgccggatattggggagacgatgattcaatggagccaagtccacatgaactttatcgttctactgtgccggaatgggcaacctctaaagaccgccgggattttaaaaaaatgctggaggaagacgacgaattaatgttcgatggcattccgctggatgaaaaagatcgtcaacggattaaggacgtgctgacaggtctgttctgggaagccaagcagatgaacaaacataaaaagcccaaagagccccgaacgggcaaagatcagggatagcaggtgagcgtatgaacgaactcattcacagacttgtccgaaaataccgtaccaactgccccttcgatattgcgaaagccctaggtatccatatccgatactgcgatctaggccccacaaccaaagggctgtattaccacaagctgcgtagaagatttatcgttatccacaatggcctcacacccgaatgggaacggttcgtctgtgcgcatgaattgggacatgaccgactgcataaaggcattagccgcttttttatggaggagcattcctacttttccccaggaaaatttgaacagcaggccaatcggtttgccgtgcttttgctgagtgaaggaaaaccgccactagctgacgaaacgttggatcactatttaccccggatcgggctgcccaaagagactgcccttttttttaatcataaatcagaacattagttctcattctgtgagctgctgtttattacttcctctataatataggtaactagacgatagatttaacaaccgatatatcaaaaaaatttaatgctttgatataaaatagaagttatttttacaatcatctgataaaatgtggtcgtaagcggtttctctaattcattcattttatgggaggttgaaggaacaacatgaactcatggaaaaaactctcgtcaatcctgacgactgccgcgcttttacttgggtgtctcggtacagcagcagcagcagacccagcaaccaatgtgggaacagcgggaacggcaacgactccagtcagcggtaaacacatcaccatcctacatacgaacgatacccatgcccacgtggtcgcgaacgacaaggaaatgggattcgccaagctggcgggtatcattgatcagtaccgggcttccaatcccaatacactactgctggatgacggggataccgttcacggaacgaccttcgctactttggttaacggtgaaagtattgtgaaagtgattaacaagctgcgctatgatgctatggttccgggtaaccacgagtttaattatggttggaagcatcttgttgagctaagtaaggaaattcagttccctatgcttagcgccaatattaaacaaacagacggaacacgtttgttcgaaccctatattattaaagaagtggacggcgttaaaatcggtattatcggtctgactacgccagaaacggcatataagaccaatcccaaaaatgttgagggtattcaattcaccgatcctgcggctgaggccaaagcggctgtgaatgaaatccgaagcaaagtagatgtcgttgttgttcttggtcatctggggcaggatgcgtctagtaaggacaccagcctcaaggttgttaaggaagtgcctggcattgatattttcatcgatggacacagccataccgtactggaaaaaggcttggttagtgacaatggtacattgatcgctagcgcaggtgaatacaccaagtatctgggtgttgtggacttatgggtcgacggcggtaaggttacgcaaaagcaagccaagctgattgattcgactcaagcagtcgatgttcagcccaacgctgagattgctgcattgatcgcctccattcaaaaggaccaggaacctattcttaaagaggttgtaacgcaaacgagtgtggatttggaaggagcacgcgaaaaggtacgtgcaagtgaaaccaatctcggtgacttgctcaccgatgctatgcgtgacgtttcgggagcagacgtggctttaacgaatggtggcggcatccgggcttccatcaagacgggaacggtaaccaagggagacatcatcactgtactgcccttcggcaaccagatcgttaccctgaaagtgaagggctctgacattcaggccgcactggaaaatggtacagcctcctatccagagccaagcggaggtttcccacaggtatcaggtatcacgttcaaaatagacacatcagcagccaaaggcagccgtgttcattccatcctgatcggcggaaaaacacttgatcctgaggcaacatacacactggccaccaatgattttactgccgtaggtggtgaccaatatacgatgttcgctaaatatccacaagcaggtatgttcggctcgcttgatgaggcgttaatccgctatatgcaaaaagtcggctccgctagcctgcaagtacaagcggacggtcgcgttcaagaagccaaggctgacggtaaaacttctgtccctgccacacaagctgggccgtctgcctcaaccgcaacacctgcacctgtgcaggaaaagccgcaacccgttcctacaccggctgcgaaaccagcacccgcaaaaccgacgccggcaaagtctcaaacagccaagccacagcagacatcaaattctgcacaagttacaaataaccatgtatatgttgtgaaatccggggatacgctgtatggcatttcccgcaaacatggtaccacctggcaacagcttcagcagttgaataagttgaagaatcctcaccgcatttatccgggacaaaagttagaccttccggcctaattcaatagctagcaaaagcagcgtccggaatcctagtggtttcggatgctgctgtatgtcaggcgtttttagatatgcgatagtccaagcttatttggacatcgcatattttttttaaaagcaaaccttttaaccgctgacaagttgtgaaccgagaggtatgatggagaagagtcattcgggcagagaacattcgtcccgatacccatcgggatcagttatatgtgtgaaaggagtccagaaatgcaatacattatttacgatcttgaatttaccgttagtcgtaacgccagatattcctccgaaatcattgatatcggtgccgtcaaagttgttcagggagacgatggcctatacgttgcggatacgtttcacagttttgtaagaccctcgaatcggcctgtactctctacagataccgttcagttcacgggtattactcaacgagatattgatgccgctccactatttcctgaagctgtgaaggaattcatagcctggctcggtacggattccccttattatttatgcgcatggggcccggatgaccgtcagaagctggtatcccattgtcgtacccatcatgtagatctcggatggattcataatacaaatgatatacagaagcagatttctcgtctgtttggttccaatggaaagtaccgtcagttgagcttgtctcaggcgctggaattgtgcaacattgactttgacggtcaacaacaccgggcactggatgatgccgtgaacaccgctcaggttttcatgtaccattttgatcgtattacattagttcataatgctgctgacgatgaggaaagccgtggatcgaagctcgtctactcctcaccagaagaagaacaggagcagtacagtccttttggcaatctcgccaacctgtttaaggaccgttaagcggatagctccccggcccgttccgggggatctccccctgttattcttgattccctgcctttttatcgaaatagaatgtcccccaggtccgcagcatttcttgcattcgtttgcggtaccgtaaaggctccaggatctcggcctcagctccataggaagtgagccaatccaaaaattcacggtcatgattgaccgtcacctcaaacaacaaacttccatccggcaaatccctaagaaaaggcttgatgaacagctcctcttctttgacccgatatacagactcggcagaaaaacgtaccacaaaccggatattctgatttcctttggtcaccgaccaggtccctttaaaaaacatctccatttcagttgtatttttttgaaacgtatacggcaaaattctcatgttccgaaatcgactgatccgaaaggttctcatcgcggattgcttgtgacaaaaaccaagcatatagaatcgccgatcctgcggaaccaaacaataaggatccacctgaacgagtgatacatcttcattttgaggtgagctgtattccgcttcaatcgtctgctgcgtaagactcgctaaaacaatcagcctgagcagatagggctggttttcccgatcaagtgtcgagccgagccggacaatatttttcatttcctgcgcgaagctcgtctggtccatcttttttttctgactagaggccatcactttctcataagcactttcaaaagctggcggtaaaagaggctttaccgtttccataatctctcccagcttagtaaaagcctctgcctcttcttccgtccaatttagaggatacaaagcaaaattgctaataaaaatgtaccccttgccatgccccatattcgtaatcggtatatgcatagcgcttagcgcctccatatctcggtatatggtacgttctgatgtttcacaacgttcggcaagctctcttgccaatatccctggatttgcctgaacaatagtaataatccgcattaaacgtatcaaccgatcagtcaaggaagtctctcctttacaaaaagttagtaaattagactcactatattacacaaataaactagcataattgcctatctcaaagtatcattttcagtaaaacgaacatcttctagcgatatcgccttattaaaaaagactttagaactatacgctgtaaatgatacaaaagtaccactccatttattacgtatagccagaagcaactcggcttcctgcaggtagtccatatcatcgattcttgctgcacgtataagtaattcatctgcttgtctggtaaggatgaacgccccttgctcatattcccctttctcgtacatacgcaatgccttttttacaataggggacgtctcattcagctttatgtatttttccaccttcgggttggatggaatgctcagcagaccaagatgatgcgtaaaatggatgtagagctgatctgtccggatcagcgttcgcttttcctgcgatggcttgcgccagctccactccatcattccaatcgtatgtcttccggacgagtgagccggtatagaaaacgtcaaaatagcctgtctatattttccccgccttacatcaccacagtgaacaaacatcctatctccgttttccgagcgtttaaaaccgagccttaccccttcagcttttaatagacttactccgttttctggaatgaactggagttgaaggtcacatcccgctgctttcggtattagatttccttttcttttgcgtatagctccatagccccattctatcagtagatttacttgtttggacccattcgcagatatagactctttgtcccatgtgtacgttacattgagcattgacttcaccactggtaaattccccctaaaagaacatgtaactctaaattaacagtgttatctgacactatattgtcagggaacgtatgtttgattgtgaaaattatacatgggaatctttatgaagggggacctagtttggtaaataacattttaaaccatttgaattacatgaatgcgcaaaaatagcccggcgtatgccgggccatatcatagtctacttctatatttaaacttatgagattgtagtttctgttaaagaaacattcgtttttgtgcaaatatcagatataggagcaaaagtagtgctatctacgacgagatcctttgataacggctttccatttacagtgatttttaaagttttatagttttgttctctctcattcatcttgcaaaatctccttttatatcaatttttaatatatttcagttcatttattcaacttaagcccctgatcaggtgcggatcgtttctttactcgtatgctgggaaaaatgccggaatgttgccgcttccttgatatacccgttttaaggtacacttaaactaatatatcgactttttttgagaacattttcttcatatttatcgtccgtttattctaaaatctgcatccgaatcgttatattatacgtaaccatgtcatatgggtaatgatctatatcatctaacatcttggtttatcaaaagggggaacatctcttggcacgaccaacttgtcgttttgctttgtaccgccgcattgtctgcgctgctatagcacttttgtttatttttgggataactcgtgtacccgaagtacatgctgcttattgggatgatgtgtaccaaggcttcgagcaattttcgcggttgcccggtgatgtgtatcagctcaaggaaagctaccgacaaacacaggaggatctggagaaggcccgtaacagcttagaagcctatcaagagcaaaacgcccaattactggagcaaaaccgcaagctgactgacaccgtcacagaattaaaaaatcttcaaacccagcgcgatcaggcttcacaccgaaataaaatgctcatcatcacagctataattctgctggccggttattttatcggtatccgactgctgcgttacgggatgcgtcgacgttcgggaagatactaactgtctgaaaggatgaaaggtctgaatggacatacaagcaggacaacaccattatgaaagcgtcggttcggtcgtaacgctcgatctggcggaaggagaaaagctgcacgttctgcatccgcagcaaatcatcgcataccgcgggcccagctcaggccgtagtgataaactgatgaatattaagggcatgtatcgcaaacacaaactgattcaggccgatttcacaggagcttgtcgcctaattgccgcacttccacctggctttagtctaaaaatgattaagcttgaaggaagcgatgatctgttatacgattttcgcaacctgttctggtacagctccggtattcaaatgcgtaccaagctgctaagcatgaaaaacatgttgtttagccgcgatgttataaaaatgaaatttgacggtgtgggtcaaatcggtcttttgacacagggactggtatgtcaagaacagcttcatccgacagagccgatatatgtggatgcgagtagcgtcattgcctatcccgaaaacgccaaactggagttgaccgtgtacggcaaccatctggccagtcagcatatgaactatcattttaaaatgaccggacagggtaccgtactattccatgccggggaacatcatcggcggctccaacaggatatgaacgacgatggcgtgatcaagcgctttttacgggaagtcattccatttggtggagtgtttatcaaatagccctgccatgctataatgacaatgctaaagccgtctgtcctcgtggcagatactaatgaagaaaatccatgcgtcatgcatgggagaggttcgcgaactccctctataaaaaactaacgatgctttgtcctccgcaagaaaaatgaattcgcggggcaaggcctgttttttgttgaagtcggttcaagaactctccttcttccaagtgacaagactccgtgtcttgcaccattccaagaagatcgagaggtttttttttatgtttgcaaacgaaaaagcagtcgtcgtattcagcggcggccaagacagcacaacctgtttattttgggcaaaaaaacattttgctgaagtagaaaccgtgacgttcgattacggtcaacgccacaagcaggaaatcgaagtagccgctggaatcgcccgtgaactaggtgttccacaaacggtactggatatgagcctgcttaatcaactagcccctaatgccctcacacgtaccgacattgacattacacaacaggaaggcgaactgcctagcacctttgtagatggtcgcaaccttctgttcctgagcttcgcgggagttctcgccaagcaaaaaggagcgcgtcacttgattacaggcgtttgtgagacggatttcagcggctatcccgattgccgggattcttttatcaaatcgctaaacgtcacactgaacctttcgatggactatccctttgtgattcataccccgctcatgtggctgaacaaggccgaaacctggcagatggccgatgagctgaaagcttttgaatttgtaaaaacacgtacactaacgtgctataacggcgtcattggcgacggctgtggcgaatgccctgcttgcaaacttcgccgtgctggactcgagcaatatctcgtgatgcgcggagcttcctcccaaggagttgaaggtcatgcgtgagccaggtaccttccgcattgtcgacaagctccagcagttcgggacagacattgagcactctcagctgcgttatcaccgcaaacgtgtactagtcagcaaacaatttacattcgatgcagcacatcatttgcactgctacgaaggcaaatgcaaaaatctgcacggtcatacctacatcgtcgtttttggcataagcggtatacccggcgaaacgggtctaacgctggattttggtgacatcaaaacgatctggaaagagcggattgaaccttttctggaccatcgttacttgaatgagacgcttcctccaatgaatacaacggcggaaaatatggtcgtctggatctttgaacaaatggagtccgccttgacctcggatgcatactgcaaccgtgtcgaaggtggacgtaccgagtttgtacggttgttcgagacacctaccagctacgccgagttccgacgggagtggatgctcgatgagtaataccgtgactactcaccaacccatgatagcctcccacgggaccaaaatagcccctattcccgtactggaggtgtttggacccactgttcagggcgaagggatggtcattggtcgtaagacgatgtttgttcgtaccgcaggctgcgattaccattgctcgtggtgtgactccgcctttacctgggacggcagcgccaaggatcagatccgtcgtctgagtgccacagacatttggcaggagctgaaggccatcggtggcgaacggttttcgcatgtgaccctttctggaggcaatcctgccctgctgccgcagcttggggagctaatcaccctgctacgcagccaaggcattgccaccgctgtcgaaacacaaggctcccgctggcaggaatggctgtacgatatcgatgaggtaaccctatccccgaagccgcccagctcgggtatgacgaccaactggagcgtgctcgatgatatcgtcgcccgtctatcgaaccagaagatggctggtgagccccgagctacgtccaacgtcccaaccgcaacaggcttgaaggaacccgctaatgaagctgcgcggctctataccggagcttgcagcttgaaggtcgtcatcttcgatgacaccgatcttgcctacgcccgcaccgttcacgagcgctatccacacgtaccgctgttcctccagacgggtaatccagatgtgaacacggagaacaccggacagattgcggagtccctactccatcgttatgaatggcttatcgaccgtgtcatggacgattcccgactcaacgacgtaagagtactcccacagctccacaccctcgtatggggcaacaaacgcggcgtataacacttatatgtaatatattccgtatgaactgtatgtgatacacaagttacaccaaattagtcgaagtacatcctcgacatccaaaagagaaaccctcgtccgtgagggcggggtttctcgcaaaataacgctcctttcatataggagcgagcattattcacttctgccccaacctacaggtaaacaagcagggactttatggtgttgacggcggtcggcagcgaagcggaggaattgaagctggagaagcgatagcgttcgcctttgaaatgggattctaacctatatctttcatcttatcagaaagaatcccatttcaacagcgatcggaagctcaaatccttcgcggagcgacctccccatcaccataactccctctctcttttaccaaactaaacttaaggagcctcatccatatgaccggaagaacacccgaagaaatgaccgacgttaccctacttggcaatcaaggcacacaatacacttttgcctatgatcccgccattctcgaaagctttgataataaacatccgtatcgggattattttgtaaagttcaattgcccggagttcaccagcctgtgcccgattacaggacagcctgattttgcaaccatctacatcagctacattcccgatattaaaatggtagaaagcaaatcccttaagctgtacctgttcagcttccgtaaccacggcgatttccatgaagactgcgtcaatatcatcatgaatgacttgattaagctgatggaccctcgctacattgaagtatggggcaaattcacgccacgcggcggcatctctatcgatccgtataccaactacggcaaaccaggaacgaagtatgaacagatagcggagcaccgtatgatgaaccatgatatgtacccggaaaaggttgataaccgataagctaataactcttctgacatagcgtaaatatcaaggggttgtcctaaagtcatcaaatgactcagggcagccccttggttttactgaaaggagactgtgcacgcttgtggcgttacacatccagatcaaatcttgattttttatattcataaggtgttttacccataacttctctaaaagcttttctgaaagacttctcgtttggaaacccaacctcgtacgaaatttctgtaagtgacttattggttgaatccaataaatcaatcgccttctccaaacaaagaatttgcttgtattcggtaaacgtctggcctgtatattcatgaaacattcgcgacaaataagcctccgaataaccgcagatacgggccgttttggccaggctaatattttcagtataatgctctttaataaagtccatgattgtctttatctttcgttgcttttcactgaatacttccggtggaatgtctgtcgcctgactaaaatgattgacaagcaaatatttcagttcaataattcggctttgctctaaaatgtagtcgtatttgcttttggaaatatgtagatcatatatatccataaacaatcctcttaatttagagattatagtatcttcaacttgtttctcttgcgtgtttaaatggatgattacttgttcattggcaaagaaagtgtctggaaattgcagcacaatgacctggttctccgtaatgctctgcgtggaatgcggaacattgctgttaatgaatagcgcatccttttccatcaaaatagttatttttccttcatgccacacctttagacttccacttgtacagtagattaactccatattgctgtgaaaatgcataggaatgactctttctgtatctctggattggaacataaaaaggttaatcattttttttctgtctatttcgatatgttcatatatttttttcatcaccacacctcatcagccagccatgagtgacccacctgtattctatattaagcgataaactcttgtactaatactcatactataccgatagtaaaatgtccggacaagcagaatctattcaacgggcaaaataaaaaagaaggcagttcttcccgcaaacgggataatgaacagccttccttagcctgcttgcaactctgcaagcaaaaaatgttaccctacgcattcctgcaattgatatattctaacttctcctacattgtctcctgcctcaagcaatacgttgcgttgctctgcatcttctatgaaataacgcaaggaaaacacttcttcaccctcgttcacaaagatctccaggcttgaactttctatgaatatttgcatttctgcaagcttattacttaacgttgcttttctgtactctctctcgccagtcaaccagtttgttctccaaactgtcagactgttttgttcctgatcatagtcaatttgcacagcatcccttatgatcattttaaagttttctgtaagtaaggaaaaatgaacaattagctccgcttgtgtagaaggcagcacccactcactactattttgaatttcccctttgtaatgcatgccttccagccttaacaattgtaattccggtaatggtttctggtacaacacaccgttcatcaacaccatttctctaggaagagtcaacgcatgaacccagccctcctgaatggtcgggacagccctctccgcttcttcattcatggcgctcatccatccgaacataatggttctgtcattaactttgaatgattgtggtgcgtaaaaatcaaatcctcgatcaagctctttaaaatcggaaaggtccccgttgaatttgcctctattcgataatttgccaacaatatatcccgattgattaggatttttataatattcgcctctctcgggtaaaccctgaggagagaaaacaaaaacatcgctttccgcaaaatgaagtacgtccgggcattcccacatatatccaaattgatgatcatgatcaacaaatgatccttggcattcccattcggacaaatttttagatttgtagataagtgtatctccagtcaaatcttctctctgagcaccaacaatcaaccaccagttcccgtgttggtctctccatactttcggatctcgaacatgcctagtataaccttggggatgctcaaacaaagggccgattttttgaaaatcctctccatcctccgaaatcgcgacgcattgatagctttcttttactccatcatctcggattacatttcctgtataaaacagatacagcttttcattatgaacaatgcccccgcccgaatagatgccatctttgtcataccattccgatggctccagcgcgacacttttcctttgccaatgcaccagatcgctggaaacaacatggccccaacatttatttttatggtccgttccttttggattccactgatagaacacatgatattgatgattgaaataggcaagtccattagggtcattgagcaaaccgtaaggaggggtaatatgatacttcaggttatacgcgtcgcttttattcatgctcatcctccggtaacaaaacaaaactaaaactcagcaaaatttcctgcgagcttgacccgatataaacatcaaattcgccgggttcacttttgtattgcatttcacgatcataaaatttaagcatctcttcatgaattgaaaattcaacattttgggtctcgccactttgcaaaaaaacttttttaaagtcttttaattctttcactggtcttgcaatacttgcaaatttatcacgaatatataattggatcgtttcctttccatcataaattccagtgttggtaacagagatacggatatcaactgactcattttttttcatttctttttggctaattgttaataggctgtattcaaatgaggtataggatttaccatagccaaacggatacaagggttcattcacttcatcaatatatcgggatgcaaaccgataagaaccattttcctttaaatttggtcttcctgtattcaattcattgtaggatatcggaatttgtccaacgcttcgtggaaaggtcatggctaatttccccgatggattgacttccccatacagtatattggccaatgcttctccgcccatcgttcctggataccaggcttgaacaatggcgtcaacttttccggcaacttcagtaagaatcaaaggtcttccgctataaacgatcagaaccatctttttgcccagtaaacttaattcatggagcagtttcatttgcggcttaggaagcgtcgggttcgttcgcgatcccccttctccgctctgataaatactttctcccaaggcgaggacaatgacatccgcttcgttagcatttcggattgcttcgcgcagttgggcctcctcatcgactgtttcagcagccagcttgtccgcatatttgccaagggcttctctcgcattggcggggagcatgtgcgcccctttgcaaaccgagagattgtcgggatcaacatgctttaataatcccattttcaaattgacggtatccgcctcatcccccttaatggcccacatgcccagggtggagttttcatctgcgtaaggaccgattaaagctactttggtatgtttagacaatggcagcagttgattttcatttttcagcaagactacggattcttcagccaaggacagcgcggcttttttatgttcatctgacagaatgctgtttctcgaccgctgaatggtttcctgtaatccgcggaacgggtcctcaaacagccccaaatcatttttcagctttaaaatacggtataccgcttcattcaacagccccagcatatgctcgttatcagatactactttctctaattgattggcgtatactgctgtcttcatatccacatcaacaccagccaacaatgccagccttgcagcggaagcctcatcttcggcataaccgtgcatgatcagttcttctatagcggcgtaatccgagatcaacacaccattaaaattcatttctcgtcttagcacgtcgcggttaagccacttgtttcctgtcgcagggacgccattcagggtattaaaggccgtcataacaagctttgcccccgcttcaattgcagcttgataccctggcaaataatattctcgcagcgtgtgctccgacatgtccacggcgttatactcacgtccagccacaggtgccccataagcggcaaaatgcttgacgcaagcggcaattttattggctggtatgatcccttccaagtttcttccctgtattccctgaaccatgctttcagcatatttcttcgctagcaaagtatcctctcccggcgattccatcacccgcccccaacggggatctctaacaatatctaccataggggaaaaggtcacgtgcacaccttcgtcgtaacattcctgggcagcaattgaacctgcacgttctataccctcataattccaactacatgcttgtgcaatcggaatcgggaagatggttcgatacccatagataatatctgccatgaacagcagcgggattttatgaatcgatttttccaaataatccgtttgcaactggataattttttccgggttagtgatgttcaatatggagcctgtgttatatatattgtagccggcgtttaaccctaatttttttaaaggtcctgtcacaacagtgtctatatccccttcaaaaaaatcaccggtcagttggatgagttggcctattttctcttctattgaaaggctgtccaatttcttaagcagtgtgttgttgtccatgattctccccacatcattttatttgttatctactttttctttaaacccaaagatccacgttagtgcaaatgccacagcaaagccgattacacaaactaagatatatatgaatatctgattgttcaggtacaataacattcccggtagggctgtgattgacatgcctgttgcttgaacattaaatatacgtgcgaagaaaccgccaaccgctccgccaatcaagcccatcaagaacggtttgccatatcggatgttcaccccaaagatagcgggttctgtaatacccaataacgcagacaaggtagaaggatacgcaatggatttggtttttaaatttttggattttagaccaacagccaacgcagcacctgcttgtgcgcaaatcgatgcagaactgatcgggtttaccatattccaaccgctgcccactagcatctgtatttcaatcaggtttaaggcatggtgcagtccggtaactacaataatctggttgatgccaccgtaaataaatccgccgatgccgtatggtaatttcaaaatggcggtaacagccattaatattaaagcttccacctcgtgaaaaataggaccaatcacgaacaatcccagtaccagtgtgattaataatgtcagaaacggtgttaaaattaagtccaatgcatcggggactgacttcctgatcttcttctccagcatcgcccccacgacacctattatgaaagcaggcaaaaccgagccctgatagcctgcaattttaatgaatccgaaaaacactaaaggctcttgaaccttttgcgcgacatcccaggatgtaggcaacgaaggacttactaacattaatccaatcaatatccccaatagtggagacccaccaaacacccggaatgccgaccaacataccaacacgggtaaaaatgcaaaagcggtatcggtcaatatttgcgtaaataatatgaaattcgcagaaatatgatcaggtgtaagcccaaataattgaagcaatgcaggctgagttactaagcctctaactcccataaataatcctgtagctaccaatgcgggcataatcggaacaaatacatccccgaaaattcggatcattcttttgaaccgattatcatcttgggtggaggccatttctttcaaatcagcttttgatgtagcagatatgctttgaccaaccatggcatcgtatactttatttacagtaccggttccaaaaatgatttgatattgcccagaggtaaagaaaacgcccttggccttatcaatattctcaataaattcatcatcaataatttctctatcttttacaatcagcctcaaccgtgtggcacaatgtgccatggaaataatattgtcttctccgccaagccctttaatgacatcttgggcaattttaacgtattctttttcaagactcatcagtctcttcctttcctctgttcctcttagttagtctgaatcctttaaaactttgatcaaatatgcttcttaagaatatcatgactgcgctttcaaacagcgggattattttacttcattaaggtcaaattttgacctttttatatccttgattataaatgcatatagcaactggtgcctgtctatattcgcttttggagactcgcatttgaattatgatgaaacaataaagtgcacccctagaatacacactgggataaccttctggtttatccccatgtattttaaaggtgcacttcaattgttatatagcgagctaattatgttttacttagtgactttcaactgagcactgtcagctgtatagataaccttcattttataattgcttggtaaacctaccgtttcaatcgaagaaaatgctccattccgtttagcataagttaagatcgtagcaccattagccggtacatatttgttagaaaaattcagacgtaattttccgttgagtatagctgttccctttattttgagtacatcatttttactgcgcaggttaagctcaagtgttcccttggcagattgtctgtaatttccgccaataatcagctttccagcagcatttttaagaagagttcccccgttattcgtaattccaccacttccgaaagccgtttccgaagttccctccaaagtaccttggtcgatctgtgtaccgccggaatacgtattgttccccattagcttcaacgtacctgttccctttttagtcagctttccaacaccagagatattattgcgccagcgatccaatgcattgaaaccgcctttggaagcgtccatattcaccgtcacattattggcgaaagcaccgtagccatccgcagctgaaaacaggttcaatcgtccccatccctcagcatcatcaagtacaggatagccggaaggaatccctgtagtagccaaaacccaacgacgttgtgtgctatccaggtaaggcaagcgtgtctccaatagtacctcagctcccttaggcactatcataggcgtcgcggttggattaacctgactgaatccgtatgttaatcgttgattataattttttttgtttgtggcataattgctgaaccgatctggagttgtacctttttgagacagcagttgtttacgagcatcctgataagcggctttcttcaagctgctattggctggatcagacaggatagcagccgccatcgccgttgccatgacacgccctcccataacatcaagcggtgaatgcataccagcaacaacacggttattgcccagctccgaagctcgcgtcagcagttcttgataacgctccggcacggcgtaggccatagcaatagaactgagatacgcagcattggtatgaccgctaggaaagccgccatcgctagtagcatcagctttgagagcgggaataaggctcggaacaactactgagttatcgctccagcgaaatgggcgagggtagctaaaataagacttagctgggttcgtcgtagaatattccccgcgcaaggtatttaccagatttacgatgttgccgagattggagcttgtactcccagcattcgttccctcatcttcgtatttcttagtcagagcatctgccggaatgtcgttgatcgttgttgtggcacctgcattctttcgatatacatcagtgagcgaacccagaccgtcgaacacactgtagctctggtttctgcgatcatccaaataagctgcatcagcctcactagaagtgcgacgggcagctatatcaatcactttttgaatattggcgtccagcacgctgctgtttagcttggtacctgtatcccaagtagcaccgggagtccaaagcttattaaattcggagagcaatccgagagtcggattagagctttccgtcttatttgcagaactattatttttataatgatctacgaagtatccccatgacggttctgttggagttaccgttgttggtagggttgccgcactcgcataacttccacccagggaacctagaagtaatggtaaagatagtagtgcaactgatagtggtttccttagcgatttcattctcaaatcagatcctctcttctcttgtgctcttcatactttctctacggagctattatctatataacaagatgtatgacataaagaatcatatcttaagtttgttaaatcaagagcttagttttgttaaatgaaaaaaaggcatcccaagagccgtatatacgactctggagacacctcgttcaaaccgttatagaaaaaccagctaccctacagccatacttctatgactttgccattcacgaaagctaccgccttgaaataaagactacggttgccgtatacccaggcttcgacttgagttccgtttgaagcagcccccttttctctgaccgttgggtttccccatgcgaactgcacctgcgtcgtattcatgcccaagcttacctcattatttttaatcttgttccagatggcttgcgaccattggtatttcttgtacggatcgtaagtcagaaattgatcggaatcagacagcatttgtggaatgcgtgaagctccgatgatggaaaacgtgtcataagtttcgccattggccccctggaaaataacttcgtaagatttaacaccattcgggtccgtgctgacttcgatatctttaactgttaccttgccaaatcgctctccagcgctatagaagttattgacccaataggttttgccaattaatttggacagactgcccagatcaatggctctgataatttttgccgtttccggcgtctcaatgaccagcttggtagcgcccacagataattctccttgctgacggtcacgattccatttgaatccgcccaacttcagatcggtcagtaatgttcccgggaatacaacctgtccgttaaccgtttgaaccttgcccttcagtgcaacaggtttaccattcaccattgcggtggaactccctttttggagtacgatattgtttttacccagcttgatcgtaaaggtctggttcaccacggtaacagatccacccagcgtcttgaacacagactgcacaggcaaatacacattaccgttcagtatagccgccccggtcaaggtttgatcggacgaaacctttagtgtaaaagaagatggtattccttcggtccgcagagctacggatgtgcttccaatgccccttactttgagtgtaccggaaccattctgctgtagctcggcaacctgcggtttctccacttcaatctcactagcttcgggatgacgtgttagtcgataaccgttcgaatacgtctcttgtacatttaattgaatcgtatcgccgatggcagcctctttggaggtcgtcaacaaggacatacccgttaatgtaggcaagctcagcgcagtcgtgattccgtccttatagccgacccaagagccatcctttaattgtgcaaaaagctcgtcaggcgaatcaaccaaccgtgcaacattagacaacccgctaagctgcacagctggatatttcttcattcggtcatagctccatacagtcccatcatgatgtacagtaatcaagacatgtgtaccttttttccataaaatcgaagcaatatcacttcccacttcgcgcggtggttcattggtcagcatatccagcatcgtgacatggccatcttccttaagtactgcagcatacgccgtactcattttgatatcaagcgcaccatctacatgacctatcttgcggggcttagattcttcgtaccctgtggaataccatacatcaccggatcgagtaagaaccgtaaagtaggtacttaccttatcaccgtctatagcatccgatattccctcaacctgttctcttccccaggagatcgtcccatcggttttaatagccaaaccctcacctgtaatttctttaactcctgaggattgagccgtcacttttgggtcggagttatcatcccagatggctaccttcccgtcctcagtccagccataataaccttggctctcgtttttgctgcctgtaatgcctttcaaattcaatttctcaataaccgggccatctatactctttctccataaagagccatcattcagtatgtagttattccggtcgatcacgtctataattttagcgtttttccaagtgttgttcgtcgttacatttgccgctactgctgtttctccattgtttaacgcagttcccaccaccgctccacataccaaagatactgccagcaaaatcttcgttgcttttctcatcgtggttccccttttctatctatatttccatatcagtattttgcataattccattcccaacgctcaaaaatacattatatagacgaactagatcacttcgatctctatatttctgatttgaaaagcgctcttgggacttatgcaaaatactcacatatatatcggttttgaggatggtaaatgtttgaatttggatatgtcattttagaaattctaactaaatggagcaatgaagagtatccagcaggatgggcaagcagtaatgagtaaaggtggcctttatcccactttcagccatttgctgcaaacggatcgcttcctatatcttaaaatatacatacatattcggaggttgccatgactagtaaatctgctacaaaaactgaaacgggccgatcgctccccctcccgggtccacaagcgaaaggcaccgtttttgcgatactgattgcgatcagtttcgtccatctgttcaatgactcgattcaatcggtcattccagcgatctttccgatcttaaaggaatctatgagcctgaactacacgcaaatcggctggatttcattcgcgatcaattttacagcttcaatcatgcagcctgtgattggcttgttttcagacaaacggcctacgcccgctatccttcccatcggcatgggctttacgctgactggcatgctgttgctcgcctatgctgccgattataaagcggtgctgatcgcagtcatttttgtgggtctgggctcggctgcctttcaccctgaaggctcgcgcgtatcccatatggcggccgggccgcgtcggggattggcacaatccatttttcaagttggcggcaatgcgggccaatcgctggcgccgatgctcacgagctggatttttatcccattaggacaatttggcgcgatctggttcacaggtattgcggcagcgggaattgtggtgcaatcgttcatcgcccgctggtacggtaacgtcctgcgtacagaaggcattgcacgcaaaaaagcggtggcacgccgcatgaagcccgaagtgcgtaaccgcgttatgtttgccatgattgtcctcattctactggtattcgtccgttcgtggtactcgacctcggtcggaagctactattcgttttacctgatggaagtatttaaaatgccattggctgatgcacagctttacattttcctgttcctcggggctggagcgctgggtaccttctttggcggtccgctcgcggaccgttttggtaaacgcaatatgatttttctgtccatggtattagctgcaccactcgcgctggcactgccttatgccaaccaattctggacggcgatcctgctggcaattatcggatttattatgctgtctagcttttcggtcacagtcgtttatgcacagatgctcgtgcccggcaaaatcgggaccgtgtccggtctcattacgggcctcgcttttggccttgggggtgttggcgcactcgtgctcggcaactggatcgacaaggtaggcatcactcacatcatgttcctgtgcggctttttgccactgctcggcatcttaaccttcctgcttcctacagataaaaccctgaaccgttgggcagaagaaaatggagccgaagtgtaacaggcaaacgtgtggcggccatcttggccgctgcacccctttatacccacctaacgtaactcctcactctctacttctgccaaacgcattaaaatccgacgcttccgatacagcattttccctgcttcagctacgtcactaatagcgcttcggttcgcaatggagccaaacaaaatacccgcaatcgggaccatttgaagcagctttttccatccaaactggtcacgataagtgttaatgacctctctccatccctgcatctgggaaaaaacctgtgcctgacgtgaaggatcatcgaacaaagccagctcctctaatacggccttcttacccacaatatcagatgaagcaaattgcatacatttaataataaaaatgcgttcctgcttatcatggggattaaagccataacacaaggctatttcctgaagcactttgagtgacaagccgagcaaaagaggaatatccgccgcaatcgtaaacacaccgccaattcccgttgttgctccctgagcggtagcaaaggtaatacgagccgacgtcatatcgtcagcagtccgatccatgattgttagcgggagctcagccgcctgcttcaactcccacctaggttcggcactatgttccgaatcagcgttttccccggcacgaggcaggtcctgcgtatccgacacggaatctgagccattttgctgaattacatgttcatgggccgtctttttcagcctgttcagaaccgtttcttccttcaccaaatatttgccgccgttctgaatgaaactacccatttcattaagcagttgctccagcttgtctttaatgactttgggcgtcagccgatccagcaacataaaaggccatctgccgattttttcccagaaaaaaatgtccttctgttccttttcccatttttcaatattcttcagctcatgacgcaatacatcatggctttcccgatattctgtaagctgcttcataaccgtagacgtctccttttgactatgctagtttatgtatgggtaatacgtaagtaaggcgagttcaggtttctttttttagcaaactagatgataaagaaagttaaaaatccatacagatcggagtgtaatgatgaataatcccacattcgcctcacagtcttcttcaactgctaatgtagagcttgtcccttaccattgtgaacatgatgccattttacataccttctacttgcctgaggagcagaagcagtttactggaatgccggatgaaatgctgacactggccaaggaagatccgcaccgccatcctgtcgtgattacggctactagaagacccgttggatttttcattttatacgatggggatgaattagcggactatacgaatatttctgaggcactgttgctgcgcgcgttctctattcattacgcagatcagggacaaggattcgctaaaaaagggctgcttctactaccacaattcatcgccagacacttcccacatattcgcgagattgtactgggcgtcaatgcccgtaatctgcctgcccaaagtctgtatcgcaaatgcggctttatcgatgaaggcaacactaaaatgggacaacacggattgcagcatattttaaaaataagcctataacgttgacctcatagccctcgcccaaataaaaaagctttcggcacaaacgccgaaagcttttatcgttaaatctcaccaatggaaaaactcaatttgtaattaccaaacttcgtaagctcatccagcatggtatttaactctgcctgtgatgacatgcgcaagcgcatccaataacagccttccccactcactcgatggatttcgacaatatagggatgctcccgtgcaaaagcctggaaagcactgtgagttgttcctgaattcaaaaaaaccgtaataaaggcatgaatcgtctgtccaattttctcagggttccagcgcagcgtatagccctcgataatgcccgcatcctgcatttttcgaacacgcgctcctactgcttggcctgtcaaatgaacaagctgaccgatctccttgtgcgataaagagctgtcttcaattaaatgatgaagaatgcgcagatcggtgtcatcaggtacgaatagttccatagttatttttcctttcatgatgaaacgataatgctggttttcctttcagcaggccgtagcctgtagctccttgcgtcagatatgattgtaacagaaacaaagaaccaccgaaaatacactctgtccaaaaacattcactaccaaaggagcttccatagatgaaaatcacactaatccgcaacgcaaccttatggatcgaatacgctggagtaaaatttctggttgatccgatgttgagtgatgctggcgcaaatccgccggttcccaatacggaaaatgcccgccgtaatccgctggttcccttgccgccgcaatggcaggcactcggacagcctgatgttgtgatcgttacacatttgcatcccgatcattgggacccggcagcagtacgctggttggacaaacaacttcccgtcttctgccagcccggaaatgaagaacaaattactgctgacggttttacacaggttactccgatttcggtggctggctccgtgggagaaattgagctcatccgtactaccgggcatcacggcaccggagaaatcggggaacagatgggacccgtatccggctttgtgtttcaggcaccaggtgaacctgtcgtctatttggccggggatacgatctggtgcagtgaagtcgcggaagcactggataaataccgtccggagtggacaattgtgaacgctggaggggctcggtttacgattggtgatcccatcattatgactgcccaagatgtaacggctgttgcgcagcatgcctcttgcacacaaatcgtggctgtccacatggaagcaatcaaccattgtttactaactcgctccgagcttacggaatacatcaaccgtgaaggtttggagggacgtgtccatattccagcagatggagcgacgatttcgggataaggcgataatcccgagtcaccgcttgcgcctattttgaatatattggatttcaaaacggctaaagaagggattatcaatgaattggcaatatccttattatggtacagaaacccaatgtaaagaagttccgattatctttcctccccagcatcaatatagacaaccggggttggaatacctgatggttccacgccctatttatgataatccaaagtatatcggcaccggaaagcttcaggatcgggtggctattattagcggtggggacagtggtattggtcgcgcggttgcagtggcatttgccaaagaaggggctgatgtggtcattgcctatctcgatgagcatcgagatgctatggaaacccgtgatgtcattcacaggcttggccgacgttgtttgttaattccaggtgatctaaggctaaaaagcaactgctgtctggttgttcaacaaacgatggaaacctttggtcggattgacatcctgattaacaacctaggtattcagtttgtgcgcgaatcgtatctggatatcagtgagcagcagcttcgtgatacatttgatacgaatattatttccttcttccatatgactacagaagcattgccgtatatgcgggctggggctagcatcgtcaatacggcatcggtgacagcctatgttggtcaaaagaatatgatcgactattcagccaccaaaggagctatcgtcagcttcacccgcgctttggctaataatctggtcgatcagggtattcgcgtgaatgccattgctcccggtccgatctggactccgctaaatccggccacacagtcgcctgaagtcattcgcaccttcggcagcaatacaccaatgaagcgtgccgggcagccttatgaattggctcctgcctatgtgctgctggcttcggatgacggttcctacattacaggccaaacgctgcatataaacggcggccaaatggtcaccacttagtttcgttggctgatagccacaagacccaacaagcaagaaaacctccagcatccacatttctagtggaactggaggttttcttgttttacgataccgaatctgagcttaagctgatcttttgtttttgttgtaaatatcgaaggcaaccgccagcaacagtaccaagcccttgattccttgctgccagtcaatacccagaccgatcagagacataccgttattcagtacacccatgaccaaaccaccgataatggctccaaaaacggttccgatcccgccggacgccgaagctccaccgataaagcaggctgcgatggcatccagctcaaagttcgtacccgctctcggcgtagccgcgttcagacgtgcagcaaagatcagaccggaaatggcggccagcacacccatattgacgaatacccaaaatgttacctttttcgttttgacaccggacagacccgctgccttttcatttccacccaacgcatacacatgacggcccataatcgtgcggttcatgatgaaggagtacacaacgatcagtatgaacagcagcacgagaatgttaggtatccccgcgtagctcgcgagcatgaaggtgaacaaattgatgaccgcagctaccacaatcaacttgagtacaaataacgtttgtgacggaacctcgaatccatatttaagctgagaacgacgttcgcgaagttcattcacgataaaccataccgtgagtgcaataccgacaatgatggataccaggttataaccggtagatgaaaaatccggtaggaagcctgaactgattttctggaagccccccggaaatggagagatcgattgaccttccagcacgatcatggtcaatccacggaagagcagcatccccgccaatgtaacgataaatgccggaatccgtacataagcgacccagaacccttgccatgcgccgattaacgccccgaccagcaaagatgcaatcacagcgatccatgctggaagctgccaatcgaccatcattatggcggcaaccgcaccgacaaaagcggctatggagccgacggacaaatcaatatgcccagtgatgataaccagcaccatcccgatggccagcacgagaatatagctgttttgcagaatcagatttgtaatattaatcggcttcaacagcaggccgcccgtcagcacctcgaacaaaatcataatgacgaccagcgcaatcatcatgccatattggcggatgttatttttaaatagtttagttatggtttccatgcttcacgcctcctgacttggtcatatatctcatcaacgtttcctgcgacgcgtcctcacggctaacctctccagtgatccgcccagcattcatgacataaatccggtcacacaaacctagtacctctggcagctcggacgaaatgaccagcactcccttgccttcagcggcaagtcgatgaataatcgtgtaaatctcatatttggcgcccacatcaatgccgcgtgtcggttcatccagaatcagaatatccggtccggcaaaaatccatttgctcagcaccaccttctgctgattgccgccactcagattacccgttttctgtaaaatgctcggcgctttgatgttcatgctttttttcatttcctctgcaacgacgacttcctcctgctcattgacgacagcgcccttcgtcagcttgttcaggccggtcaacgaaatattacgcttgatatcatccatcaggatgagaccgtactccttgcgatcctccgttacataggcaaagccgttgttgatcgcgtccgtaaccgtgttgttctggatcggcttgccgtctttaatcagctgaccggaaatgttgcgtccgtacgacttgccaaaaatgctcatcgccagctcggtccgtcccgcccccatcagcccggcaataccgacaatttcaccgcgacgaatgttcaaattcacctgatccagcaccttgcggtctgcatgatgctcgtgatacaccgtccaatccttcacttccagaacgactttgccaatctcggcatgacgctctggataacggctggtcagatcacgtccaaccatcccgctaatgatccgatcctccgtgacctcatcctttttcatatccagtgtctcaatcgtcttcccatcccgcaaaatcgtaattgaatccgacacctttgcgacttcattcagcttgtgggagatgagaatgcaggaaatgccctgctttttaaattccagcatcaaattaagcagattttcactatcatcctcattcaacgccgctgtcggttcatcgagaataagcagcttcacctttttagagagcgctttcgcaatttcgaccagttgttgcttcccgaccccaatgttcgtaactaatgtattgggattctcactcaaaccgaccttggacagcagatcgcgtgtacccacaaaagtctctttccaatcaatcacaccgccactggcacgttcgttgcccagataaatattttccgcaatcgagagatacggaatcagcgccagctcctgatggataatgacaatgcccaattcctcgctctgcttgatatccttgaactcacacgttttgccctggaaaacaatatccccttcataggttccatgcggatatacaccgcttagtaccttcatcagcgtcgatttgcccgcaccgttctcaccgcacagggaatggatttcgccttccttgaccttgagatttacattttccaatgccttcacgccaggaaaggttttggtaattcccttcatttccaaaatgattccagtcatgggatacgctcctttcggttggattcttactcttatttcagtccgatttgctctttggtgtaatagtgactgccgacaatatccttttccacattcgtccgatccaccgagattggatcaagtaagtaggcaggaatgatctttttaccgttgttataggattcggtgtcattcacttccgcttgttttccctgtaaaatgctgttggccatcacgaccgtttgctcagccagcttgcgagtatccttaaatacagtttgcgtctgctccccagccacaatcgacttgatggaagccagctccgcatcctgccctgtaatgatcggcagcggcttgttcgctgatccatatccgaccccttttagggatgaaatgataccgatactgattccgtcataaggggatagtaccgcgtccagattagcccccgaatagtacgcactcagcaggttatccatccgcgactgggccaatgctccatcccaccgcagtgtagcgatctgcgccatcgtcatctgcttgctgcgcacgaccagtttgccggaatccacgtacggtttcagtacggacatcgcaccattaaagaagaaataagcgttattgtcatccggtgaaccaccgaatagctcgatattgaatgggcctttgccttccttaagtcctaactttttctcaatatacgccgcctgtagcacgcccaccttaaagttatcgaaggttgcataatacgtcagatacggtgtgttgcgaatcagccggtcgtaagaaatgacctgaatgcctcggtcgtgtgccttctgaattacatccgtcagcgtgtttccgtcgaccgaagcgatcaccataacattgacacccttggtgatcatattttcgatttgggagatttggttttccaccacgtcctcggcgtactgtaaatccgttttatagccttgctcctgaaacaaccggaccatattctctccgtcccctacccaacgctcggacgatttggtcggcatggaaatgcccacatagcctttttccttgctacccgttccactctccgccaaattacaggccgaaagcatcagggccaaaaccagaagccatacgacaacagctccttttttcatatgaagttcccctttcctcatgtgatgcaggtcatttgaaggtaaggattttacaaaatcctcaggtcagtgctgattagatccgtaattagatagcgcttacataagtgaggtaacgagtacctctcctttttttatgtgcaaacacatggtatcattccaggccaggaaaggtctttgctggttttgaactttttttataaaattttaacctttgtggtgagggtagagggatttaagttggaataaggatcatcaggatcgcacatataccttgaaaatgcaaaaagactttggcctttttacgattggcaaaagtctcaatttgtagaatcattaaaaacggctatctaaagagttacacttttttggaacttattcacagaggctcatatttcttattacctatgcctcagtaacgaaccatacctaaataaattataaatttaattaaatgatttgagttattattaggtatcccattccccgttaatacttaaaggcttagataaatagctttatatttatcagaaacctaagtttggtcttcctccgcatctccattcatttttgaggtgaaaaaaggattaaaacctgttttaaattcagtaactaagttctccgaatggtctggttttaaatccaatgtttcatattcctcatcatcaaacataaaaagctgtaatttgttttttccgatactttcatatgctttagatattactctgcctatagcttttgaatttgaatgatcaaatggcttagataaatgatcgataaccaatatagggattattggatatttattctcctctattaatattttcaaaaatccgaaataaccgcacaattgaattagtgtatgccttgccatacttccaatataataattaacagccttcttttcttttaattcattttcatcaaattctgttttaattattgtgggttgcaatatattacctttttttagatactgtatcttgaaaccttcttggttgaaatcatcatctaccactgaagaaatatcctttgcagattgataaagatctgtaataaacttggataactcctcaatttttttattatcatcagaattttgcaatacccttaattcttcacgtatttctttgattctcttttttttctgttttagctcatcttcataggatctaatatctgccgataaataatcttctataattatgattgcctttgccttttcttccattgaaaatagtctgaatcgagaatcgtttctttttatttccattttcacttgttctctttgtttctttagttcatttatagtactgtccccgattagaaatttactaaacgatattgtagaatcaagttcagaaattaacttttgtaatggagaaactaaatattcaaaatcactattttctccaagtagtgaattcagcttctctaataataactttctgttttgattgtctctctcaatttgcttataatcagagattcggttttcatatattttaatttgttcagagatgttgctatacattacttccaagtcagcaatattcttctctttcttgcttagaacaaggtcattcatgttctttatttcattaagtttgatttttatatcttccgcatttttcccagagtaccaaattccagttcctagtttctgaaggttcttatttatttgtgcaaatataaaatcataccttgctgttgcagtttctaactccctcacttcagataatagagaattcaattctttttgtaactcatatatgcgctcaagatgtttattgaatatgaaatttaatataggcgccagttttaccgaatatttcacatcactacatttgtcaaaaaaatcatgaatcgctccttgccttttctcaccaagaaaattaaacattgtaaatgatctataggtaagttcttcctctgtaaagtttttcaaatctttaaggaggtcaatatctcttgcaaaaattttatttagccttcctttatactcccttaaatctataaaggctgtttcctcttcatctgaataatagagataatttatattaggattactggttcttgatattttaaaatttaaaccattatattcaaactgcattgttgcctttgctaatgttccattgtaccaaggcttttttctaatatcttccgaggacccgaacataaaatcaataaaactatagaactcagtttttccagaactatttttacctttgaaataattaatccctggtttaaactcgtatatgaatttactatcatcaacactacaaagctctaaattaattattttaaacattattagtgacctctttcataaattgtctttcatttatacccttactgtattcaatggctttttcgaggaatttggtttctttgaatatactttgactatcagataaattatccttaatcaataacaaatcattttctacaataataatcttcctagttttcaatacatggattgccttaataataaactctacactgttacagaattctaaatagtctccagaaaggagcgaaagacatttataaataatatcttgagtattatttccgttataaacactattagggataaaacgctgttttttaattaagtaggcaaaaactaatgttttagttatgcttaatctcctatgcttcctaagaatatctaaaactatttcacaaaaaatactaacctgaatggattcaacttcaattttcagttgtctcatgtttatcatccttccaagaaatttggatgtcttcgattccttcttttgttaaaaatattcctgatccaaaacgaacatgttcattttgtgcatatgtgttcccttgttgttttgttgcattcaaacgattaaatggtgtatcatttccatttttttgtaattcaaatttaaccatctcaaagttctcatgtgttgtttcttcgatattatcaatcttaccgatcttatttaactccatatatttaaaacgtaactccttgtaatactcaccgtatcccaaatgcgttttaattataggctgtggcagttcacaagcaagtaattgcttatattctctagattttgagatacttaaatcattaaaatcaatagagtgaagctttttaaaatccgaatattgagggagcgttatttcttccgtcatcctactgcaaatttcttctactaatgtaatgaattttttataggtgaatatatagggttttttactatatatgctatccatgatttgtacggtaatatgctgtaacaattcctttattctttgataataaacaaccttatttataccagcttttctaaataactctgaacaattttcatctattttctcatcaatattttccatagaaacaaattcgtatttttctttaatagagtcgtatacatttttgaattcttctacttctttgtatatttttttaacctttgtaatagtggccttattactcttatccgagtctctaattgattcaaaaagtgtttccgctgaattactaaacaatatatctgtattgttatattcagcatcagtaaacaacgtatatttggaaaccttatattccgaagattcgagtaaaatccaattgagtaacacttgtactgcggtactttgcgtgatagtggttctcttaacttgcattgtttcatttgttgaactaccaactattttattcaaaaatttttcatcaaaatcatctagttgttgaggtttaattttcttcatattaatatcatcaatcgtttcaaactcaatttgcattccttctttaagctttaacatataataaacaaatactcgtatttgataagaaaatccgctcaaactatatattccactgttatccagtatgtatggttccataattgcacctcatatactaattatttcgttacataaatacttttttgaatcataacaaataattacatccctcaaaactacttagtcatttgcaaatttataaatgatgtaaatataatggtccatatgaactactactttcgacataattttatattcctcctgcttttcccattaattttagtatcattaaaaatattcctacaatttctttaaatccaaaaaacttaaataataacaaaaagaacctctgtaattactccagaggccctctctacggctaattgggttcatcttaacaaaccgtcaactctactcgattcccttccctaattatacacaatccgctccaccattttcttcaacgctcgattctgctcttcactcgtctgcgacgctccaaagtacttgcttctgttattatgtcttcttcatacgattcatgtggcttgtccagaactcacttttgtttctttaatttctgcgcttagacctcaattatcacctgtgcatcattataacgattaccattcatttcaatcttcgcatatacttgcttcatttaatattacttcctgctgtaacgaaccttttgctgatgtttactacactctctcaatcacaaacacaaataatctctttattttctttcccctgtataattccatatttctcttaaacattttgacgatgtagttgaatacatttccttaaaaaatagattatcaatccgaactgcattataaaagaagtcataataaaatcccggaggcatatcgtatctccgcgataagtccatccgctaaattatccgtaatgagcttgacattaagcttcatcaacatcaattaagaacactcgctcctggaatccgccccgtgcgtcggctttgtctgcccgtagcctgtccagctctgctgcattcgctccatgttcttctgccagcgctcggatgacttccagcatatccgccagctcttccagcgcatcctgatctttgtccgcttcaaaatattcctcggcttcttcacgaagcttcgttctcagctcctgcttatattcctcagggtccaaaatgcgtgtccgacattccttgccctgagacataatgatatgcggaatctgatcccgcaccagtttgttgtatgtaggcatatgaaataacaccctttctgatgtggaagctttaacccgtaatccaacatcttccttttcgtcattatatcattggctcaaaaagaatcgggtattattgataaaagatctaacgactcattaaatgcattttctttataaatagatggataccgcttagacggatcagctacgatccgctgtgacatagactctagaatagagtccgttttataaagcaacttgtctacttcctcctgtctcatcgtctcctcggatgcttcatcctctcccgaaaccagataatgtaccgtaccgataaacagcaccatatctaaattgggctcagcatctgtgtggattaaagggaacaggtcagttatagataaacgaatgtacgatggaatgatttggtttcgatggacataaatggccttcgccatagaaaaaatcgcacgatcacacagaatgaggcaattttgaaactgattatggtcgcgcatcatctgtgcgagcttgatctggtattcggcaagcttttgaaaatccatcatgcaattgaatatgtaggtgtcgctgtacttaggcaatttgaaatcggaatcactatgtagttggggacttaaggagtaatgtttcaaggggaatcaactcctgaattaaaatttcataaacaaggattttgcaaaatcctgaaacaatgtgagcaacgtagcacaattatgtaaccatcaagatgtataattttctagctatcggacaagcttcctaataaatattactatatagtagtttttaattcaatttacttactaacacttattaattagatgtaactctttctctacacttctaactagaggattttgcaaaatccaataagcgacttccaataaataatatataggtcgggatgatctagttcgtctatatatgcactttggagcggttggaatcgattttgtagaacccttactatagagaggtgtattcatgtcagaacttttggaattagtcggtacacgtattcgagatattcgaaagtctaaagggctttcccaagaagctttagccgaaaaagcaggattcaattcgagttatattggtttcattgagcgtgcggagagaaatatatcactgaaaaatctggagaagatagcgaaggcattgaacgtgggcgtctatcagttgcttacatatgtgaaggaaaatgatgagcttaccgaagaagattcgagtataaaaaccattttaactctcctaagaactcgtgaatccaaagatactgaactggcactaaagattcttacggacatctttataagaatcgatgaacgatgaaacaaaaaaggaactgcactttgcagttccccaccaatctcttacgacaatgccaacatcgctttcatatcttcctctgcggtcgtaattagcttcaagccaaacatctccaccagcacatccagtacaccagaagaaataaactcaggcggctttggcccaatgcgaatatcctgaatgcccaggctgaacaagcctagcaggatggcaaccgctttttgctcaaaccaggacaacacaatgctgacaggcagctcattcaccgtacaaccgaatgcatccgccaatgccagagcgattttcacagtagaacccgaattgttgcattgccccaaatcaatataacgcggaattcctgtatctccaacggttccataatccacgtcattgaagcggaatttaccacaggatgtggtcagaatgactgtatcgttcggcaaggatgtagccagctcgcgataatagttgccgcctttgcctggtgcgtcgcagcctgcaatgacgaagaaacgacggatatgcccgtctttaaccgcctgaataatctcaggagccagcccgataaccgtctcatgatgatatcccgttgtaagcacctgctctgaatctacatctgcggctggcagagccaacgcacgctcgatcaatggtgaaaagtcgtcgtccatgatcttggctactccctccagcccagctacttcataagagaagaagcggtctgcatacgtgcctttaatcggcataacacagttcgtcgttgcgagaatcgcacccgggaactcctcgaacagtctacgctgatcgtaccaggctttaccgatattccctttgagatgtgcatatttcttcaatgctggataaccgtgggcaggcagcatttctgagtgggtatagatgttgatacctttaccctccgtctgccgcaacaattcctccagcgcatacaaattatgtccagtcacgacgatacattggccttcgattttattctggctgactgtaatcggctgcggaatgccaaaacgatccgtatgcgcacgatccagcacatccatgatccgtacagctgcatttccgaccttcatcgccatctccaaatgttcttgtacattaaagttagaattggttaaggtcatatataacgcttcatgcgtgatgcgatctacctcaggatcggtatagcccaactggcgagcatgtgtcgcataggcagcaatcccttttaatgcaaaaatcatcgtatcctgcaagctcgctatcgtctcatccttcccgcacaccccaactactttacacccgccactcggcgtctgttcacactgataacaaaacatatcgttttcctccaaatatttatagatatttgttcgttatccccagcgtaacaaacccctgaatgcgtaggtgtgattacacacacattttttagcatttatcataataagaccgtgtagggcaattccacattccaattattcctattccaacgaattttcctgaattcccccacctttacggtactgcacaggagacacgcccatggtctttttaaaagcggtgctaaaatagtgctgactgtcgtatcccgtacgttctgctatatcatagatagacaacgtcgtggaatccagcagttgcaccgctttacggatacgggcacgcgtgacgagagtcacgaagctgtcgttaagctcctttttcagcacgcggctgagatatacggcggatacctgtagccgcgaggcaagggcttccagcgtcaactcccggtctgcgtaaccttcctgaataagctgccgagcacggcgtacgatgggagacagctgcgattcaccatacactcgatcccgactcacccggtacgcatccattgcgccttccagcccacccgcgttggattccacatgtgtatgaaccgctatattcaggtagcgtccaatcgcctgctccatggaagcgcctatcgtctcgggtgcctcctgccacaggcatatgccgatcagtccgttcgcatcgcggaacaacacatgcggtcggtcctccagcagttcgccaataatattttcagcggcaaaaagaaacaactggcggtcattctcgcgcataatcgtctgccgggcctctgccgctggccaccgtacgacaccgatctgagcaggcggccgcgatggaagccgtaaaaacgccaactgctccatgacgtctatgcccgtatgttgcccttccagccattccaggcaaaaccgctggcgcaacaacggaatattccgctcaatctgcccggcagcttgttctacataggcggcacgcttacgctcttcctcgagccgctgaccgagccgtgacagcgcagcgtgaagctgctcagcatctaccggcttcaagatataatcctctacgccaagtcggactgcctcctgcgcataagcaaattcatcatgcccggaaatgattagacagcggcactccggacgtacttcccgcagccgacgaatcagttcaatcccgtccatgaacggcatattcatatcgaccagcatgatgtctatgcgaagctgacccaccagctccagcgcttcttcaccatcctccgcctcagctgcaacctccatgccgagtgccgcccagtctatgcaatcccgtatcccctctcggatgatcggctcatcatctgcaatcaatacttggtaacgctgtgctgtccctgttatcacttccgttatggcctggtcaatcagactcaccgtcgttgagttgtctctgccctttgatttcgtcatcctgaccctctcctttttcataaggcttcttcagttgcgccatatccagcagcaacggatgagtgatcgtaacgcaggtacctgtcccttcgttgctctccagtacaattccatattcctcgccaaaagacaaccggatacgcgcttgtacattcagcatgccatagcttctgccatgggtattaactcccttttgcttctgttttccttccatcgcctccaggggtatttccagccattcacgcagctcacgcagacggtccgccgtcatccctgcgccatcgtcacgtaccgtcagcagcagcttgtcgccctcagttttagcttctacccatatcgtgcctgggccacgtctggccttgatgccgtgataaattgcattttccactacaggctgaagcattaacttcaacacgaacagatcctttagctcgtcaggtacattcaattcccagcgaagtcggtcacgatagcgggtttgctggatttgcatatagctcgatatatgctccatctcggagcgcagcggaataaagtcatctcccttgctcagcccgagacggaacaatctcgatagcgcccccaccatgtcggacacgtcgtctgctccattttttcgggccatccagtgaattgtatctagcgtattgtatagaaaatgcggcttaatatgctcctgaaggctgcgcagctcggcatcccgtttttgtcgttccctcagttcgctaagtgacatgagacggcgaatttgctccagcatccggttaaagctccgccccagcattccaacttcatccccacggtcactccattggcgaactgtaagatcccctgtctctgccgtccgcatataggacatcagccggaaaatcggctgcgcaatggaactcgacaatcgcaaggatgccgttaagccaaatagacatacaatgaaaacaaaacagatgacatagaactgaatttgccgcacttccagtgtagattcgcgtgccgggaatacccctactgttctccagcccgtgaattcggaagccctgaacatgaacagcaattccctgcccccagcttcacgggtaaacatcccgctgtcacctgccccgaaccattgcggcggaatgcgctcaatcaaaggcatatccggcctgtacacgctacgtccctcagcatctgtcaccattaaatacccgcttttgcccaaggttacatctctggcggcctgcgacacagcccgcagcttgaggtcaatcataatcgcgcctagcacgcgtccggtttccgaatccgtaaccgaacgaacgacggagacaatttcactgtccttgtaccggacatgagtggtcacattacggtggctcggctgtcctagcacagtgaatatgcctgcatgctgcgccgcctgttggtaccagccttcttccgtcaggctacgtgtgcttcgagcgtacatttcgttgctgatataatcgcctttttcgttcacgatcagaatcccggcaatttcaggatataacgtggtatagccctgcaaaaattgcttcattttatacagcgtatcctgctcctgtacagaacttaatgactgcttggaagtgagagtctggttttccggcgttactatactcgcatgacccgcgtggccgtctgccagcgtcttccctttccagaactccccgatatcggggttaaaagcaatcagatacgtcatgttttgcaaattttccattttggtgtccagcgcttcgttcaccttgccaatcaactgcattgtatggttttccacctgccgttcaataatccgttccaccgtccaattgaccagcagacctaatcccagcgaaggcacaatgccaaacagcaggaacagaagcatcagctgatagcgtaaaggcatattgcgcaagcgtaaccgcggcatcgtttggcgcacccctaattggatacgctcccgaaatttatttcgcataataatcatctacattcgcccgggtgaccacggaaattccagtgtctacccgcacgggcagcggagtgttgtctccagtggaagaaggtgcaggaatcgttaaatgatgatgcagatggaacagatattgaagcgaccaatagcccatattccatgttccctgggcaatcgttgccgagatcgtcccaccacgaatcatatccagtgttgctttattcgtatcaaaagaaatgattttcagcgggtggctgtttttttgactcagtaccgcttcacccacacctgttcctcccgttgcatcggtcacaaaaatgccggccagtttcggataagctttcatcagcctttgcgactcatcccgggagaccatcgcgtctgcgcggccatcagctacttccaccaccttcatggcaggatactgccgctgtatggtatcgcgaaagccacgcgagcgttcctcatgattttgctgtccaggcagtgtcagaacagcgacttgaccttctcgtcccaacaactctgccattttatccgcagcggtcacgcccgccttataattatccgtgcccaaaaaggaatacgcccgactccccggcgcttcggcatcaaacaataccacaggaatgcccgcatccagcgccttattaatcaccggaatcagggagtgaggatcaatcgctgatatggcaatccctgcgggtttacgagcaatcgcctgctcaataacggtcgtctgctcctgcgcatcataacgggtagctccccgatactccacagtcacccccagtgcatccccggcatcctcgaagcccttaagcccgcttttccaatactccaaaccagactggaacgtaatcatcatataggtctctccgatgctgcctcgcagccccttatcctcccaagtgccattcaacgggcccgattgttcatacctgaacacatagagagcaaaggccgcaatcaacagcatatataccagcagcgtttttttcatccttcctccctcttcctgtgtgtatccttaagttataaattcactttaatttattctggttttacttagattgtaaacgcaatcatatcaaattggaactacttcactcttcttactttcaggtggcgttaatcctgcactaatgtttctacgttacaatacctacaattgtgctagggaaaacatatgcgtatcttgaggaaaaggagtgatatggatgagcaagccgcgtatcgcggagtggacagaactacggggccttgcctacctcgctgtcgtgcttcagcattgcattggcgaatatatttatcgcagtgacatccaacagccagattctgtgatgctcgcgatgctgtatcatttgacacgttttggcacaccgacgttcgttttcctgtctgcggcgctgcttttttataacggcaacaaaccgattggatatcctcgctatattggcaggcggtttcgagatatttatgttcctttcctttgctggactgttatttattgggtatgtactcaaaactggtcaacggcgcagtggggaaatatttacttttacaaaggtatgttcgaggaaatgatcatccccgtcagcggatatcatctatggtttgtagtgatgatctttcagttttatattttgtttcctttattttcaaaagcagccgggcaggttcaagcgtttctacgtcgttacagcacaaaaagacgcaagcagcttgttttggctattatgctgattgccgctgcggtttatgctttgctgttacaatggtcctactatgacatgtctgcatggagcactgggttgccgtccttttggcagactctgctggattatcgcacctataactttgtcatgtactttttctattttatgctaggcgcagtatgtgcttacatgacagacacctggcgtggactggccaaacagacgttgccgtggaatgtatttgtctttattggtttgttcatgctcatgggtcacacgatgctgatccagtcgggcgatacgatcaatcttaatatttccacctatttgaagccaagcacctttgttctaattgtgtcgcagctgcttttattgtacggactactgctccatttgcaaaaagatacgagatccgagccgtttcgccgtatgctgaactggatcgggcgttattcttttggaggatatctggcccatgcactcgtgctggccttcatatcctactacacccgcccgcttgcactgggcgatcatcattttacagctacgctcattacgtttgtcgtcgtggcaagtgtttctctgggcatcagctggctctttgcccatctgcccggcggcaactggattgttggctccaaaggcagacagcgattgaactggcactcgtttcgtttccagttcctttcctccagacgtgcttccaaaagcacgcaggagcttggctaaacttgtgcgtctgtgttcagcatggggttataattccaatggactttggcagggctcgctattgagcgctgctttttttattaccttagtatgccgtcccccaaaaaaatgattacattttatgacatgaatatgtattttattttaaaataagtcattatatagaataatcataaacgttacgtgggagaagtcacagttttgcataaaaagaaaggggaggatggactgaacataacatcgtcgttgttaatgatctgatccaaaacatggtgaggctgctttctggtctgaaacatacggttgtactgattaatcagttcatccaaaagcatagactgttcaagtacacaagcatgtccgaagccatactcttcgtaaagatcatgcaagtgttgtctagcattttccatttgttgaattaacgttaacgtgtcatctctgttcatcctgcatacctcctaatgaatttcattttaaggaggaatgtccaactatttcagaagtttttttgaaccaaaaaattacaaaataatacaaaaaaagaccagcagtaagctggtccagtggtaagctttcgaattatgcaccgccgataattccagttgtagaaatcgttccatgaccttgaggcaagccttggattggtactgcgaataccaacaataagctagtcattgccaaaagcaaagccatctttttgatcatttttttcccacacctcctgtgacaatttttcgtactgatccagtatttcaggatcggcacaagctctgaaacgatcaaataaacctgcgcaagtatgagagagctgtgcattatttatcttatcagatttttccaatgcgtctattaaacatttgaaaccatatggatatctacctttatttaggttgtacttagctaacttgtaccaaaaccgcgcagcttcctcaggcaagacttgctgagtatacatatcagcagacattggttccttataggttgcaatttgaggctcaaagtgtttcaggatatgatctatatcaatattataccgattggctgcttctacgatatttaagagttcggcaaaaatttcatctttgccttccatatactctacgtattccggcaaaacagtagcatcacctgccatcagccgatttacacatgtattgatttttccccatccttgaaacaaaccgatccaatgttgtgtttcaggatcactttcctttacccaacttaaatcggcgtgagcctggatgtatttaagaccttgtacgtaatctcctgagcatgacaaacggctgcgcacaacaggtctgcgtaagcaatatatacaaaaagcggcctgcttggtttcttttgtttgtcacagtcacgattcaatttgtactgtatttttgctctacgccccatttcctgagctaactcatatacagtgtcccaatgattcaatgaacgatgtatgttcgccaaatcttttaatgcatctaattgctctatctcgtctaaacgatccacaaaaggggcaaattcaatggcagcttgaagatttatagctctatcttgtccaatattgatttggaacaagcgatactggcagatcgccaatcgctctgaatgctgctgcttctcactttcagccacctttttgtaaaggtatgccgctgcttcattgtaaccgtctttgtatacattttcggcaacttcaaagagcgatggctgataattagggttatccaatagcaaaattacaactcgctgcaagcagtccagtcgtcctagctcaatgcaccggtataagaaaggactgatttttttccagttgagcggagattcttcaatgcattcttcaatataacgctcgtaaaaataatccggtggtaaattcattcccgcagtaatactgtccagttggtgaacagaaatagatcggttaccagtcacaatgctactaactgtacctacattcaaatcaatcgtatggccaaacttggtcatcgttaagccttttcgtttcaaataggtttgaatttctgcctgtatcgtaggtgtgatttccatggataaaccaccctttcagcattttcatagaatttcaatttcaataaacaatatagtttggaaactaatagtataattattgattttccttcacgataataccatcttttggaacaaacataaatgcttttactttattgatttttatattttttttaggagatcattggatgttgaataatggaaggagaagatcacttgaaaaatacaggtatgacacgtccattgatacgttaggtcgaattgttattcctaaagagatgcgaacctctatgggtattcaagctggtgagtccttagagttttatttagatgttgagacaggattgttgagtatgcggaagtatattggagtctgttgtcacttatgctattcgattcaggacttaagctatttcagggattcatttttatgtaaaaaatgcataaacgatctgaagggaaatataggtgtgagtccattacctgttcctgttattaaggaacctgcgtgcaaagaaaaaaatgcacatcggttgtcttcacaacatttggttgagaagctaagaagactcgtgcgcgagcatccaacagccaagcaaggcgaatatgctgaatggctcggcgtatcccaaggtcgtatttcccagcttaaaaagctattataggtatcgctcaactcttattctagcaaagctaaataaccagtcgctggttgatttcgtgcgactggttatttcaacttctaaacctgaacgaattaccactcctacccatgaccacaaaaattagagactccaaaaaaacaatcagactatatttgctgtaaattatggaattaaacctatcaaggtgatatattctgactatatgtaaacttcctgaaggcacgtctaacgaatacaaagctacaaaattaaatgttggagtggtgtataaatgaaatcacatgttctaatttatgatggttatgtgagttttgaaattatgttagcaacctattttatgaaaaccaaaggggacattgttacgattggtgtaaccaaagacccagtgatttcctatgaggattttaaagttacgccttcggtagcccttgatgaagtgtctgcggaggatattcaactcctaattatacctggtggagataacactccattaaagacgaacaagcaacttttagctttaatcaatacactgaataatgataataaagtgatagcgaccatttgttctgccactgaacttctggagatagcaggtgtctcctataaaaatcctgtgaatcatccaacgggtctggagatatacaagaatatcattacggctaaaccaaataagtatgtggactttgcaattgaaataggcaaggtgatggacatttatacggatgatgaagatttaaaagaaaccattgatttttttaagctctttaaagatagttgactcttctgctccccccacaacaatcactttatgtatggtgatatttaggatactatagtgagggaattagcatacataagaggggtaattaaaatgaatgacaaattaaaggggctattagtgggcttaaccattggtatgatgattactggtgcaaccgcaatggctgcatctggaacaagcgtaaatgctgttgtgaaaaagtttgatgtatttttagagggtacaaaaaagaacactgccgttggcttgatttacaacggaaacacgtatatctctgttaaggatattgggattgcagaaagcagacaaatcagcctcattaataataaactgtatttaggtaaacagcaaaagatgattacagaaaatcaagcactcaatattctttctgataaaataaaaaaggatgctgttaaatataatttaaacttaatggttgaaggtttggaaggaactaaatattgtataagagtttacgaagatttccctgatcacattgcaacttatggattctattatgtagataaatacaccagtaaagtaactaaatatgacatagcacaagataaggaattagaaatttaaggatgggtttccaccatcctttttttattgtcaaacgatctactcctcgacttattcaagagcagatataccacggtatccccgactaacgcttcaattgagcttcactcgaagctccggacttacgatcgaatgtaatcgggcctttacggttcacaagccgtttcagatccatagtcatttcattcttcaatttatcaatgagctgatcttctttgatgcctttgcttttagcaacctcggccaacgacttcccttgtcccagctctttctctaactgtacaggagtgatgcccagcaacctagctactttctcgttgagatggtgattcaagccgctaggccttttgccgtgcctatttctgtgaacatgcccatgtccgtggtcgtcctgtggttcaacattccattggcgggctgccccttggataaagtcgttgggagtgagaatttgcaacgaattacccggttcggtcccggaagctcctgctgcacccgcagtaccatacattatcactcctccatataggatagcagcggtcaatttccattgttttttcatgttgcagacccttctttcatcctttttaaaataatattttcttttcccgctatttttattcatattttcgcctgttaagtaaccataagacgggaaaaagaaattatgaacattgctatcacaattacacccaaccttcgatctacacgcgctccttgggaaccctatcctgtagagtgagtaagaatgaataactatactttctacaatataacttgaaatttttcaagttatatattaaggaaaatatgataaaatcaaattgtaaacgtttacaattttatttttgaaagacatgttgcatcaagctactacagaatgcactgcatcatagtgaggctacaggaggaaagtccaatgaaacaaaaaaataaggttatttttatggacatccaaacgcacgagcaaaaccatttcggtcagcgagcacttcaaaaagtgagaagacatggacaagatgtatgaagcttcacttactgtagagggataccaaagcagtcggagtgccaatgtaactagtaatacaattacgattagcggcaataatggcaccagaaaccaagagatcgagctcgttgtaacagccgatgacgggacatgggatgcttatattgactatttggagatcgactaaaatttcaaatctagtaaagagttgaatcggttcggaatatcggaacatccatactatattaaaatagctaggaggtagacccatgtttatagctaaagcaggaaaatggacggcgattatgtcaatcaccttgtctttattcacaggctcgctggtgatctcgagcaaccaggcgcttgcggctgattgctcgagcggttatgtagcgttaaccttcgacgatggtcccaatccctctaacaccaaagcgctgcttagtgctctgaagcaaaacggtttacgcgcgacgctctttaatcttggacaaaacgcgcagaataatccttcgcttgtacgtgaccagcaagcagcaggcatgtggatcggtaatcattcatggtcacatccgcatatgacacaactgagcacatcgcagatgtcatcggaaattacacgcacgcagcaaacgatacagtccattacgggcacggcaccaaagttgttccgtcctccgtatggcgagaccaacgcaaccctcaaatccattgagacccaaaacggtcttaccgaagtattgtggaacgttgactcccaagactggaacggcgcctccaccgcacagatcgtagctgctgcgggcaaacttaaaaacggcgatgtgatcctgatgcatgatcagtaccagactacactccaagctattccacaaattgcacagaacctcaaaaaccgtaacctttgctctggtatgatctcaccaagcaatggccgggcggtagcgcctgatggcggaaacggcgaaacgccgccaaacaaaggcacaaaagtggaagcagaaaatatgaccaaaggcggtcagtatacttcaaatatcagctcgccgttcaacggagtggctttatactccaacaatgattcagtgaaattcacacagaattttaccagcggcacccatagtttttcactccgtggtgcttcaaataattccaacatggccaaagttgacttgaaaattggtggacaaacgaagggtaccttctactacggcgggagcagtcctgcggtctatactttaaacaatgtcagccatggaaccggaaatcaagagattgagcttgttgtaacagccgatgatgggacatgggatgcttatattgactatttagagatcatctaattttaaaaaaacaaaatcccggcgggatcttcccagccgggatttttgtcgacatcctttttacaacattctcaatgtaaaaataacaaaatcttgaaaattgcaatctgttgtataatggccggtaacaactagaaatcgctataaaaatattcataagagatgcaggtgatggcgatggaatggtattttgcatacaaagacgaattggaaaaagtatttcgtcaagcagaggaacggacgtccacgtttccagctccctttcagcaggagggtttggactttctggcgcgttttaatccgttgcgggaagacagcacgcgtaattacatatgctatttgcttccattttggctgcaagaactcaccggactctcccccgaaacatgccgcaagctgtcacttggcaacgtgttcgtcatggctcactatttaattcaagatgatgtgatggacacagcagcagacaaccgtaaaacgcaactcgccttaagccagctcttctataccgagtgtataagcgtatatcgggacctttttccggcaacctctcctttttggtcatatgcccgaacgtatgttgatgaatgggccgttagtgtgatatccgaaggaacagaggactattttcaaggagaaagaaataaggtcgcgctgaaagcaagtccattaaaaatggccggaacgggtgctttactgctcgcaggccgtgccgatctgatccagatcattacaaatatgacagacttggcgctactcgtacttcaaatgtcagatgattgggcggattgggcagaagatttggtcgaacatagctataactgtcttttgtcccatatcagtgccgagcagaagacagcttactgtgaaggattgggacccaaacagattcaggaagcaatttatgtacgcggtgcgctcgccagctatgtgaacattgccgatcaagcagtccaacagttagagaccctggagccttctatccatggcctacgtagctttgcacattctatcgcagcagaactgggcgaagtggcggcggaaattgaaggcggacgctcgcatttgagaagaggcggacttgactactggctctccaaaaatatgaaataatgctagatttttctgagcctttcgtggtatactgactaggtaaatataaccaattgaatgagagggtgatttttgatggctacagaagttcttcaaacacaagtcattcaaaaagcttgggaggatgccagtttcagagagaaactgatgacagatcccaaatctgcaattcgtgatgtgttaggagtcgtgatccccgatcatatccaaatcaaaacgttagaggaaacgcctgatcagttttttctggtaattcctccagacccctccggcgtgcttgctgcatcccagaaacctcgctcgatgtggtaaattagttgttaatgcttatttaatctatattccttactctcatgtgggtgggctcagcaagtttccctccgttttctccgaatgcaaaaaagccggatattatccggctacggggaagcggatggtcgcttctgttcccaccccttttgaacttgtaaaggttattttgccattcatcgtttcaataatccgaaaagtcaccatcatccccaaacccgtgccttttgtcttattcgagaaataaggctcccctagtctggataaagtctgagcatccatcccttcaccattatcccgaatatgaatgacagcttctccgttgtccacataagcccatatatgaatatgaccctgatctcgcagcgcttcaatgctgtttttgatgatattgatgaacgcttgcttgaacttggaggaattcccgcgcactttgatttcctggggaatatccagtgaaatttttccaccttgcaaattagccattggactgatgattccttcaatatgtttgaattcattcaatatggtcaacgttttggtttggtcaaattctggcttggcaaaagtcagaaaatcagtaataatcgcggaggctcgatccagttcctccagagcgatatgtagatagtctttatttttaccatcctcctgcttgctcatcaactgaagaaatccacgtgtaacctgaaggggattacgtacctcatgagctacagatgcagccaaatcgctaataatctccattttctccgaacgttgaagctcattattgaacatctccagttccctggagtaccgaaccacctgcttgtgcttttctgccagccttctgcccaaaatcgcgatcaacgccagtacaaaaccgaacacgccccatttccacaaaaacatattgtagtgtccgtccagaatgaagaaccagctcagttccccgatagagatgactgcaaaaaatgcaaagcctgtcgataaaatgatcgcttcgtgatcacctttaagtgccatgcgaaccgaagcaaataccagcagtatcattaaggcgacgagtaatatacccaagatgactacactaaaaaaataatatatatcgttcaaccgctcctgtgctcctaaattcacaatcatcagggtaaagcataacaaagagtatgcggttaacaactttctgaatttgcgaatcagtataatcgaattgatattttgttcaaaaaagaaggctaatgaaggcagcagaataaatagtgccacatcaaaaagttgtaagtacagcttgccatagccgcgatagaatgtatacaagaatggtgaatacgttacgatcatcagaccaatagacaatactatcgcacttagggacagccacatagccatactcggacggaacatgaaaaatgagcagatcagtagtactagtgccataaagataaacgtactgcccagtacaatatctaaaacatccattctgaccaaggtccctaacaaatcacgataatcaccggtcatcacattgccgataatgcccagtctattcttactgctttccgtccatatgtataatgttttaccgctgtcttccggcttcagcggaatcagaatacgattattctcataattgtacccacggtaggattcgtaaaaattggtcccatctttatacagcgtaatatgcctgccataaatattttcaaaaagtaccgctggcgtttcatcatttagcgaaggtaacttaatacgaatccaggcagagcctatattaccgggctgcctaagcagttgtgtatcattttcaatatgcatccagaccttactggaatcctttacctcatctaaagagccatcctcgtttaccgctccccatctcatatcccaggagggtatcttataatccctttccggggtcattttggccgcataggcggagtagcccagcgacaacaacacaatgaccgctagcagggtggcgacagctttgggcacatgcctcatattaagcacctcaaagttacatagtaggatttacaagtttgtatacgttttaacattttttacgtcctgaaattatattattctatacgatgatgtgcataccttcttcattagtagggtatcatgttctttttactcattttttgtaaaatcttcatattgattaatgatcatttcctgttcgcgccgctccttctgctctctaagccccaaccatggttcacaatcttcatcctcatagatcgtccaaatatcggaaaataaataatcacgtatttctactatttttccagcctgtccgccatctgtccagtataagccttccgggcgccgaatgagggtacgggaaaatcccggggtagatgccttttgacctactcggatacgactaatcatcggaccaaacatgtaccattccaattcatatccctccctatcctctttatcatatcacagcagttaccaaaaaaacgctaattgagaatgggcatatccctattcgcatgattttaacttcctacagacacactaactcaaggtttagccgttctactgtttgggtaaggtcggaataagcaacaaaaagtaaaggagctgagcaacatggccaatcgtgatgatcgagttaatgagctacatgacaatgattttgagccttctctgcaaaatgcagaaaccaactgggagaatctaaccgagggcccagatactcctctcgaagacgtcccagatgccgatgaactgacaccgaacagtcctgttgatccttctgctcctgccgaattcctgcatggtaccgatttgctgaatggtaccgatggggacgaagaagagcaactggacagcgacgatatgctggattaaacacttcattttatcgggtgaaagaaaacggttacccattctgctatgcgggtaatgaagtgtataaccgaaaggagttgactgatctcctatgtataaagatccgatgtctcaagccgatatggagtataagcgctacaaagccttgaatcccgtggaagaggatgaccgcaggtctgcggacaagacaattacagatgatatctcggccgaagataacccacgaggagtcgcatctgcgaagcccgaacccagagatcaaggaaaatgaaaggacagatagagaatgcaaaaagggtgctacccaagccacacaaatgatacacatggcttgagtgcacccttttgaacttcacatgtttacaatggcagcaatgctactgtcgatttggcttccaatccatctatcatttcgttccagacagcaggcttgttcggcaatactgtatagtaacgacgtaggaaagctgccaccaatttggcgctcacttcttccatgctatcatcctcaggcataaagcctaaattcagcccttctactgctacaccatcgttattccaggacggatgtacgtagtacagatccaaacgcttatagcccagatgagatagcacctcacgtcgcacgtacgggtccatttgcttgacaccaccaaagggatgctcgttgccacggtaagggtcatagatttcagcaaacatacccagcaactgctgtccgctggcctgagcaagcgcgtgcaagtcattctggcgtcgtgtccaaagaaaacggccaatgcccagtcccgattgtccgatgatcgtaaaatctgtcatagctacattaaagtcctcataataacgatactctgttgcaccaactaccttatcatcctgtaccgcaacaaagacacgaatacccgggtcttccagcggttccttccacagactgtactctagcacttcctctggtggaaatactctctgcattagctgatgcatgctcgcaaacaaggggtcttcaatatgagtaatgcgatgatattccataggataggacacgctcctctacaattagtgatgggtatgaaacggatttcgccattccatgagggcagcataattacgcgattgttcatcatccaaataattcggcaggatacaaacgggcacccgtccgcaacgaagcagaaaagttaataccgggtccttcagctcaccagacactacggcatccacatacgcttctgcgctcaattggtcggcatgatgctgataaccaggcatacgccccgcgcccagcaaacgatccagtctccgttcaatcacaagatgatataaggaaaaaatcagccatttgcccagacccaatctgcggtaagcaggacgtaccgccaaatcaatcacatacagcgccttgccgtcctcacagtgcgtacgaatataaccgtcatccgctacttcatcccatgtatgctggggatgttcggggttataatgcatcagtaggctggttaccgaacccgccagttccccctcaatttccacacacagcgctccatctgcaaaatgctctgtctggctggcaatctgctcccggctccataacagctcctgcggataaggtggggggaagctctcctgctgaattcgcagcaacccctcataatcggctgtagaataattacgaatcaccgcccgtagcggtcgatcgccgtcaaagatgaaccattctttgcgatacatggcttatttcctttcattagctccagtctgtgtataaatctgttctacggtcacgccaggttgtaaccgagccccgctcgcgcacatcgtacaacagctgcaaatcgagatctgctgtcacaatcatatcgttgttcagttcaccctccaccataatgccgcgtggcggaaaaggaatgtcattgggggtaatgactgcggcttgtccataattggcacgcataaaatcaaccgtagacaaagcgccgacagtccccgttaaaacgacatacacctgattttcaaccgctctggcgtggcttgtataccgtacccggtaaaatccgtgacgatcgtccgtacaggaaggacagaaaataatatctgctcccttagtcttcgccatgcgaacgatttcgggaaattcaatatcatagcaggtcagcatcgctatggtgcccttggacgtctcaaacacattcagcccctcaccgggagccatattccattcatgcacctctgtcggtgtaatgtgaattttgtcctgagtggccacacgcccatccgggtaaaacaaatgtgccgtattatataaacgttcgtttctcctaactacatgagtgccaccgataatatgcatcccggttcgacgtgcgaacgaagtgaataattcaaggtaccggtccgtaaaatccggcaggtcgttgatcgtcagagctttgccttcactgtcaccaatcgacataagctgggtcgtaaaaaactcgggaaacagaacaaattccgcgccaaattcctccgctgttttgatataatgctccgattgcagggcaaattgctcgaatgagtcaatcgtatgcaggtgatattgaaccgccgatactctgattttgctcataattcctcctcggacatcacgtcttttagattgcaagggggtcccgttgctgttcacattataaccgattcaaaacggtgcgaaaactgaacctgataatcagggcttgccttctgcacctactttgtttaaaataaggtcaaatcttttgaataccatgaacaaagacatcgacggagacaagtagacgtttaacggattcccacagaaaggtacgaattgctgagagcgtaccgcaatcccgcgttgaaattcactcccgagtcgagccttgaaccgacagaaggattcattcctttgtccgcagtagaggtttccggaagcccccgttacgggcatcaagatcagaagttactgccgtcgactgaacgacgttgacgattcgtatgtatacttctgtaattagggtggtaccacggcattcgtcccttgcggcgaatgcctttttgtgttattttctgcaaaaaaagtccatgggctaacagaaaaaacaaatttaaattcgggaagggtgtactgtatgtctacaaatgaaagttctttggagctgctgcgtgaacagctcgatgctacaaatttgcaattgctggagttgctgtcccaacgcgctgaactggcgggacaacttggaaaattgaaggaagctcaaggggtacctgactttgatccggtacgcgagcaacaaatgctggacaagctgatcgcggctaaccgtggaccatttgacgatgctacgattcgccagctgttcaaaaatattttcaaggcttctttgaactatcaaaaagaagaacacaaaaaacatctgatcgtcagccgcaaaaatcaaccggatagcacagttatcaaggttaaagatacgttggtgggcggcaaagcctccattatggttgcaggtccctgctcggtggaaagctaccagcaaactcgcgaagtaggtgcggctctcaaggaagccggtgtgccgattctacgtggtggtgcgttcaaaccacgtacgtccccgtatgatttccaaggactgggcgtggaaggattgcaaattcttaaacgtgtaggcgacgagttcgggctggctacaatcagtgaaatcgtcgatccaagacatttggaggaagcgatccaatacatcgacattattcaaattggtgcgcgcaacatgcacaactttgaattgcttaaagctgctggtgaaaccagaactccggttctgctcaagcgcggactggctgccacaatggaagagttccttcatgctgctgaatacatcgtttcccgtggtaacacgcaagtcatgctgattgaacgcggtattcgtacgtacgaaaaatggacgcgtaacacgctggatatttccgctgttccgattttgaaaaaggaaagccatctgcctgtattggtggacgtgactcactctacaggacgtaaggacatcctggccccttgcgccaaagctgccctagctgctggagctgacggtatcatggtggaagttcacccgaacccggcagtcgctttgtccgatgctcagcaacagctgaacattcctgagttccacaacttcctgtctgaagtcaaagaatccggtttattcaaagcgtaaaactaattttatgccggcatttataaaccgctttcatttcctcagataatgagaggtacaggacaatggtaaacatcctttaaagcattatcaacgtgtgattataaccgtaaaataatagaacacaacatcaataaaattaggctcatggaataacactccatgggcctgtttatttttgcacatcgaacctcggacaatctctatacacgtttaatgcttttttcagtcaaaggaacataatatcctttgccattcgggcccatagcaaatttattgcgaagatgaattagattagggccgaatttctcctctaattgttcacggaactcatataggatttccatgatataaatatcatgaataatcacttcagtaatcggcatcaccagccccggatgcaacgtccatgcagcgcggctgtcatcaccaagtgaaagtatgccagctacgacctcacggtcgtctacgctaagtacaatccaccgaccaccaatttcagacgtaatctcctcactcatatcatggcggtaaacagtagcgaaatcaaagttaagctccccatacgctacaatgatcacttcaattccttgttgagcgacttgctctaaggcatctcggaacacctcggcatcctctttccaaatttccaataaaattcggtgttttgctccctttaccccttcatttatgcgattgataatggcttcataccccgaaatattccaaatattctctctattttgaaatgatgctgtgtactgctccaaactctcttgcgccacattgaaaatctgctctgctttgcgttttctctgagcaatcaattcatgtggcggaagcggcacatatagaggcgtattttcttgactgaccatgatatccccacggttaaccattccagacaaaacctcgtaaattttggatctcggtaccccggaattcaatgaaacggcgtatcccgaaagtggagagctttccaataaggtcacataagccttggcttcatattcactaaaattcaaatctcgtagaatttctaatatatttggttttggtttcatgacgtcttctcctcaattcgtgttcatccttactatatcacttccccttgacaaaaactgatatacacactatctttttagtaacgtttttatagtagtcactatagtagcaactattatacttcacagggaattacttcagggaggatttaacttgaacaaagtcatagctcatcacagcgaaagcaaccgcatttactacggttctacgattctagccctattgatctggagtacatcgtttattgccaccaaagcagcctacacgacgtttccccctcttaccttgggtctatccagatttattatagcttccgttgtgctaggtatcgttttgctgattaaaaaagaacatgtcaaagtaaagccaaaagatttggctacgatttcgtttagtggtgttttggggatcactctctacttttcaatggagaatataggggttagcctgactaccgcttccaacgcagcattaattgttgcatcatatcccgcaattacgtcgctgcttgaacttattttgtataaagtgaaaatatccaaatataaaatttgcggcatagcactggccatgatcggggtatatttcttgacttcagttgacgaaagttcggatagtaagaatcaactaatcggaaatttaatattaatcgggacgggttttgcgtgggcgttttatactttcatgacgcgcaaggttgtggacaaatatccgcctgtgacgttatctttttatcaaaccgttgcagggagtatctttttcataccgttggctctattagaaaaggatcgttggcaggttccgacaaccggatcgtttatgttgttagtatatctgggtgtattctgctccgttatcgcatttttgctctacaattacggattaatcaagctgtcaccgagtagttccgtttctctgatgaatttggttccgatatttggagtcttattttctgtgttgcttttgcaagaaacgattacatggcgccaaatcattggcggtttggtcgttattatcggtgttttactgagtgcacatcaaacaaaccgtacctaaaatgaaagattgcacactagttataaaagttaagacaagcatcgttgttataagcatcagcgctacaatataagggcgagtgacctcaccaaaagtttctcgcccatcggtttcatttatgcagttggctttttttcttttatataaaaaaggtggttatattgattgatgaggttatccataattacagactgtctgagcacactggcatgattaaaaccatgttttgcttgcaaaatatacagcttttgacgagctttctcaagctgttgacataaaatgtcgtctcttatcataatatatccctccttgtcatattatcagtgtagagggttatgaataagtatactaaaagtaaaggtttgggataattatctaataacacaaaaaaagacctgctctaagggctctaaggttgtcctcttcgacaatcctgtgtgattcgcttatccggcagaatgaatatcctgatccgtgacgttcttcttggctgaaaccgggaacacgtttttccccttcacccctagcaacaacgctgcaagcagcagtatgccaccgtttaacacaaagatccagcggatcggcatccagctgccaagcatgccgccaatcaacggccctgccattgtcgcgagttgagtcgctgactggttcaagctaaaggctcgtccgcgaaactccggcttggtgacctccacagtcatcgcattgatagcaggcatgacggacgcataaaacaatccatatccaaaccgaagcgcaccaaaaccaacaaagttggttataaaaaattgtaagatattcccgattcccgaaccgatcagcccaatcagcagcacgtgtgcaaatccggtccgtcctccaatccgtccccatcggggggccatcagcaccgccgcgatgcctacggctgagaatacaatcccggaacttaaagacgcctggctacggtcaactcccatttcaagcacatacaccgtaattaacggttccaatatcatgacggaaaaggtacttaatcccgccagaataagcaaaaagcacaaaggccgattagcaatagcctccttgatatcatcacgaacatgcgagcgggtactggttcccttgaagctgtcctctctagcgccaaaggtcgcgattaacgcagatatcagtacaagagccgcagagaaaaaaaaggcattccgattgccataataatggctcaccacacccccaattaacggacctataatgctgcctgtcgccccagcggtcgccataataccgagtgcatagccggttttctcctcaggcgaacctgttccgaccaacgcaatcgcagcaggaataaacccggatagtagaccttgaaacaaccgtactcctacgaacacatatggatctgtcaccaaagcacatatcaggtacaacaccgccaggctaaagcctgaacgaatcagcatcggcttacgtccatacttatccgcaagcgaaccccaaaatggggcaatcaacgcgctggctaaaaaagtgactccaaaggcaatccccgaccacagttccagatgatcatttacacccatttccgtattcagaaatataggtaaaaacggaatagacacggaataggccatgctgcaaaacaatactccaatccacaaaatgaccagatttcgcttccaatatagatgcatgatgccacacgtcccttctgctcattccattattaccctctaaattagaaaagtctaccgccccctcatccttcaatcgtggaacaaccgtgaagaagctgatataatcgaatggaatggagttgatgacatggctaagaagagaaattcgtcttcccctgctcctgcggctcaggacaaacctgctacgttaaaggatctgttgagtcaggatgtgctgaataaacttaaggctcaagccaatgaagcccaagcagaacaggacaagcgtaaagaagacgaacggcagcgtgccgtcgaagcaaaaaaagctgaacagaagaagctagataacaactttgagcatctgctgaataacagcaatttggactggcacaaatacaaataagccaaaaccataacggttttggcctatctttacgctttatgttatagccagtcacgaatatgttgtactgagtacagcacccctacccaaaccggcagactgaacgccataccccatatgagaccttttgccagctttttgtctacctccatcatgatcctgcccctttccttgggaatagcagcagtatgggtcaagaatacggctttcaaacccgtatttccttatccccagcaaaaaaggtatgatagaaaaaggaaaagtgttctgcgctgcccccaaactttaaattaggatgttacaccatccaacctttcaggaggaatatcaatgaaccgaaaaacgatacgcccatggtacacgctgtttctactggccatcatgctcgtgctggttgctggatgcggtacaaaagcggccgatgtggaagctgccagccggacaagcactacaactcctgctgcgactaaagacaagaacaaggctgtttcccatccgattgtcacaattgtcatgaatgatggcaagaaaattaagcttgagctgtatccggaagtagcaccgaacacggttaacaatttcatttctttagtgcaaaagggagcctataacggtaccattttccaccgtgttatcccaggctttatgattcagggtggtgatccgcaaggtaacggtacaggtggccccggctacagtatcaaaggcgaattcaagagcaatggtgttaacaatacactcaaacatacacgcggcgtattatccatggcccgctcagcggatctggattcggccggatcgcaatttttcatcatggttgccgatgcggactacctggacggtcaatatgccgctttcggtaaagtaacgtccgggttggatgtggtcgatgctatcgtcaattccaaacgggatagcaatgacaaaccgatccaaccggctacgatgaaaaaagtcactgtggatacgctgggtaaaaaatatccagctccagtcaaagtaaagtaagacattcaaatcagtctttcaaatcgggataacagcaacgaccttgtgcatacgcatgaggtcgtttttgcttatcccttgatgctctctaagctgctacctctatgatgtagtaagagtatatacacaaaaggaagcgttttcaatcattatttctaaagtttttttcgttataaaagccgtcagcgttcgacaaaaaagctactgtatgagcagtaaattcgtctaattggacttggtctcgactgaacgaataccttccatctcttgaagcagtgacagcagttcctccactccctctgaccgggacagctttaagagcatatgaataaccaactgctcactgttattgatgcgctcgacgtgaaagctgtgaatcgtcagcttcttgtgcttcagcagttctttgatccgattcagtacgcccggctcattgtcgacctgaacaactacttgttgcgtggacggggtagccatctgataaaaacgactatggagcaaggactgagccgctaaaataaacaacgttacacctgcaccaatcccatacatccctgcacctacggcaataccgattccggcggtagtccagatgcctgcggcagtggtcagtcctttaattctatttttttgtgtaaaaatcatccctgcgccgataaagcctactccacttataacctgtgctgctattctggaagggtccagcgacaggttagaccagacggcttgatcctgaaaaccatatttggataccaccatcatgagcgctgcgccaataccgacaatgaaatgcgtgcgaatgcccgcttccttcatccgacttttgcgctcatagccgattaacgcgccgcataatcctgcaaacataacccgaatcagataatcccaatcccacatacttttttcactccactatagtttatgttttgaaagatgttgcctcaaagtatacaattcaaaaatgctacggcaaatgagccatttatacagctgttattttgttattacccaaattttaaggaaccctcacttcatcctctggcagattgcgatgtgccttccttcccttgagcagccatagctgcggtgtatcctgcacaccatcaaggcgcaagctgaacgcccccgctggtaaattgcgtacacgcagcaatagacggtttccgtctgctacggcatccacaagctccagcagcgttagtgaatcgttccttaggtggcggctcaggtcgcatgttgtacctgctctgtcctcccggctccaaatacgcagctcatctacagacggcgtggcaattcgcttgttgaaagaaataaccacctcatcttcggctgaacgttccgcccttagcggtttgggcggctcatcgtacatgtaaccacccaaatggtattcataggcggtccaggcgtcgtagtcgccctccagggcggtagccccgaaccgccgcgtccattcgcggtctcgaaccatccgcgcgagcgaaccgatatccgcctgcaccccgaggggcaggcccggataagcggcgcgaatcgactgcgcgatgcgggcgtagccgcgaatatactgtggcggcagacggcggcacatccagtccggccaatgggtctggattacgtgcatatccggggcgacgcacccgatcatggctaccgcgtccagaccctgccattcccgcagctggccgggaacatcgccgcgcccgctcacagcaagcgaccatgtcgccacgcagatgtccggccggacatcgcgcacaccgcctgcgccgttcaccagctcgctgatcaggccgttcacggcgtccacgcgcaggtcgacccactgcgcgtacaggttcggaaccttccggtagtaatttcgcgcatgcttgttgcggaaatccggaatgttctcaccactgcgctcgcgaaaggcacgctgtgcatgcggcccaatatccccgtacactccactgcgcagcccgttccattcggggaaataaggctctgccacctcgaacccgtcgaacggaatgtcggtgacgagccgggcagcggctttctttttccattccacatactcctgggcaaaatgcgaaagccgctgaaatccgtcgttcggttcgcgcagcagctccatacgccattctttccactccggcggtagctgggacacgccaaaagagccgttgcctagcaccattgcccacaccgctatgcctctgcgttgaaaagcagcaacaagcgctccatccacttcattttcacgtacgacaaaataatgaacggtctggtagcccgcaagggcgatctcatctgctatactgtcccgcgaacggttggcgtaatagggaaacaacggatcgatttgaatactggggccgcttagtgcccacggtttcatttttccggtcagtgctatagcgtctgtcgattcgggtcggtcatttgcgttatagctcaattcgatccacctccgtcactcggtcttctccatacttgttcctgctatatatttttgctacaagttcctgctggttcgcctatgttaccatatttcgcaaatgggataaaatccagctgtgactgtttcaccatcaacgtccagaggtatggaataacgagtcaggtttagtttatgaacggaatgggaggaatagtcaatggcagagcagagattgcaaggaaagatagcagtggtcagtggtggaggttcaggaattggcaaggcgaccgcgatccgttttgcagaacaaggcgccaaggtggtcatgctggatcggacacccaagcatgcagaggagaccaaagcaatcatcgagcaaactggcggcgaggcgcttgtactggaatgtgatatatccaagccggatatgattcagcaggggttcgctaaagtcgtggaaacgtacggaaagctggatatcgtgttcgccaatgcaggcattaacggcaccatggcccctatcgagacactggaactggaggaatgggaccgcacgatgaacattaaccttcgcggcacctttgctaccgttaaatatgccgtcccttacctgaaagaacgcggtggcagcattatcattaccagctccatcaacggtaatcgaaccttttcgggcattggattctcagcctacgcctccaccaaggcagctcaggttgcttttatgaaaatggcagcgctggagctggcacgttacaaaattcgggtcaacgcgatatgcccgggagctatcgacacgcaaattgacgataacacgtacccttcggaagacttgaagaaggtacaaattccagtcgaatttccgaaaggcggagagcatccgctagaggatgcccctggtgagccagagcaggttgccaatctggtcctttttctcgcctcagacgagtcatctcatgtatcgggtacagaaatttatgtagacggagcagaatcactactgcgttaagtattagaatggggaacgttatacccatactactgtttaggcattcttagcagccttatccctagtcatatacttgtggaataggctgcttttgtatggctttacaacgactttatgtcgacctgtcagcactatgcacagctcctttacgcgagcggacatacagcctgcctcccggaagcacctcgaacaacagcatcagaagagaaaagaataggagcgcaatggcctcttctgccacaatatacagaggatatggccctaaaaaatctaatatcgacggtgttgacggctttccggccagaaacatgtagttagctccgagagcatcgtctacgatccacactatcagcgccaggccattcagaaaaagcatcactcctcccacacttttccacgtcggtcggagtccttctatccaggtcatatacaaggctgccagaataatagcactatgagctatgaaaaaatggataaaacgataatgcggaaatgcgtatgccaaattaggcgtgagtacggcttgaagcgcccctccaattccggcaaaaaggatgattggatataacgatcggcttcgaaaaatgagcattaggatagacagcagcagtgtcacactgcacagttctaatggcagtgaggtctggacatcccaaatatgctgcatcacataccaaatattcagagtcacctctgacagaatgaggactgtaattaacaaccagcgaattccctcgcttataggcttgttcgaccgaatccatccccgagtcagccacagcatcaaagcgcatacaatgagtcccaatatagccaacccatgtgacggagtaaaagcctcgaacccttctggcgcgttggcgtcgaaccaaggccctgaccacgacctatccatagctagccccctttgatctctttctctcttcgttgcattctattttatacccaatagccgattatgttctagccgtgtttcttgcttgttccataccttacctttatgataaaagatattatattcaaaggagaaccctcatggccattaatcgccgattaattacagatcaggatttcagcgaggcactggaacgtcatctgcgtgtccgggtatttcaggatgaccaattgattggctctggcggaatcataatccgttttgacgatcaaaccattgtcgtgcaatccagcgtcagtgatctggcttaccaccccagaaaacaatgtgagttttttgaaattaaaaaatagccactacacaccggggaaccattttgctgcgttttccggtgtatagcggctatattttgtttgtatatatcatgcctcacatgatggtttctgttatagttgcattccacgtgttttcatcatgagtttattcgtaagcactttcaaatcctcggaagaagacgaaatttcctgcataattgctgtctcctcatgagcagccttataaattttatgagctccttcagagaaggcccctgacatttgctgaatacgatggatctgctcaaaggtttgatctacccgattcgtctgctccgtcacggcttcttccattaatcggatgctctcgacaaattcacgtacaatagcgttcaaacggttcagcgtctgatccacagagcttgtccgttccgcctcagcactgaccaatgacgtttgctgatgcatcaactgcactgtctctacgatttgtgactggacacggctaacgatggcatttatttgctgcacagactccgtactttgggcggcaagtgcgcgaatttggtgagccactaccgcaaacccgttcccttcttctcccgcacgcgccgcttctatggaagcattcaacgccagcagatgggtctgttcagcaatatccttcacggtgcttgtaatcgcttcaatttgggaagcttctttttccagtcgtgcaattacctgctgcgaacgaccatgtgatgctgtcagttctcccattccatccatcagggatgaaaatacagtctgcgtcgaatctactgaatgctccatatggcctgacagttccagcatatgccccgatttgctacgcatcattttaaaatcgcccagcattcggtctgctgttttaatagattgggcagatgcttgcttttgctgctccacgccattcaaaatatcttctaccaccgaagacatggactcaatttgcgtggtagcctgcacaatagccaagctcagattttccgcactttgcgaagttgttctggtgctgtacgagatctcattgaacatatctttaatgttcagcatcatatgccgaaatgcatcatacagaactttgatttcatcctccgaacgacgttcaggaattacaacagacagattccccgccgaagcttcctctgccgcctttgccaacctaacaattggccgtgtgagtaattttgagatcaaccagcccaaaatgccactccacaggacacccaataacagaatgatcgaagtgtacacccattcttgtgtaccttgagcaagccagtccttgagtacaaaaataaaaaaagcgcttgttccataggttattgcagaaattgagacaaatgcagtaaccattttcgtacctagtgacatcttcatgtactgtagcccaccccaaaaaactcaaatttgattccattttaccataaaattgctacatttctagtagaatttttcacagacagatatatttatgagcataaagatacagagtcttaagtcccctatcctaattacaaaaaaacaatatgttaccaggtagcagcttgcatcttaaaacggacgaatcgcgctgtcacaagctttacaggccattcgtcacatcttaagcgagctgttaccgacaaagtcaatttccattattaaaaatcattgtcatttttctggtcaacgactgctttcttaatcgcttcaattgtgtctatttggtgactgtttttttccagtacagtaaattcccatacaccaatggtcagcttttctccttgctggatatcaaaacgctctgaaagcatccatccgccaatcgtatatacgtctccggcctcaatatccgtctccaagcgccgattgacctcatgaatgagcgcctgtgatttgagtatgtaacgatgatcatctgtttttgtaatgagtggagttaacgctgcgggggtttcggtgtcggtataggaaggaatgtctccaacaatttcctccataatgtcctccagtgtgacaagtccagatgttccaccatattcgtccaccagcaccgctactggaatgcgtcgtttttgcatctgaatcagcagatcccgagcctgaaccgtctcgataacctgaagcaccgggtgaatataagaagccatcgtcgtattccctgtgctgtgcccacgtgccaaatcatgcagggcttccttgacgcgaatcattccgataatacgatcccggtcgccatgttcagctacaggtagaaaattataaactttatcctcgatcagctccataaactcggccactgttgcctggtgggagatggaacggatatggatgcgcggtaccataatttcctgcgccgcacggtcgtcaaaatcaaatacattgttcagatatcgatattctgtcggtgtaatttcaccactacgaaagccttcagataacgccaaacgaagctcagcttcactgagtgctgcatcttcttcagatacctttttgagcccgaatagacccgtaatgacacgcgatgaacgactgagcacccaattcaggggataggtcattttataaaatatcgtgatcggacgggcaaaaaacaatgccatgggttcagcaatctgtatggcgaatgttttcggtaccagctccccaatgaccacctcgaaataggtcaagatcaaaaaagccagcaaaaaggagagcactcccgtcaggcctgctggaatatgagccaatacaaacagggggtgtagcagatgttcaacagttgattcccctagccagcctagcgccattgaggttaatgtggttccgagctgacaagcagataaatactcgtccagtcgagacagaatgtttttaacggctttcgcatttttgttgccttcagaggccaattgattgatgcgagatacccgcacacgaataatggaatactccgaggccacaaaaaacgcagttaatgcgataagtaaaataaccagaatgatatttatcgtttccatagccctctcttgctccgttcatgacgaagcaagaagcaccccctttaacgttcatttttggatggaaccataacataagtaatgatgtccataatcgtgtattacccaaaaatgacaaggagtagactatgtatgaccctgttagcgaatcgccagcggactcttttgcacgatatctatccattgatcagctatcaactgatgcccaaccgctgtcggatgaaccccatcatgcagccaataggaggcgtccgtctgggtagctgcttcgttcaacatgctctggaacggcacaaatacggccccaaattcgtccgcaagctgacgtacaatacgctggtaccccgttattttttcttgccaaatgtcccatcgcgcctcggtagctcccgttttcaaaataaacggttcacacaacaccagcccgatatcgggcatcacttcacgcgtttcttccagaaggtggcgataggctcgttcaaatcggtccgtcaccccggacggctcctgctcgacgatccgccaggcatcgttcactccgattagaatactgagcaggtctggcttcaggctaaacatatcctcattccagcgtgcatacaaatccgaaactcgatcccccgaaattccccggttcacaaattctggccgcgtagtagtcaaacggctccccaatgcacctgcgatcagatacacatagctctgacccagccaatggttcgcatcctcatttcgtccccttcctccgtctgttatagaatctccctgaaaaagaatacgtgcgtgttctgtactcgtcatcttcctaacttcctccttcgaatttcccaataatacccttatcatacctcgcttcatctaaattataaagcggtttcaaaatatagaagaattatagatttgccatatagccggattcactagcttaattagggtaggaatccgggggcaaaggcgatcaagtcatttcacaccgctcggtacttacacacctcgcgaaaattacagcctccgcacgctctgcgtgaaggcatcggagtgaagaaagactcgggcttggggcgattatagtaatcgtcatcgagacaggacttcatttcatcgatgtatcgtccgacattaccaaccactttgtcgatatcctcttgcgcgggacgatatacctcatgctctcctgtcatcaaatactccacacgtacctcaatcttctccaaaggaagctgatagtgctcctgcacataggaagcatacaaaaaaagttggtcggaaaaatcgccttccttgcctgttttccaatccacgatgaccatgtctccattgtctctacgatagagcaaatccattttgacatacactttcgtctcatgaagaagcatcgtatcccacttctccacttctacaattcgggcctttccctgttgcagttcacgccaaaccgcagtacggtacaaattgtgtatcgccgcgtgctgtcgctccttaataagggcgatccgttccggaagcacctcgtcgtcgtaataaacctccgccagcatgacgcgatttttcggatcttgtagccatagctcacggtgtagcgattccttgtaactgttattcaacatgttcttcatagctgtctcgaggtatgctgtgcgcgggatagcccctttttccatccatccacgtatgactgattcacacatttgatgcgtaatattcccgaataaaatatataagttgctcagttgcttgagccgatacaatgtaacttgctcttcagtgccctgcgccgaattccagccattatgcgagccgtaataatgataatagtatttgcgtaagcattcatcgaacgtttgagccctcgattgcgaataggaccaggacgggtatatagccatgacaggccctccttcattaaaactatcatctctttattataacgcaaacccaagctgtatcggcgataaaaaggacgaagactttaacccatgggttaaagtcttctactgactgactagtttgtagactcgcaatgagtccgttcaacatggatcaaatcactaacattaacagcaccgtcctcacggacgttgacaacaagtaccggagtttccagcatgccgctgatccactccttataatcatccacatgatcatttggaagaatcgtcaagatgacaccagcaaagccaccaccatgtaccctgcatgcgctgttatctattgactttaaatacatttcggttaaagccagtgcaaccgatacgtcttgttcccgcgcaatcccacttctatatacgttttggagccatttccatgaggaattaccagattcggtaacgagcctcaggaaatcagtaaagcgcccctcctccagtgatttcacctgttcatccacgcgtctattttcttcaaaaaaatgcaacgcccgcagtactgcacggtctcctgctttttccctgaccattttaaggttggcatatagatcctccggcaataagtcacggcaaaccaaagcgtctaaagactgagccactgcaaacatttcgttgggcaccgccgcataatcgtccgttaaatcagcatgatttccacctgtatttacaataacgagggaatatccgttttgttcaaaattccaatgaacaggatttatgatcggttccttgggattttcaaagtcaatggaaatcaagccgccatacgcgcaagccatctgatcgagcagccccgacggcttgttccaatagccattttccgcatactgaccaattttggatttagcaacagcatctaacgctccctcgttataaaaatgatttaatatcgtacatatcaacatttcaaaagaagcggaagagcttaaacctgaagcagagaacacattgcttgatatataagcttggaatcccccgatacggtatccgaattcaagtagaccagcggcaatgccacggatcagcagcatcgtactgtcatcctccggttttggcgacaagtcggttaaatcgatgacgtacttcgtcttgtagccttcagaaaagaatgtaattacagactcctccactttagaagctgcagcgatggtatcgagtgtaatactgcctgccagcaccttcccgtgattgtggtctgtatgatttccaccaatttcgcagcgccccggagcactaaacagttcaatatcccctacaccaaaatgctcccgatacgcctgtataagggattcatatcgagtcgtttgctcagagatttgctgttgaccgtacattcgggcaagcaccatttgtccctctctggaattcaatagttccatatctttcatcgtatatccccctaattgtatgtgttttcctatgctggaatgatactatcattatctcaattttccctgtatgaaagtatggcacttttaaaatttgtaagcgcttattttaatcgctttactgagcattttaccaatataacaaaaaaagaaccagcccctaattgggccggttccttgaatttctttttagtcgcgtttcagtacatattccccatcagtattacgagttactgtggcgccaagcgcctcggcaactgatttgaaaggaacatacaatgtaccatattcatccgtatatggagcttgtggcagcgtcaatgtgcttccttccaatacagcctgtttggagccacttttcagtttaatcgtcttacctgtaatatcatcaattacagtagtctgtttggcagctgcatcccattttaactcggagctcagttcgctcgtcagttcacgcaatggaataaaggcagtgccaccacgattctccaagacgtagtaatcgtctttaggatcgaaagttgtttctacttttgtaattttcaaatcattttttaaaatgttatagatcggagaattcgcttcaaaattgcgcagcgtcgctcccggagttaattcagcttgtttattcaagtcaataacaccgttagaaatatccactttatcagccgtcacactaccattgacgttccatgattgagtttcggtcagaattgtgaaggacttcaccggaagaccgtccacatctggcaaagcaaccgtcaggtctgtcgccgctttgcgaacatttcctttttcatcaaaatacatgtcgcttttcagaaccgtgttagcactcaggaccgttttgatttcaggggactgtgcatacatggtgctaacgcctacatcatactgatcaacggccagatccaaatactttttaacttcggtataagcctcattgaccattttttctttgttagcactcagttccgctgttactttatcactgccttcaatattcatgccggaagcaattgttttagtcatatcaatggcttgcccgatcagctctttcaagcctgcttcgtccttggccagattcgccaggaacggttttaccaatgttaccagctcatcaccacgaagttcagcatgcagatgggtcagtttcactttgtctttctcaccgtatacttcctcggttacagacgttgcagaaatggtagaagggttaggcgcatgcttgagcataagtgcagcggctgttttcgtcagttctctcacgtctttggaatatacatatggatcaaatccagcaggcagaccgctcaaactctcttgcgagttcaaagatatgtaataaggttttttggcaccttccagttgaatagccaaaccttgacggtctaaagcaagttcaaacggcaaattatacttatcgatgtgcaatgtacctttggcagaagcaagttcctccgattgtactttggcttcatccacagtgacggaaatcgaattaatcaaatctacgatttccttatctccttgcgtgattccttcttttggagtcaatttaagagagattttctccgttgtctgctgggatttcacatcaagtgttcccaataaacttttacttacatcaaatccacctactgcctggcaacctgtcaaagctaccattaacagaataagagggacggcgatccatttttttatattcatattaatcccctttcaagatatttccgtaatctcttctattatctcagtgttaacacgcattgtaaatgagtagaatggaaaatagaactagttatttagaatcaattttcagcctgaagcatccggtaagccagtagtgccatttccaggcaacgacgtttgtcagggtctgccagatttccctctatgatttcattaattttatccagccgattataaagggtctgtctgtgaatgtacaaaattccggcggtatcacgcttggagccatgggattgaaaataggcatccagtgtatccaaaagctgcatatggtgctcacgatcatgcgcaatcagctcgcccaaatggtcctctacgaactcttgtagaaaaggaatgcggggcaccgccttcaacaattgatagattccgatgctgtcgtaaaataaccgatccttcatgactgggacgcttcgtgccacttcaatgacctcatatgcctcttcaaaactgcgatccgtccccgtcatgcgatgccttaccttaccaaagcctgcatgaatgcgcaccttatcaagctgtcctgcggcatagttctgaatatattgaacagtatgggcaagcacttttttcatttgcgctgcggaacgcagtgttaattcctccttggcacaaaggatgtagcattgacttcccttcatcatcagcaggttgtgcaacgtttcttttttcaacaatgaacgaagcagcactagcacatcctgattgatggattccttgcgtacctgactggcatccttgtcctggtgttctacctcaatgacccctgcccaaaataaatactgccccttcgataacaatcgcaggcccatccgggtctgagcctgttcttcactgggaagctgtccgctcagcacatcctgaatcaattcattttgattacgcagcaatcggtcttcaagaaactgtgttctcagcaccaatgtagcggctgccttggcagtgtaatcgagtagcagcgacatttcttccgtcggcatttcactatgcagtaccaaacctactgcggaaaacacctgaccgaagcatacaacgggctggaacaagacggcagtggattcatttaggtgaaacagcagatgcccctcccgatcggcggtcatactagattccacttcattggcataaaaatctgcaatacggtccgctagatccggctggacggaaggtacgaatcgattggtttcaatggaagacatgtagatgacctgccgggctgcatagtcatgaagcacacgcaagagggcgttcatatcagtgctgcgcagggtttcctgctgaagctgacgtgaaaatcgctccagatctttaagaagttcatgatgtcggttaataagtagggaatgaatatcttgtgtaatttcaacaaaacgtactggctgctcaaatacgatgaccgggaagtgatgtcgttccgccaactccagaatttcagaggggatttcatgaatgctcgtgcccagctccacacacaatcctgcggcttccgagcggatcagttgctccatatactcggcacgctcttcccccttccgggtgagccacaggccggtcgtcaaaatcaagtcatgacggctcacaaacggagaaacatttgtgatttctagcacatggacccaacccacaaggcgatgtacgccctgttcccccgccgccagcttcgcccgccggaaaacggggcgttccagcacatccgcaatggtaaatgtttttttaccgttcatcggcattctccttatgtatatgtctttatgtcattttatatgacatatattcatcaaaaagtcgagcctttaagtcagataatccgacaaaatgtatgatgtcaaggagcttcaccccttgtaaactgtacctaatctaacatgaattgcatttatcggcttgagtccatgtaactaatcggcagggctgcgcaaaaatgatagtgtaattttcttaacaattatttttaggagaggtgaatgaaatgaaaattggggttccgaaagagattaaaaacaatgaaaatcgtgtcgctctaacgccagcaggtgcagctcaattgattcaacacggacatcacgtatttgtggaaagccatgcaggtgttgaaagcggctttacggatggagaatatgccactgcgggtgcgactcttgtgcagcaagctgcggacgtgtggtcccaggcggatctgattatcaaggtaaaagagccgctctcctctgaatacggatattttcgaccaggattgattttattcacctatctacatttggctgccgagccagcgctggcccgcgctttaacagataacggcgtaaccgccatttcctatgagacgctagaggttgaaggcagcctcccgctgcttactccgatgagtgaggttgccggtcgaatggctgtacaaattggagcacagctgctggaaaaacccaagggtggcaaaggcattctgctggcaggtgtgccgggggtgaaacgcggtaaagtgaccattattggcggaggggtggtcggtaccaatgctgccaaggtcgccatcggtcttggggcagatgtgacactgatcgacctgagcctgcaaagactgcgccaactggacgatatttttggcaatcagctccatacgctggtatccaccccgtccaacattgctgaagccgtggcgcaaagtgatttgctgatcggtgctgtcctgatcactggtgccaaagctccgcggctcgtaacggaagccatggtacagacgatgcagcccggctctgtgattgtggatgtggccatcgatcagggcggcatagtcgagacgattgaccacatcaccacacacgatcagcctacctatgtgaagcatggcgtcattcactatgcggtagcaaacatgccgggcgcagtaccgcaaacctcgacgctcgctctgacgaacgcgacgctcccctttgctctccaactcgcagatttgggtgtgcaggaggcgcttcgcagaagcaagccactgcttagcggcaccaatgtcctgaacggacatattacctatgaagcggtcgcacgtgatctgggatatccttatgttcccgtagaacaggcatggcaggcaaaagccttacaatagaatagaaacagctcaaagaaccacacgctcttcccagcagggactgaagcgtgtggttctttttgtgctagctgtattcaccgtgcttactgcatttcagacgatttctgacgaaaggaacgtttgaagatggcgataaatatctgtgatttcttccagcgacatgcgcaccagtccgctagacgaaggtgccacaaattcatgcatctcggaaatgagcggttcaggctgaaatccccaatttactttggattttttactgtattcggtgtacacgcctttgccgacaaagcaagcaacctttggacggtattcctttagcttctcgtatagcttcagacgtccttcggcgtattcctcgcgtgcaatatcctctactcccctcgtgggacgggaaacaatgttcataaagccgaagcccagcttcagcagctcccgatcttccgatggatcgtacaagcgaggtgtcaagcctgccccctccagtatgcgccaaaatcggttgcgcggattcgcataatgatgtcctacctcgcctgatttcaagctgggattaaagccgatgaatacaacggataatccataatccagatgatcatctacctcatgcagttctgtctctcgctctgtcatgggctcctccttcctcaaaccatatccagcggctgcttccgcgttggcggaggaaaaacttcgtctatttgttgaagttgttcaggagtgagccgaatacttgctgccgctgcattttctcgtacatgcgattcctgcaccgccttcggaattgcccagacatcaccgtcccgtatgacccacgcgagcgcaatttgggatggagttaccccgtggctggcagcaatgtctaccataacaggatgctccaacagcccccgtcgcaggcggccaccttgggcaatcgggcaataggccatcacaggcactccatgcgtacggctccaaggtagcagatcatattcgatgccccgcgaagctgcgtgatacagcacttggttgacagcgcaggcttcgcctccacttaggctccatagctcctccatgtcggacttgtccagattggacactccccagctgcggattttgccctgctcacgcagtttttccataccttgtatcgtctcttccagcggaatattcccacgccaatgcaacaaatacatgtccacgtactccgttcccattcgggttaggctcgcttcgcacgcttgagccagtccttgacggtccgcatgatgaggatacgccttgctaacaagatagacatcatcccggcgaccccgaatggcctctccgacgatctcttctgcgcagccctccgcatacatttcagccgtgtccaccagcgtcatgcccagctccaagccaagttgaagcgcgcgcacttcttcctggcggagtgatgctttttcacccatatgccacgtgccctgcccgattagcggcacttcacgaccgtcagtccaggtaatcacacttttcttatgttggctcatatgcattccctccttaggagcctgatgccacaggcttgtcaaatacatggctctgcgtccaatgctgtccaccatccgaggtggtatacatgactggggcctgctctgaatccgagaaaatagcccagccttccttggcatttgccatcccgatttgctgaccaccataaccgtcaaagccttgcttgccattgttccacgtcttgccgccgtcagtcgtccagccgatggtattgggcttgtcgcacggtgcgcagtaaccgcccatccatgcggtattgctattaaccgcatagagcatacctggtgcagccccttcatttttgggaacctggttgtcttgctggctaatacctggtgccggaccgccgccagcagtggtattcgccagcacagcacgccagctttgtccactatcggcagtatgccaaagcgaatacgacgtctgattcatccccgtatcgccaaccagctcgatccatgcgtcgccacgttctaccgaacgaataatagctccatttagaggcgcctccactgtccgtgacatgacagtagtccacttttggcccccgtcaaccgtgtgtaaaatctgaaacgaacggtctgtgtcctgcgtaactgcccagccgttttgctgatcatggtaatatggctgtcctaccaagtggccaggcacggggagcgaagaccagctttgcccaccatccttcgtatattggttgccactgaacccttccttggatgatacaaagtgtaaaaagcccgcttgcccttgctcaggtacagtcccaacaacctcccagcgtttaccgccatcgcgagtggccagcagcgatccgctgtctgccataacagcccaagcctgctgcccgttcaaggcaaaaatctgctgaaccgtaccttggccctgatattgcacattccacgtcgatccgactgaatcggatgcaaccgcgtccgtacgggcaatccagccatttccgccgatccagccggattggccgtcgatcaaacgcagcgcggtaatattgtccatgcggaccttcgctatcgtagtgtctgtggttgcttgtcctcctgttttcggtgtatctacagtcgctcccgagccattcgcttgtgccgaggcggcacccttttgctcattttgagccgtttgtcctgtttgcgaacttgtttgtgagcctgtttcacaccccgctgtcactatggctacggcgagtaaaagcacccagaccgatgtttttttcttcattttcgttcatccccttatgttggtgatatacatggctgtgcgggtattgtattcacagccatgtatattctatgtattaccctgctgtcttcgtttcactcttaaggtgaatatacggaatggactgaatgcaaaccagtgttacaggattacgagtttacaggaacaaagccgcctttttcgatggcccgagttccttcttcactttgcagccattcgagtaatcgttgcatcgaagggcttggtttctcgccttcccgtgtgaccacgaacagttgagctgtgaatggatattgtttcgagcgaatgtgctctttgttcggctccactccatcaatagacaaaaatttgacctcttgacgattatgcatcacatttgcgaaataataaaatgaataaccgagcgcattgtgatccttgttaaaatcagcaactgcattaatcatttcacccattataccaattcggagttcccgaggaggttcagccatgtcatgacctttcatcactttcttttgcatatatgtttgacttcctgaattctcctcccgctgataagcaacgatcggctgatgctttccccctacttcactccagttacgaatagatccttcatatatgctgcgtaactgctccgaagaaagtccgttaactggattgcctttatgaacgagaaaaataaaagcatcccacccaatgggtgtaagcttcatttgaattccccgactttttgccaggcgtaattcctcatcggatggacccgccaccaggatcagatccgccttcttttcaatcagattgacataagcctgatgtgttgtgttgaatctcagttcgtgagccgcacgaaccttgttcattccggtcaattcatgcagcatatcctgcgcgaatggaatggccgctgtagctccatctactaccgggaaatccctttccgcaatgtacggacgttgaggaagcatgatcgtaatcaccagcacaataatgagcgcagcagatattgcagctacaacccattgccatctatggtccaactttccgtgcttgtcggtcaccgcaggataacgatctaccccaaccccgactaccatgccagctatgggtagcagtgcggtcagcaaaaaccagattccgctacgctgtgtatataaccccaatacctctagtacaggttctgcccaagcgtgataaagtgaaaacagctcccatgctcctccagacacttcggcaagttgtccaccagacccttgtatgcctacaatccacaaccacagcccacataataatgataatagcccggtcagcatcagcgaaagcttgcccatgctagacatacgcgcactcaaggcaccataagctgcaaaaatgagaccgataatccatgcatatagaagtagtattacaaacacagttgtatctgtgacatcttcatgcctcagcagaagctgcacttggggtgccacaaccatactccaaactacattaaacatgactgaaaacaatccaaacataaacgtaccgcccagccatggccaaaaccatgctatccgcacagactcatccttttccggcttggttataactctctttggatcagacatgtacatccccctatatctaatgaatgaaatgagactgtaaaccattgcttcttcattgtacaattatggtaaagattagtatacgagaggaggataaaaatgtccttatccgatcatccgaatgaggaggcactcaagctgcgtatggcaaaaaaggcctcccctacgggaaaggcctttttggtatcgaatcttctttatatcgctccggcatggatcaaaaaacggtgctgcttcacgtcccagtacccatcacgttggatatccaaatacagaccatacagctgttctatatatttctctggctgaaagtctgcaatctgccattcaatggcttttaaaaatagtagacaagtgcaaaatacgtcttaccgtccgttggcgaaaatgactcatgcttatttagcacaagatcgaacccggcatcgccaaacggaggggaattgtcatcctgtatagctatatcgtgggcttaaggaattgctggtaaagcctttgcaagctccggtgtcatatctttcggagttaataagtaatagcctgtgtgggcatctgaactgtataaaggcttaatcttaacttgaaacatataagtgcctttctctatatttggagtaaggttataaggtctgcgcttttccagtacagtactccaaagcttctgatctgtaatagttgttgctttgtgtttctgttgaatacttctaaatagtttatagtcttcaatatactgattgggttggtaaggctcaagctcttcagtaataataggaacagcccgtattgaaaaaatatccttagaatcaatgatgaccttatccgcatatcccttttgttctaaccattctgtaagcttgtgataggaagccggccaattaaatgaaagttcacggttccatttcggttcattggtaaaagatgactctttatttgtaacagaaacactccccaagggatatcgatctgattgcatttcgctataactcatatttaaaacttcttctttgagtacagcttcaaattcatgaatctctttgggttcgctcaaaaccactcgtcgttcattgtcatctactgattggatattgatcgtttctgctctcccttgcagcttatccagcttgtatcttactgttttataaggctctgcttccatcaccttagtcagttctgtctggaaaggcttctccgggaatgtatagcggcgagtcatggtggaaccatcatccaaacggtagactatgactgccgattcgacggccaggtttttggacaacgttttctcgccagctgcatgtgcacgtacaagttcacgatgtaaatttagcacagaggcgatataagccctgtcttgggagtaataagcttctgtttgtgcatctccccctagaggctcctcttgccccacataaaccttttctacggagtgagctgttggaatccgtccctcataacccaaccaacctgaaatcgggatatacagtaccaaccccatgatcacaccgtaaacgaccatttccaccaaagcacgaacacgcacaatttgccacgtcttgcggatgaccatctctacaacgatatagcctaaaatagctccaagtgtatagccaaaaatcgaccaatttactcctcttgtacctggattataaaaataatcacctagtactagcatggcgcatagtataacccctgccttgaacaaaggctgtaagaaaggaaatgctatggcctgagtcgccttttcgaccaaacgtttacgatacaaaccataactcaaggcgacaaacagcagagagatacctaaataggcaagtagctctatgtaggaaaaggcgcgctgcggcaagttctccacaatgcgtacaaacggcgataagttttcccaaacattattattactacgaaactccgaaccgttaatatattggacaacggtttctcgtacccgcacataaccgtataaattacgttccagaaaacgccccatcatcatgaatagaaactgaggcaatagcagcaaaacatacactactacggcctgtagcaacgattgtcccacacaagtccctacaaacacggtaaaggtaaacaggaaaatcgtaaggacggatacgaccagagcccacgatccaatatcattgatatggaaaatataaggcagttcgattgacgtgttaacccaagcagttactcccgcagtcagccacacaggtacaagtaaaagaataagaccgctaatgaaatgtgccgttaatagatgctctctacgcaaaggtaggctatgatacaaatcggatggcccctgtcgctgaacaaaacgaagcagcatcacgcctgccagcaccggtacggtcattaaaatcaatttttgcaattcattacccgagtttgtgctatcgaacaagctttttaaaaccacttgcggttgttcatcaccaatgctcacaaacaatggcagcggtactgtaaacagcaatcccgccaagtacaatagaccgatccagccatgctgtgtcaagcattggcgaattacgccgccgctacagaagaatcggttggatgtcataacctgcgtcctccatttcataaatgaaaatttcctcaagcgtcagcggcaacaaatcgaatacatgcggctcatacgcttcaattgtctctgcaatccgctctcgctcaccccggataataagcagcagaacactgcccctccgctccttatgtacgaccgaaagttggccacagacagcttcctcatgcatgctgtcccgaaaagcaacctgcaccttatgcgtatcagatttgaggtcgtcgacctctttttccaacagcatccgtccttggtgcataatgcccacatgatcacacatgtcttcaatctcacgcaaattatgagatgaaattacgacggtcatctcacgtgcagcggtttcttggaacaagagatttttgatcattctgcgcatcacggggtccagaccatcaatgggttcatccaaaaccagcagctcaggcatacagctcaaggcaagcaaaaaagcggcttgacgcttcatccctttggaaaatcggtgaagtttgcgcttcgggtccagcttaaaaatacctgttagctgtgtgtagcgttcttcactccaacttggataaatagagcggtaaaaccgggccatctgacgaattgtcgcttgtgggaagaaatagggagcatccggcaaaaacagaatgtgctgcttgacttcaggctgctcatataccggctgtccaccgattaacaccttgccaacatcgggtcggtaaatcccggcaataattttgagcaaggtcgttttcccagctccgttcgagcccagcagtccaaaaatggagcccttctttaccgtaagggctagctgatcaacagctttttcttctgtaaatgtctttgtgacttcccttaattcaatcaagggacatccccctttcctttgtttgtgtagcttccacgtatatgccgtccacttcctgctgtgtaaaaccgaaatggacagcttcgatcatttgttttaacaatgccgcccgaatctcatctcgcttgatttgttgcggctgctgctgggtaggcgtgacaaagctgcctttgccttgaacggaatagatatagccttcacgttccagctcacgatacgccttctgaatcgtattcggattcaccgtaagttgagcggacaatgcccttacagaaggcaattgctcatcctgctgaagcgatccgtacacgatcatttcctttaccctgtccataagctgttcgtagatcggcttgcggctgcggatatccagctcgaacatggacttcctccttccaacactggctcaatttcaatttatataggttaactgttctaactgtactattgacgatagtacagttagaacagtttgtcaatcttttctttggacatttcttacaaaaatagccgtgatgcatcatgcatcacggctatctcttattagccttcctttgactcataaggttcatcacggcttatattcgcaagtgttgaaccttccggcagcttaagattcagctggaaccggaacgtcgctcctctggcctcatcgctatccacaccaatggaaccccccatcagcttaaccaagtttttacagatggacaatcccagtcctgtccctccatattttcggttcagtgccggatgaagctgggaaaaaggctgaaataatagatgctggcggtctgctggaataccgattccagtatccgttacactgaactcaatcaggcatctatttttacgacggctgtaagcctttctctccacaaagatatttacacgccctcgctccgtaaatttgatcgcattgctcaccaaattcaccagcacctgtcgaatacgcacatgatcaccgaccagcatccccggcatttcctgatctatatgccattccagttcaatgcctttttccatagcctgcgtcatgaataggtcagccacactgccgaccacatcatctagcacaaaggactcgtgaagcaaagacatcttgccagcttcgattttgctcaaatccagtatctcattcaatatctgcattaaagcaccgctgctgctggtaataatgtctatatagctacgctgctcctcatccaattcagtatctgccagtaaccctgccatgcctataatgccgttcatcggtgtacggagctcatgactcatcacagagagaaactctgacttggcccgatcggcgcgttcagcagactccttggcccgaatgatctccttttcattcgtcctgtctacaaaaaccattacagccccttttcgctcgccattatccatcaaaggactgattcgataggaggccagaaagctggacccgtcttttttccaaaatacagcttcctcagcctgataagaggctccgcttcgaatcgcttgaagaatagaggactgttcgtctggaaaatgactgccaatttcgtcagcatggcggatcatatctatgcatgcgccattcagcggattggccgaacttacaccgaacatctcgacagctgccgggttcataaagcggacatgtccttcgttacttaaacccacaattccttcggatacggcattcaaaataagcgaatgctcattactaagtttttcaatttgagcaatgtagcttttgagaggggtcacattttctataatcccgtagcagcctacaatttcctcttgcacgaaaatcgggatattcgtcatcttaatgaatagacgctccccctccttatgtatgaattccgattcataggtttgcgtctcaccctgcttggccagttccatatgacgcttgattttgtcctgttcctcagaggaagccatgataagtatgtcagccccaagcagctcatccttcgtataacccgtaagctccaccaagctcggattcacactcaagatatgaccttccatattcacggcgcatatcccaagtggattatgctgaaacagtgacctataacggttttcactttcgcgcagacgctgctccatttcccggtgctctgtaacatcctggatcataccaaccacttgaacgggcttgcctgcatgctcgtccatttcagcttcccagattgaacgcagtaccttttgttccccattgggcaatacaatccggtaaaaggtttcttcgtgaactccctttaatataacgttggtgataatctgtttcatgcgctctgtatcttctggatgaacagccgccatgagcgcgtcaatacttgtttcaaccggcttgacaagataaccaaaaatgctacgaaattccttggagaaatgcataacattgttgaccagatcccagtcccatgagccgaacatcgccaactgctgagcttttgccaaattctcctcgctcttctggcgctctgtgatgttgcgtccgatggacagtactcgcttgatcctgccctgttcatcccgaataatgcggtacgatacttccagccacaaataatgcccgtccttatgacgtacacgccgcttcatgatgcctgtttccttgaacattccatgtacacgcatgtaatcggcatcttcgatatggtaaaattggagccgctttttgccgagcatttcctgctttgtatagcctaggagtttttccaccgaaggagaaatatattggagtatgccgtccgccgtgctatatgagataacatccggcgtattttccgtaatcagcatgtacaaatcctcattatccgagagcacctgctccatatcttttttctccgtaatatccattgcatacgcaatcaaataagattgttcggtagcctcatcatcaaatatggttaattccagcgatagccagacggatgttccccgtttatgtttcaaacgcagttctgtcttatagacttgatctgtagcctttagccaacctgcgtaagcctccctcaaccctcgctgatcctgagcctctttatataagagatggtaatatcggatatctagtaattcctcctgctcatatccgaccattttgcaaaaggcgggattgacgtacaggcacttcccctccctcgacaaaatcacgattcctgtcggggcatgattatacatatgttccagcaaaggcagtcgtcgagcagcagaaaacacaatgaatctcctcctttgtggtccggcagtttttctaactatacctattctaacatgatatggaatttttataacggtgagtccgcctctagatgaatgcccttaaaacatgtatgcacaaaagattgccgatgcaggttcatcggcaatcttcgaattatttttttataccacccggctaagaaaatgacgcaaaaatcgctccgcatcgactttaagtgccacgtcaaccgtagtcagtgcttgagcttcgttctcattttgcacctcacgggtgcgaccaacctcggtggaatcgcccacctcaacggcaatgtgcattggacgcgtctccacaaagctggaatctatcgctaatcctacagccagtggatcatgcaaagcacagcctgcaataccaggtctgaagttgcgataagcttccatataaaagtctgtcatatctgccataaacgcacccagctcggtcccttgctcacgccatttgtccacatcctgctgtggaagcagtgtttgcatcgtgacgtccagcccaacgagcgtaagcggaaagcccgctcccagcacataggctgcggcttctggatcggcgtaaatattcgcttcagccgtcggagttacattccctttcactgtgaccgcgccgcccatgatgatcaggcggtcaagcaattggggtaattcgggacagcgatccaatgcaatcgcaagattggtcagcggtcccacagctaccagggtaagtttgccttcatagcgacgagcctgtccgattataaaatcagcggcatccccagacgcagcctgacgggagggcgctcctttcaactgattgccaataccgtcttcgccgtgaatatgccgggaataaggtttgaacagctcccgagtatacggcttgtgagcgccagacacgaccggagcctctacccccagtttttccagcagaatcagtgagttgcgtgttgcctcctccaccgagatattaccaaaggtggttgtaataccgagtagctccaattccggcgaatggaccgcgtacgcaatagcaagcgcgtcgtcaatgccagtatctacatctaagattaactttttgctcatgatgaccctccactgtagaacagcattcttttgttcattatacacaatttcaatgcttattcccttggtcatcaaattctttattcgaagacgtaaaaaaggctacgacagttatgccgtaaccttcttttaatacttttcaatcattcaagggcacatgttctgaccaaatcctaaggctcgattccccacaccagcttatcattgtggaacaacgttgctttgttccattctgcataagaggttttggttggatcgaaggagtaatcattggattcgtccagattagaccagtcgctattgttcatgcggatctgaatatcacctgtttgcgctccagcagcaagcgtgccggcagccgcactgaaaccaatttcaatatagttgtcagtaaaggtacgcagcacgttatcattacctacttgcgcatagtctactgcagattgcagctcttggctgccatctttcgtgaaatagtaacggattttcagctcactcagcttcacaggtgttgttcctttatttttcaagttaaagaaaggcttgactgcgttattcgctggatcagtgtccccggcccggtacattacaaccagatctcccgctggttctgtaggatctgtagggtccgtcggatctgtcggtgtacctttaggttcagcacttaccgctgcggaatccttacttgttcctttcgcattcgtagcacttacaacatagaagtaagttgttccgttcgtcagtcccttatccgtgtactctctttccgttacaagaggcgcaacggctgtaaaaggacctgcttcgctagtagcacgtttgaccgtgtagctatcggcaccagtagacgcattccaagtcagcgttacttgagcattgcccacaacagcctttaagcctgacggtacagccggagctgtaggcgctgggtccacaccaccagtggaaggcacgatagcagggtacgcattttgtaccagcatcacaaactgatcatggaaccatgctcctgaaataggtgcattcggtaaagcatctgttaatgtgccatccttggttgtataggtaggatcacacatacggtcaaagcctttaccctcatcgttcggaatgagtgagctggaaccatcggaatcacccggaggtttcgcccagacataggcatcgatatggccagctggagccgtttgtggcggcgttcccatacctgctccactgttattacaccagttaccacggtgtgagcgtttgtctacacggcctgagtttacataggagttaatatcattgccgactgcggaagtcggacggttaggtcctccccatccattacggcctgtatcaattaacataccgagtgagctcggccagcctgcgctgacaaaatctctatgcaatgcctctgcgaaatccgattcatcgaaattaggattccattcgtagtacttggacgatttgatcggctgtccgccgatattcagatttggatcaggtaaattaggttctgtcagcggtgaagtgttggctgtatttgtgataaagccatctacactggccagacctttgctagtatctttgaaaatggttgtaaacagggataccgttgctgaacggttgttatcccaacctaaccaaccagagtgaccgatatctacgtatttgtacacattcggaatctcgttcagcttattcattgtgtacttcacgccagcttcatagattcctgtagacttggcttgtgcacatttcggatcatccagattagttaccagatttggcaaactgtctggttcaatgatcgctacgatacgaatatccttatatttgggatttgcaaaaatagcagctattttgtcaatataatccttcttataggtttccagacctgcctgggtcagcggcaattcaccattggaagccaaggcatgacaatcccgtccgggcagatcatacacaataaattccgccgtaatcggtgtgctgcctttcttttgcgccaatacttggtccaaatgcgcttccaggccaagcttgcctccaccgccgttaatagcagcgatacgatcaagccatacggctgtcggaaatgttttgaccgtttgcatttttgctttcagattggcatccgtaattttggcaatcgatgtgtcgacactagccgcataatcagggctaatgtattttgtagccccttggtaaggattgtccacatgggattctgcatgtattttatccgtaaatcctgcacctggtagaaagctgcttgcgacgagtgatagcgcaaaagcatacttcatgcttttacgaagcacttgctttgttttcaattgcttcacctatctttccgtggattttgttgaatcttcctatgtcggcacctgattgttacatgattaaatgtgagttacgcctactctctccaaaaaaagcggcgttcatagttgtaaaaggtaagcgctttctatttgttcatgcgctcacattttcccctttttgtcacctcctatgttagattatagtgagctggaaatctgctgtaaattgaataaattaaggactacattattaattaggcatatgaattgccaccctagtggttcatcgcggcccctctttttctgaagtcggtttcttcatttgttgaacatccctgctataacaagctttcgggagatttaggatcgacggcaaaagagcaaattcataaaaagtaagaccgtattctttaatttccgtcagcctaaatcgacaatgataaacttcagcacgccaactgtgccaaatcgttatatctatcgacagcaaaaaggtgctttcaggccatcatgaccatgaaaacaccctttaattgttgtgaagacaatctctgctcttattgttctacactttttcgcgatccttgcctttgtcggattgccctgcatttttattggcggcatcccgatccagttgcatttcttcaaccgtcttcaccttaagtcgtgctgctccctcatagggtcgggttggaatcagatcgcctgcagccagacgttgacgcgcctcggcaatcgctgctccatattgcggcagccatgcttcctgcgccaccagcatctcatcgaccatctgccaaatttctttcggattacacaccgcgcctactagcggatccatcataaatgcttgtcgcagcagcttatcatctccgtgtacagccgcttcaacagccaaacgctggacggaaatacttacattacagacggcagcaagaccgagcggaaggtctcctacatgtggcatggagataccattccgatccacatatccaggtgcttcaataatcgcgtcgtctggcaaattggaaatcacaccgttatttacgacattaaaatgccctcggtatacacgtccggtttccaaaccttcgataatgtatgaaccatgctcttcaccgcgattttccgccttgtactccaatggatcttctttcatccagttagggaaatctgtttcaaaccaattacgtccttctgtacatacacgcagatagccgcctgtttctccattgatccagctgcctagatcaatccagtccataatttcattcggacgcttccggtaccaaggtacatattcactgagatgaccattcgactctgtgctgtaatagccaaaacgacgaagcatgtcgatgcgtaccttttcggtgcggctatattcgggatgtttttcaaaaacctccagcagtccggctgtcagatccttgccttcatgtgacgcctgaatgtaccacgtctggtgattgattccggcacacacaatgtccacatcctgcttctccagaccatacacctcggcaatttggtgatgcccatgctggacgccgtgacatagaccgattgtacgcacaccgctgtatttattgcaggcccacgtcatcatcgccatggggttcgagtagttcagcagcaatacatccggtgcacttagctcgcggatatccttgcaaatctccagcatttcagcaatgccgcgctgaccatacatgatgcctcctgcacacagggtatcgcccacgcattgatccacgccatatttcagcggaatatccacatcggtcgcaaaggcttcaagaccgccaacccggatggtacaaatgacgtatttggcatcctttaaagctatctttcggtccgtagaggactgtatttgtatcgataaaccgttctccagaatatcccgttggcacagctcagtgaccatatccaaattgtgctgactgatgtccgtaaaagccacttcaatatcattaaattccggcaccgttaacagatctcgtaaaattccacgggtaaaaccgatgcttcctgctccaataaacgctactttaaatgacacggcattcaacctccggtaattagaatgggtatataccgtcattgtagcaataggctcgtagaaagcgttatcaaaatcatgaccagtttcgtatttaggtgtcaaaaatcctaacttccgcatcaataaatgctgcttgccgttgacgatagctgcctacgcttcttttgttgctgtataatgagttaagtctctaaatattgacaaaggagcaatacatgtcaaaccgtaaatggacatttatccttatccccgtcttcctgctatttgcctggctgctctttcagttcactctgtcttcttttcagattcaccaatttgcagagttattgaagacagtttctccaaaagacggggtttccgatacaaaagtcgtactgatatcacaggagttggataattattactggcggtcaatcgaacaaggagcccgaaaggaagcggaacagtacggtatgcggctcgattatatcgggccggaccgcattaatccgtccgagcaggtcaaactgctggataaagcgatcgccagtaaggcggatgcaattctggttcaggggataaatgatccagagtatcgccgattaatcgacaaagcagccggacttggcatacccgtcatcacgatcgatacggatgaaccagactcccgtagactagcttacgtgggaacggataacgaaggagcaggaaaacggatgggcgcgctattagcgaaagcctctggagagcgtggcgacatcggagttatgatcagtagcgagcgtgtcgagaatcagcgactcaggcttgctggatttcgttccgtgatcggtcgttatcccaagctccgcattgtggagattcgctcctcaaatatttcacggcttcaggcagcacagcaagctcagaacatgctcacccggtatccgcagatccgctacatggtcggattcagtgcgctggacggccttggcattctggaagcctcggagcggcgcggcgcgcggagtttgcagattttcgcttttgacgatatgaccgagacgttggaagccatcagagatggcaaaattgaactgaccattgttcaacagccagaggaaatgggggctaaggccataaaattgctgaatgattatctaaaggggaatgccccccaggaattaacctacaccagaatatatgagatgcatgcggacactcccgacaacatgtccggagatgacagacgatgacgatcagaacgaagctgcttctgttcatccctcttctagttgtgttcgccaatatcatcgcttattttgtattccaaagcggaaaggtcgtacaacagagctacgatgaaatgcttggccgaattctcctcattgagcaaacctccgaatcggcggagagcaacttaaagctcctatatgcctatctgcttaatccaagaggcgataaggctgtgcagggtccgacagaataccaattaatgcagttgaaagccagaattcaggaagtctccgactcgaccgacccttctttcgccgaagaggactacatgaatctgttggccacatttcttgaacagaaacaagccgcagttctggatgcaaaggcacaagatccacaatcggcttttgaacattatattgaagcggaaaaaaccgtcagctatattcatgaggagggtcagcaactgatcgatgctgaactggcttattaccggccaatcattgagaacatccggaacaagaatgagcgaatgaacggatggggagtcgcgttgttcggcatgaacgcgctgatgggggggttgcttgcaatctgggtctcgcgcagcattactggccctgtcggcagacttgtcggactggcgaagcgaatcgccacaggtgatctgaatattaggccccaaccgcgacgggatgacgagctaggcgtactgtcggacgccatttcgcaaatgtccaccgatttgagcatccttatcgagaaggataaacagagtctggaaatgcggcggcttgtgaaggaactggagcttctggctctgcaaaatcaaattaacccgcactttttatttaataccttaaatgtgctctccaagctggcgatcctggaaggggcggagaaaaccagcgacctgatcgtttcgctgtccaatctgctacggtacagcctgcagaagctggacaaacccgtaactctccaggaggaactggatcatatccgcgaatacgtaaccatccagcaggcgcgcttcagggacaggattcgctttgatcttcactttgacgcttccgtacttcagcagcaaattccggccctgacgatccagccatttattgaaaacgcttttcttcatggtgtggaagatatggaaagcggagccattatcgtgttaacgctgtcgagagcgaacgaagatgtacaaattgaaatttcggacaacggaaagggcatgacggaggaaacccgactgtccgtactccgtcttaaaggcgaagccgaaagcggcagttcaacaggacttggaatgcaaaatgtgtttaggcggctgcagttgttttacggaaaggaagaagaaatggttgaaatcaatagcaatatcggacgaggtactaccataaccatacgaattccagtcaagaaggagagtgagcggactgatgtatcggttgttgatcgcggatgacgaggctttggagagggaaggactggaattgacagtggaacgggcgatgccggggatattccggtttattcatgctggcaacggccgcatggcgattgaatgcgcggaagagcaccgtccccatattgccattctggatatcaatatgcccggaattgacgggcttgaagcgcttcgtgaattaaaggagcggctttccgatacccgattcgtgctcgtcactgcctacgattattttgcctatgcccagaaggcgctctctttgggcgtaaaagaatatattctgaagccggcgaagcgagaactcatcatcggcacattgaaacgactgattgaagaaattgagtgcgagaagcgggcacgtacggaagaattggagcttaggcataaaatctcacagctgatgccgctcgcagaaaatgagctggctttaatgcttatggtcgaccagaccgtggattcgagcgcttcccagctatcagaatggctggactttcctcttgatcagggaagcgccatcattgccgcctttgacggatatacggacgagcaggataaaaagaaaatttacgatcatttccgaagctatgtaaaaacgcatggcccgaatgccattgtaagctctttgatcgaccatcatgtagccacttttttacgcaagccgcctgccactagcgaaaacgactggcgccagttggttaaacaccttgttcagcagctctccgagcttacccagcagcaacttggtataaagacagccattggaatcggatcgctgcataacggcgaggaaggacttcgcaaatcctattttgaagctgtttttgcctccaccctacgcaaacgggatggaggttactgccactttgacgaactgaagtcatcagaggctggaaacgcttctttgcttgccgtcaaagaagagaatggaatgcttcagcagacgtacgtcatgtcagcactgcaacggatacgcgaacagcgggaggttcaaacactgactatgctgggtagggcgaaaatgtatattgaggaacggttcaacgatgatctttcgctggaagaagtggctgattttgtccatttgaatcctcactacttcagcaaaatttttaaacaggaatacggagaaacattcatcgactttgtaacccggctgcggattgataaagccatctctctgattaaggctggcaaccttactcttaaggaaatcagctttgaagtgggttataaggacccgaactattttagtcgcgtctttaaaaagataacgggcgttcctcccactgagtttaaaggccaaaaatagtgagattcatccatgccgactatcggcatggatttttttaagctcgaatgacaaggtaatgctaggttcagcccctctatctccgattcgggaaccgaagccaaaatcgtgcatgaaaaggtccgtttattgaagacgataactggcctttcttttataagcgcatgttatacttctcctcgaagaacggaatgaggttccagagatctggaggggagatgatcatatggcagtaatcatcaataatgaaagcgctaaacagaaagcgcttcaatcagaaaaacccaatatgctttttgtgacgttggtatccatcgtagctgcgctcggaggcatcctgttcggttttgatatcgcggttgtttcgggagcagtcgaattcctacagcagcgtttttcgctgagcgaatttcaggttggttgggccgtttcaagtctgattgtcgggagtgtcaccggagcagctctctccggctacatgagtgaaaagatcggcagaaaaaaggtattactggccgcgggatttttattcgtcatcggctcgatctgctctgcgcttcaagacacgttcaccgggtatgttatctttcgcatgattggcggcattggcataggaatcacttccaccgtttgtccggtgtacaacgcggagatcgctcccgccaaataccgaggtcgtttggttgctttaaatcagttggcgatcgtaacagggattttcctggtttattttcagaattcgtggatcgtcagcatgggagatgaagcctggggtgtctcaacagcctggcgctggatgttcggagtgggagccgttccgggactgatctttatgctcttgatgctcttcatacccgaaagcccgcgatggcttattaaacaaaatcggccctatgaagcgctgccgattttgctgaaaattcacggtgaagaagccgctaagcaggaagtgcttgatatcaaggaatcattcaaaaatgagaacaactcattgaagcaattgtttgctcccggtattcgggtcgctctctttatcggtgtcatgctcgccattatgcagcatattaccggcatcaatgccattttgtattacgcgccggttatctttaaaggaatgggactcggtacggacgcttctttgacccagaccatttggatcgggttgatcaatgtgttgttcaccatcgtatccgtatggctgatcgacaaagcgggacgaaaagtcctgctgatcatcggcacctcattgatgacctgctgtttggtcattattggagccgcattcaaaatgggtttgaccaccggaccgctcgtactcatcctaatattgatctacgtggcctcctatgctatatcgcttgggccgatcgtatgggtcatgatctcagagatctttccgaaccgcattcgcggcaaagcggtagccatcgcttcgatggcattgtgggccggcgattatctagtatcgcaggcattccctcctctgctgagttcagccggcccgtccaataccttctggttattcggagccatctcgttgttcgtcgtagtctttatatggcgcaaggttcccgaaaccaaggggagatcacttgaacagatggaaaatatgtggcttgggaaatgacccaactttagccacgccctctgagtcataccgaccttaaatcggcaatggttcagaggcttcttattatcagctcctatcctcctccgcatagttcctcacattgcgctccacagctgagcggtattctacaggggtttggcctgtgtgctttttgaacaacatatgaaaatactgcctgctggccacgcctacataatcggcaatttcttgaatgggaatgtccgtttgctgaagaagcatacgggccttgtccattcgcagcatcgttaaatacgcggtaggcgtttgcccagtatgttttttgaaaatacggtgcaaataacctgggtgcagattcacggctgccgccatgtccttaaccacaatatctcggtcatagtttagatggagaaattcaatgcatcgtttgatgtacatatccgtttgctgcgtgttgctgcgctctgcctcttcccgtagacgtgcaattcgtactagcaattgcataaaaagcatctcggccattgcacccggctgttcttttcgttggtccagctccagcacgagacttttcagcgcataatatacctcttccgggtccgatagtaccaaatacgggaacggacgtgacatgagcgtcgtgacctcctgctcctctgctgccatttgtcggatagacggtcctactctcactccctccgaaaaaccaaactctacatttagcatccggcacggttgttctccttccaccaccagtcgatgcggtacacctgcgtctagcataataaactcgcctttacgcagcgtgatgctttcttccacattctctcccgtttgtacatctaccctgcaaaagccggaaatcatgtacataatttcggtagaatgatgatcgtggtaagacatggtatagtcatgccattgcttgtaatagtaagcaaaaaaacggggaatataatccctgtcacgcagccgtggctcaaacagacttccgttcatccccgcacctccacaaaatagataaggctaacacgacaacgtatctgcaaccgctctattttcacagtttaacagactgagccatgtacttctatttcactccatcggacgatctgaaatcctctggaatatgacaggcgacttctgcctaaaaggttggggatttatcactttctggacttaaatactgaattaacattcccacaaatcggttagcaatttctatatcatcaagttcgttattccaatcgtccttggacgtcagactcattttctggagtatacccatcatagacgtgaagataaaatgagcggtctttaagggttccgtatcagacttcaatgatccatcttggaatccagcttccagagcatccatcaggaaatgtcgttcctttcccctgctaacaaaatttttgtactgttctttgagttcttgatttgaatcataagcttcgtaatgcagatcgaataaaagaataaacttgatgtattccggatgttgccaagcgtaatcaatccatgcatcaagcatcgaagtaagcatcttcttaccgctcatttcggctgaaggtgcccttctaacaaattcggtcatgctctccaggatttccatctggacctcaaagatcagttcgttcatggactgaaagtgcttatagaatgtgacccggcttacaccagccacgttgcatacatccttaacattaactttgagaaagctttgcttcataaaaagttccttcgcagccgcaatgagctcttcccgatttttgtttttcaaattctggtgccagttctcagtcattagcaaccatccgtttctcattttttggtttttgtaaggttaagaaaagggcagatgcaagaataagtgcaccaaaaatataaggaatatgaatgtgcttgtcaaacaacaaacccgctaaaataggccccaatatattgcctaggctagtatacgtcgtattcaatccggcggcatatccttgacgatcaccagctgagttcgcgatcattgtacttacggttggccttaggaaggcattaaaagcaaaaaacagtgccgataccgccagcaaataacctaaattgatcttaattatcattaacaataaagcgatggctgtcatgatcaaagagagacgtattagcttcatctctccaagtctcttgatgagataatcgagcagccatatctgcacaacgatgcctataattgcaccaaccgtaatgatcattgagattttagtggcatcaaaaccgtattttcgttccacaaaaagagcatacactgtttcgtaattcatcaaacctaatgtcatgatcagaatgaggagaagataacgaaaataggatgtccgaaatgaatttaggatttggttgcgaattggctcccggcggacccattggctagcgggttttcgtttttccttgggtagtgtctctggcatatacaagctaagcagcgtagctacaagtccaagtccaccagcaaaaaaatagggcaccctgatgccaaactcagcgatcataccgcctaaccccggaccaagcaccatacctaaattcatggaggcacccaagtatcccattcctttagctcgggtttcagaagtggtaatatccgcgacgtaggccatattggaaggaaccattagtccaatacctatccccccgataaatcgggcaatatatagaagaggcaatgtcgtagaaacagcaaacatgagatccgagatgaccgttaaaaacagaccggtgatgatcatggattttcgaccccatctatccgaaagctgcccacctaggggcgaaaaaataaactgtgctgctccaaaagcggcaataagataccccgcagcagctcctgccgcattaaattgtttcagatattcaggcagaatgggaatcaccataccttgacccaataaagcaataaacaaattcagcatcagaatgaaaagtggaaatgtagcagacttaggtaagctgctcatatttgtaaccccctccaaccatttacactatgtaaccctttactatgtgtaaaccatattagttgaaataggggccattgtaaataaaaatacaaacctattaagcctagctattgggctcctgttttgcaaactcctgtaacatgcctcttatttgttctaccaatttagcaggagctttcttgggtgaacccgtgtcacatgtcttctcccaattcccatgccaaaaccagaacaatgacctttaggagtacgtacctataaaaaggcatacttaaaaaggaccaccccggggtaggtagtcctttttaagtatacctgcaaagctgttaatcgcgagccgcttaagagctttgctttctcaactgaccataatataaatcactgtaaaagcctttgtgagccagcagttcatcatgagaaccctgctcctccagacggccatccttcaagaccagaatccggtcagcctgacgaatggtattcagccgatgcgcgatgacgaaacttgttcgaccctgcataagccgctccagtccttcttgtatcttcatctctgtaatggtgtcaatgctgctggttgcctcgtcgagtacaaggatagaagggttggccaaaatagcacgggcaatagccagcagctgtttttgcccttgactgatgccgctgccattcacttccagcaccttgtcgtatccgtccttcatccgcatgataaaggaatgggcgttggccaatttcgatgcttgttcaacctcctcatcggtggcgtccagtctgccgaagcggatattttcacgaatcgtcccctgaaacaggaaggagtcctgtagcacaaatgccatacgggaacgcaagctttcacgccggatggtaataatgtcgcgaccgtccagcgtaatcgttcccttgtcggggctatagaatctggaaaggagctggatcagtgtcgttttccctgccccggtcgggccgactagtgcgatcatttcaccaggtttggcttcaaaagaaataccttccagcgtagcgcttccctcatcataaccgaaggaaacatccctaaaccgcaccgccccctttacatgccctacttccactgccccgcgttcatccttggactcttcatcttcatccaatatttcaaatacacgctcagctccggcaatggcagacagcagggtgttccactggttagccaaatcgttcagcggtctggtgaactggcgggcatattctacgaatacaataattgtacctatagtaatggagccgcgaatggccaaaatcccaccgatccccgctacaatagcaaagctgagattattcagtccgttcatcagcttcggtatgaagcctgaaatcgtttgggcccagaaacccgacagccgaatacggtcattacgctcgccaaaaccatagatgactctcttttcctgcgaaaatgctttaataatctgctgcccggacagcgtttcttcgatgtatccgttcagttcgcccacattcttctggcgttccttatataagggcccggtacgacgtgtgatccagcgcatcccggcagccattaacggcaccacgataaaagtcagcagggtcatcagcgggcttaaccacagcatcaccgtgagtgtaccgattagcgtcaatatgctcgaaaaaatctgaatggcggagctgttcagcgtagaactgacattttcgatatcattggtcaaacggctcatgatctctccctgctgacgtttgccgtagaaaggaatcggtagtcgatgcaaatgtgaaaacagatcgaaacgcatgcggtacaccgtctcttgggcaatctcgatcatccagatattttgcagccaggaggtcagcgagttgagcagatatacagctcctaatccgatgagaaaataaatccacgtgcgtccacctggaccttcgagaaaatcatcaaccgctacgccgaccagatatggacccagcagagctagcccggagctgagcaggaccatgaacagtaccagcatcagtttggccttacggcgagccagataagcccatatccgtcctaaggtgccagaccagttcttcgctttggccttgtggcgtccttcagctcctgccggatttcgcagcacaccagacggcggtgtaggctgacggaacggttcaatgagttccttaaacatgcgactcctcctttccatattgtgattcatagatacgccgatacagatccgaactatccatgagatgctcatgacttccacttgccatcaggcgaccctcatccagcagtaaaatctgatctgccgatgcggtcgagctgatcttctgcgtaatgagaaatgtcgtgcaggacagaccatcgagtgcattcagtagtgctgcttctgtccctacatccagcgcacttgtgctgtcgtccaaaatcagcactgccggctggcgcaccagtgcgcgggcaatcgaaagccgctgtttctgtccgccagacagattgacgccacgttgcccgagcatcgtgtcatagccttgcggcaagcgttcaatcatattatggatttgcgccatgcgtgcggcttccttaatttgctccaggctggcattctccagcccccaagcaatattatcccgaatcgagccggtgaatagcagtacctcttgaggaacatagccaatcgcctctcgtaatatggacgcatccagttcacgagcgtcctttccgtcaaagcgcacatgaccttcatcttcttcatacagacgtgtaatcaactgcacaagtgaagattttcccgagccagtggctcccataatagctatccgctcgcccggtcgcgccctaaaagagatatcctttagtacagccaaatcactgcccggataatgaaagctcacccggtccatttccacctgtcccttaatccgtgtatgatgtgttgaaacagactccatctctgacccatcttcattagatgtgtccaatatctctcgaatccgcccggtagatgcagttgcccgggaaaatacaacaacgatacctgataaggcagacaaggctcctatcgtccgcagtgaataattgacgactgcgaccacctgtcctacactggcatccccagtggaaatttggccgcgtccaaaccaaagtactgcaataatccctgcattcatcgtaaacaaaatgaacggcatcgtcgtttctgtccagcgtagagcggacaccgtccctttcatcaattcgcctccataatgggcaaaacgttcgatttcatgccgcatccgcacaaaaacccggatgagccgaatgcctgtcaggttctcctgaatcactccgttaacgtcatccaggcgacgctggacacccttaaataaagtgaccgttcgccgcatcatcaccagcacaaacacgaacagcaccggggccataaccgccaatagcagcccaagcctgaaatgtacaaccagtgccatcacaatactgccgatgactacaagcggaacccgtgtcataaaccgcaggctcataaacaccgtatcctgtacttgcgtgacatccccggtcagacgcgtaatcagcgacgaagtggcaaaacgtttaaacacaggatacgaaaaagattgcactttacggtacaacttttcccgcaaatcatagccgaagccctgacttgcatgtgaagcaaaaaaagagctggatatgcccgccataaaagcgataacggcactccctaccagtacactgccccataaccagacgacggacaaatcctgctgtcggatgccctcatcaatgattttagagatcaaatatggctgcgatagctctaccgtcaattccagcaacatcatcacgagcgctgcgatggctggaacccgatattttttcagaaaagaaaacatcattcccacaagcattcctccaattgccccatagccgtccttccagatcagcgtgtcatggttataagattcgaacctgtctgctgtagaaccatatatacgcactttatacagcactatattttattatacccttctgaacggcttcgtttaaccagcaaattggagactccggttgtgaaattaaaagatatacaagaaagcgttccagtcacggtcacacttaccggacgggaacgccttttcggttatttcggcagctctgccggataatactgcagccagcgccttaaatccgcgctatggatgacacgcttgggatcttcaccgactaggcgaagtcgctccagcacaaacttgatttcaccggagcctgcctcgattccttcctgctccagcatatattgaactgcacttctgcccgaatgcttgccgagtatgaacgaatggtcagtgcccagctcggttggatcaagggcctgataggcggcacgctcctttagcagaccgttgatatgtatgccggattcatgggcgaataccatgtctcccacaattggcttgccttcgggaacgattcggttggaggctttagacaccagtgcagccagcgggttcagcagttcgggacggacgctgcaggttccttgatataggtccctccacgacatcaccacctcctccagcgccgtattgcctgctctttccccaagtcccgacaccgtggtactggcccagacagctcccgcctgcaaagctgccagtgtattggcaagcgctagaccataatcattatgacagtgaatctcaagctccacatcctgcggcatgcgcgatacaagcctgtctatacgggcagctatcgcagcgggatggtgaacagacagcgtatcggcatatctgaagcgccggatgccatccctgtagagctgattcgccaactgctcaaggaacaggtcatctgcccttgaagcatcctcaaagcctacggaaacagtcaatcctttacactgaccgtaatcgacagacttgcggatcagctctgtcacctgctcaggattcatacccagcttggccttcatctgcaccgtcgacacgggaaccgaaatatgggcccagccgacgcctgtcgattcagctgcatcaatatccgtgaacaccgcgcgattccaggtcattagcttcatttgaagtccgagagcagcaatcctggcaatagacctgcactccgcctttcccattgccggaattccgatctcagcctgctccacccccgccgaatccagcatgatggcaatttcagttttctcctcggccgaaaaggcaacgcccggagcctgttctccgtcacgaagtgtcgtatcacaaatatgcaactgactcatctatatcccctcccgttccgcagcaaggacaacacgggttgcgtttgactgctatggtgcagctgctcatatccagcacattcatacggtacatacggtcagtgaacagattgcccgcatctgtaatccatttgaccgcttccagtgcagccatacagccaatcaaaccggaggtagctcccagaaccgggaatcccagaggctcccaaggctgtccgccttccgggtagagacattccaggcatgccgtcctaccgggatcaatggtcatcaatgatacttcataggcgtacatggccgcttctatcatcggtctgctatgtcgaacacatagtctgttcagcgcatatctttccggaaagtcataccgtgcatcaatcacgatatccgccgcttctacccatggtccagaggatccttccgtgattctgtgggcgtagccctcaagttgggtctctgggttaatacgatgcaaatgctgcaatgccgtctccatccgttcctccccgattcgtccgctgtccatcagcacctgccggttcatatcgggtaaatggattacgccctcatgggccaatatcagctttcccactccggcagcggccaggtacatggccgctgttcctcccaatcctccgatgcctgcgaccataacagtagcttgctttagcttgttctgaccttccactcccagcagcttcaactggcgtccgtatctactgtcttccagcagctgtaccattctccaccccctccatatgcggccccgcctttaagatattcggtccgcaggatcttgacaccatatctggtttctcttccttacagaaggctcatgattcggctttgccactgccctcctcagcatgcaggattttggcaagccacatgggcggattacgagccagcatattctggagacgctggacctgctcctcaatggtgctgccgaaggccaccttcacaggcataatggtccgcttggtaacctgtgcggcggccgaagcgccgatctgtaccagaaagatcaaggcacaatcctcgatcaggctaattcggctggcgatcttgcccgcctcgttctcatcgctccccagggctatccgccgatgctccaggaactggacgcctgagtgccggatttcgaatacagtgaacataggactctgcccaaaatgagcattcacaagcacaccgtcttccgtcgcaaatgcaaccttcatcctcccttccccctctcggcaagtaatacattgcccaccttattcacccattccatggttccacggtatccgacgcttacggatgtgtgggcgcccagctcgtcatacaccggcaagcctgccggcacgaatgaggcgccagcccgtgccgctccctttcttccatgcgaattgctgatccacaaatcaacgccctgcgcgctctcctctgcgtcatccagatcaccgatccagacttcccgttctgtcttttgcagtgcgggcgtgctgcagggtgttattagccgtttcagttccactcccatctcctccagccaggctgcggtcgacagcatatgatccggttctagcgccactacagcggaagcgccggaataatagaaatgggcatccagcatgctgtccaacagattttcacgctgccagcggaagcgaacaggggctggctcgcggctgattttctgcagaaaatgtatgaatgcatcgctcgcggccaagccagacagacccgtgaacaagtggtagggaatgcctgcggcatgagtcagcctgcgcgccggacgctccatgctcgcgccaatggcaatggtgcaggaagactccagcatctggcaggctgaatccagcggagtcccccctctcgtcaaaggggaaaaacctgtcagcagatgaccggacaaggaagtggagatatcggggagtgtaataacctccaggccgaaggaagcaataatatccttgatttccatgacatctccggcagtcagataagaagccggcagcagattgacctgcgtccggcgctgttttttgggggacttgcctccgactaacccgagtacggcatccactagcgactctactgtactgctgtagcccgtctccagagaaccgtgaaaatcaggcagcgatacagaaaacagcagactgtccttcaatgcccgttctcgcttgaatgcctttaccctagactgaaaatcaacgcctgccacctcggtgagggccgtgctgatcacgccgatgacatctggatggtgtttggaccagatatgatccagcgcctcctccagattccgatctgcatcaaatataacgtccatctcttgcagcgcagaggtctgaacggcaatcggctctcgaaaatggcgagtcagcagcgccttggagaaggccgagcagccctgagcgccgtgcagcaaaggcattgagcgatacatcccctgcagagccagcacgccgcccaaaggctgtcctaccttgagcgggttgacactgacaggcttcgtggcggatttaatcggcaaattccgtctcctcctcccatggagccaatttggcggtcagttcccataccggatgctgtagcgtatgcacaagctgtttcgccagagataacagcccgtcatagcccgcataggctttgtgccgttcttgattgatgtccacaaaaggaatttgttccttaagcgccatatacatgttccggcccccggcaatgaccatgtctgccttgcggctccgtacggtcttgagaatctgccgggcgccgccttccgggatgtattccgcatcatctccgatacggtcagcaatccgggatacatcctcggcagtgcttttattcgtgcctacaccaaccaccttaatgcccagctcctgcaaagccgtaatgacagaccagctctttacacccccggtatagagcactgcccgctttcctttcagctgcttgcggtagggctccagctccagcgatagcctcatttcctcccgtgcggccagcttatccacccgtctctccacatcacgatctccggtcaggtaagccatctgtcgcaaggaataactcgtctcctttgctccataaaatgaaccttcaaaataaggaatgccgtatttacgctccatttggactgccagacccagcaaagcccggctacatacgaccatattggccttggcacgatgcgcccatcccacctcacggaaccgaccgtctccggtaattcgggacaggatactcattcccgcctgctgcatcagccgctcgatatgccacatctcgccggcgatattgtattccccaatgagattgatatcatgggaggttgtctgttccggctcggtgctcccgataatatgctggaacagcacgtctccggccagccgggtcccgagattcttgctgcccacaaatcccgggctgttcaccggaatgatcggcgttcccaactgctctgattcagccttgcaaactccctcgatatcttcacccgtgagggctgtgacgcatgtggtatagacgaatacagcgggaggagcaaagcggctgacaatgtagcggatcgattcatgcagcttttgttcactaccaaaaatgatgtcctgttctccaagatcagtagtgaagccatacgccgacagctccgggccgctggacaggctgcctctgttctcccagctattgccgagacacgcaatcggcccgtgcaccagatgagccgcatctgcaatggggatcagtgtaatctgggccccgtcaaaggagcagccacccgaagcctcccccggcactggccggggacagggcgtgcttttgggaattttgttgccgcaggatacctccagccttccgttagacacagcaggctccatccgaacccccccttatttcagatagaatccattgaaatcacaagccaagttgtcaacttccatctacgcgatacagcaattagcgcactagatcaaagctatgatctggagcctgctcctccatgacatccagtacggtattcacgaattgggtaagcagattcagcgcaccctggtagccgataatcggataacgatgcagatgatgcctgtcgaagatcggaaagcccacacggagcaatggaatttttgcttctttcgccgcgaacttcaggtgggagctaccaatagccaggtctactgggtcctggaacagcagcgaacgcatatgccacaaatcctgaccggaatgaaccgtggcttctgcaccgtaagggctggacttcagcagaagctctgcttccttctcaaatttccggtccccattggagcaaacaatatgcaccggctccattcccagctccagacaaaagccaatcaggccgatgagcatatccgggtctcccgccatagctactcgtttgccgtgcagataagcatgcgaatccatcatggcatccacaattcgggcgcgctcctgcttcaatgcctcgggaatttctcttccagacaagcggctaatctcctcaagcaaccgatctgtagcccggatgcccagcggtgtggagatggaggacacctgctgcccccaggtttgcttcatataacctaatgttttacgaagagagtactgctggatcgccaacgtgcctgcagcatctgcggccttgggcacatcctcaagcggcgttcccccgtaatagtagctgtactctccagtagcccctgaatcaaaattactgctgtggtcacccagaatggtatacgtagcgccgaacatccccagcatgcgccgcatttccgcaaaattgcctgtatacccgtcaaacccgagcagtacattcagcttcaattcatgaccaggctgcggcgtccggcctgacttgttatacagcgtctccagcacagagcgcagcatggcgtcatagcctgtaatatgtgaaccggagaagctgggtgtattggcaaaaggaaccggcatatcctcgggaagggctccctcctgacgggcattggccaggaaggcagacagatcatccccgatcacctctgccatacaggtcgtgcataccgcaatcatctccggctgatacaaggcaatgcagttctctataccgtcaatgaggttgcgcatgccgccgaatacggcggcatcctcggtcatcgaggtggagacggcaggaacaggctctttgaagtgacgggcaagatggctgcggaaataagccgtacagccctgtgagccatgaatgaacgggagcgttttttcgaagcccagcgcagccatgactgctcccagcggctgacaagccttggccggattcacaactacggctgtacgagcgaaattcttatccttgtattccttggtcttggtatactcgagggtggcggtaacctcctctggcgagcaaggggcctcaaaagcccgtttctcctcacgctggcgcacatatttatcctgccgaaacaactgattgtgatcgacaatgttcagacgctcgctcataccgacacctccgcagtctgccgtgatggcagcaggctccatactggactgtttatggtcatatccatatcacgcgcaaaaatcttaaagccgtcaaaaccatgataaggcccgctgtaatcccaagagtgcatttgacggaagggaatgcccattttgtgatacacgtatttctccttgactccggcgcccattaagtcaatattcagccgctgggccaattcctccagttcataggccgttggatcatcgtacaaaacagtgccttcctttacatcgggaaacgtcttttcgtaatcatccttatgggcaaattcatagcctgtagccacaatttccatacccagatcctcataggcaccgatggtatgccttgcccgcagcccgccaatcagaagcatcacctttttgccttccagacgtgggcggtatttacggataaccgtctccatctgcggcatatattgggcaatgacctgctcacatttttcctgaatcgtctcgtcaaagcgggcagcaatcgctcttaggctctccatcgtcttggtcgggccaaagaagttatattccatccagggaattccgtattcctgctccatcgttgtgcacatataattcatggaacgatgacaatggatcagattgagcttggatttatgggcaattcccagctcattgatcgtaccgtcacccgaccactgcgctatgacccgcagtcccatttcctccagcaaaatgcgcgaggcccaggcatcaccgccgatattgtagtccccaataatggagacatcataagggccacactcctttagctcccggcgccccattagaaaatctcggatagcatcattagcaatgtgatgacccagagactgactcaccccgcgaaaaccctcacagcgtacaggaatgaccggaatgcccagctcctctgtcatctttttggccacagccccgatatcatcaccaatcagtccgaccggacattcagattgtacggagatgcctttggccagcgggaacatctccttaatttccctgcagatcacctccagcttcttatctccgccgaacacgatatccttttcctgaaaattgctggtaatctgcatggcggtaaaattatcgatgcccaataccccattcgcataattgcgtcgggtaccccaactgtattgcccgcagccgatgggaccatggctaatgtgcaccatgtctttaatcgggccccataccacacccttggagcctgcataagcacagccccttgctgtcatgacgccgggccgtgatttcatgttggacttgatggaacaggttccgcagttcacaagctcctcatccgcgatctcaaaatgcttggtccggtccttcttggccttctcgggatatacctccagtatctcctctacgatctgctttcccttatccacaatactgctcatttggcctattcctccctcctgcgagctgtgcgttcagctcccccaccatcacacgatgattccgtcattaagccttctggctacagcctactgcccagacgcctcagctttgttaattgcggtttcttcatcctcaataatgccgaattccatcaatagctcctctagctcttccatggaaataggagtaggaaccgtcagcatatcgttattcaaaatcttacctgccagctcttcatactccgcagcctgcttatgttccgggttatattgggtaacagtcatacggcgcagctcagcatgctgcacaacattgtcacgcggcaaaaagtggatcatctgcgtgttcagtcttcttgcaagctctgtaatcaattccgcttccaggtccgtattccggctgttgcagattaagccgcccaaacgcaccccgccgctgttagcatacttcaatatcccgcgcgcaatattgttggcagcgtacatagccatcatctcgcctgagcatacaatgtagatttcctgcgccttcttctcccggatcggcatggcgaagcccccacacacgacgtcccccagtacatcgtaggaaacaaaatccagcccttcgtaggccccctcttcctccagaaaattaatggctgtgatgatgccgcgtcctgcacagccgacaccaggctctggcccgccgcattccacgttcagaatgtcaccgaagcccttctggacaacatcctccagctccaaatcctctaccgtgcccctttcagcagccagatgtagcactgtctgttgggccttcgtattcagaataagacgggtggagtctgccttgggatcacagcctacgatcataattttttgtttgaatttggtcgcgagctgagccagtgtattctgcgaggttgtcgatttgccgataccgcctttaccgtaaaacgcaatttgtctcatattttctcagcctccaaaatgttcaatgggtaaatccgaatgattgcccttaactcccttattgcgcttacttcccttattgcgcttacttcccttattgctctgcacaggatacatataacgcagaaattttacatattccagaacggattcctcaatatccccgccgcatacaataggcagcacgccagcttcctgcaatgcctctttgggggcttcgcctatgccggtcgacagcagcaatgcacagtcatgcaccatgaaaaggatctccttcatcgtctcgaccttgtctccattgcaatcggctttcccatggcagtaggattgcaccttacgaatgcctatgaaatttacgatagtcccgtcgctttcatagatcatgaattccttggcacgaccgaaatgctgattcaccttccctccgccacgactggccacagcgattaggactggctttgaggtaaagcttgcttcaggcttatcctccgataacgggcagctacatccaaccccggttgacgtttttttgtggtgcgattgtccctccttgcgttccattctcactctcaccttctcatccagttctttctgaaattgtgcccttgcctcttcatccatgggaggagcagccgcaatgttctcccatgtaaaatcctgattgcgatcctcgcccagcagtccaatcgcatccgccctgcactgacggcaatggcgcataatgacagctcccgcctcagcacattgctcctgcagctgccggaccagacggggacggggggcccgcatcccttcctgctcataccgactgccgggtgcgatgatgagcggcataatgttgtgcagcaccgcgccgtgctccttgaccaccctggctacctctggcagatgggcatcattgacttcgggaatcagcaccgagtttaccttgcacaatacgcctctcgaagcaagcatcttcaagcctgccagctggcggtcaatcaacagccgcgcggcctcctctcctgcatagcgttttccttcatcgtagacccatccataaatgcggctccccaccactggatctacagcattgatcgtgatcgtgacatgcgaaatacccaactctacaatcctgtcgatatgcctgatcaaagtaagaccattcgtgctgagacagaatatgacatccttaactgtctcacggacccggcggaaggtatcgaaggttgcctccgcattggccagcggatctccaggtcccgcaatgccgacaacggacagttgcatcagctgtgccgctacgccataggtcttgctcgccgcctgctcgggcgtgagcagttcactaacaacgccgggacggctttcattgacgcaatcgaatttgcggttgcaataatggcactgaatattgcatgccggggctactggaagatgaatgcgtgcaaaatagcgatgtgcctcttcgttataacagggatgtcgtctgagggtgtccaaggctaagggagtttccgagagatcagctaaagagtccattcattccctcctctctacgttatattcccttacacaattctctgtttttgtctggaatataattacatcttagagacagggacaaatacagtcaattcgcttctccatgaaatccctgatatttatcctcatttcacatatgtgtcaatttttacgtcaagtaatatatcgtacactttacatgtgcgcggttacatttcatattctcaataacatcaagacgtaaaaaaagagagtccgtaaatacggctctccttttgagacaagaaattcaaattggctcgatccttacatattggtaaaacgcctgccctccaaatacattcacacccatatgtccctcggtaaacgtaccctcttccaggtcgatgacatgctcaccgtctacgtcaatgcgaatgcgcaggccctctgccacgattttaatatgatgaaacatttccggcagaacgaatcttggaaccttggcaagcacctgctgatcctcgaaacggccgtcttttttatagaacagacgaatcgatttcatattgaggtccaaattcaggtaatagccactcgttccgtcagcattggcgcgaaatatcattgatcccgcacttccttccgaatcggaagccgtaacaacagcttctcccggggcaaccgcctccattagcacgctaacgtcctcggacgcagtgatcttgacaatctcaggattgttggagacccaaattacatcacgcctggaacagatcccgttaaccttctacaagccacccgtgctgaggtactccgtcacctgtctctagtgccgcacccgctgcagcaaccaaagaccacttgtagctctagctccagctgcaactattgtaacgcaaacatcaaaatctgaattaggatgactggcatgatactgtagagctaaggctgataagatcacactttatcaaagtaccagtgatgcgatgaatagctttctgccgataataggtaatctctacaacacaacgaacaatcaaaatattgaagtacggcataatttagttcttctaattgatcagagcttaatacaggttggagaacatcgttttgggtaataaaactcattaatgctcttgcgatgctctgataatatgaaggcattgttccatttttttattcatcccaataaactgtctgggaaattgttcggattttcggagtaaaacgagccaaatgagtccaggaaatccaaacagatttttgagtaaatacgaacaattaaattcaggattaatatggaaataaataatatatttaatactatattactatttttttgtcgaaacactacaataagtggaatcttttagtataataaggtggtagttttatacaaatatagggaggaataatcagtgaagaaaaaacatttaattgcgtcagccttatctttaggtttactaggaggagctattgccgtgcccagtgcgatctttgcggattcagatgctgtaactgattctgcaaatacatccactactgcaccccaagatgctggtacaacaactactagcgaccatgttataactcctcaaagcgtgggaaattcctttaactttactgtagggggaagtgcaactgcaccaggcagctttgaggttcctaagggtttcgggtatgttaaattgcgcattagaaactatgcaaatgccccagttgattttactgtagaacacaatgattctggtaaagcgtatgttgacggccagacaatcagcaaaaacagtgaaactgtttggagaagtgctgatgctatgcgttccggacgatatacaattcagttccgtggtggttcaaacaaagttaatgtggaagtatggggcgtagccggttcattgccttcggacgcaaaataatagctgatcaaaacaaagagagcttcagaccttcgtcgtcggtctggagcttctttgttttatttttttaggtcatatcgtagtttgaataaatcttttagcatatcagacaatacaaaaaattagcatttatgtaagaaaaaattgaccactggacagaaaatgactatatttgtattagattgttataatttctggaactcacatcttggtgtacatactccatattacgaaaaaaactatgggaggaagttggatggaagaagttttggaagggaaagacgctacttatttattaacggatcatcatagattggataaatgtattgaattacttcatttgcggttctctcaacatgcctgggaagatatattggccatagccgatcatttgcacagccttgctgagaaaatgtataacgaagcgcaagaagcaagcttgcaaaaattgccttatctctttaaggcagaacggcctttggtattctattacgggttcagctatctggccaagggaacggctcttcaaaaactcggtttgtacgatcaggccagagagtatattttgaagtattcggaattaggctggttttcggggttggacaaaatcggctgggaagaagtcgatcgattcaaattttttgctaaagcaaatctgtatacgaatgatttgctgtctggaaaattgagcgtgctacctgagtatgttcaatttttagaagataatccggaagagttattgcccggactcgtcacgatcatggagacagcttcgcttcattcgattaatatagatgatctacttgaaaaattctcagaaaaaataaaggattttggaaatctcgaagatgctacaaatagaactcactattttagattcttgtatcatcgggctatttactatgctaaacatcaaaggtatcaagattctgtacagcttattttactgtttttaacatcttataatatgattaatgatgcggactttaaaaagtttgttgtactatttgaggtttatcggcagtatgcttcaaataagcaaacagagcagtatcaaaatctttgtaaggagctgttgaagcatgaagaaggcgttagtatctgtgatggtgatattcgctctcgttagtattgtccctctaagtggctttaccagcagcaacacaggatcttttacaactttttcaccagaaaatcacggttggaactaaatgtgattttctgtaatgagaaccatcagtgttggggaagtcctcctgacattgatggttctttaatatttggggtcatatgcgaccactgacgctttttcgcaatcgttccgtcctctccgctgctttcagcagatctgctattttagaggtggtctaaaaccagaaatgcctacatggatagagtcgtctatactcttaaacttttgaatacaaaaaggcaagcctctaaaattcagaggcttgccttttttctaaatccattaactaatttatatgcggaagtagaatcttaggcttcagctagtcgtttataaatcctctgctggaactacaggaactactgggactgctgcctctacttcatccgcttcgtcactgctctcttcctccatcaaggcttttggcgtgtagagcttgggaatcggcacattcgcccaatccatatcggacgcaaagtaaaagctcgtataggacggctggttatacccggtattttgacgtgccacatccgtgcgatactgcggatcatgcatcaacgtgtacaatttatgcgtcgtaggttctgtgctcagatagatacggattgctgagctatccgctgtacggacgagcatttcctcccgccaatctccgaaaatgtcggctaccagcgatggcgttcctttcgtatagttgttcgttttggttccagtggcggtcaacaatgtacctcgtttccaatcctcaatggttggggttacatcaattgcgccgtttacgatttgtgtggtcatatcagctgcccatttgatactcatattggtaccgggcatcttcgtatccagctgtttacccgctgcggtccacaggcctatggcccaggtctccagacctcgctgatccgggtcgatgtcaccgaccattccccgacctgtatccttgccggaatatgcgccgtaaatgatttcacctgttttggcatcccgcaaagaatagccatatggagcgtaagtgccaccttcatgtaccataaagatttctttgccggggcgatccgggtcaatatcggttacatgcagcgcatcgccatgtcccaatctggcggtttgacccggagttgcgctttcaggaggcatgacatcaaatgagctgtacaacaggctgccatcatggtcaatcgtggcggaaccgtatacgatttcgtccttgccgtcactgtccacatccaccatgctcaaagaatgcgctccttgtgtggtcaaggtgccaaatttcgggtccgttccatcacgcccatgcggactatcgttaaatggattggtcattggtgcccagccactgtctaccatccaatgtttttggagatggcgaccatcccatgtgtaggtagccaaggtggaacgcgtataatagccgcgtgcaaatacagcgtacggcttgcgcccgtccaggtaagccacacctgccaggaagcgctctacacggttggcgggttcaatccgggccatagaatagtcaccccacatgaggccatcgtcatgacgctccggctcatagcggatggtatccagctcagctcccgttttccccttgaaaatcgtcaaatactccggtccgtctacaataaagccctcgaactctctcagcttgtttttgtcgctccgtgaaggtgcatatacatccataaagtagtctgtcaggctttccgcatcctttcgggataacggataactgtacttcggagcgatgccaaagcattcctccagcgtagcaggccattgtcccttgaccacttcttcatgcttcgtccagttcatgaacatgttcaccacatgctcataataatccgagcgactcaaacggtaatcgtcctcatgtgtaatccctgctttgcgatcctcacgtggcagagtaatatacttttcttttttcggcttgcccttcttatcaaaagaaatcgttttggtccctggagccgttttgaacatcagctcggctttaccatcgccgtcaaaatcgtacaccattatctgtgtataatgtgcacctgatcgaatattcacgcccaagtcgatccgatacaacagcttgccttcggccgtatacgcatcgacatacgtatttccggtataccccttctgagatacatccttggagttcgacgggtcccattttacaaaaaattcatattgcccgtctccgtccacatcccccacactcatatcgttggccgaataagtataggattcacctgcgggtgttacaccatcggcaggcttttggagaggaagttcatagtaaccctgctgccatggcttcactttagcgctacgatccttttccttaccttttacgactgaagctactctgtacaccgcatttccggttccttccttatccacatagttggtgctgtcagtcaccgtcgcgatcttcttaccgtcacggtatacgttaaagtctgctcctgtcagccccgttggaccgtaaccgttcacttcatgagccaataaccgccagcttaaaaatatcccctcctgcgtcaccgcagctaccaatccgcgatccagcttttccagctgaatgctgccgctacggttctgttctactgcaattgctgattccgcctgcagtgtgggttcggataagtcttccgcagccactcctccagtcgtccccgtcatcgccagcatcgctgccaacgcggcggtcaagcttccctttcgccacacgcctttccctcgagccattcaggtcgtcctcctcaattgtattgtgatgacaagctaatacctgaaatgattgcgcttacataaattaaatttccttactattatagttttgccgttcccccaaacgcgtttaaatatccgaggatttctctacacaaatccgtgttgtttactcattccaaataaaacagccctcaccaagcctgtatgaaaacggcatgttaagggctgaacactgccaaactccccatgaaggcagaggaagtaggcaaaatcatattcgcataactcaaaaggaaatataaaaaacggacagtggattgttcccattgtccgttttcatatttttcgcgctagctatggattaggattcgtcttgattactacaagctagtgagggacaaatgaactgaaatcgtccctgctcgactgatccgcatgataaaatactacatccccgtcctgtaaatgaaaggtatgcccgtacgggtcttttatctctcggcggtaaccctccagttgccactggttcaatagcgggccatttatatactgtaaatgcggatgctcagcgtccccctgacgcagtgactccacattaaagcgaacgacgataaagcccgttttcttgaatatatctgtatgctcgtttagctcctgacggcgactaacctcgcgcaaatccgtgcctttggtaactgcgtacacatcagcaggcaggctatattcaccataccagcgctgaatcgacgcattagcgcgatccacgttgaccccattcggcagatctgtcttcggaccaatcaaggtacgcacagccgcaggcagcaccagccagtcgtaacgtccaatcctggtcttgctgcgtgcaatacggtgggcatacagggaaacatagcgttccagtgtcaactggctttgttgtgcttcactcagctcatgcttgtattggtaggctgacgtgtcctgcatttcctccatcggcacattgcgtagccgttcattcaaaataacatatcgcttttcccggtcctccgccgatcccaaacggataaattttcgactgccggaatgtgtatacagatctacctcttcccgctgtcgcccatctttgctcacccaatagaacgatggcgtgatgcgaataccgtccttggcgctaaacatattgcctttggtcttgaggtcaaacttgaaatgataacctgtcttgaccgccacatttgcataaccttcatatgggtgactgccggggcgaacgggcaaggtgaatggctccgggttccctctaggcaacccatcaatattgccaagccccgtccaataggacaggccgctatgcatttggcttccttttcgctgtcgaaatacccgctcccaatggtaatcggcaatatccgtgatatgaaaatcgtacatccgtccgatgacctctatatttaccacatcattggcaacatggtgggcaataaccgtgttggcatggtgctgttcggtgaacccgtccggtgcattttcggcaatggtacggaactctactgtatagttgccttcatccacccatacgggcaaataaaagtctgtgtcgagctgcagcaccggaatgtcgatccaggtacctcgtggataaaatattgtctttcctttgttgtacacatcgaacggaaatcgcacctgcttggttcgtacatatttggcatactcccgatcaccatagccaggaatgttcaaatgtgggcctgctgtcgagatcgtcacccggaaagggcgctccaaaataagcgcggatcgtcccttcgtaggttgggttttctgattatgagcagcatcgtccgacacactagacagattcactacgggagtgtggacagtcaccgtattgattccctgtatcgggaacgttttatccgcacctccattgatatttcccttgagaatcgcgtaagtgatgtcaccgctactgggcgtattggacttatttatcttatgcttatcaatcacatgattcggactgtacagcacatccggcccaatcgctccggaagagggtacaacgcctggcttagggccattcaccttgacgcgctccggattcataatgattttattttcaaaggtcagagtatcgttctccacttcgatttcctttacggccccctctgccttggatttcagtgcactgcggtcatcaggcacacttggcttgctgctgccaccgtttttgctacggctgccgccatccactgtcccgggtgcagggggcggataaaagttgccctgagtcgctgcaacataggcagggggtgtataggattgcggacgcagggtgattgtttcattaggtaacgcataatttcggagcgtagcctccttgatgccatacacctccaaattgtctatcgcccaatatgaatacggacgaacaatttggtaagtgtaggttcgcttcaccgtctcactccgccgggattttttcttaggccgccaggtcaatcgatattctcgttttacgttaaccgtatatgtacactggcctgtcatgttcacaaacttatgttgaaaaaggtatctcttcgcttgcacatgaccgtataggctttcagatgtaggaatacctttggatacgtcaaattgttcactaccacgctggtctgctttgataacggcagatactgtcggatccagctcggcagtttccaagcgcagacctggaacggggcgggagcagacaacaccttttgttggctgttcattatcttggcaatctgggggtgctccctcttggctttctccaggcttcggacagccctgagtttctttgtaatacaaataagcggtaaactgctcaaaagaaccgtcataggtaaacccaggtacaattcctggcaatatatctccgcttggcggtttacctgtcgtgcttttcttataacccacatactcatatttcgggttggttggcggggtaaaatcatacagttgatcagctttcagttcatcttctattggtgtaaatacgttgttaagagattttccatcagtggtaaaatgcttgacgatcagaccactctccagctcaatcttgaacaggatcggttgatagatacgccaggcttctacttctttggcacacgtggggcagctctgttccttgatattctcagctcgaaccatcgcattcagtcttatatttacagtaatcggaatgatggtggtacccgttccaatcccctgtttctcaaagggaaggatatccttctcgttatctgtgcctttactcatggcacgtgcataatccatataattatcagctcgggatttaagaaagtattcgccatgactcacatagtcttccgctgtatacaagcgagctgttaccttcttaatcttacggcctggaaaattaaatttgtaggtgaacttggcttcaccctgcatgtccttgtctggctgtttaccaccatcagtgacccaagtcccagcggtattcttccacatgtcgaagtacatcatgccgacaaagtaacggtcattcttgtctgcaaagtaggacaacggtgtaatttccgtatctgctactgccttatttgtgagaaaagaaaaaggtgggagctgcaacagtagcagtacccccaccagcaatacggccagaatttgtttcgctttgttcatagatttagttacccttccacgggttgaccatcatcgggatgtattccgttgatgcaaggtcaaatgcaatgaattcaatgtcttgcagtttaaaggatttatagttttttataccctgaaagagttcatcaccagatgaataaattgggtagtatatcatctttgtaccgtctccgttatcttgggtaatctctctcaatggagaacgcaggcgtgtatccttgttcttggtcaggaagaaaatactccctgcagtggaattagtctttactctaattctcagataaggcacaccctttggagacgtgtacggctcgacagagtaaatatcatgcagtaacttgataggcaagtcagactgtttaaagagtactactttatcatatggcttacctgtaatattgttaatgaggttcggtatagtgttaattgccttcttatacggctcaatactcaccgccttatgccccatatcctccagcgcagcaatttccttcttcccaatccagacccagcggctgaccttatcccactctaccgtttgccccagaccctcacttaccaaccgcagcggcacaaaagtacggttttgcttcaaaataatctttgtctcatacgttttggtctgtccatccacggtagcggtattttgacccactgtcatgttaacggcatgtgcatcatttttaatcgacacagccaattggccgcctgttttctcccagcctaccttagcccctagcgcttcagatacaaaacgaatcggaaccatcacataatcgttactatcctgaaaaggtttagcatctggaaactgtatttttttcgcgtttaacaaaacttcaatgggtttggtgctgcttgctgcctccgtcgttggaatcgtacttgtcgccccccatagcaacgtgactgcggtcaaactcaacatccattttttcatactcatctctctatcccctttgtcagcttaaactttaaactatgtataacatctctaatctcataaacttatcgcatccccactttcggaaaatactggatacaacttatatattatagggtttccctattacaaaatctataagaaaagcttctaatacacagcattccaaacaaatagactctattgagcaccccctcccccctaaatcatagaactgactctttaaaaagttttatatttccgcaaaatctcaacaaaaaagggctgcctctcccctatgaaggaagaaacaacccgtgtgcttcacgcgcaacaaaactatgaatatatcagttcataccaccatatggattattccagcatcatccaatatttcttacatcataaatcataccggactaaaaatcaaacgttacttttctctcacgaaacatttcaaagatcattcatgtatacctgaacttccagcttgatagagttgctcatacacgtccttgttgaccatcctcagcccaaacaatctgcgaatacgctgtcccggcttggccttgaaggtcaccgtcgcttgatccttcccctccagatatgcagccggaatagcggcattaacgttgtaaaacttatcggcctcatcaaaaccttcactaaaatgctcaagcagatgaccgttaatcaaaatatcaaaaccgcagttaggcatttccagcgtagctgtgtaggtaatgaccaacagcatcggagcagatggatctgtatttaaatcaaaagaaaaccagccgtcaattcccgcattccggtaaggtcggttattcacatatccggtgcgagtcgaagcatctccctggaagttatgatcccgctctggctgcatttctccgggttgagcaaaatcaatcgtgcactgctccagaatcgccagcttttcgcgtgccgctgtgtattcctgttccgcctcctgccaagcttccttcgtaaaaatgtcccagtatacggaatacgtacggtcatgcattttatacagaggagacaattccacatcccggggatgccctgcattcaaggtacaaaacgtattcgtcttgccttccacgggctgtatccaggcatctagctcctccgttagaggaatgaatacgggtgtgtacaggaaatccttggctttaggatcttctaagggtcctaagtcgcctgccagcaccagcggtccatacatgacagccgcccgacccgggttatccggcatctgctccagcctcagcgacatcggaatcgtcacctctacagcatcaccgtcaatccatgttctggcgatagagacaaagctgcccggttccgatacgaccgattgttccttgccatttacacgaatgataattccttgttcagcccaatatggatagcggatgagtagcgtaaatggagctggttgatcgcattgaatctccagcgtcgtatgatccgtatctggataggaagtgttttgttttagcgtaacgcctctgtccttccattccagcgtggaggcaatgaactgattgacatacagcttatcgtgatcgtgaaaataaataccgctgccgtagctcgcatggttttccatccctgtgccgacacagcacgtaaaatcatcaaattggctttcaaaatgcttgtgcccgcccatcgccagcgacagaaaatacgttacgcccccgtgaaccgggtcctgcgaagccaaaatatgattgaatagacctcgctcataaaagtccgcttccttggcggaagcattccattgaaacagatgattggtcagcttaagcatgttataggtattgcacgtctccgtcgtatgaggcccgatgcgatcattcaagccatctggcgctccaaaatattctccaaagctattcccgccaatgacatacgaatgatgatccaccacccgctcccaaaaaaactccaccgttgcccggcgtttcgtatcattcgtgaactcatattccttggcaagcccgatcagcttcggaatttgtgtattggcgtgaatgccctgcaagcagtcctcctgcgagctaagcgggtccagcacctgcttgtgccagaagcactcagccagccgcaagtagcgctcttccccggtatccgcatacaaatcggccaatacctcattcatgcctccatattcgcaaaacatcatctgctgcatctgctcatcgctcatcggcttcaaaattccttcgagccagtccgccagcttgcgttctacacctaatgccttatcacagcctgtcaaatgatacgcatcacgcaggccagcgaataacttgtgtagtgtatacaagggggcccatgcaccgttcaggtcaaaacccttcgagcgaatatttccagcagacacctcttcaaaaagttcctttccccctggaataccggatacatatccgtcaccatgcgccgcctgacaaacgtctagttcatccgtaatgtaatgtgcgatttccttaaaacgctcatcgtctgttgaagcatacatcatggagcaagcggacaaataatgtcccagtgtatgaccggaaatagtcatcgcttcccagccttcatattgaggcgctttgggcgcaagtccggcatattcccgaaaacgcgccagcaggcggtctggttgaagttccaacagataagatcggttcagctccatcgcttgtttgaagggaccttcagccaataccaactcgttcagtgcgaacggccttgctttcatatgggcttttgctttaagagtcactttccgttcctcctttaaggcgaatttgggataaaaaacgcatatcagacacaacgagccgttacgcgccactgccagaggtttgcccccactgctggtacagctgcgttctcgcctctgtaatgccgggatgaaactgaatcagcgcatgcttccgtgcaaaatggaccccacggatcgcctcctgcacccgctgttctccgcctgttccgccgagtccagcggcatggagcatagaagcggcggctaatcgaccctgggccatcgcgaccagcccgctttcgatgccggtaatattgccggcaacgtacagccctttgagcgaggtttccattcgctcaccatgcagtggaacatgcccgcctagctcagggctgtacacgaatttgcacccggctaccgccgccagctcagcgagcggatacaagccgccgctcagcgccacgaagtcggcgggttcgacgcgctcgctgccgggaataggcgagccgtccggtttaacgtggaccagggtcacggattcgacccggtcctgcccgttgacggacagcaccgccgtccgcaatcggatcgggatatcccacagacggaaacctctgtggggatagcagcacgcgatgagtttctccatccgcatcgcagctgccagcttgccgccggcgcgcatccaggcggccggggccagccccgacagctgaagcagtagcttggcggaggctgtcggatctgccgccgcaccagccagcggattagcacacggcagtgtaatcgccgccaccttcactccggcaacggacagctcgcgggcaatcgccatcgacaatacgttcatgcccactatgatgccgcgttctcccggcttgacgtaatgaacattggtcatcacctgcgcagccccgatggacattacgccgggcaatgtccaaccatccagcggaacgggaatttcggcagctccagtcgccagcaatacgtaatccgcagtgaacaatccacaggaagtggaaatttcccacgttgtcgtatattccataccatgtacggaaacgccgcagcgaatgtctaccctaagttccctgcaacgggtaatcaactcatccgaaacgtgttttccaacccaccagccttgactgccttcctcatgatattgcccgggcatacgtccacccggctctgtaaactcatccagtaccgtgactggcaatccttgctcagcagccgataccgctgcggacaatccggcgggacctgccccaatgacgatgaaatgcgccatttcattcatgtcacaattctccctgtgatttcattcgaaagctgccgtccggtttccaccaccataccttcctccagcttggtcaggcaggaacggacggtaccgaacggatgaaccgtcaggcggcattcgttacaatgcccaatggcacagtatacacctctgcccgtaccggattcctcatgccttctcagcaaacggacgccgctggccagcagtgctgctgccaatggctctccagccaatccctgcatgggacgaccgtcaaaaataaaagatacctgccgccgctccggctttggtcccaaaataggatgatttacaatacgcatatggctcataaagaatctccctctgccagctgcccaaacgttacgggacgcaccggaggcctttgggataacagctccgcctcccggcgggcggcaggaacctgattgtaaaaccatgactccaccatttgtcggcataccctaccctgacatgcccccatcgtcactcgtgtagtcattttaagctggcgcacggtgtccgcgcccatgcggcaggcctgctccatctgtgcgatactcacttcttcgcagcgacatacgagcaaatgacctgatgcactcccaatcgtctcacttcgtcccgtcgcccgtttactcatagctaattgcgcaggttttaatcgctgaataaaagtccagcgccgcctggccctgctcccgagtatgtgagctggattgcttcagaccgccgaacggagcctggtattcaacaccagccgtctcctgattaacccggaccataccagcgttcgcctcattcagaaagcgatgagccagccgcaaatcgcgggtgaatagagaggcgcttagcccgtaaatagaatcattgcacaatcgaatcgcatcctcgaagtcgactgcctgcaccacacccagcatgggtccaaaaatctcctcctgaatcaatggatgggacgaatcaagtccagtcaccaccagtgggcgcacataatacccgttctccgtcccggcggtggctccgccttcagccaaaatgtcggcttcccggcgggcgagtgatacataggacatgaccttctcatactgacctgcggatgccacaggtccaagatacgcactggggtcaagcgccggagcgatctgaattttttccactgcttggcgtaaggcttccgtgaacgtctcatagacagactgttccacaatcacccgactggtggccgtgcatttttgcccggctgaacggaaagctccgctggcaatcatcgccaccgcctgtgctacatccgcgtccttcagcaccacagcggcatttttaccgcccatttcggtctggtacttgatattacggcgtgcacatcgtcccgcaatgcccaaacctgtagcagtagaacccgtgaagctgaccgcatccagtaccggatgctccagtaaggcatcgccgatgcggttaccttgcccaatgactaagttcagtacgccgggcggaagctgcaccgcctcgaatagctcggcgacccgtactgcagttaatgaagcatgttcggcaggcttccagatgaccgtgtttccgcacaagagtgcaggggcgattttccatagcggaatagctaccggaaaattccacggcgtaatgacagccgttacccccagcggaatacgcttcgtgtattggagcactcccggctcattcgaagggataactgtgccgatagaacgtacgccctctgccgcatagtaccggagcagatggacacctcgcatgacctctccgcgcatctcggtaatcggcttgcccatctctcggctagccagttcagccaattcaggtaatgctgcctctagtaacccggctgctttgaacagataagctccccgcgctgcgggacttaaagcggcccagcccacctgagccaaccgtgccgcatccccggcctgtgtaatatcgcccgtctctgaaaaatggacgactcccacctcctccttcaaggccgaaggattgtgaaccaccatttcctcgccggaagggctcagccactcaccgccgatccaatttcggctctccatcgtcttcacctccattcaggatgatacttcgcttggacgaaccgccacctcaaatgcttcgcgaatgcggtcataatccgactgcggcagcgcaagtctgggcggacgtgtcgggccgactggaaatccagccagctccatcatatatttgatggactgtaccaattgtgggctggcatcatagtggaacagcggcagcagcctgcgatacaacgcggacgcttccgccatatttcccgcctgcgcaagccggaacagcttcaccccttccttgggcaatgcattcggtactcccgaaatccagcctgtcgcgccgaacaatgccccctccatcgccagattatccactccaaccatgacctccagctctgtctggttcaaaattgcgtgaatacgccgtacatcaccggaaaattccttgactgctacgatattttcaattcgcgacaagtccgcaagaatatctggagtcaagtcaaccttgtaatcatgggggttgttatacgcaatgatcggcaggcccacctccgataatgcttcataatgggccgttacctcgtgaggcagtggattgtaattaatgggcggcagtgccatgacacccgcagcccctgcatccttcgcatgctgaatccaatgcaccgcctgtttggtggacggagctgccgagccgacaacaaccgggacacgccctgccgcagcgtcaattacagtatgcacaacctgcgaccgttcctccggggacaaagccgcatattctcccagcgatcccgtaggaaccagtccgctaatgccgcttgcaatcagatgctcgcacagctcggtcagacgcttatggtctacctccagctctgccgtgaacggtgtaaccaaggccacatatacaccttcaaaacgtgccatatgctcaccaaccctttcccatctttattttcatattcagcattcgggaatgatgtaaaatgctcacatcagcaaaaaaccttctttaagcgggtcctcggggtccaacacaaattgatgatgtcccgtcacccaagccgaacctgtaatttgtggaatgactgccggataaggacctatctgcgtctcgcccacgatttcagcccgaaacatggagcctgtgatgctttcatgtacaaacggctcatgtaagcccagttttcccttggcgtgcagcaccgctaccttggccgaagttcctgtgccacaaggagaacgatcgatccctcccggtgggatgacgacgacgttgcggcaatcggcctgcggagccacaggctccccgtaaaattcaatatgtgtcaatccttgaataaccggattctcaggatgtactacctcaacaacagcatttactgcctcccgaatctgtaccgctgttcgtacaatttcggccccattgctctgctccagtacaagcccaatggaagccgcctctacaatgccgtaaaagttgcctccatacgcaatatccagcgtgacttgcccgataccctctacctggaccttcacctcacggcgatacacaaaagaagggatgtttgtgaacgttacttgtcgcaccttgcccgcatccacctccagccgcacttgaaccgggcctgccggagtgtccagcaatatcgattttttatcctcagcaatcagcccgccttccatcagcgctgtacatactccaatcgtatcgtgaccgcacatcggtaaatagccgccagtctctataaagaccacccccatatctgcacctgaatgacaaggttctgttaaaatgcagcccgacatcacctcatgccctcgcggctcgaacatcagcaaacggcgaaaatcatcatgatgtgctgccatataagtcattttttccagcatcgtatgacctaccagcttaggcgcgccgtgaatgaccgtccgcgtcggattgcctcccgtatgggtatcaatggtagtaattctgcccgttacactcatccggttacctccccgtgaacctcatggctggtaaaagccttgccaaatcggtcatatcgcaacggctccaccggaatgcaagtggattcaccccgtaccatttcagtcaccagcttccccgtcaccgccgcaagactaatgccatccccctcatgaccagaagcgatatacagccccggtacttcgtccactgccgatacaaccggcaaatgatcaggtgtccatggacgcaagccggtatacgcccgcatcagcggtatattggctaaagcagggaaaaagcgaatagctctgcgggcgattaagcgaatcacttgctgatcgacacctgtgtccataccgacaaactgacggctgctgccgatcagaatattttgggatgcggttggctcgaacaccagcgctacaccgtatttttcataaagctcatccacactccgctgaccgccaaacttgctcatcagatagccgaactccattaccttgcggttcccaatggaaggcattcgggcagacaccagtatatgtcctttgcgcggcatgatcggaaggtccaaaccgagtgaatgaccgatgctgcgtgtccacacacctgccgccaataccactgcacctgcatggataacaccattgggcgtctctaccccgcggacgtttcccccttcgtccttaaggacagattgtatcggtgtgcggggcagtagcctcgctcccatccgacgcgcggccccggccagtgcatacgtcatcaacaccggattcacagtggaatctgtcgcacactccagtccgcccggcaaatctttcgctaaatgcggccattcctctcgcaaatcctgctgatccagcatgcgaaactggagtccttcctgctgctgacgggttacccattgctcagccgcctgcatctcccgatcgttttcacagaccagaatactgccaggcgcacgatactcgaactcatcttccagttccctagccagctctgccaccagctcctgcgataccaacgacattcgactgtcaaacccgggctctttatcgattgccaatatatttccatcacaacgggacgaagtgcctccagcaatctcccctcgctcagccagcacgaccttcatgccggaattagccgcataataagcgatggctgtaccgatgattccaccgcctacaatgaccagatccgcggcatcctgtttcattcgcttcccctcccttcgaccgttttaatctgtttgagaggtattttttacagcttaagcgtaaagctttgtgtcacaggcttgctcagctcatcataatcccgcagctgtacggtaaacgtatacgtcttgttgcctgctccgctgtctgctgttccgctaatcgttcctgtaaagcggtccagtgtgaagcctgcgggcagttgaccgcctgtcaccgtccaatcgtaaaacggtacgcctcccttggcctccagcttggccgtgtacgttttgcctttgacgggtgcaggcaattcctttgtcatgatttctggcgcgaggaaaggagtcaggtccctacgcagcggccagcctgccttttctgctaccagcagcgaaagcttcgtgttcatccagcgccgagtcgggaacagatggcgccagcctccattttgaccgctcaatctgtcgacttctgcaagctctccagagaaatgatagctgtcgtccagcgcggctggtctgtgctgataagccataatatccgggtcattgcccgccacttccttcagcgctttgacacccgggaatatgtcgctgaatacaatcgcatgaccgaattcatgcatgatcagcccatgcacatccgtcactttggacagatcggattgataccattcttcatcgtccacggatgtgaatggaatcgcatcatcatagaaatccagaatcaaactataggaacggttcagattccccgggacggtcacaccgttacgtgtatgataattgccgttcgtggctggaaagcccgtagaataaggcccgttcagccctctcatgaatacccacatgcctttatagggtttgtcattcgtcacctgtatttcattttgccaatcgtcccctggcagatggtttacctccgcgttggcaggaacctcatcgaacggcgccagatcaaagaaatagaaccagtcctttaccgccagctctgcggcctttttggtatcatcatcattgaaataaggcctgatcgtatcgaatctgtagtcaaaatggagggggacggtgggctctttattatcgtcctgatccagcacgcgaatcggaatggactgagtagtcgtgtgaccatcatttccggcaacggacatagacagcgtatagttctctatttcaccgtttcctccaatccggtcaggatggatggctagccgaaaatctttttcctcctgtgcattggcaaaagtcagcgttttgcttgcaccttgcgccgacaacgtacttggcagatccatcatcagccgggacgtgccctgcgcatttaacgtaaccgttaacggaaaagcagcatccgctggcggcatcacttttagcttcacatacgggttggccagatacccttgccaatcaaccagatctataccataatcgttcaccgtccgactaaagatgtcgatgacttttacatccgactccgcttcggcataagccgtctgttgcccaggaatagctggtgtcaaagccactatgagagaagctgccagcgcagtcatccatattttggtgcatcttttatacgtgttcattcgatccctccatctcgtttttggatgacttacaaactatggatagttacctatagcgccactgcgttttataacaaaagcagctccttgggcgaggaggtcagaaccttgacaccgtcatctgtgatcagcacatcgtcctcaatccgaaccccgccgaagcctggaatataaatgcccggttccacagtaagaacatgacctggtacgagcaccgacttactttcgcgggacagacgtacctgctcgtgaatttccagaccaaaaccgtggcccagcccgtgaccgaactgctccccatagccgtaagaagcaatcacatcccgccccagactgtctccctcccgaccgcttatgccggggcgaagccctgcaatcgtcttcatatttgcctccagcacaatggcatacaatttctcatgtcgttctgagggctggcctacgaatacggtacgcgtgatatcggatagataaccacgcacatttgcgccaaaatccattgtgacgaactcgttctgaccaatttccttgtcactggccagtccgtgcggcagcgccgaacgctcgcctgaagcgacaatgaacgcaaaaccgcctgattccgcgcctgcgagccggagctgatattccagttccgccgcaatcctccgctctgtaaccccaggctgaatataattcagcacctccgtgaaggcagcatcggtaatacgcgcagcttcgctaatggtgcgaatctcttcttcgtccttcacatcgcgcagccgttcaatgacatcctccgtttgcacgtactccaacgagcccagcgccgcttgaagctgtcccgactgttgaagtgagacatgcctgctctccaaacccagtctgtggacacccaatttacttgtgagatcggccacggtttgaaagatttgcgcctcatgccgaatcactgaatattccactgcctgatctgttgcctgcatcatatagcggaaatccgtcactaaaaaagcctcttcctgcgtaacaagcgcaattccagcggagcctgtaaatccggtcatatatcttcgattaggcccatgtgtaataagcagtgcatctatccctagagccgggaattccgagcgtaaccgggccagtctgcctggaacaccctgtaacggttttgtcttttgactctcttcctctttcactcgtacgcctccttattccacatctcttttcagggcatatgccttagaacacactctcccacttgcttttggacacatgtatgctcttctcgctgccgcattcccgtaagtcctgcgcccaattctccgtctctttttcaagcatatcagcgcgtcccagcttccttttagcctttaatccctgtcaatgtgatgccttcgataaaatagcgttgtccgataaaaaatatcaggacgatgggagccaaaatcgtgctggaagccgccatcaggtaaggccagttggtattgttcaatccccggaaagtcgccagccctagcgctagcgtaaaatgcttttcgtcacttaagtaaataatcgggcccaaaaaatcgttccacacatcaataaatgtaaatattccgatcacgatcaatgcaggcgaagataaaggaataatgacgcgccatagtacagtcagaggcgtacctccgtccatataagccgcttcgtccagatcgcgtgggatcgtcagcatgaattgtcgcatcaaaaagatgttaaacgcccctccaccgaaccatgcaggaacaatcagcggcagaaatgtattcagaccgcccagttcacgccacatcacgaaagtgggaatcagtgtcaccgcgtaaggtagcatcatcgacccgatcagcagggaaaaaatcagattgcgtccaggccagcgcagacgggcaaaggtaaatgccgatacaattgaggtcaacatcactcctgccagcacacatacctcaatcatgaacgtattcataaaatacctgccgaacggtaccgaagtcagcgcttccgggtaattgctccattgaaaaggagagggtatccactctggcgggaacacgaaaatttgggatgtccccatcagggagctgcgaatgagccatacgaatggcaacagcattaaaacactacctataattaaaacgacatacagtacaacacggctgattgggaatggtttggaacgggtggcggtagcaggacttcgggagcgttcaggctgtggcaacggatgttgtggtgtttctgaaggattgacagaagaagtgacctgattcatgaacgttcccctccttcatagtgaacccactttttggatgtggagaaaatcagaaccgttagcaccatgatgacgaaaaataagatccaggccagcgctgaggcgtagccgattttagtctccgtaaaggctgtacgccacaagtagaacacatagaacagggttgaattgttaggtcccccgttggtcataacatacgcctgattgaaggcctgaaaggtgctgattaaagacatgaccagattgaaaaagatggttggtgtcatcgaaggaatggtaatgtgaaaaaatttatgccacctattgccgccgtctacctcagctgcttcatacagatgggtgggaaccgactgaagtcccgccaaaaagataatgaccgtgttcccgatcccccaggtgctcatcataatcagcgagggtattgcagtgctctcgtcataaatccatttgctccctggcagtccaacgccctccagcagcgaatttaacagaccaaaatccgggttgaacatccatagccacagcatcgtgttggcaatactcggcacaatggtaggtaaataataaatcgtacggaacaccgacaaacccttcaccttttgatttaataacagcgcaatgataaaagctgccgccaagcctagaggtacgctgcccagtgcataatacgtagtcacgaacatggattgggaaaaggtagcatcctcggtcaaaatggttcgataattgtccaatccgataaaggtcatctgtccaccaatcgtccaatcggttaagctgaatacgaacgaggctgcgatcggtccaattgtaaatatcattaatccgagaatggcaggaagcgcgaatagcagaccccagtttcgctccatgcgcatcattcctgattttggtcgcttcatgggctgttctcctttcgcagctgtcccgccgcattattcatccgggtataccccttgaagcaatggctgaatgataggctccagttcatccagcgcttgctgcggagtcttcttgttcgtccagatcagatccagccctggggtcagcttggaaccaatatcaggccagttgcgaagagtcgaagtggacggcttgatcgcataatctctggcatactcaatgccagccttttgaaattccggtggatgtgcggcattattggtccatgactggatggcctgctcatcggtataatatttttcctcgataggcatccacagaccggacttgaacagatccaccttttcgggattgttatggtacaagtaaaattcgagcgcttccttcgggtgcttggtgctctggaaaatgaccgtggctcccgcaacgatcatcgttttgggctcttttagcttcggcagaacgccgatactccattgcagttgcttgttgttcgaaaaatcgagcagggaccatgtcccgtccaccaccatggcgacctttcttgtctgaagccgaatcgtattggacggcatgtcctgctgctggatcaaatcaggagaaacatactccttgaaaaccagatcctgcagcttctgaaaaacctccaccgactcaggactgttcagggtgtacttcttgcctgttttgtcagtcaaacctccaccgttgctcgctaaaagcggcccccaggagctgcggtcattgccgaaggcaaagccgtattgcacaatatttttcggatcaaatccactgtctcccggatgcttgccgttctgatccttggtcagctttttggcaatttccagaaattcatcccatgcccacgctttttgaggatcagccggagggacgggtacccctgcttctgtaaacaactccttgttgtaaaataactgcatcacttccaatgcggtgtaatttccgatagacttgccgggttcgctgtagagataggaggatttgagcttgttttttaattcgggatattcgtcataataagaggataaatccaggagtctgccttcacttgcccatttcatcgtgagggaatcgcccaggtaggcgatatcaggaagctgattggcagccattaacgtgttaattttcgtcgtgtagtcaccagggacatgctcgcccttcacccggatgttcggatgcgatgcattaaagctttgaatcattttttccatcgcctgcttctcgtcattgcttccccagtacatgaacttgagttcaaccgcattgggattagccggttcaccagcgttaccaccgcaagccgtcagccctgtcaacatcgccgtcatcacgagagccatccatgtccgtaaccttcgtttcagcaaatcaaccggccccttcctgaactggtttctccttacaagcctattatgcgccgagagcccagagccgaccacccaacgactccagactctctttgttttggtatgatttttttaacagcgcgtttacaaaaatgttttacgaaactccgtcggggtcagtccggtatactttttaaaggcaatactaaaatagttcgtatctgtgaatcccactacctccgctacctccgccaccttgcgattcgggtccagcagcagttctcgggctcgctcaaagcgaacacgcgtctggtagtctgcgaagctttcacctgtaacctgcttgaaacgggcactcaaatacttgggactcatattcatgtactctgccagacggttcagcccgccatcctcctgaagatgctcccgaatccattccttggcccgttggaatttgcgtggaatgaccttctcgcgtgattctcggacatggcggcccactcggacaaaatagcgcgatacataatcaatcatctcgggcccatgccgcaatcgggacagctccaacaacgggtcctgtccctgcatggacgtttttcctacagatgcatcactctggacgatgcgcatgacgaacaaaacgagctgagtgacaatcattttcacctgcttgacaggcaagcccgccaattgtcctgaccattcctgtaaaatcgcatgtacggcagcatcattgcccgctcgaatttccgtaatcatcagcagttccttctccagtaattgattgctgttcagctcggccgcctgaatgctctcatagggaatgatctggctatagcccacccacccccgatgctccgccgcttgcacagcttcctcatacgcttcgggaagttgctccatccgttgtacgggacggctaatcccgatggacaggccctggctcaatcgttcctgcacggcctgacgaatctgctgtgccatccgctccgccgccctgcaagatgccgtcgccagcagcacaacacgccgatcgcgggaaaccgccgcaccatgcgccttcgccccggctgctgccgcagcctcccccgccagtccggcgaatacatggctgcttttatgcatggaaccgtgtggcttgctagtggcggttgcctcctgctgcgacgcctcctccagctcacagcacagcacagtataaggcggcccactcgtctcgccgaaaaatctcagcccgtccatctcccggatgacctcggctgcaggacgccgctgctggagcaaatccagcagtagatgctccctgtacaatggctccaatgaacgatggcggtgaatggcatcctcctcgcttcttcgccattgtgcaatgcgatcctcagcccggctcaatgccgcttcaaaatccccgctggtcaccggcttgagcaaataatcgaccgcttgaagcgaaactgcctgacgaatatacgtcatagattcgtaccctgttagaaataataacggggtccgctgatccttttcccgaatggtttttgctacgtccagtccactcatatccggtaaattaatatccagtaaaatcatgtccggtcgctgctccgtatacaaacgtaatgccgttgcgccgtcctccgccacatcactgacttccactgacaggccactttccgccaccatcagcttcagtccttcccgaatatgatattcgtcgtccacaatcagcagccggtacatgccattctcccctttcttattcggttcgaatgggtgcaagtaaggtaaccgaggtgtactgatccggctcgcttgtcacggacagtccatattgcggaccataatgccgaagacgttcatgcacattgcgcaacccaaagccaatagcattcccccgttccgcatccagcgacttccggatatcgttcagacgctcggctccaataccgcccccatcatcactgaccgtcaaacgcaacatatccccttcccttgtaccggataacatgatatagccacggtcagtgcgcccttttaagccgtggtaaatagcattttcaacgagtggctggaggatcagtttgggtacataaaatccgcaaatatcctcctctacctcgcaaatccactcgaacgaatttctaaacctgaactgctgcaccttcacataggcgcttacatgctcgacttcctgtcctaaactgatttgctctcggccataacttagcgaaatgcgaaaacatttaccaaaggcaccgattacctctgccatatcccgttgcccattcgccaatgccattcccttcagtgattctagcgtgttgtacaaaaaatgcggattaatctgcgcctgaagcgcgcgaaactcagcctgcttacgcgacagcaatgcttcgtagacctgaccgtacagttcatgatttttttgcatcatatgaagaaaacgctgcccgatctgccctacctcatccttaggattaaaaacaacggaattaggagcttcgaaagcttgggctgagcctgtagcgctcacactcccatcgaccgccatcaatcggctcaattgaagcagggggcgacgaatcgtgtcacttaaccgataagacagcatccagcccagcatcaatgcaatcaaaaaagtccagatggtccaggcaccaattttccgcgcatcctcaaacagcacggactgatcgactttttgcagcaacgtccattgtccttcatttaacgggccgtaagagatcatcgtctggcggccgttccatgttctccagtccttcgtaagcacaggcctatccacagccgatttggcaatctgccgcaatagcgcttggtccgcaacaccctgctccggcaatcggtatacaggctcgccctcctgatccagcacccacatctgggtattaccgtctgtttcatgaaaagcaagcccccgaaacagactggccttgtcgatttccagcagcaaaaatccgaggggcgcataatctccagtcgtttttcgaagcagcttccccacatagatgcgatcctccgccatcccgcgtccggattcaaacggcgaatgagccatccacatcatgggccgctcagcgagcaggcggcgatagtacacacgtgcttcctctaatgtaggaaggccgccaaaacggaccgaaacattcccttgatagagagaatgcttgagcccgccattggcggcatatatgagagaggacgtgatatacggcttggtctgggtttgcgtacggaccaccatactgagtgtttcatcgttccgtaaatattcataatcatcttccggcttggtctccagcgtagactgcacatcaggattgctgagaatggaattggtcagatcattcaaatcggagagcgtcgcattgacgtaattttcactcatttgccgggactgcatagccagtgcctccgacttctcaccaagggaatgggccgcgatccggtaaaaggtaaaggtcagtaccaccatcggaatgacggtgagtaccagcgtcagtacaataaatttcccacggattgtaggaatcccggcgaacttttgacgaccccggcctcccattcatctgcctcccttagacataggctgggagccatgtcccgtgggctgcaatcaggtcatcacacagagaaacaatatcatccatggacagctctgcggacgtgtgcgggtccagcatagcggcgtgataaatgtgctcctttttcctggtgattgcagcttcaatcgttaacagctgggtattaatattcgtccggttcagcgcagcgcattggggtggcaaatccccgacaaaggttggcgtaaccccgttacgattcaccagacaaggtacctccacacaggcttccttcggcagattggtaattaagcctgtgttcatcacattgccgccaatggcaaaagactgattcgtttcgatcgcctcaaatatataagaggcatactcgtttgaccgttcatgacgcagatcctgattgcccaaaagctcctcacgcatcgtttcccatcgttcaatttgactcacacagcggcgcgggtattcatccaaaggaatattgaagcgctcgatcagctcagggtatgcccgtttgataaaatacggatgatactccgcattatgctcggacgattccgtaatgtaatagccgaattttagcatcatttcaaagcgcaccatatcatgatgcttttcctgttgcttagcggcggctcgttttttaatctcaggatataaatccacaccatccttgctcacttcgagcaaccacgccatatgattgatgcctgcaatttttgcctttacaccttcctgctccagcccgaggcttttaaacagctccggtatacacgcctgcacactatgacacagccctaccgtacggacacctccatgaacattcatcacattcgtcagcacagccatcggattcgtgtagttgagaaaccatgcatccgggcacacctcgcgcacatctgccgcaaaatcgagcatcaccggaattgtacgtaaattgcggaaaataccgccaatgccgaccgtatcggcaatcgtttggcgcaggccgtattttttgggaatttcaaaatccgtaattgtacacggatcatagccgcctacctggatggcgtttaccacataggtcgccccacgcagtgcttccttgcggtcagtgtaggagcgaatcacacaggtgctccctgttgtttttttcaaattggataaaatattttccgaatctttcagccttatgggatcaatatcaaacaacgccagttcaaagccctgcaatgcaggcgtcaacatacaatcgccaagcacatttttagcaaataccgtactacctgcacccagaaatgtaatcttgctcatactttttcccccattcacatttttgttcgcagctttgcactccaaatgcaaggatacccaccgccactctcccctttacaggagggaagtgacgatgggaaaggttactcataactatgcgttgttgcctcccattcaggatacccccgctgatttagcggatctaacaggccgaagcggtaaggcagatgttaccgagggtgtcgtagttggtggggttactaaagtctccaggctaaccggtgttaccgatggagccgcagcccctcctgcctcaatcacggttaccttcgcaattgcctttaactctgtcccttctactttgcccttcaactcaaacgaacctggagcagcatattgtgcaggggctatatcctcccattccacagccacccatttagtggagccttctccatacgtagcttccactacgcttggcagttcgggtttttcacccacacgagtcgttacatttacttcttttaacgcggtaattttctcagttgccgccagattctgtgctgtaccggaggccagacctgccacctcggttgcattcaaagcacggctgtagatacggaattcatccaccagaccattgaaatatggatcagggtactgagatttgccgataaaattatttttggtctgacccagactgataggatttaaggtcaagttggtattgcgtcccacttcttttccatccacgtacaaaatacctgtggaacccgaaagcgtgaccgcaacatgcttccatacgcctgtcggcagtacagggccttcaatcgtctgctcctgtccctgcccgttgccttggttggtaatggcaaacagcatggtatttcctgctttaggcgtcaggaacatatattcattcgtcccggagccaaagtcaaaaatccgcacataatcgctcagggtgttcgctttaacccagccggatacggtcaattgctgtgcccgactgacaatacccgccggaagctgcacatagctgtccttgccgttcaggctgacagcattgcctgttttacccgcagcccatgcagccgtccccttcacggcagcatcattgccgctgtccgatgaatccgcaactacagaaccgcttgtttcatcaaacttgtaaactgcaagctgatcaagtaacggagccgccggttcagctaccaccgttactttagcctccgctgacaactgagaatcgctggctgtcagcttgaacacatacgttcccggctcggaaacgtccaccttcgtgcgcagcgatgttttgttactgaatgtgaccttcgcgtcctgtggtccttcaaccagactccactcgtttgtcacctttccttgcggaagcccatcatccgtagccgtgcctttcagaatgatctgatccggcagctttaccttcgaatctttgccggcatccacgacaggtgctttgttcggatcaggtgtggtcgatgtcagctctaccgtgtaagaggatgctgtaccaatctccaatttaagcttgttggaaggcgcatacgcattaaacttcccttgtgattgaccgcctactttaaccatatacgttccttttttcaaaccgtcaaatgtaacgtacgtggaatgggcttgacccggtgtttgatttttcagttggagccatacgtaatccttggatgttgccagcttggcttctgtatattggtccttttccagctcgatatacagcttttccgtgatcagattgatgcgcttgaacaggccgtccagcggcttgatcgtatacatgttgccgtttttgctcacctctgcaccgtagcccgtcaatccgaaaataggatcaatcgcgatatcagcacttaacgttttgagcgcaccgaacaatccgagatcagcctcaccgctcatgccgcgccagccgttaaagagcggaacatttttaccgccgccagtgccgttcgtgccgttattgcctttttccgcttgatacgtccatgcgaccgccccgatgttctcagggtccgagctgatttgcccggagttaatcgctcccacattggcaattttagctgcataggacaaccgttgttgttcctcacggtgattgtcctcgtggtggcgaatccagtcatccatcgcatatccagcaagcgaagtcgtgtactggaagttaaaccagttctcaccggtaatcgtcaccggatcggtgtagtagtaccatacgggcatatgaccgcgtgccgcacgggttttggcattaattttactcatcatttccagggctttagtttgctcgccctctgtatctatattctgcttggctaatgtatatacagcctcttcccctgtattgtcgtagctatattcagaaccgtaaggatactttgtatttttaaaattgttatatttacgatccattttttccttgagatcattcgcttcatcatcatagccttcatcatgaagtgcctgaataatatccggtgtggtcagttcgcccatcaaacctgtttcccagttgtacgcgactggcccttcatacaatgctttgaaaatgttataagcccgcagcaaataggtttcctttggatgcttgtaagtgacaagatccgggtattccttggcaatcttgtacatgctgaaatacgtgttgtatacgtgcggataagcataccctcgataggttggtgtatcgttcggttccggcatcaagaaatcatgaattaaataatcctcatgatgtccgttcatcagattcgtccagatcgccgtctccaaataatcgtctactgcccgcacctctttggcgactggagacagtgtgtttttctcagctagaaactgcccgtgggtcagaccccaatcgtctccccagccccagtagccgttgaaaatgttgcgtttggatttggtatgcatcatccaatcgtcaaataccttgtcgcgcagatcacccggtacattccattgggttttgtcgaccataaatgtagcatgccgttgcagcgcgagatcaattggctcgatggcatagaattgtaacaccgttttattaccgttgccgtattctaccgttatgaagtttggacccagcttagtaaatttcagttcataaatgtgatgtcctccgggcttgctatccgtctgcggaataacggttccgtctggataggttactttgctgatcgcctgcttggagcgcaggtccaccttcgccttttgattcgtaggcacgatcatacccggtacgactgttgtatccaccaagttttcttggtacaacgtatctttcacatcatgctcgtccttcaccgccagaaacttgaaaccatagtttttgctttgaccaggattcaggatcaggcttgtattgggcaaatacccccggttggtggacttgatgacattggaatgaatataaaatacattgagtccttccagccatttgccttcgttagccgggttccacgcccatttactgcccggatgctcctcatcccgccagtgatcctgatactcaaagcccgcacccgttgtggaatcaggaatcagcagcagggaagaaccaatgccgctgggacgcccagctgtgatgtaggagctgttattgccgacaaaggaatgcgtcaccactctagtttcgtagatcgcatcaccgttggtccactgctcattgaaaggcagaggcaaaccaaaatcaccaatctccaattttttcccacttgtattctgcacctgtatattccacaacaccgaaccattcgactctgccgaatacgtttcgatgactttaaaattgcgtatcccttctgcatgagtagaattctcgtacgtgacagtgacacggttaccactggtcgtgatcttacgtgcgtctgccgacttgttcgtccatgccttcgtccagctgcctccatccaatcggtatgtgaacatcagctcccctagccactgatgatctgcggtgttctgttcaggtgttaccgttgcgttcatgacatactctgtcgggaaagcatctcccttgatacgtatggatgaaatttcgccatgctcgcctgtctgaatcgtcagcttgtcattggatagttcatgggcctctgccgtatgcgtcccaaacaacacagacgctgtggttaaaaacaaaaatgccgccaatattcccttaaatttcatcaacacggcctccttttggatctcggggtcctgatttgtttgccaatcagctgaagtctcttcatttcgccgcaccctccttggaaatgtaagcgctacaactctattgtacaaatccttgtccattggtaaaatcaacattttcaaccgatttatataggatttcaacctaatagagggatactgttagatcggcaatcaaccaagctacgacagatttatctgaattaagattacagaggatggagagaaagaaatttagatagagagcaagggaggcatttttagatatatcggggtgtgatcagactatacaaacggacactataaaatcgagaatttattttgagttgctgtagtggttaatcgatacgttgggttttccagatgcgagggtatttatttaatagattcgctcctaaggtagaatttggagtctgagtatgtaaagaattttggggatagggtatgggatatttgctgcttagtgattatttcagacatttgatcctccccgtgccgtcattctttaaagttcgattatagtccatatttatctgttaaataggtggtagtgagaggattaggcaaacatttggcacgaacgggataacgatcgctttgtcatctggtgcataataaagatgtgaagtgggtgtctgttatgaatatgaattgtatttgatttacacataatatttaaaaatactggaggattttatatgcaaaaagtaactttgaacaatggggttgagatgcctatactcggttttggtgtttatcagatccaagaagcaaatgaatgtgaacaaagcgtttatgacgctattatggcaggctatcggctgatagataccgctgcctcttatttaaatgaagaagcagttggcagagcgatcaaacgtagtggcgtgacaagagaggagttatttatcactacgaaactttgggttcaggatacgggttatgagcgtacaaaaaaggcatttgaaaaatcactggatagattgcaattggattatttggatttgtatttaattcaccagccatatggagatgtgtttggttcttggcgcgctatggaggaattgtaccgtgaaggaaaggtccgtgcaatcggcgttagtaacttccatgaggatcgcctgatcgatttgattatccataatgaagtagttcctgccgtgaatcaggttgaaacgcacccattcaaccagcaaattgaaaatgcaaaattcatgaaagagaataatgttcagatcgaatcctgggcgccttttgctgaaggaaaaaataacttgttccagaatgaaatattggtatccatagctgaaaagtataataaatctgttgctcaggtggttttacgctggttgacacaaagagaagttgttgtgattccaaagtctgttcgtaaagaaagaattatcgaaaacttcaatatctttgactttgagttaagccaggaggatatggagtcgattactacgttagatacgaaacagagcctgttcttttcacatcgcgatcctgacatggcgaaatggatcggtacccgtaaactcgatatctaaccatcttttaaaagatcacctgtaggttttgattacgccaaaagaaccaacaattaaaagtatggagtagatgccctaaggatatctactcctctttttcgtttgcggtatcaatgttttattcttttggtaagcgcctggtcatcatcggtccatgatatttggagctgttcgagggtttttgagtgcaggcagtagaataccatcgattagcgctgtaaagaaaggcttgtcgaacggtttgcgctggatgagtccgcgaaaagaagccattgaagtaatgacctggcaagccatctcaatgtccgcgtgagcaggaatttcaccgcggacgacggctcggttcataagctcgcggtttacaacaacccatggctcgaaaatcccggctgttcctgcttcggcaaattccggatgctgcaaaaaggagcctaggcccgctaggactcgaaatttgcgttcttcttccgcgatcgattgcggcttcaaaagcacgaggagatcttcgcgcaaggttcctgtatcaggcaagctttcgagctcaagatgatttcgattcatccatgccaaggcgtctcggactaactccgccttggaagaccagcggcggtaaaccgtcgccttcccagcctttgctcgagccgcgaccatgtccattgtcataccatcgaaactcgtatcggcgaggatggcgattgccgcctcaaggattttatcatcccgcgtgtgatctctcttacgtcccaatattttcgcaggcttttctgccacgacctcagttaattcgcccctctcagacatttccttttttattttactcataaacttagctccttttaaaatatatattcagaaactcatcagttccggaactttacagtttcgtttttgtgtgatttaatatcattatcccacatccaacgggaaatatatagatggtgccccataccaaaaaggagattacgatcatgcaagacaaacccgtagccttgatcaccggtgccaataaaggaataggtttacagattgcgaaggatctagcggaacacggcttcaccgtgctcgttgggtcacgcagcctcgagaatggagaaactgcctccaaaagcattggttcggatgcgcacgctctccagctcgacgttaccgatcaggactccattgttgctgcagcagagcgtattcggaacgaatttggtcgtctcgatgtacttgtgaacaatgcgggcatatcacacgcaggtaaaccggacgatccgtttccgagcagtggagcgacgagcggtcttttgaccgttgcttcgctcgaagacattcgttcggtttatgaaactaatgtttttggtgtcattgcagtcactcaggccatgttgtcacttttacgtgaggctccggcagcacgcatcgtcaacatgggcagcaccggcggctcccttagctggaattccattccggaaaactcacatcgtgcgatgtttggggcctattcggcatcaaaatcggctgttcatgcggtgacacttgcctttgcttttgcgcttgaatcgacaaacatcaaggtcaatgcggcctgtccaggttttacatcgactgcgctcaataattttgctggcactcgtagtgttgaacaaggggcgcgtgaagcagtccgacttgcgatgattggtgcggacggtccaacaggaacgttctcagatgaggatggacccatcgcgtggtaattataatttatacattaatggttagtagcttaagggagatttcatgatgcgtgttttcgtaacaggagcaacaggttacatcggttccgctgtcgtccgtgaactcattgatgcgggtcatcaggtcgtcggtcctgtgcgctcagacaatagcgctgcgaaactaaaagaagctggggccgaagtgcaccgcggtgacatcgacgatctcgacagccttcgtagtggtgcggctgctgcggatggtattattcatctggcattcaatcacgacttctcgaacttcgccagggcactcacagcagatctgcacgccgtcgaagcgatgggggcggcgctggaagggtccgggaagccgttcgtggtcaccacgcacgccaatggagtggcagcagaaaacgtaatgttattgctggctgagcgcggagtgcggacatcgatcgtagagctttgcccttcggtacacggtgagggtgacacaggatttgtgccgagactgatcaacattgccaaaacgaagggcttctcagcctatgtggaagaggggagtaaccgctggccggctgtgcaccgtcttgacgccgcacatctataccgccttgcattagaaaaggcacccgctggttcacgactaaatggggtcgcagatgaaggcgtgccatttcgcgacatcgcaagtgttatcggtaaacacctgaacgtgcctgtagtcagcatttcacgtgaagaagcagacacccacttcggcttcctcagcacacttgcagcgctcgatatcccgagatcaagcgttgcaactcaggaacttctgggatggcggcctgtgcaacctgcactgatccacgacctcgaacagtctcactacttcaacaactgattggagacgagaccgagaatcgatcatgggccacttaataaagacttgagaaaagcgaagcaagacatggactaacaacaacatgtatgaaataaaagtttggatattaaaacaagatcaatacgagtgcataccacactaaatgttgttaccttcattcgcagcaaactattctggctaatcgtattgttagctcacttcccacaaggaaatttttcatctttacttacggtatggttcaccgcgttggctgaaggggcaagttttcaaaaaaatagtctccttatcagagactacccaccatcttcctgtttgtaatcatacgataagcggtagcttttcatcattctttcaaaaaagggccatccttttgcgggatagcccttgctttaatttcacatttttttgcaaagagaataaggggctggattcctccatttgcgcttttgcttactttaatattgtcctttaattacaaaaaacgaaccccgaattgttccagctagtttagacttctgcctagcaaacttaaacttctcttctagctcctttggtacctccatcccctcagaaagcttaaaaccaacagcccgctttttaggatcatccaccgtatacatgacattgattgcaagaccatcctcataaaaaacgtaggtaaattggatattttccacttgaaaacgcgacgtttctaaaggtttagccgcaaacgcaatatcacgttcttctctcaaaattcggttcacataatcaaggctctcctggctttcgctagctggtacaaccgtaaattcatacttgtatttgttcataaaataacgggcctcattagcacgtaaaccagcaagcgcttctgctacaggtgaagactctaaaccaaccgtagatacacctttaaaatcaacgagatacgacattccattcctcctcttctctctttacgccctaacagcttccgcatttcatcaaaatcgaattcatttttcaagttgttgtagaaacacacttatagccagacttcaaaataattctcaattctcttatctaccacatagtataccaaaattggttcaagagaagattttcaatggcgaatttgttagtttgttaaatagtgttcacatagactggtattcacaaacaccgctttaaatattcgaccagcgagataatacaatgctgcctatagttcctctaggtcgggaaattaaggactcaaagtatgtcctaacaaaaaactctcggcctgtgccctgtactccattaaggaggttcagattcacaagccaagacatttgcattcatgatggtggccgttagtctatgtttgtttgggaaagaccctctgcatggaagggggcgtacccgcatatgtaaaccaaataagtacgtacgatacctatctatcatgaaaatatagatgcacggttgaagaattatatcgtgcctgtaattgcgctaaactttgtaacggttatacacgagcgccaaatgaaaaaaaacgccggcgacgacaagttgttgcggcagatgatcgcggctatggacgaaggctttcgcgtggttagaggccttacaatatccgctaacgccggccgcgcaagcttcactaatccgcaaacgaccggcgttaatgcgcctttttatgaaaatttatcataggatgccgatcagccgactggttgacggattcgtaggggaaatcgtagctttgagccgcgtgtttcacctttggagggaacagtcccgggtccccacaccctgggacgatttggaaaagcgttttgaagccaaggtcaaccgttcataacttttacccgaggagtaatcaaccgaagatgattctatttctacaaagaagactttgatcattataaaacaaggggcgttcagttgcttgaatctccgaaacttatcgcgacagcatgacgcgtttaccggtctatatattcaaattaaactgcagttccaagccgcattggatcagatgtctcctgaatacaagggtgtttatcggagatcttcattctgcggtgtcgttgaaaaccttattgaagttccccacctctgatgccgttctgaaagccggtgtctgataaaaatatagtattagactgaattgaatatagtaatagcggcagccttggactgaaaaaggagaaagtcctagactaccgctgttctttatttaactaacgttcctcgttagttgaataagcacgctttcttttattacacaatatcttcgtactgttcagtatttctatcattcatcttttacttttataatgagaagtgttagactaatataggttttatatacttattaccgattactaagatgtgtaatcaatgaaaggatttgatgaatgtggaatcgactaatttcaaagttatacctgaaaaacttaaaggtaggacgattgaagatgtcgccatcactactaatgctgtggttattaaatttactgatggtacttatttagatatctatctcgatgaggctgcacaaacattaaagacatcaacaaacaagctggatagttaactcaacactttacacttagctatcattttcccagcttcctccttcacagtttgcgtcaaatgcgacataaaacctccacttatcttgttcaactaaactgcccgttagctcaatgaaaaaaagcagcccctcatgaactgccctactgctactcacttcaacaataggatgagttcattcaaaggctacctcatttaccaagtaatccaaccactcgttcgtttgtaactgtgtaggagctcgtattcttcactacgcatcagtcgtttcatttttgttctatacagacgataatcatcttttcttgctattttacattctttgttgtaatgaacactcttgattcctttacggaaatccttaagcttctcttttcttggatctttgggcttattattgatctccagactttgctgtttctcatcttcccagaattgaatctcttcccgtgtaaacatcttcatccccgttgtgccgggttagattttggcatttgaagccatgaccttagacacaactaatagaagaagatcttcggattgaacattagctcacctctgattttattctcccttattttaacatatttataactatcctgcccgttagtttaataaaaagagcagacttgaagcgcctgctcaacattgtgtgttatttaactatcgttcctcgttagttttacgccctatccatagaaagcctcgtgtgtacctgtcatatctggcatcgtgatatccatggtcaccaggtccagttgcttctcagacaaagatgactccggtcagtgcttcgctcaaagcccattaaccgatagttaagcagattgaaactctggatctggagcggttgcttctctcgccgataccagagttaggttgcggggcaatttctgatgagattttctgtctgcatgctgatattgccttcaagaactgaactacgagctgaaacttaagtatatgaagaagatcagaaaataaaaattctggaagttgcctgtgtatgttaataacgcaaaggaacggaggagattgccttgaggtttctactggttgtcatgtcgataggaattgtttaaaagtaaaaaaggagagatggcataaaaataagccatctctcctttttcatttatataaagcgggtaatgggaatcggacccacgctaccagcttggaaggctgagttttaccattgagctacatccgaaatagatgccggtgagaggactcgaacctccacggtttccctcacgattttgagtcgcgcgcgtctgccaattccgccacaccggcttatgaagttaatggcgtcccctgagagattcgaactcccgaccttttgattcgtagtcaaacgctctatccagctgagctaaggggactaataaatggagcggacgacgggaatcgaacccgcgaccctcgccttggcaaggcgatgctctaccgctgagccacgtccgcaaaaaacaagatgcgcgtggagggacttgaacccccacgtcaaagacgctagatcctaagtctagtgcgtctgccaattccgccacacgcgcatgtaatacaatggtgagccatgaaggactcgaaccttcgacaccctgattaaaagtcaggtgctctaccaactgagctaatggctcgtaaaactggtggaggatgatggattcgaaccaccgaacccgtaagggagcagatttacagtctgatgcgtttggccacttcgctaatcctccaaaatggtgccggcgagaggacttgaacccccaacctactgattacaagtcagttgctctaccagttgagctacaccggcatattaagttaaatggcggaaccgacgggattcgaacccgcgatctcctgcgtgacaggcaggcatgttgggcctctacaccacggttccagagacaactctcttagttgaaagtaattgcggaggcaggatttgaacctgcgaccttcgggttatgagcccgacgagctaccgaactgctccaccccgcgacagtaataaatgtttatttttcaagtggtggaggctgaggggctcgaacccccgaccctctgcttgtaaggcagatgctctcccagctgagctaagcctccgaattactatgacccgtaggggattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagctatcagggaatattggtggagccaagggggatcgaacccctgacctcctgcgtgcaaggcaggcgctctcccagctgagctatagccccatctaaaaaatcaattttgtatgtataatcaatagcctgataggcgaaaaaaaatccccattatggggttgcttggcgacgtcctac

SEQ ID NO: 2639 - DNA, 14775 bp, Unknown
  Kingdom: Bacteria, Phylum: Firmicutes, Class: Bacilli, Order: Bacillales, Family: Paenibacillaceae, Genus: Paenibacillus
aactttaaggggtcacttcagacacgtacaacgtgctttgactgttttttaatttaatagaaacaaaagatagaatatatcaaatcaaatgcttataacgaagcaaagcaatcactacaagtacagtagttaaagcaatacagacgttttctatcttagctcccttccgggttccggtactcatcaatttaaatcgcagcttccatttgaacggcggcaaaggtttgattccattattcgtcaaggaatctgccagtaaatgcagcaagtacgctagacctccagccagccatatgctgtcaccgtgcaaacgtgtcgtaccataaagcagcgcagtccatgcgactgtaccgtataccgtatgtgtcaacccccggtgtgggactaacgtacaaatgatcagcagacacccggcgatataattccacggtgcatatgattctccataccaggctaggccgataccaattagaaagataataaccttgcgcatggatcgtgaaggcataaaagaagcactgatcatcagcaaagccaaaacaagattccatggcggtggagccaaacgggtgaaaaatacccaaccagcagccccaatcattagaagctgtataagtctaagcattttggttggcagcgcacggctcacgagcatggagttaggctcgtcaatatccggcaacagtgaaccgaccacggcagctgccacggcagccggggtcacttcgtatccacttaaagctaataccgacagggagaccccggttccaataattaaatgggctcttcccatcatggtgcaaaacatcctttcgttgtagcatacaacagagttcaacatcactccatttgaatcagcatgattcgattgtatacgacaaacaaaaggagaacaatagttcgcttattctatttaaaagacttcatccaaaagtcctattttcgtcctcattacttaatcctccccttgttctttatctgtacaaccatttcttaaaaaaacacgccatatggcctatgagtatgttgacaaacatcttcaatattttctttttgcctcaaagtcctattgtacaatttgaaatattaggtaatatagtgtttatatttactatatgaatctattaaatgaataaggaggaaatgttatgcaaaaaatatcgacgttccgaaagttcaaaaccatcggtctaacatcgttgctaagtcttgtattattcgcccttcccgcttctgctgcttggaatgatacatacacggggtacgccacatatacaggatcaggttactctggaggggcattactgcttgatcccatcccttcggatgccaaaattacagcgcttaatcgcacacaactgaattataacggaatcaaagctgcattagctggagcctatttggaagttcaaggtcccaaagggaaaacaaccgtatatgtaactgatctttaccccgaaggtccaagtggcgcactcgatctgtccccaaacgcgttcaacctgattggcaatcaaatagacggaaaaattaatatttcgtggaaagttgtcaaagctccggttaacggcaatgtctcctaccgcattaaagaaggcagcagccaatggtgggcagccattcaagtacgcaatcataaatatccggtcttgaagatggaagtccaacaaaacggacaatggctcaatctcgaaaaacaggattacaaccactttctaggtactaacttaggaaaacaacctctgaaaatacggattacggacattcgcggtgtcgtgctaaacgatacaatcccagctctagcggaaaatggtacaggcggagcctatatcgttaatggtaacgttcaatttcctgactaattgcagtaccgtcatctttccttcttttatttgaatacacaaacccggccgggaaccgacgcaatccaatgcgtataagtgttcctggcctttttgcgaaaaaatcattattttttacaaagaatcggtttgttcactgtcctgttcataagaacatacgtataatgaatacataaatagggtgtactttacagctacgtgcacacagacaggaggcctgttcgtatgagcaatttcaaaaagcatcacaagcttcacagcaaattgctggtcagcattacgttatgtattacgctaacgttgctggtatccaccactgtgtattatttttactatattcgcgtggaaaaggagcaggcattcgaggccaatcacaacagcttgacgttgagaagcaaagaggttattaacatgacatctattgctcaatctttggcattccaaatgtatcgcagcagtaccctgtccaaattgttgtattattcaaaacctaatgtatatgatgtaaccgctgccatgaccgaattgaacaattatcttaactccatgccgtatatcgaatccatctacgtgtttaaccctaaaagcggcaccttctacattgcgtcctcacaaggtcaaaacgggttattcagcaaacatgaactggctgatacagatatcattcgcgtgctgaatcattatcaggactataaaccctttactcctattccacgcacgtatccgctgctgtcggcctcagactctggagctggagtagagcaagcaagcccagatatcgcagcctatacgtatttatgttatgacgcaattaactcgaacgaagcgataaattcggctgtgattgtgaatgtgtcggcggcctggatgaacaaggaaatggcggcgaatccaatctcaggcgggaccgcttatattttagacgatcagggcagactgttgtctggtacaacattgacagacgaaactttgaacgaaaaagagcagttatggttgcacacgagagtcaaaaaacaagaaacaggctattttgtagaagactttcatggtaaaagatcactcatttcctacacctccccggacggactaggttggcagtatattagtgttgcaccatataaaagcgttatcaaaatggcgagtgttattcgtaatgcaatgttactgatagccgccatcattgcattggcaggattcgtggcttcgtggctgctatccaaaatgctgtatacgcctattggccaaattgttgtgcatatgaattcactggaatcggagaaacgaaacagcatgtacacgatccggcaaaacattttacggaatgtgatccgaggaatccaaaatcttcctgacggtgaagaaccggaacgattacgcgagcttgggattacgttccagttcgacaaagactaccgccttgtgctgctgcgcatagatgaatatacccgatggcaaagcgaacgtggacctgatctgctaccctataagtttgcaatcatgaacattgcttctgaaatatgcggacaaacgtaccgggtggagaccgttgatatggatgaggacagtgtactgctgatgcttaacattctcgatcccgcagagcatacagacactgtactgctagaaaccttattacgccaaatacgtgaagcttgctttgaatatttgaagctgagcgtttcactgacttacagtgccatcacgagtcaaccagaacggctgcatttgctgtaccgccaggtacaagacgcatctatgcaccgattttttcaggggcatggctgcattattaatgcgcaaaacactacagacgaggatatccaaaatacttacgtatatccagccgataaagagaaaaaaatgctggatacgttgctgtctggtcatacggaggatgcacaccgtatgttcaaagaattgttgatgcatatggaaaaatatccgttttcctctgttcaagtggcaatatcccggctcatcatgagtgtgaataatgctgttcggcatattagtgagctcaatggatttgctatagaaactaaacctgaattaccatccgcagatcggttagagaccgctggggatcttattgatcattatcaattggtctttgaacatattcgctccagtctatcggaaaaacgaaacacgaagcaggaacgattggtgcggcaaattaatgaacgaatagagcaagcctatacgaatcccaatttttgtctcaatcagattgcggaagagctggatatgtcgccgatctatgtcagcaggctatataagcagcagaccatgtctaccatcgtggacgtcatccaacaactccgtattcgcaaggcctgtgagctgctggaacagaccgactggtccgtggctgacgtagcagaacaaaccggatttgcgagtagctcttatttccatcgcatgttcaagcgtagcttgggcgtaacaccgacagattttcgtcgttctaaagcaaatgcgcaataagtagactgctctacacgacagctcggagaacggaaccttgctcccaaaaacataaactgacattaaaaaagcaagcctccaactttctggagacttgcttttcttctttatcataaatctttatgttttatttaatacccttctcctttacgtaagcttcccattgttttgtatattcggtttgaattttttccaaaccagcttggtttgccttttgcaagaaggtctgcaagccttgatctacattgtcgatcagcccagcttggagcggatacagatattgcttctccacctgttctagagccgctttttcagcttggtaggttgtgtagtcctctgcaaacccggtaaacaggtcaggcttctggattttatccagctcagcaaatatcttcttcacacggtcaaagcctgaatcaaacagcatatattccgggttacgccaagcccaactgttcataccttcgcgtgaaaatccattagaactgccgctacctatcatatggtagtaaccatctttgacttcatagtttttgccttcaataccatactgcgtgagcaagttatagcgtttgtccgtcacaagcttttcataaaaagctaatgcgcgcgccggatttgggctgctttttggaattgcaaagccgttgtgaatcggatgcactggagttgcataacctgtcgtcaaagggaatgggtaatactcgagcttccagtccgggtgagatgctttgagcttaatgaccatatcattaaaccgggttggattatcaccgaaaatactcgccgctttaccagaagtcacttgatcctgaagcgtatcttttacgtttaatacatttttgggaatgaatcctttatcggcccagcgtttgtaagtgttcagctcttccttttgttcatccgagccccaatatttacaaacctctgttggtttttcatatttaataccaatgccataaggcaaggcacccacactcttcgttactaattcggtatatcggtcatgcaggtttcccttgatatcgctgttcagagatacggttttcatatttggctcatgctgacgtatcccatccatataagcctcgtaacttttgatatctgtcggtttaggcaaattgtacttctctcgtaaatcctcacgccatacaaagccgttagtgacatactctttatacgtgccaggcacggtataaattttgcctccaattttaactccatcccacatgtcttgaggtacaaatttttgcaaggcaggtgcagccttaggcagcagatcgtctagcggcaggaatgcgcctttcttggcataggcctgatactgcgtccaatctgcagtgaatatcaggtcgataggctgacccgaagacaataacagcttatatttttgatcccagtctgtccacgtcgtatagttaaatttgacggtggcattcaaatccttttccgccaatttgttaatctctgcctcaatggtagacagatccttaggagcatcccccagcatataaaattgcagctgaactttttgggatttatcatcctctccatttgctttttgagcactgtttccgctaccgcctccacatccggctaatagcgccatgatggccattactgcaatcaggatggacatgcgttgttttcttttctttgtgaatgtcatgtgaatcctccctttgaaatggtagtctgtttattaaaacgcttacaaaaagtgctgctttgacggcataccgtcagcacgttatgccatcaaagccttttagtgccgcttcagccttttaccgcgcctatggtcagccccttgacaaagtaacgctgaatgaacgggtacagcagcaaaatgggtccagtaactacgatcgccattgccattttagtcgattctgttggcatatcattggaaagagatacaccagtacctgcacccatttgagcaataaattgcatagagttaattacattatacagataatattgcaactggtatttatgcggatcgttaataaagagtgaggatgagaaccagtcattccagtaagccaaggccagaaacagccccacagtggcaatccccggtgtagataaaggcagcacaattcgatagtaaattttaaaatcacccgcaccgtcaattttagcggactcgaacagttcttccggcatggaagaacgaatgaagtttttcatcaaaatgatcagaaacggagtcatcaatcccgggaaaataagcactgtatacgtatcaagcaatcctaaatacttcgtcagcatgatgtaccaaggcaccaacccgcctccgaacagcgtcgtaaagtatatatagaatgaaaacgcattgcggtatttaaaatctttgcgtgccagcacatatcctgccatcgtcatcaggaacaggcccaacgtcgtgcctaccaccgtggtaaaaattgtcaccccgtacgcccttaacacctcttcaggaaaggtgaacaccgtccggtaaccttccagtgagaattgttgtggtataaagtgatatccatccctgataatcgattcattactggtcagtgaagccgaaataataagtaggaacgggagtaaacaagcaatggaagcaataatgataatcacataagagatgattttaaaaattcgagtgtatacatcctctttgatcgccatccgtttgggtcctcctttctagaataaggcatattcgtcgttcaacttgcggatgatgtagttcacggtcatgatcagtacaaaaccgaacaaggattggtacacgcctgctgccgaagccatacccacatcaaaagtcactttcaaggaacggtacacataagtgtccaaaatatccgtcgtattgtacagcaccccattgttgccgattaattgatagaaaagatcaaattgtcctttcataatactaccaagtgcaaacaacagcagcacaacgaatgtcgatttaagcatcggaacggtaatgtaccagattcgttggaaaatgttggctccatccattttagctgcctcataatattcgtcactgatccctgtaattgctgccagatagatcaccatactgtagccgagatttttccataaatagaacaggataatcaggaaaatccatacccatggtttgttgtatacatccacgcgttcaccaccaagttgcagcaacagcgtattcagaaaaccattatcataattaaatatgttatacacgatgacacttagaataacgaaagaaacaaaataaggcaggaacatcacggattgagcgatctttttaaagtagcggcctcgcagctcattcagcaaaatagcgagaacaatcgctaacacgttgccgagtaaaataaacgctgcgttgtatccgaccgtattcaatgtcagttttgtcagcgtgccggattgccatagaaagcgaaaattttggagtccgacgaacttggcatcaaacaggctggtattgaagtcgaactgggtaaatgcataataaatacccaccataggaatgtaggagttaatgaagaaaaaaattaaagtgggcaacaacatcaaaaataatacccgattgcggaacagttcatagaaaaaaccgtgttttctacccgttcccagcctcttaccgttcaggcgggaatccgttgcaagcattgcagaatttttgggcataggctgattcaatgtgagtcactccccctctgtgtacgttaccgatagcaaggtttgtagcaccgccgccgtataactatattttatgtaagcgcattcaaaatgaaaagtgaagcctcttatgcttcatgaacaaaggagtgtccggaggagtgaacatttcggatatttgtgaagttttatgtaatatgaggcgcctgatcgacgccttgagcccattcacaaagcatatttgaacgatctactctattccttttgtccaccctgaaaagtggtttcatcctgtttcacccgaaatccgattttcttggcctgctccagcagctcagcggcattatcctgcggcttatatccgattagttcttccaagtagccaatgtcataataattatccgtattggctgacgtaccgtacaaattaagatagcttatctctggacgagcttcgatacagcagacggtcagacggatcatatcgcgctcggagatccaaatatgagcggcgcgctcagaatggggccaatcatccccaggaaaatttccgatacggatattcattgaagatattttgccctgatcggcatacagtcgtcccaacagttcaatgtagcacttactcaatccataaaaactgtctggtcggtagggatcttctacatctatactttcgcctactttataaaaccctgtggcatgattggaactggcaaaaacaatgcgctttaccccatttttcaccgcagcttcatacaacttgtaggctccgctaacattgccagacagcactttgccgagaaaatccccttcatccttgatccatgcaaaatgcagtaccgtatccactccacgcgtgagctcatccagtcgtgcagcatcatgtatatccatttccacaatccctgcctcttcatcgttcttcacatcagcagcggttatttcatatttaccttccgcttgtagcccttcatacaatacttttccaattgtacctgccgcacctgtaatcaataattttcgtgccatcgcccgcatctcccttcttagcttggttgtatgctgtcatccatatcataattttaaccaactccccagggaggaaaccccttaaactctcgaattcggtatgtcataacccacttaactgtgtcacctgtcggcatataaaaagggaccctgctattgtgcaagagtcccttgtttttactttgtttcaactactacgctcaagcttgtcgtactactttcactctgcgattaaccaaataaatgctaagcccgattaagatcaacccgataagcaggaaagccgtaatcgcttcgcccagcaccaacgagctgacaaatactgaaatcacaggcaccaaaaacgtataagacgcaaccttactggcatcccccgaattgaccagcgtgaaatacagcagccaggatagtgaaattcccagcaccgtgccgaatattagccctgacacatacgggacattccatacgatatccgaccagttttccgtcaccgttccagctcccgtcagcacgatgcctcccagtgtacattgaaatgcaaccagccacagcgaatccacacgctggtttacctttttcacatataccgttcccaatgcccagctcacggctgtaataatggcgatgattacacctgccacagccacatgccctgaaaatccgcccacactgacagctgcaacgcccaaaaatccgatgatcaatccaatcaccttgagtctggacatcgcttctcccagccacatccatgcaaaaataccgaccagcacaggctggagatataccagcacagaaaacaagccggaggggacgtacatcagtcccactgtttgcaggccataaaacagtaccacgttaaaaatacctgaaatagcatacacccgccaattttctttccaacgaatgcgattccatctcggtactaaaattgctcctaatagcagaccgcccagcagtgtacgtagccctgcaaacaacaatggaggtgtgaattccaatgccactttataaatgggccaagaaatgccccacaatacaaccagtagcgcgatcatcatcatccgcttggctgtcgttaactctcccatgacgctatcgctcctctatgaaaaaaatcactagactttatatactacgcctgcagaacaactttatcaaacaaaaaatatgtattggaaagctccacctttcatgcccgcttgttcatcgaggtatgtcttcggacagaggaatccagtcatttgcctatgttacaatataccaaaaagacttataaagcttataaggataggaggttgtctgcacttgatttatatcatcaaatttttgtacagctttgtgctccctcccggtttgttcatcctcgtgatggcagggctcgtgatctggctatggaaaagggcacgtatacctgcggtcgtactgcttcttgtcacattgctgctgtacgtttcctcgaccaatttggctggagatttgttaatcagtagcctggaaaaacagtacccacaaccccgtaccgttcaaggcgatgtcattgtcgtgcttgggggcggagccacacagggaacccccgacatcaatggacaaggcaatctgctaggatctgcggccaatcgactgctcactgcggccagattgcacgaagcaacaggcttacccattcttttctccggcgggcaagtgtttggagacagtggaaatgaagcgaatattgcgcaaaggcagctgctaggactcggtattccggcaaaggatatcctgatcgaaaaccgttctttgaacacacagcaaaatgccgtatatacatcgcaaattttgggaaaacatcaactcactagacctgttctggtgacctccgctttccatatgccacgtgctgcactggaatttcagcgtgcaggcatgcaggtcattgcttatcctaccgactatctagcaagtgaaaagctgtcactgtatgctggcaagctttcgccgtctgctggggccatgtctacaaccggaacagccctcaaggaatacctaggaattcttgcattaaagcttaaataatgtgatgtctagtcgtatagcggcacatagcacaaacaagcgtcttgcgctcgcaggtataagcctgtaagctagcaaggcgcttgatctacccttacatattctaatccaagaaaatatctgatatttgttcttccgatatgaccttaaagccttccttttttaacaaagccgaggttaccccgttacctgctattttacgattttcgaatgacccattatatattgctgctgatccgcaggacgggctgttttcttttaaaacaacaagtgttgcgttaacctctctggctatattcaaggcttcatatgcacctctaatgtacatatcgctaacatcgttgcctgagaactcgaccaccttagctgtgccgttcagcacatcctcgcctgtccctccaacaatctcagcaggctctctcggagtcacaaagccccccaaaagctcaggacagatcgtcacagctttcttttcctctaccaacttctgaatatgtacatccaggctatccgtcccgttatatcgtaccttcatgcccgccaaacacgaacttaccagaatcattagttccacctcatatccattgcattcactattaagtagttaaagtataaacaaattttctagtagagtcatcgtacgaaaattttgactcgccactacgtccgcgttccgtaaggatattcttccagctgatgacataatcgtaatcatgatcctgcactctacccatacccttttgaactctgttcgaaatacaagtaatgagaaaaaggccctgattagggccttcaaatactgcggagttcaacgtatctcctttgtcgtttaccccttctgcttgtaaaactcatggtacaacttcatcagagcgcgcttttcaattcgtgacttccttatcagtccctatagcatcgcggagagatacgtctttgcgtgttttttcagggaacgtaaatgcatcaggatctcattttctatacaacgggctgcaaatgttgccagcttggtgcctttcccggcccgaaagctttcactgtattcatccaaaataacctgataaaaacaagccggaggcgcatttttgggtttttatttgttaaggttcatcctactcgtaagtaagaaaattcactcttgctataagtcgtaatttaagatatgttattaattaaataatcaatcatttaattaatgaagtttagtttaaagagaggggaatacatttggcaagacccattaatgaagaaaaaagactggagcggcgtaaacgtatcctagaagaagctgttgtcctgttcgcagaaagtggatattctaataccacaacggctatcattgcgcagagtgtgggagtgactcctggaaccatttttcaatatttccccagcaaagaagctttatactacgccgctgtccttgagccgcttgctgatattcaggtgaaatcgcttgcttgtctacaacaagaggggacgccgggtgtattgattaagaacatggtggcagaacaattcaaccatatctacttctatataaatgaattgcggcttgtccaatctgtcttaggacaacgaataagattccctgaacttacacagaaggtccttgaaagtataaaggtaatgacagatgcgatcgaatgcgtctatgccaagggacagttaatgggagaattcaacaaaagcttttctccagcaatgatctctcgtgcctatatctctttcttaaatggagtgggcttaactcttggagaaagtattattcatcatcccgagtgggaaaatctgaaggggcatgccttttatttgttcgcccccatacaacctaaagaaaaactggaggagtctgaatgagtcaggcatcattacaacccgagctgacatttaacgttcgtgtgaaaaaacgaaagaaaattttatggagcctagggatcgtgcttttgcttgtgatggctcttgtattttttatatcttataaagtagtagacaccttgttgcaccatcctagagacactaatgtcagctacggattgaatatcgataaaactccctacgaagaggtcgagttcaagagtttgaaaaatgataatacgattagaggttccttctttcctgcaagtggtctttctggtaaagcaagtaataagacaattattgtcgtccatggatatacgagcaatcgtttagtcaaagggcggacccaaaagttagtagagcatttcgttccgaaaggctacaatgtattggcatttgacctcagctcacaaggtaaatccgatggtgatttgattacactgggcttcaatgaaaaatacgatttgctaggagctgtaagctatttaaaatccagagaccatacgggtgataagattggagttatcggcttttcaatgggtgctgctacttctttgctagccgcaagtgaaagtgatgacatcaaagccgtaattgcggatagtccttttcgtaatgctggtctatttttgagagagggtttgcccttcttttcaggtttacctgcgtttccattcagttatacatcgacatggatggcaaattgggcctttaaggttgatcttgattccatatctcctatggatgcggtaaaaaagatgcaagacaagccagttatgctcattcatggtactggagatcagcaaattagttataaaaatacagaaattatttacgagtccttaaaagataacccaaaagcagaagtatggtacccgcaaaatacggagcacatcgatgccatcaaccattaccccactgagtatttcaaaagagtagatcgctttttggatgagtatgtaggaaaataaattcaatccaagagagccgactagcgaaggaacttgtcctgacgaagtataaacacccaataatatcaagcatttttagcctgtagtgtagaaaaccactacaggcttttatttgcgttttaaatgaaaacacatagcaaaatagttattatttaagcgaaaaggggcagttgtttttataagatagccttagataagaatattggatggtagagggggatgcaatttaaacacacctctgaaaagaagcaagtaattgaattatgaaaaagacctaaaaaggccctgttaagggcctcaagcggcttcatatatctccttatccattaccccttctgcttgtaaaactcatggtacaacttcatcagcgcgcgcttttcgattcgtgacacgtacgagcgcgaaattcccagttctcgtgcaatttcccgctgtgttcgttcttctcctccggcttccaggccgaagcggccgatcaccacttctttttcacgctcatctaaaatatccaggttgcgatagattttacttttctcaattttgagctgtactttatctacaatatcatccgcctcggtgccgaggatatcaatcaaagtaatctcgttgccttccttatcagtccctataggatcgtggagagatacgtctttgcgtgttttttttagggatcgtaaatgcataagaatttcattttctatacaacgggctgcaaatgttgccagcttggtgcctttcccagtctgaaagctttcaatggccttgatcagtccgatggtaccgatggatataagatcctccaaatcttcgccggtgttatcgaattttttcacgttgtgttctag

SEQ ID NO: 2640 - DNA, 21522 bp, Unknown
  Kingdom: Bacteria, Phylum: Firmicutes, Class: Bacilli, Order: Bacillales, Family: Paenibacillaceae, Genus: Paenibacillus
tatcttaatgacattgcccttactctgtccctgttttccatgaatggtgttcgcccacttcccgttaacggtggtccaacctgataagttggatttaaaagaagagttcttttctttccatacactctttagaggatataggtgcaaagatttcagctttacatttccgcccttactatagatctttagtcctttgcttgcagaatccgcgaatatctgatcggtaatcactgtcgtaccctcattaccgaacacctctacagctgatctatcaacaattacctgcaatttaaccgtgccgttttttggctgtaatggtcccccatgcttaccaactacattacttccgtaatcaaaatttcctgaatgagtccggtcaacgaataattgctcgttgtagacatcgtaaccgacagtagtatattgctcacttccttcacggattttgaagccaaattctgttgccttagtatccgatacatcaaacaaagcgatcatctcaaatgtatcttctgataaattagaaagcagacgactgttacccgatatgattttattggtatacgaaatacgatcccctctgtcgcgaatgctttttagagaaataggggtttgttttaaacgtagaccctttgcggtttgagtgagctccatcttccgcggcagtgttgttgaacttctccacgttgaggtgggtgtatcgttggcatactgccaattactcatccagccgagccaatatttctcaccattctccccttctactccactccaatccacagcagcataataatcagccccatagtcagtccataatactttatcggaagtattctcatttttaaacgtttttccgtcaaagctgcctacaaaatactgcatgcccgatccgcctgccggagcaccatcatttatacttacctgtaggacccactttctttttgaagggtcgccatcaaccggcaattcgactaacgtaggacattcccatattcctccgatgctgccgtttgaggaaggaatccactgtccagaaatagcagaccagtctgtgaggagtccgctttgtttcgtatctgttttctccggctcttttgcaacctggtcaactttatccggcagggctccttcattataaacattaacatcatcaatatttagatgaccgtaaccatctgttgcatggtctactgccttgatatataacacttcaccaatataattggacgcgtcccatacgtattttgagtatttttcctcattaaatcttgtattgtcctggcgaatcaattcttgatcgtcggctgctctgaccaatgatacataggtattgtcgccatcatcggctgctcctagtaacagattgatttctccggatccgcttaatttaaaataggaagaatgcagttcacccgttgcttcatctccctcgtgaagcttggaatatccccacaagtgataattcccctcatgtccgaagggtccaccccaataagtcgcttcactggatacatgatcatccgaaaaagtatcaccctgggtcacagtccatccggttaaatcgcctgtttcaaaatcatgattggtgatttctttctcatcggtcatgatatttctacccaactgaacatcctgaaatatcgcagaagagtgtaaaagatgtaatccaaaatggccagacaagaaggttgtgtcattgatatcatgaatgagatttccgtccagatacatctttatatttgttccaaatgtgctcacttttaaagcatggctttgataagtatccagcgttactgtggtttcagccagaaccgttctattcccgtcttccattttcacaattttcactttatcgtttaaagcatcgatactcgccatatatccatttttcgcatcagcatccgtccggaaaacaagtgatcctgtttcatctcctccctctgacaaatctatattcgcattatatataaagttgtccccagtcttaccacttataataaaagcatcatctgcagatgtgccgcttttcccctccatggtatcttcccatcggccggttacagctgtccaattagatagattggttgtaaagttagaggtgttcttgaaattcacatttcggaaggaagctgttgaattccaggcggtcagaccgtaataaccataatcaaattcagtatccgtttctttaattacagactgatcatctacaaacacctgaatgtcatgaccatatacgtctacctgcacgttgtaagttgatgaggttcctagagttaaagacttgcttgcaatttctgtattcgatccatcgatattcttatttaaagtaacgacatcatttttggcatccaggctgacgacataaccgtttttcgcattcttgtcagcacgaaaaaccagacctcctgagccttcccggccattttttttattaagggtaatatctccctctaaggtgaatgaaccaccttcctgtgaagacatagcgtacgaagtggtatccagactattggcctgtattccgttatctttgccaaattcacttgcataggtccattcttttaaattgggtgaggtatacaacattactttgttcactgcaaccaaagacatcacccactgtttagagtcttcatgccagaatactttagggtctcgccaatccgatatcgggggatccggcattaccggatttcctttatacttagtccaggttctgcctttatctaagctatacgcaatgctttgaacctggcctttatccccgggttgagtaaagatcgcaaccatcgcttcttttccgaatcctgctgtattgttccaatcgatcacggcacttcccgaaaaaatctgaccgttttcatctggatataacgcaataggtaagtgtttccaatgaataagatctttgctcaccgcatgcccccaatgtaacgatccccatgtcgttccatacgggttatactggtaaaaaagatgatattcacccttataataaaccattccattcgggtcgttcatccagttagcctcaggcgaaaaatgaatctgattacggtaaggttcatcgtaataaccaagatccgctgcaaaggcaggagttaacggtaaaccaaataccataaagcaaataagcagcatacttaacttcctcttcaccatctttcacatcctcttttaatattttgaacaccaagtgttattcttaacatcacaaataaagcgtttacatttatcgcaataactcaatatcttctgtttacgctgttttggtcacaaaaatccgacgaagtccggccaaggataactccctgaccggcacgttttaagccaaaacaccaaatgcgtacccaataatgcctactgcgaataaagcaaaaatcagagcgattgcgttcactttctttttaagtagcctcatacataaaaaggtcaataatagtggtaaaagtccaggcatcaattgatccaaaatcatctgaacggttgtaataacctcttttccatccgttcccacataacttgataccaccagcggcacattcagggtggtccatttggaaacaagtgcacccataacgaaaagccccagtatggaggctgactccgtgagtttttgcaaccggtttcccgacatatcggagacaatctccgtacctttgtgataaccgtatttcagaccgtaccatttcgttgccaagcgtgcagtgttaaagagaaggaagaaaagaaccggtccgacaaggctcccggataaggcgattgaggctccgagagcagccagaaccgggcgtaaagtcccccagtaaatggggtcacccactcccgccagaggtcccattaaaccgactttgactccacttatggtggcattgtcaatcggctggccgctcgctttctgctcttccatcgcagccgttacacccataataggcgccgagataaacggttgagtgttgaaaaattccagatgtcttttcaatgcctctttttgatcttctttcttgctgtacagccgcttaatcgcagggatcaaggtgacacagaaaccgatcgactgcattcgctcaaaattgaacgagcctaacaggaagcatgaacggacaaacatcttatttaaatcacttttagtcagcttcttttctttcatagtgctctcctctcccttcaggtagttactataactcttcgatttcttccatcttctcattacgctggttgtattttgggctcagctggatgtaaagcagagccagaaccgcgccaatgaccccaaaaccaaccagattaatgctggtaaaagctgcaatgacaaagcccagaaagaagaatggcatcaggtatttggctgccatcatattaatgaccatcgcataccctacgacgacgataaagccgcccgcaatttgtagtcctctggtgataacctccggaattgcgttaagcatagcagtcaccaggcccgtttctgcggcaactgccaccaaaacagcgggcaaagcaacgcgcagaccttgcaaaagcaaggcaataaagtgacatagctcaattcctttgaaatttgcagattccgcatacttatcggctaaatgctggaagaagacagtaattgtcctgacaaaaatggtaagcacttgtccggcggctgcaattggaatcgcaacggcaattccggcgccgatcgattgatggccgacgatgaccaaaatggttgaaaccacgctggctagagcagcgtctggtgccatggatgctcctacattcatccatcccaaagccattaattccagagtaccgccaagtataatgccagttttgagatcgccgaggacaaggccaatcaacgtacacgcaatcagaggacgatgggtttgcccttcatccagaacgctacccatgccacatatggccgctaccagtgttaccatcacaatttgaaaaacagtcatttctataactcctctctagttgccgcctggtatttacgatcacatatcctgcagtttggtaatcaagttgattttcggatcactggctacttttctgatttccagctcaatgcctttttcatgcagcttacgaaatgcatctacatcctgttggtttacggataccgccccggtaatctgtgtctttccttccttaaaacacattcctccaacattcaccgagcggatgggtactcccccttccacaacccgcagtacatccgtagggttggtaaagagaaacaatgttttaaaatcactgtatttggggttattataagcctctatcgctttgttaatcgttacgacatacgccttaattccaggcggcgacacctgaagcaataaggttttgcgtaatgtatccgctgcgacatcatcgctaacggcgataatcttattgcacttcgcttctttcacccaaacggtcgccacctgaccgtgaatcagacggtcatcaatacgaactaatgcaatttccattctataattcctcctctaattgactgtttcgaatggcacgaaaagacatcatggaatcgtgccctgcatggatcgctaaatttaccaaattctccacttgttcaattcctctgtttgcaagaaggtcaacgatcattggcaggtttactcctgtcacaatatccattttttcatggttaaccgcaattcggctggcagcattataaggactgccgccgaatagatcaacaaggaagataacaccgtccgtccaatccagcgatgccaacgcagccttatatttctctacaagtccgctgacactttcacctggttcaaacgtaacacctgccacattatccaattggccgaaaaccatttctgttgacctcagtatttcttcagaaaatttcccgtgtgtcccaacaattacaccgatcatctgtctcaccccctttgtttctctccacatatctatgatgcaagttctgtgccaaacttctgtatagatcagaggaaattttgtaaacaacaaaaaaacccccgttgcgtcggaggtttttttccagtctgaacagatcattatttatcaatctccactgctttcatacacatatgaaagcgttttatactctttggccattactgtggaataaagttatatacttcgctcaacatttcgcaaatataatatttttcgtcttcagaaagtataagattcataccagaaacaaatatgctgcatgaacggtttaccacctcgagtatgtgctggtcgagctgtttcacttccccctgataaacaagtccatcgcgaataaccatacgttccagcgcataagctgtgtgagtagaaatttggacttttgttgcataatcaaatttgacttctaatccaagttccagctcttgcacaaatctcatcaccattcccagaattttgtggggattcaaatacgtcataaattctttcagactttcctcgcataactccctgacgactacactttgatccacagcagggatctgtttgttattcagcagtagctctctcaatgtctgctcaccgctcgcttcaatcagcttttccaagggaataaacgggatttccggctcgcttggccgttttactccaatcacggcaagaatggttcgcttagaccgcatatcctggaccactttatccaactctcttacgtttgccgggacaaccagtatttcctcatccgtcaaatcgcagacaattttctctacaaactctttcaatttgaccgctgcacctttgccagaggagcaaaccgtcacaattgccttataaactactttcactgcggcgctactattgttatatcccctgaaatcctttagcgattggtatatctcctctatccccatgtcaaaaacactggcctttcggacagcctccagcgtgagcggagttgaaaccatatcaatagtctttacattgattccaacacgttccataatagtttcttcaagattgagcaaagagcccatatcaaccagcagcaacacgcctctaccacggtcaatgctctttactttatcgataataagctccaaaattcccctaggactgacatcgaggggcatatcaacagcacaaagattagaactgcccagcaagctgtctacgacgccgacgatgctactcgctgtactggtaccgtgtgctgccacaataattcccacactaccctgtcgttcttcctcaacagatttcagaagaatcgccatataagttatttcggcctccggtacatgtacaccaaacttagactcgatcaaacttttgatagtctgggccagtctgtactcttcatcatgttcattcatcggttcatagattcgtgcatcaccgtattttttctctctggtgcgcttgaaaaaggcgcttaaatgaagactgaaagcatacacgaatctctcgctgtaaattcggtttagttcctttttggccatttccttaatctgctcggagaattcaaggatgtctttgtccacaattttcagaattcgttccctgctccctttggtgttataaaaacggttataaaagctttttatatggatattgacatccgtagcaataaatctgtggatgtaggcgtcgtcgagcccttcttccttcagcatgccaatcttgtcttcaattagtttgtaaaggttaaacggcagctcggaaacaacctcttcatccaaagcttttcttccttctggagtaatgtatagggacgaggaaatacatccgattcccttcatcttatattgcgttttatcaatattaaacaaaccatctcggatatttcccggcaggtttttaaaatcaagtcctatttcttctttgttttcatgtatgctgtttaaaaaacctttagcgcataccagctggatgttcgactttaactggccgatattgccgtaggtgacgctgccgatcagtgctcttactacctctggttcaatcctaatcggcttgtttaccctattggcctcgttagcaaacaaatgcttcaaaatcagcatttgctcctcaatagcacgttcctgaagggaagggatattgatcgtgatgggtatgcgcctaatgaaggttttcagcatggatgatccgggatcctccgtcgtagctccaatcaataacacactcgcgtctctttttcgatccgtttcgcccaatttgttataggtgtgagtatccatgaaatagaaaatcatttcctggccttccgggggtaaacggtgaatctcatccaaaaacaggatgcctccgtcagctttctccaccagccctgctttttcatgatcagcgcctgtaaacgcccctttaacgtgaccaaagatgtgggaaagtagcaagtgggggttattgaaataatcagcgcagttaaaaacgataaatggcgcatgctctgaaaaccgcttcatatacttgccataatggtacatcaacctggcaaacatagtttttccaacacccgtctgcccgactatcagggtatgcagacctctaggaggatacagaatcgctgccttcccctgctcaacctggttacgcatgctgcccctgaaaccgatcaaagcatggaacggatcgacctgttcgtcaggcagcaatacctctttgatgcttttgacctcaatttgtttctctttcagccgaacctgaaaggtgtcctcgataatctgcttgtgcagaaatctgaccggtcttcctttgattttaaggattagatcgtcacgcagcagattattcaactctttgctcacattgtttctcaacatcttttgatcatcagcaatttccgcagccgtaatcccttcccccgcaaataaagcctctttggaaattttcttggtgctttcggcaatatactctaaaatcttatctattcttttcacctgtattcctccagcctgaatcagtcattggaaattgatttcaacctgcttatttagggaacagaatatggtttttcagcgcatgagctactccatcctcgtcattcgagagagtaacggtgttggcagcagctttgacctcaaggggagcattttccatggcaatgccaagtcccgcaaaggccagcatgtcgatatcattgtagttgtcacccatagccagacaatcgctttgtttcagttggtactcttttagcagaatttgaatggctgccgttttggaagccttttttgacatgatttccagataagtaggcttggataagtagagatttacttcttcgccgtataggggtcgcaatacttgaaggacgcgtctgatctcttcgggatcacccatgcacaaaattttacttgttccatcagtctcttccctccaaccactggtaagcttagaaaaactataaatgcgaggctcgatattggtgatgtcacgttcttgaagcgcccatgcatccaattgttcaatataccactcatcatccttatacaggcttacgtgaagatcatactcagccaggctgtcaagcaaacactgtgtcattttcttatctatataacgggtgttcagcttgttcccgtgtttatctataacaagtgccccactgtagcatatgagaggctcagaaataccaagatgcttctgcaatggaataattgcttttggcattcgcgcagagacaagaaccactggaatctgcttatcatttataacctggagaatggtttctttggttgcttccgtgatttgatgcgccgagttaagcagcgtcccgtcaatatcaatgcagacaattttataagtttccataaatgattcctccagctccagtgtattttgttattcaatgaatgagtatacaagaaagatagtgtatataaccaaaaatacaacacacataataactgttacttattacgacaagctttggcttgtttatgaatcgtttctatcagataaaattactcggtaacgttaacatctaggcaggagaattgcataggcttagagaagtagatctttcataaatgactgactgtgaattcgtaccggaaatgtatggaaaaggagttcgaataagtcaatggtacgatatggattacaacaggaacaaggattcaagctggttatgacgcccgaattgcgacaagcaatcacgatcttgcaatattcttcggctgatttaatatcctttctgcatgaacaggcgaacaataatccagtcattgatttgccggagtttaatatgtccataggcagtatcaaagaagaagcagagcggttttcacagaaagatcaaggagatctgcttgaacattatcgtggcggagaaaaatatccatcggtccagcgagcaaaccccgttacatttctggattttgtccccaatccgaatgataccctgtttgaacatctgaacaggcagcttggactggtatgtgggcttacaaattcacagcgtatggtggcacggtacctcattggcaatttgaacgaaatgggatatttagaacttgatgttccaacggtcgcctcactattggacgttcccatagccgaaattgaggatatgctcttggtgatacagagttttgatccaccggggatcgcctcttacagcttggaagaatgtcttcttctccagctccagcttgctggcatggatgatgaatgcatagtcagaatggtaagcaaccatctggccgatctggcgaacaatcggatacaaaaaattgcggatgctcttgaaatcggtaggcaagaggttatacagatggccgatcgaattcgcaagctaaatccatgcccgggcgcagcatttgctcataaagagcagcaatacatcatagcagatataacggtcgaaaaagccaacggggaatatcttgtcctgattaatgacattagtgcgccgcgggttgagattaaccctttttaccggcaaatgatgcaggatctaccgaatagtgaaaccaaacgttttatccatgagaagatgaatacggcaaaatggctggtcaatagcctgaagcaacgtcggctgacccttctacgggttgccaaggccattgtggaaaagcagcaggatttttttgagcatggcgtgtatttcctcaaaccaattacccaaaaggagattgccgataagacgggcttacacgaatccacggtcagcagggcggtcagtaataaatttatacagacgcctcgcggattgttcgagctcaaatttttctttacttcctccttgacgtcagcggacggagatgctgcttcatcggagagtgcaaaaaagcgtatcaaaaatttgatagatgatgaggacaagcaaaaaccgttatcggatcaggctattactaccctactgggaaaggaaggtttgcatctatcacgcagaaccgtggcgaaatatcgggaagaactgagatatctttcttctgccaaaagaaaaaagtttgaagtttgaatgtttaaggaatagtcgcgtttgatccggttccatatttttcgatttggcttgatcctgaatgatccgactcgctagttcttgaattcaccattacacctcctttcttgaactaggatgttttcacttttgaaacgcttccaatttgctgtgagaaaaacatcagttagtagatccatactatgaatcgaccgaatgagctaatatttttacaataaaatcatgtagtttcgccttgcttgaagacaacggggagacgatacacttgctgatctaaagtttcaccttcgattttcttataaagcagtctgattgtcatacgtgccatctcctccactggctgcctgattgtagacaatatcggatgaaaataaggatggtcctgaatcccgtcgtagccgataacctttacatcctctggaacgcgaatgccctccctgcgtgctctttctatatagttggcggctaacatatcggtaatagcaaaaatgccgtccacatcgcgatgctcatttaggaactcgttaaaataggcatcgtcgtccactatagggtcgggcttctcgtagattacataatcgactcccaatgtttgcgcctcatgaatgaaaccttttctccgattcatggtttcactgaaaacggaagtgacacttcccataaaagccggtttctgggcccccactttaacaagctccctcaaagccagacgccctccctcataattatcggaggtcacacaagtaatttttttattgaagtgcctatcaatacttacaatcggaatgtcattgcttacgctattttctatatcattgtaagtaatgccgacaataccagctactttgttttgccgtagcatatccagataatacagttctttttcgggtttgccgccgctattacacaacatgagcttaaagccttcccgatccaactcatcctcaatgtaataagccagttcagaaaaaaaaggatgccagatacttggaagcagtaaggctaccatcttggatttcctcatcttgaaatttcgagcgacttcattaggaaaataattcagttcttgtatagcttcctccacttttctgcgtgtatctggttttacagagcccgagttgttaataactcgggatacagttcctacagctacgccagctaagctagctacatctttaatacttggcatcggcatctcccccctatctctctttatgaaaattataataacactaagatggaaacgtttcaattttgttgatgctcttttttcgctgaagctctttatcttccttaccgggctgaagcaccagcgcggattccattaggtatacgtcgttgtcctctacatctgttcatattcatctctatccttagggtcaagttctaaaaaacaataaaataaacattctccctgtgtgttcgctatacatattattcaacataacgtacaaacgtatagtatattgatactttacaacttacgttatatactattataaatttatacactgggggtaaggttaaaatgtccatagcttcggagttgagcgaaacgaagcccgattcactcagctttttacacggggttaaagattgtattcctacattgctcggttatgtatgtattgggttcgcggcaggcattgtgggtgcctcatcaggggttagcaccatggaaattgccttcatgtcggcgcttgtatacgccggagcctctcagtttattatgtgctcgatgctggctgcagccagtcctccatccgtcattattttaacgacattcattgtgaatgctcgtcatctgctgttaagtgcgtcgctggctccttacttttctaaatattcattgtggaaaaacataggcatcggcgctcttttgacggacgaatcctttggagtagcgtcggataaattggctaaaggcgggcaggtcagtgaccgctggatgaacgggcttaatattacagcttatctcgcttggattgcatcctgtgtggcgggaggggttctcgggaactggatttcccggccggaggcttttggtctggactttgccttgcctgcgatgttccttgccctgcttatttcccagctccaaagtgtccagacctccaaactcaagcatcgtctgctgcttgtgctatgtatggctgttctgatgtaccttttgtcctggtgggtgccatcacatatctccgtcattgtagcaaccatgatcaccgcaacgattggagtgttaaccgacaaatgagcattaatcccaatgtcctgtatatcattatcggtgccatgattgtcacggcgatcccaaggatcattccttttgtcgtgctgcaaaaactggcgcttcccaagccagtgctacaatggctttcctatattcccatctgcatattcacagccctcgtgatggaaaatctgctcgtccgaaccgaatcctcagtcactcttaatgggcaagtacttatggctgtagttcgactattgtggtgaagataaaaatgccctcctacaataggagggcatctgccatttcttatgatccacctgtcgtccttactaacgagggtgacagatcttcttcctcaaaaccacgttctcgttgtgaaagatacgaggaggcttgaagcctgaacatttctgcatacactccgtctatatccattaagcgttcatggctacctgcttctacaattctgccctcctccattaaaataatggtatccgccatacgtgcggaggacaatctgtgggatataaacactccaattttctcatgaataagctgatcaaacttttgaaaaacctctttctccgcatgtggatccaaaaaagagctcggttcatccaaaacatatatatcggcatttctcataaaagccctggctattgcaatacgctgccactgtcctccagatagctgctgtccatcttcaaaccattttccaagcaaggtattcattttatcaggcaggccgactatcaaatctgtaattcccgccttatctatagctgtccaaatagcctcatcattttctctggaagccacatgaccaaagcctatattatctctaacagccatctcataatgtacaaaatcctgaaaaacaacgcctatcttttctctaaagatgtctttatccaattcatgtatagagtttccattaattaagatttctccttcaaaatcggaatacaaatgagttagtaacttcacgatcgttgatttacccgatccatttctccctacaatcgccagcttctctccttgatgtagcttgaagctaacattagaaatggcattctcctccgtgttcgggtatctaaacgatacattccgaaattcaatactatgaatagcggacaaaggcaattgctgaaccgttttttgtatttttgcctcttccggcatatctaaaaaatcaaatagctgcttgatatataaattattttgacacaagcttaaaatcccttgtacaatgctctgcgatgttgactgagttaacgtgataccctgaattaagctcaccaagttccccactaaaatttgaccaacataagtggcttgtatggccatgaaaataataaatgcacacgcaccctgatttacaatctgaaatacaagagaagtataggatctacgaaccgctagcactttatcctcgcgataaaacccttcgagtatcgttttgtatctttttcgtagatagtctcccagttgaaatattttcacttctttaaaactattatctcttgtcactaaaaacgacaaataccaggattcacgttgtcttcctgctctttgaaagtgaacattaaattctctttgcccgatacgtaaaaaagaatagaatgacaagcatggaatgagaaaaatgaataagaatgcccaccatctccatgcgataagaatcgcacccgtcgaaaataaggttacaacactgctaataatagcaaggatttgagtaaatatttcaaacggcctaaaatctgcctctccctgagcacgttgaagcatattttgcacatctgcatcctcaaacgactgcaaagacatcttttgtgctttttcaataattctgatatttacctggtttgatagccggctttgaaacattttacgaaaaaagctttcgccaatattgatcagatcgtacagcaaattgacaccgattaagacgccaaaagctataaatacaggttgaaagcttccccctgacgctcccgccacgacactgttaattaattctctcgtggttaaaaggatcacagcaggaattgcacccttcaacaaattcgtaatgagtatagcaatcaaaaaggaaggatgtgtgtcccaaagcagtctgaatatacgaggccaaaatagaaaggtacgaaatatatttttataggacaaagagatcaggtcattggtttgtccattagactgtgacatagcttacccctttcctatgcaacaggttagctactgtatgcttagctaaagccatacattttatttctcgctccctatttacaccaagcagacgattcaaatgcatatgaatgatactgcccaaaatatcatcaggatgattggtaagctcgtgattatttttagccaggattatcgcttgagcatactgctgaatcatagtctgtcttttttctacaagtgctaagaaagcaacctgtgtggccgtatctgcttgtccaatccatttataattcgcttctacagtggtaatcaatgtttttttgacatccctaaacgccttcatatgaggcttgcaatcaattctctcttctagccagctcacttgctcctgaattgttaagccaaaaccactcagataatgaataatgttaatcacagccgctatctctatgtccagattgaaagcattagagcgaattcccttcatataggcgatgacccattgactatccacgtcaaaaacctgttctgccagctccataagtgtctgtcctccatacctctccaattcaggatggtatgtatctatgaccatattcgtaattatcccctcttcacgcaactcggctgcccactgatttaattgaggcaagccaacaagccatagcttttctggttctccctgaaaccgtagacggatatgatgttcaggatcaacgtatcgtaaaaagtaaaattttcgactccaatccttaaaccccggctgttttaagagatgccctaggcttaagcctaccaggtcagtctctctttccttgactccgtacaatttaaggtatagccactcccctcctggaaatatgcctctatgaatgctggaagaagtatgagcaatgaagtttggagaatcaatatgattttgtgaactagggatactcggtttcacctttatttttttcttctttagtggaaacacaaattcccccatatatcttcctgctgtcccctgtaatggggtatggaagggattacccaaacactcggtaagaagaagctcctgtccttcgcgtatcttgctcacctcacgtagcaattctttgatatggaagaggttgcataggtctaataaaaggcgattatcccccatcgttaggtaaacatagcgcggtacattccattgttgtctccacacctggaaaagttcttcgcctgctttggactcgcatgattctgaaatattcaatgaagctttgctcagtttccactgcgcagcactaataatgatctttttatatactagtcttggcaaaaaaggggactgctctaatggcccccagtcaaaataagaccacgtaccaatctctttattagtaatatccgttagaaatctgaatatatgtggtgaaagcttgtaattcagcatgtgtgtttgcaaggggattatttccttacccaaacgtctggacttgacataaaaacgatcatgagtagcacccaccactaaatcatcaatacaaagcgtatggtcctcatctttagaagacgtggttcccgatacaatctcatattccattaaatttttgcttaatgagatgttggatattttcccctgttccggcataaaaaccatctctgacaataaggcatcgggatgaaagcatcggtgatgatcatatatttcagataatttttgtacaaactcctcactaaacatatccagaaaacgtccaaaggttttacccgctctattcgagccagcactggctccaagtaaaagcgaataatctccagaatcaactttttcaggagaatcagcaaatatactataatagatctccattgactctggggaagtgtcgtagttatcagaaatcatcagttgctctaactgttcatctgtaagggcgagttctatttcatgattagaaatggcattcgaaacccattgaaagagaacagcgttgcgtttaaatgcctccatgcccattgattttttttcatttgaacgatacatttccggtatacccagaccccaatcctcatcaaacagttcatgaataggaacctcctgatacacaccgtacttttccaagaaacgattcaaatattcagccaattcatccgttttgggggatgcatacaatttgcacatgacttcagcccctaatgaaacctcatcaagcacatgtttcggcagcgttacttctttatccaatttaacatcaacttgtacaggtgtttttacagaaatgatatccagcattttgtcacataatttccggtagaccttctctccttctccaatcgtgcattgattatattgaagtaataaagcatcaatttcgtgtaaaatgtgaatccaaggatcggaaatatccagttttttaattttttcgaatatgtaatgaaagggtgaatgatccattaatggaggtctaagctcgctcaaaataaactcttgttctactagttgctgcaaataatcagctatgatttccaaagtagcgtcagggaatgcctttaatagtatttctttgagttccatcactcgaattggatgttcagcagcttcaaacgtcattcgaacaacgtcagtaaaccgaatggaattaaaattttctgccgaatcatcagcttctgctgctccatgcttaggtcggaatgataatttggctcgatttcctttgatcataaccgttttgtttaggaagacctttagttgattaaatatggccggatcagcttctattttttgaatcagtttatatatccattccatgtcaggtctggctctcttcagatgcttaggatagctaccaatatccagatcggtagtcttcccgcaaattccctgccccactcctgaaaacaacccaaatggagtcgttcgggtagtcatccgaataaaataccgataaaagctgttcagcgtcttctcatacttttgtagctctcctttatcatccaaagcatggccatctttcaagtaatgtagaaactgcattagggacggagaggctaatgatatggcttcttgaacaacagcttcttgggatgccaactttaatcgacgagttatttcctccaaagtaagctggctgtccacattttgatccgaaaacacctgaaaatatcggtctagcggtagtaatggagctctgattagaaaaaaatcacatgcactaaaccatctttcatcccgatctctcacttcattatgtagtttatgcgcatcagtgtaatgcagttgtctcttcacaactgaccacctccaagtttttaggaaatatattcaacttgtaaccgattccatgacatgttaccagaatttttggatgacttggatcatcttctattttctctctcaattttcggatgtgcacatacaccgtattagacgtagtaaaagcatccactccccagactctgtctataatgtgatcaatcgtagaagcacactcttttgtagtaagaagatacattaataatcggaattccatcatagtcagcatatgctcatgcccttgcttccaaataacctttccagtaggatcaaaaatgacattgggtgataaactaatagcctgctgttctctttccattccatattcagatgaagccattgaaaacaattgtttgaggagatccaattgccgttgatcatcactatgataggaaagaaagataaatggaaccgtaaatttttctttaatgctgtgccagtaagacaagtcctctagcgttacatgatcctgattcaaagctacaccgatacactgctcatcaatctccggtagagcctggtaaagcgaatcataaaacatgattcgaatgttttctggagtgcttaaagtctcaaaaaaatgcttaatcttcctaaaagatgatataaccataaatttttgtttcatctaatccccccaaaaccaatgcttcagataaagcaataaggtagcacccttaagaaattagaaacaattcactccatctccctgaatatttaagatgttctttcccaattccatagtccagcaaacttaacgcaatccctgttgctccttgcagtattcctacattatgaacatgagttgtcccctccaaatcctggtatccaaatgggagctcttcatcgtataaatttactaactttaaagctatctgatcggcaaagcgtaacgctgctagattatcggttaagttatagaatctatgagctatatgaagcaaaccagccaacccgtgacagaaagtaggggatagcgcatttagtagctcatcatctaagcaaaatatggattccatagctttttccgctatctttttccattcttcattactgcactcaattcctgctctgagtaatgtcaaagctattccaaaggttccatgacaccagccttcaatttctctcatccctacttttttcactctcttgttcattgaaggcgcttgagagtttacaggccaataccagccatattgatcctcctgaatttgaataagcaaaaaatcggctatatgttttatagcctcttgtaatccttcaactttgatctttttttgtagggcagtgacaagcagtgcaagtattccggtgataccgtgcgccaaacctagatggattgaagccgaatcttcccttgacgacaaatgtatatattcaggtataaagtgcgtaatggtatctaataattgacgggacagatcacacatcgtgttgtcttcagtaacctccagtgtgtatctgcccactccaagcagtccattgatgatatccatttgggtactgaactctgtagttgtaccaattacaggtaaatctccccactttacttcaatatacttattaagctgagagattagtttgttataattagctctgttattggaagctaacaatatgccataagctactccggttgttccataataaagagaaatacgaggcaataataatagagagttagcatctaagtaccgtaactgactatgcacatgctctgcccaattttgatcaggctccaggtaaccccattcagacaacagcactaacacacccggaattccatcggcaagcgagctaggattccaaggggactttccacgtgaaggtgaaaggttgtttgtatgattaactatcttttctgtatatgataggtctattagcttttgtgctatatacttactgatttcaactgatctccccttcaaatcttcagccatagatccttccctcattttcataactggaaaagacacggttatagaaaccgtgccttttttccatgtattttcgttattaacacgttttgcagaaggtaagactaacttgacaattcaaagtacctgttgcacatgaaggagtacagataagaccactggctggttgaaccccttttggagcaacctcatttttggctacttgcaagtccagatcaaattgatttttcatcttgttacctccttttattttttacaattttattgtaagttatataatcttaactagactttatatatttcttacatttttcttaatttcaacgagtacatttaagatatatctttattactttttagtatttttaaggacagcacactagattttattgacaatataatgagtgaaaaaataatggaggctttcatatgaaaattgatagtttttttatataacaatacgactaagttcgtt

SEQ ID NO: 2641 - DNA, 139334 bp, Unknown
  Kingdom: Bacteria, Phylum: Firmicutes, Class: Bacilli, Order: Bacillales, Family: Paenibacillaceae, Genus: Paenibacillus
  misc_feature (106370)..(106371): n is a, c, g, or t
gtcatgaaatacattttattagacttcgatacaacccatttgtatgtagcaccataatctttttatgtcattaaagcatcgaattatgacacaaaaacaattattagagaaattaatgatgtatttaatagaaaaaaataaatcggttgtatgagtccatctagttttagtagattccttattatttgaaactagtcgagaggagataagatcgtggaatatgttttttaattcttattcacgtgaattatttcatgatgatcaagtaattattgctaatactaaatcaggtagttttgtcaaaacatctaaatcatattatcttgtgctaaaggatatgatcaataacggagaaattcaggtactattaaatcccgcaaaaagttcacagcataccgacgttgttcataatttaacgaatctttttcatgaattagtgaatattcaatgcattctcacggaagatcaattaacaaatatttatgaggaagctttagaagttgtatatctggctttgacgaataggtgtaacttacattgtaaacattgcagcgcttccgcggatataaggttcaccgacgttttaacaacagaaaaggtaaaagaggttattaatcagatcatcgccctccgacctcaggctattaatgtaactggtggggaacctatgatgcgttctgatctcatggatattttggcattcctaagacacagttttgatggccttattttgctatcaacgaatggtctttttatttccgaaaaaaatgctgaacagctactagagtacgtagatatgttttccattagcgtagatggttatgatgaggcaacatgctccaaaattagaggcaaaggtgtttttaatagggtgattaaaagcattaaattattgcagagcaaaggtttacgaaaaattgctttatcaatgacgattactaactatactcttgatggaggaagagaaagatttctaagtttatgtgaagaattaggtgttgatcctattgtacgtatcttaacgtctgccggaagagcagggggaaatagtgaagaaatattccctaaagaaccatttgtaaatgatcttaccccagaggatatgtattgtcgcctttgctctccgggaaaaagggaactgttcgtaggaggagatggaagcatttatccatgtggaggattgatggattctgaactttttgttttaggcaatgtatttgatgataatttaataaaattagtggataaagctaatcaaaaagctgaccatacccaaattgaatgtgcaagaccatgggaatttgagccttgcaaggattgtgacgttaatttattttgtcaccactgtatcagtaatatctattatttatatgaaaataagaatatttttcatgaggtatgtaaaaaacagaaaaagcaacttcaacaactagtgtggaatagctgaattataaaggagagtaatgaaatgaacttcacttattgggtaacagaggattgcaacttgagatgtaaatattgctatgtaggcaagacaccaaaaaccatgaacaaggaaacagctgcaaaagctattgattttacagtaagaacacttgctactgatctctccaacaataaagataaaatacgtatagcattgcatggtggagaaccactactcaattacccaattattcattatcttgtagaagaactaaaagaaagaatttctggaaatataatttttacaatgacgacgaacggtactattcataatcaagacatgattgattatattttgaaaaacatcgaattaacagttagtttagacggaaagcaagaaaatcacgatattaatagaatatataagaacggagaggggagcttcaacagagtaattgaaactattgattacatcaaaactcaaacacaatcttttcgggtaagaatgacggttacacctaataatgttttatatttagctgacagctatatttatctttcagaaaaaggttattcgaatgttacctttgcgttggatgaaagtgatacaaattggaacaaaggacttatggaagtttatcaaaagaatctgaacgaaattttctcttatatggtgaatacggacctgagtaaagcacaatatcacttatataatttaaaaaacgaatatttccggcctagaagtgtctgtgatggttgtcatacaagttttcatatttctagtttggggaatttatatccatgtatttttgccgtagggaacgaagaattttccatgggagatgtgttttcaggtatagtcgaacaacgtttatttgatttagatgaaattagtcaaaaagatcaagggatatgtacaaattgtgctatgtacaataactgtcgaagcaaagtatgtaagattattaataaaatacaaactggaaattattacaagtcatctccggttttttgtacgactcaaaagatacactattcaacagtgaagaagtacgaatatatattagaagattttgaactacttctttctaaataatgatttatcagcaattattttgctcatcttctttccaaaaatggcctgttgcataattcagcgcacgctcggaaatttataaacgatgttcactctggcttggataatgtggtagaactcttaagaggttaagacgtagaggagttagatctaaaaaagtagcctattatgacaaaacaagtgctgatttttacaaaggaaaaatcagcgacatctttgatgctaatataatagtgaaaggaggtgaggttatcatggaaaagcttgaaattttagcaaccacagactttgatatggaagtacaagggaattgcactggtgattgcagacacgattgcattgaatataaggactattgcagttctaatacttaccaaggctggtaatttaaaaaaacaactaatgtttcattcaagttgaagcgtttgttcagtcgaagaaaaggtaaataggtacccgtagatcggacacttaaaaaaggtgttcaggctgtgggtgcctttttgtatgcgggagtaagaaatggtgattagatacgcaagaagagacttaatgacgaagagcgatatcaccgtcttccatcgtttaggataagaccatgagtaaacacaaacctaaacagcacgagagcatggagagccaaaagaatatgaatctaggttcagcaaatacaagcactataatagctgctcgagagtgaaacagtctagtaagaccagacagggaatcacttttttacggatgcaggaaaaccacatgcgaaattgttaataattagtacccagctttagtgtacagaacggaactaacaaccagttcatattggtgcatatgtacgttaaatattagcaacttcaacttcttaccgcagcttcttctaattgaagagtttaatggcctccgctagcctatagtctgttagaaaaagatgcagtagtccaaaatacaaagctacgattctcaaataactgaaaatcgtagcttgtttacatcgtctaaaatataaaggactgtctcgttcgtagaaaatctactatagaacagtagacgtatcacttaactatccttgaaaattaagagatttctcaatagtctgaggacaatcccaaatttatggctggcttattgttttacaagcaaactaagtgaaacttggtcgttagtttaatctgactcacgaagccgctccacaatactttgtttgtcgtttatagaatagattgctactggaatgagtatcccaatcacaaacagtaaaggcagtaagactaatagtggccagattataaagtgatagtttaaaaaccatatgatactgcccatgggtttcacaatcgaaatagaaaatacggttgcaaatagcatagagaatacgctggtgccaagcatataatatattccttcatagatcaaaacggcccgcaactgtttcttggtcatgccaatgctttgcagcatagcaaattccttgtgacgggtcagtatgctagttagaatggcgttgataaaattgagtattccaattagggcaataattaaactgagcgtgccaccgatcatctcaatagtgttcttcgttctggaaaactcctctatgactgtgaatttggatttatagtgcatcatcggttctgttttttcggtgtaacttttcaaaaagtattccatgtctgcttccttgtcggatgatacatttaaggcgtagctcataacagctggcctttccacaagcggcttgtagacatcagccggaagatagaaggtgctataagtacccatataggggctagaatttgtgcttttgatagcaacatgaccaagcactgtgaattcatgcgtagtatattttttgtccaatggagcttctgtcgtgcccatataactgtgaagtttaatcttttcacctacctcatatttagcgttttccatgtacggtttgttattgtcgtctaaaattaccccctcaaggatgtacttacctaatgcaagctttttaaagtttagttcaccatcaatcatctgcagccgatgtaatggcaagtcttccaacccatatacttctacattgaagttgcctcgaatatcagtgttatctgcttccactgtgatatctctttcattctccacagtgagaacttttggaccaccatataatcgcccaccttcttcaaagccaggttgtgcctgtacagctttaataaagctctcggtagtttcatcttcagggccgctaaattctggcggtatttgaaagaatccagcatgggcaatgagaaagtcagtttcactgaatgtagacaaatacttatccatatcaaagctctgtgacagcgttaatactgtgttaaggagaacaaggctcagcgacaaactaataaccaccagaacagttcgctttttatgtcgccccagattggagagagccatgcgagacattttagcaccgttggtggatcttttcagcttgctgctgttcttggtattcccatcggtgtatcttacggcctccaccggggacacggttgcggcaactctgcccggcctgaaagtgctaatgattactgtaatgatagtgaagagagccgatccgataaaaatccatgggctaggtgataccgatacttcgctactgatatacttagttgtgtttatgatcgaaaagaccagcggtttgccaacaaaaaagcccgtgataaggccaatgggaattccgattacggagaggagtagtgcttgcctgcgaatgatgcggcgtatctgtttaccagtcgtgccaatcatctttaacaggccgtaaaagcggatatctcgcattaccgatatttggaaaatattatatattatcaagtagccggtaagcacgattaaaagcatagcagaagttagcgctatgattgttcctgtatccatactgaagttggtcgaaagataggaccagttgacattatgagccatataattaggcgaatctttctcaagggaataaccactatctgtaatcactctgttgagtttctcttccatattcaagctattatcaaacatgaggtatgcatttacaattcctgtttgatcatagtttttgtctcccacgctgtaggtgctttgcagttcatctgcatgcgcatctacataggctctggaagtgaagatttgtcctgtattagctgtgggattgctttcccaccagccagacagaatcaaatcacgcttcacttctttgccgtgaatttcaagccgcagcgtcagtggtgcacccaccttcaagggaactcccaacaattgcagagttttggagtccgtgataacttcattttctgcaatcggattattacctttttgtagcttgataagtccaagcttcagccccacatcgtcataataccaaagctctgcacgatgctttataaattcctcgtttgtaactttattgcttaatagtttggcataagctatttctttgattaacgggtgattcttgatgtggttaaatttctcatcattgatttgtttgagtacggcatggctttcgccaccggcctgccgcatgttcgcttgttgcatactttccacagcaccaagccccatagtgaacagtgctgtaaataacaatgcagtcaaagcaatggaacaaatagcaaagatgtttcgggttttgttcactttaaaactcttatctgacagattacggatcacttttttatttctaacctggatcatttggcatcaccacagataattttaccgtcttcaatccgaatgatccggtctgccatttgtgctatttcttcattgtgggtaatcatcaccatcgtttggcggaactgctgactggatactttgatcagtcccatcacatcaaggcttgttttgctatccagattgccggttggttcatctgccaaaatgatagccggtttcgcggctagtgctcgggcaatggctacccgctgctgctgaccccctgaaagatggttgggtagattattcagcttatggtcaaggcccaaggtatgcactattttatctatgtgggttttgtccggttgtttcccatccagttcaacgggtagtacaatattctcgtagacatttaagacgggaactagattataattctgaaaaacgaagccaatctttcgtctacgaaaaatcgtcaattcttcatctcttaaagaaaaaatatccttgccgtcaatggtgacgtttccacttgtcggacgatcaagtccacccagcatatggagaagggtagatttgccgctcccggacgtaccaacaatggcgacaaattcaccgcttttcacctccagattcacaccatctaaggcatgaacagcggtatccccaataccgtaatttttctttaatgcctgagtttttaataaagtcattttgtttccctccaagaaatagtctgtatctccttgctatactatacagactgtatcataataatctttctacaatctttctgaagtctaacaatgttgtaagaatcacctgcctatgggaagaaaaatggaaaaggtgaagccgctaccccggcgtgaacataccttgatgtaatcaccttctaccatgagtatttttcttgctaaaaatagtccaatgccaacaccttcctacgaattagcggtataggagcgatagaagcgcgtgaagattttaccatattcctcttccacaatgcctatgccattatcggtaatatcaattcggcaaaaaaaacgtacgccatcactttaatgttcatgtgtccggcagtttctgtgtatttcatagcgttgtccaatatattatagactgcctcgttcgtccatttcaggccaaaataagcatggatcactgtactctccatagcaacggagatccctttagcatctgccttggcgaaaccgtgataatccccgtttcaagttgcgaggtttcagcaatgcatgtataaggaaatgaattttttcggcttgtgtggatagagcttttatgcagaggagctatcctccagcaaatcatattcgctaagcagctgtgagtaaaggaggatgttagcattaggtgttttcgtttgatgtgggatgtcagaaatgagctcgtttattttatttgtttctgccaacaaattttcgaagaaacggagcaaatggaaagaaattgcgcaagcttggcctccactgctgacataacggattcgtcaaaaacacgctctgagaactcgccactaattgcagcttcaaccatatgaccaatagttttcattgttttacgtacgttattacgatatataagaatgatagccccagcaaagaataaagtagtaacggcacctccaatacacacatagttcaggggagtcattttcaccgcccatgtgtaagccgatcccatatatgtcttaatgtactggggacaggagggaagattctctagcttgtcacgtagcctttttatggtgactgacaatctagaggatcttcctagatccatgccgtttgtatggcagccagaagattaataaagctttggttcaacaaggagttaccgtgtcggaaaaaacggtagtacgaatcatgaaggagcttggtttaaagtcaaaaacgtgaaaaaaatacaaagcaaccatgaactccaaacatcagctgcctgttgatgagaacctctctaaatcagtatgaacggttgcaccgaaaacctgattgaaatcctctactttgggtatccattctaacagtagtcccctctatttaattatgtcgaaaaagtagctgatttttacattaaaagaatcaggagtacatactaatgtatcttaatagtgaagggaggtgattacatggaaaatctcgagattttggtagccaatgattttgatatgatagtacaaaaaacatgtactggtagttgcacctcagattgccaaacacaagatggttattgtgattgtaatgtcacctgttggtggtagcattcccacattagaatttttgcttgttaaacgattaagggtggaaaaggagaagtgtttacatttcttctttttttgcgttctatagatatgcttataatttccttgtctttcttgactttatagtaaatctgcgtccatgtagatgatcgaatagataccttcatagggcgattatgaagacgatttatgagtttcgtgggtgatccaattctgtgccgtagtcagcttattctccttgatggatgtccaaagttgctctttcgccaaggacctatgtgttccttctgttttctcattattacaataaattccagggaggttagggaacggggaataattatacagttgaataaccaagaaatgacccagccagaagtttttgctaggtcattttctttacagggggacttattcttctgttcgcagtcgttctactatagttttcctgtcgctcagagaataaatagcaagaggaagacatatcccaagtgcgagcagaacaggcagcacgaggatcaacggccagataataaatttataactcataaaccatatttgagtactcaagggtctcgcaatcaggacggaaaataggcttcctaataagatggagcatatgctggtgccgagtacatagtacatcccctcatatacaagcattgtttttaattgtttgttggtcatgccgatactttgaagtatagcaaattcttgacggcgggtcagaatgctagttagaagcgcgtttgcaaaattaagaatgccaattacaccaataataatactaagcgtaccgccgatcatcagaattgttttttgcatacctgaaagctcggcaattacagtggatttggatcgatagtccatcactggctcctttgcttcggtataattctttaaaaagctctccatcgttttttctttactatcggatacattaaaggcataactcatcaccacaggcttcttgacaagcgttttgtagatatccgccgggagatagaagtcagtataattagcaacgtctacaccagaattggatgattttacgccaacatgaccaagcactgtgaattcatggctagtgtactcctgggcatttgctgtgtccatatagttatgaagagtaaccttttcacctactttgtatacggatagttccatttcaggatgatcgtaattgtctaacctgattccttccaaaatatactttcctgaagctagcttgccataatcaagctcaccatcaattaattgtagtcggtgaagggggagatcttcaagcccatacactggtgcagataagttgccgcgagcgtcaggagtgacgatttccccgtacagcttcttcccctctttgttctctttatactcgacagtgaataaattgccgccactgtacaatcgtccaccttcttcaaaaccgggttgtgcctggacggcctgaatatagctttctgtcgttgcattgtcagggcccgtgaaatgttcttgaaaataatcagcatgtgcaatcagaaagtcagtgtcatgacttttagacacatacttattcatatccagactttgggataatgtaaaagtagtattcagtagcactagacctagagaaaggctaagcagcaccaaaatagtccgcttcttattgcggcctaagttggttcgagccatcagcggcattttagcaccgttagtagatttttttagttttttcttatcctttttggtagttccgtctacgtatcttactgcctcgatcggagacacagtcgccgcaattctactaggcttatatgcactgatcataactgtcatgactgcaaacaaagcggagccgataaaaatccatgggctgggggatatagttacctcagcatttgcgtgcatagaagtgttcataagcagcagagggataagcgatctgccgactaaaaaacctgcgagcaagccgataggaaccccgatcaaggaaagaaataatgcctgtctgcggataattctgctgatttgcctgctggttgtgccaatggtttttagaagaccgtagaaacgaatatcacgcatcaccgagatttggaaaatattatagatgatcaagtagccagtaagcatgatcagtaacagaccagtggctagggggaagacggcttcagggttcgaactgaaagtgttggaaagatacgcccagttcacagaacttgcaatgtagttcggtgcatttttgtcaagggaataaccgctttctgtaatcactttattaagattttcccgcatattcgagctgttaccgaacatgatagttgcattgatggttccggtcatatcatgatcctgcttatatgtgtagcgtaattcttcggcatgtgcatccacataagctttagaagcataaatttgacctctgtctatcatggcggcggggtcactcttccaccagccggagaggataaattcacgctgtaccattttgccgtgaacctcaagcttcaaggacaatgtggcgccctctttcaggggagtacccagtaactgtagggtcttcgagtccgcgataacctcattttccgccactggcttgtggcctttttctagctcaatcaatcctagcttcagccctacatcgtcatgataccagaactccgcatggcgctttaaaaattgctcgttcgtcaccttttcacttaacacgcggctatacgctatctctttaataagagggtggtctttgatgtgattaaattcctcatcgttgatatatttgagataaccctgccctgccccaccagcctgtcgcatcgttgcctgttggaagctatccatcgtgccaagccccatagtaaatagagatgtaaataacaaagtggttaaggaaatagcgataatcgcaataatattgcggattttattggctttaaaacttttatctgataaattacgaaccgccttactgttttttattttgatcatcgggtcgcaccacctactattttaccgtcctcaatgcggatgatgcggtctgccatttgcgcaatttcctcgttatgagtaatcattaccatcgtttggcgaaactgctggctggatactttgatcagtcccatcacatccagactcgttttactgtccagatttccggtgggttcatctgccaagataatggcgggcttggctgccagtgctctggcaatagctacacgttgctgttgtccaccagaaagattgtttggcagattattcattttgtggtcaaggcccaaggtatgtactattttatctatgtgggctttgtctggttctttaccgtccagttcaataggaagcacaatattttcgtagacattcaagacaggtaccaggttgtaattttgaaacacgaagccaatctttcgtctgcgaaaaatggtcaattcttcgtctttcagtgaagaaatatctttgccgtcaatcgtaacgtttccgctggttggacgatcaagtccacccagcatatggagaagggtagatttgccgctcccggacgtaccaacaatagcgacaaattctccactttccacctccagattcacgccgtctaaggcatgaacagcagtatctccgttcccgtaatgcttccttaatgcctgagttttcaatagagccatattacgttctcctccacaaaaaaatgtctggatcgtagtcatctacagtacagacattaacacactgatctttctacaatctttctgaaatctaacggtattgaaagaattaagtatccatagaaagaaaaatagagaaggtagaaccacggccgtagcgtgattgtaccttgatgtaacccccctctgcagcgatgatttctctagctaaaaacagtccaatacctacaccctcctgcgagttaacagtaggggagcgataaaagcgggtaaagattttaccttgttcttcttctgcaatgcctatgccgctatcggtaatatcaattcgacaaaacaattcgtatgccatcacttttatatccatgtttccgcctgtctctgtatattttatagcgttatccataatgttatagacagcttcactggtccactttaggtcaaaataagcatgaataacggtgtcctccctaataactgaaatccctttggcatctgcttttggcgttatttgctccagtgcagcatcaaggagcttatgaacagattctcgtcttggcgctaccgtgataatccccgtttcaagccgcgatgttttcaacaatgcctggattaggaagttaagcttttcggcctgtgttgatagagctttcacacaagtggaggtatcctgtgatagttcgtattcgctaagtagttgggaataaagcaggatgttggccaatggtgttttcgtttggtgtgaaatatcggaaatcagctcatttattttattcttttcagcaagcagatttttggaggaaacggaacaaatggaaagaaatctcacaaaattagcttctattgaagaaagaacggattcatcaaagacatcctctgagaagctgccatttatcgcggcatccagcatgttctcaatggttttcattgttttatggatgctcctgcgatacagcataatagcacttacagcggtgcatacagcaacaacggtaattccaatacatatatataggagtgttgtcatttcaacgcccatgtgtagcccagcccataaaccgttttaatatattgtggggaagaaggatgatcctcgagcttgtcacgtagcctttttatcgtaactgacaaggcattttcacctacatattcagccccgtcagtccagatgctgtctatcaaatgatcacgcgaaacggtatttcctcgattgttgattaggatgcgcaacaatttttgctccgttttacttagttcaataggtgtaccattcttaataaattccattctctcgaatgaaaaagaaaaattgtcgagatgaatggagtctgcaagcgagtatctggatttctttagctgaacgccaactcttgctctcagtaccataagactgaaaggtttggtgatatagtcgtcagcacccagctcaaaaccagtgacgacatctgtttccatatcattcgcagtcagaacgatgacgggtatagttgttttttttcgtatatctgttaaaagatcaagcccgtttccatctggtaaatttacatcaagaatcattaggtcaaaggcagtgacgttcaattgttcttttgcagcagcaatgtcatatgtttgcacaaatacgttgttaggttctttaagagcaagaataataccgttactcaaggcgatatcatcctcgacgattagtatgtgattcatcattttcctcctgtttttttcataaccttgccactgggctgaggtttcgaaagcggcgcacagtaaaatattaaagagaggaatagaaatactctatttccagtttacagaatattgctctaatttgctcattgtttatcttgactgttcggaaactcttcataattgagaaaaggtatcactgaaataataaaacgatggcatccaaatgtagtcaatattataaaaaaaagggctggtttttacaatagggaagtctagggttatttcaatggtattttaggagtgaaaggaggtgagggaatcatggaaaaacttgaggttttggtgaacgaggattttgatatggaagtacaagggcgttgtactggttcatgtaccgcagattgtgaggttggccctaataattgtacttcaaatatagtcccatggacgtagtttattctgaaaaactcaaaagttaacaattaaccacgaaaagaagaggtagagatacttcttctttttctttttcatttacatagcaacatcagcattataaagattaaaatagcactacttcttatttgaaaatttgcgatcaaaaagtttccgtagttttttaattgtacacttttcaaaaaatttgacagatacaatatcactgatataatttatgctagttgatttttgataatgattatcattattggagggaggacagggccgaagcttggtacaggttattggacaggctcccttagttagagatgaaattacgttatttaatactggcttttctggtactggccttcgcctcggtttttattggtgttcatgatgtaactccacttgatttgttccacttaaccaacgatcaggcgcaggtgctcctgattagcagattcccacgattgatcagtatcattatcgcaggggcgagtatgagtatctgtggattgatcatgcagcagcttacccggaaccgattcgtatcgcccaccactgcagggacgatggatgcggcacgattgggtgtgctgatggctattatggtgtttggagcggcgggattctggacgaagatgctgacggctttcggatttgctctagggggaacgctgatttacatgaaaatactggataaaatccgtttcaaggacccggtatttatcccgcttgtcggtttgatgtttggaggcattttaaattcggtaacgatcttttttgcttacaaatacaatctgatccagggcatttcttcgtggatgcagggggatttttctctaatcatgagtggtcgctacgagatgctatatcttagtgttcctttggttgcgttggcgtacatatatgcgaatcgttttacaattgcaggcatgggtgaggattttgcggccaacttgggtgtacattacaagcgcaccgtcaatgtcggtttggtgatcgtggctttggtatcctctgttgtcatcttaacggttgggacgattccctttttggggctggttgtacccaatctggtcagcatgtatatgggggataatctgaaaaaaagtctggctcatacagcgatcctgggcgccgtctttgtgctgttttgcgatattttgggacgggtgatcatttatccgtatgaaatttctgtagggcttacggttggtgtgatcgggagcgcgttgtttttgtatttgctgctgaggagaagggcttatgaatcctaaattaaaaatcggaatattagccgctgccgcgcttgtgttgattgctgctttcgtgtttatagatcttccgcatacctggcattacgcgctgccacgacgattaaaaaagatcgcagccttcattctgacaggtggctccattgcttttgcaactgttattttccagacggttacgaataataagattttgactccgggtattatcgggctggattcactgtatatgctgattcagacgacgattatttttgcatttggttctgtccctttcatttcgaccagcaaagaattgaactttttgatatcggtggggctgatggtgctgttcgcaggactgctttacaaattaattttccgcaaagatggacgcgggatttatgtacttttgctgattggtctggtgttcggcacgctgtttaacagtttatctacctttatggaggtactgattgatccgaacgaatttgcgaaaatccaggacaagagctttgccagcttcagtaatgtaaacaccgagctgctgtggctttctgtattcattcttgtgctcgtattcgcttatgcgtggagattcatcaagtatctggacgtgctgtcgctgggacgggagcatgcgattaacctgggtcttccttatggttttatcattaaaaggctgctggtaattgtagcgattctcatttccatttctacagcgcttgtcgggccgattacatttctcggattaattgtggccaatgtggcttatcaggtgatgaaaacctatcagcaccgttatattattccggcctccatctgtgttagcgtcattgcattggcagggtgccaactgctggcagaaagagtattcgacttatcgacaacggtcagcgtcattattaactttatcgggggggtgtacttcctgtaccttttgctgcgggagaataaatcatggtagaagtcaaaaacgtaaccaaacgctacgggaataaaaatgtggtggatcaggtatccgtcactgtacctaaaggcacgattacctcctttattggacctaacggcgctggaaaaagcaccttgttgtcgatgatcagtcgcctgactgacagtgatgagggagaaatcctcattgacggacaggccgtgagcctgacgaaaagtgaggagctagcccggaagatatctattttaaaacagacgaatgatgttaatatccgcttaaccgtgaaggagctggtcagcttcggccgttttccgtattccaagggcagattgaacagtgaggatcgcaaaatggtggagcagtctatggcctacatgggactggaggatatgaaagataagcatattgatttgcttagtgggggacagcgacagcgggcttttattgccatgattctggctcaggacaccgaatacatcctgttggatgagccgctgaacaatctggatatgaagcattcggttcagattatgaagacgctgcgcggtttggtgaatgatctcggcaaaacgattctggttgtgttgcacgacattaattttgcctcctgctattcagactatattgtagggatgaaggatggcaggttgctaaaacaaggaaccgctgacgagatgattgatagtcaggtattaaaggatttgtacgatatggatattccgattcaacagatcggtgaccataaaatttgcgtttatttcacttagggggaatgttaaatgaagaaaaatatgatgtttttaacgctaatgcttgcattggtactgattgtgtcggcctgtggcacagcagctccggcaacaccggaagcgactggaaacggctcctctgctgcaacaacggaatccaaaaccatctcggtcaaacacgcattggatgaaaacccggtccaagtcaaagttaacccaaaaaatgtcgttgtctttgatttcggttcattggatacgctggataagctgggcgttgacgttgcggcagtagcgcagcaggatcttcctacgtatttgagcaaatttaaagattccaaatatgcaagtgcgggcacgctgtttgaaccggattacgagaaaatcagtgatctgtctcctgagctgatcatcatcggtggcagacaagctgatgcatataaagagttgagtaaaattgcaccgaccatttcgatggctgtagacaccaaggattatatcaattcctttaagaaaaacgttgaaacactgggtcaaatcttcgacaaagaagatgctgccaagcaggaactggctgcgattgatagctccatcaaggccgtacatgacaaggctgtagcgagcaaagctaaaggactgatcgtgctgacgaatgaaggaagcctgagtgcatatggctcacaatctcgcttcggtatcattcatgatgcttttggcgtaacccctgtagatcctggcattaaagtatccactcatggtcaaaaggtttcttttgaatatgtacagcaaaaaaatccggattatatttttgtcgttgaccgtggggctgtggtggtcgaagaaggcaaggaacaggttacaggcaaacaaaccatggagaatgaactggtgaagaaaaccaatgcatttaaaaacggtcatattgtataccttgatcctaactactggtacctgtcaggtaatggtctggaatccgtatctgaaatgatcaaggaaatggatgctgcactgtaatgaatacattcacatcatggaggactgtgtaggatgaaaggtcatatagatgaaattccattagatgggtaccttgtgcacgtctatacacctcccgtctccatgaatcataatgagctgtatcctgtgctatatgtgcaggatggcagctctttatttctaagcgggttggatgagctggaaagaggtttttctacgggagagctgccccgtgtggtgctggtaggtattgagcccgtaaatcgactgaatgattacacgccttggaaggcagcggctttagtagaaggaagacctgcttttggcggtggcggagatgcctatttggcgtttgtggttacaaaagtaatgccgtacgtcgaggcaagatatccagtgcgcactggatcggagcatacggggatcattggcgcctcattgggcggattaatttccatgtatgccgtattcaagtataaggatgtattcggacgcgtcggttccatctcaggctcgtattggtatccgggtatgattgattatatgcaatctgcatcttgtgcaactgtgagggatgggacacatcgcttttatatatctgtcgggacccgtgaaggtgaagggaagatgaatgtacaaaaagatatggttccgctgactcttcaagcacacgaggtgctgcggacacagggactgaatgcaaaagatgtgcttcttgagctggatcaggatgcggtacatcgtgtggattgttttcagcgtcaatttcctaaggctgtccaatggctgttcggatagcatgaatggaatacgaatctcatacaacaacctcaaaggattggagagcgtggagtctctatgtctttggggttgttttttttgtatatttttttcgtataatagagaaaaattaaaaatttaaagttatacgttgttggaagtgaggggagcataaatgaaaaaaaaccgcctgggatcatcggatttgctggtaggtgaaattggtttgggatgtatgtcggtcggtacggaggagcagcaaggtgtttacttgattcatgaagcgctagacaggggcataaacctgttggatacggcagatttgtaccagcacggacgcaatgaagaaatcgtaggtgcagcgatccgtggacggcggcaggaggtcatcttggcgaccaaggtcggcaatcggcatctaccggggcaggagggctggggatgggacccatccaagaaatatattctgtctgctgttaaagagagcctgcggcgccttggaacggactacatcgacctgtatcagctgcacggagggacgattgacgatccgatggacgaaaccatagaggcttttgagcaactacagcgggagggcgttattcgttactatggtatttcctccattcgccctcatgtcatccgtgaatatgttgaacgttcgaatatcgttagtgttatgaatcagtatagtttactggatcggcgtgcagaggaagaggtactgtctttgcttcaggagcggggaattagcgtgattgcacgtgggccagtggccagtggtgtattggctgacgaaggggaagggaagatagctaagggatatctggactacaatgaagcagagctgctggatgtgcgtaagcaattaaaggcatttgcagggtcggaccgtagtatgggtcagacagcgattcgttatagcctttcacatccgactgtcgctgctgtgatcccgggtgcaagctctttgggacaattggagcataatatttctgctgcggatattgcaccgctaactcaacaagagcggcagacgctacagcaaatcagccgagccaatcgttatgatgcgcaataccgctgataagggcaatgatggtacaaaagcgtgttcatctgttgctcctagctataaacgctacatttcagtctataaccgaagtacacgcttgaacatgtacccatcccagttgcaatttataaaagaaccattacaatataagaataagcctcggtttataattcatatgtgaatatggagacgttataaatacactctaggagggaccaacgaatggaacgcatcgaatctcagcagcaatatcaggatttaattaacggtgacggtctgaccgtcgtgaaatttgatacaacctggtgtccggattgcaagacactggataaatttatggacggcattattgaggaaaacgcggataagcgtttctttgcgcttgatgcagagaaatttcagccgattgccgacgaaaatcaagtgcgcggcattccgagtctgctcgtgttccgtaatggcgaaaaaattgctcatttgcacagtaaatacgctaaaacgccagctcaaatttcggaatatttgactacgctagaatccaaacaataatcagaacgcatgatagggatagttcagtacgatctatcctttctgcaaaatagtaaaagggatatccaaggctgatcattcagaccctatggatatccctttttagttattggttatcggtaccaaacaatggcttataaaataatgaaaaagaacacagccgccagcacgaagcggtaaatggcgaacgtagtcagactcaagcgtttgagcagaccgaggaatgttttgatcgccagcatcccgacgataaaggaagtaataaagcctgctgcgaacaccggaaaatcactcatagacagatgatccatacttttaatcatatcaatacccgatgcacccagcatgaccggaaccgatacgaggaatgtaaattccgcggctgccgtatgacttacacgtgcgaataggcccccagacatggttgagcctgaacgggagaagcctggccatagagctaggacttggaacacaccgatggtaaaagcctgtttgtacgtgatctcatccaacgtatgtgatctaatgggcggatgaaatttctcggccgcaatcatcaacaggcctccgatgaccaaactatagagaaccgtttcaggaccaaacaggtattgcttaattacatcacggaacagtacgccaattagcccagctgggatcatggctaaaataatatgtagcaggtttagacgtggctgactcgagattttgcgtctgaaatcaaacaggctcaggaatctgcgccagtataatacgacgactgccagcacagcacctaattgcacgataacctcaaacgttttgaccgtatcattctctgtgtttaatcctagaagatcagccgtaaggatcatgtgacccgtcgaagagaccggcaaaaactctgtcagcccttcaataattcccataataatagaagataaaatatccactttactagctcctccttacacgcgtgcagggcaaacgacctaagccgtttgccctggaaatatgtcatttcagtaggagtgaacacaagtgtcaagtgcaaagataaacgctcaggtcacacggttcattcccgggaagaagtgtccgattctgcttccaattcagatgcgggggatgtgtggtgtaaaataatctccacccgacgaatacgatttttacccatttcacgaatgataaatttcacatcttcttctatgaattccttgccctgtctaggttccggaacccggctatacacccaccctccgacagtatccacgtcttcatcgtccaatgtcaagccagtcagatcgctcagatcggaaagcatcactttaccatccatcaaataactgttctccgtcagtttctcgatttccttccgttcatccttatcaaattcgtcccgaatttcgccaacaatctcctccaaaatgtcctcgatggtaatgagaccggaggttccaccgtattcatcgaccaggagagcgatatgaacctgctccttctgcatacgtttcagcagtgtgttgacggggattacttccggaacggtcaagatcggttgaatcaggctgtcgaaaacaagctcgggattgcggtcatactcaaggaatagctgtttggtattaatcataccaatgatctgatccttgctatctgtcgccaccggaaaacgggtatactgctcttcgtgaatagtcagcatgttttcttgtagcgagcgattcgtaaataagcataccatatctgtacgtggcaccataatttccttggcaacggtctcgtcaaaagcaaagatacgatttacgtagccatattcggtgttattgatcttaccactttccacgctttcggacaaaatgatctgaatttcttcctgagagtgcgcttcttcatgctcactagccggttgaagaccaaacagacgaaccagacgattggccgagccgttaaggagccaaataaacggatacataatccggttaaaccacacgataactggagaggttaacagactgacagcttccgccttgcggattgccaatgttttgggagccagttcaccgattaccacgtgcaggtaagttacaatgacgaatgaaataataaaggccaggatatgtgaaaaatccccattgatgttgagctgttgaaagagaggctccagcaatttgactacggtcggttcaccgagccagccgagtcccaacgctgtaatcgtaataccaagctgacaggcggacaggtagccgtccagattattgacgactttttgtagcgccagtgcgtttttacggttctccacgaccagctgatcaacccggctggaacggattttaataatcgcaaactcggtagccacgaagaaagcactaaataaaatcaacaccgcaaacaaaaatagactgacacctatacccatataattttcactcatccctttttcgttcaattttttaaggaactccattttaagttcacttgaacttattttaagaacttaaaagaaaatatacaaggttcatatggaatcgtagcaggtcacctacctccaatttacacggaaaataaggcttaatagaacccgcacggctcattgcttcgctttacaagcctagtttgagggcgtatgatgagttcgaatgaacttgaaatgtaagaaagggaggaaagcagatggagtcttttacccttactcgtcgtgatatggcccatttgctgctggccatggaaggtcgccgcgaattgcagcctttggccgttcttcaggacgcctggaggcgcactcatagccatcttgcccgctccgggagcacgatgccgacatttttatacaccgacgtgacacctgtgctagataaaattatcaagggtaagcacagcgcagccttttcgctacaggagatcgtttctctgggtcaactggtcgaatacagccatgtctcactggcctctatgcaaaattgggtcaaacgtgacttcaaggaatttctcggcgctccgaagatcggcaaaaagtactcggtcaaccaggctgctatattgctcattgtagaagatttaaaatcatgtcttgattttgaatccatccgtcagctatttcatatcctgttccaacaacccgaagatgatacggacgatctgattcagccggtcgatttgtacgccgcctattcaactttgtttgaggagctggatgcgaacggagatcaactgcttgatgtggcagtagcaggctttgcaaaagacaacggaatttccgttacaggacagcagcgtcaagaaggtgcgacagaggagttgctggttcaggcggctgatcaatacaccagtcgtttacagcatttgacccctaaccagtgtgaagcggtgcgtaatactttgctggtggcagcagtagcggtacaaaatagttattttttgtccatggcacgtcggtatgtgaatgcgacgttgttcctggacttccaagggtaaatcaggattggcagtagaagccaatcctatttttcttctctttttagaggattgtctacccttttggagactgaaaaagtatacaaaagaggtatatacactaaaacgctgtcaaagatacaataaacatatataatccagcaattggaaaaactttgaatatctcttccaaagcatctggatacacacacaggaggtaatggcatgtccgatgtctccatcatcatttgtacccgcaaccggatcgaagacctgacacgctgtatacaatctattgcagtacagcagcaattggagcatacggctgtagaactgctaattgttgatgacggcgatatttccgaccaacagatcgagcagtaccgtcacatggtatccggattgcctcaaagcgttttgaaatattataaaaaaagtcgtcccggcgtttggttatcccgctatgaggccttgtcccttgtgcggtatgatattgtgctgtattttgacgatgatgcagaactggacgataaactctatatccggcgcttgctcgatacctatgatcaggatgaaacgattgtgggtgttggagggattgcaaagggattacattcgagccgggcaggaaagctgctgggcgttttgacatttcagatgtctccatccctcggcaagctctcgcctagtagtctggcaggttctttgctgcgttggggcgaagcaacggaggttttcgatacagaatttttccatggctgcaatatgtcatttcggagggatgcgcttcgggacatgaagccgtatccgtggatgaccagttatgccgtggctgacgatttgtacatgtgccagttggcgagccgttacggcaaattggttatcaatcctgacttaaccatcattcatcatgaatccccaagctcgcgcgataaggcgggcaaagtagccaaggctacagcgattaaccactattattttcttgccttgaaaaaggctggagtgattcagtatggagcccttttatggaccttatcctacttgatgctcaaagaaacgctgcgtcgcaattttaatgccgcagatggatacaagcagggggtgttgttcattctgaacccgcgcaagcaaaaatataacgaatatttaggcccggcggttcagtaatccgttttatacacattgacaggataaagggggagtatgatgttaagcttgtccattgctctgtgcacccgaaatcgggttgatgatctgacccgatgcatcaattcaattgccattgggggagcaccggaggcatgtgaaaccgagctatggattattgacgacggagaactgccgaaacatgtgctggaacgttatgagcgtcagttgggcagagcgggaattacctaccgatatcatcgtaaggagcagccgggattatggttatctcgtgtaaagacagctgaacttgcgcagggtgacatcattttgttccttgacgatgacgttgagctgccgagcagctacttgaatgagttgatgcgtacctatgaggcttacccgcaggccgctggtgtcggcggtatcgcacagggaatgagtaacagcttcatgggaacaattcgatgcttgctgtcattccagcagtctttgtccaaaggaaggctatccctcagcggtcagtccggctcgatgtataactggcataaggccaagaagacgtttagaacccagtttttccatggctgtaatatgtcatttcgtcgtgaagcgattcgcggtctggagccggtaccttggttgcaaagctatagcgtaggcgaggacttattactttcgcgcatcgcgatgaaaagcggtccgttatacattaacccggcgcttacgttgcttcatcacgaatcgccgtcctcacgcgacaatatggagcaggttacttatatgcgggtgatgaatcatattcatttgctgcgtgacgagggatctgggcctatcggttatgcagcactatactggacgacgttgtatcagattttgagagaaaagcccaagaaaaatcatactgccattcaaggctatagaagagcgctgaaagcgatcttttcaagcccgaaggagcctgttggcggagggcagttgcctgaacgtaattccaaaaaaacggtaggctgatggaggtgcgtcataagacgcgattgagcatagagacgagaggcttaataaggaacaggagttggacgtaacatgagcacatggacagcagcaaggaaagtattcacgggtgacagtctcgctaaaacgatcatgcgcacgagctttaacaatttttttgtgctaatcgtcacgaccctgacttccatcctgaccgcacgtatgctcggagtagaggggaaaggagaactggcggcagttctgttctggcctacactgatcggcagtgtgttgagcttcggattaccaacgtcgttaatttacaacatcaagaagaaaacaggcacgacggaagaactgctggcgttgtcgctctggattcagttgcctgccagcttgttggcaggggctgtggcctggatatgcatgccgctgtggctgaatggttatggtgcggacatcatccaactgtcccagctttattgtgcggcagccataccactggcagtgcttacagcgctgacgacagcattgtcgcaaggactggatcggtttagcgtatataatggtctgttgttttactacccgttactgaatttcatcggtctggtgacactgtggctgatgggcttgctcaatgtgcagctggcaggagcagtgaattttgccgcgagtttccttgcattagtgtgggcgttcctccgtttgcgcaagtatatgaatgtgcgtgctttccgcccatttaccagccgccaagtgcttcgtccttattatagctatggagcgagggtttacgggatggagctgatggggacgctgtccacacaaacggacaaaatcgttatagtggcgctgctatcacccaaagcgttcggcctgtactctgtcgtctacgccttgtctcgtgtgttcaatgtggtgcaaaatgccgtcactaacgttacctttccaaaagtgacggggatggagcatagcaagattgtcgaaacggtaggacgtgcttttcgcatctctatggctgcgatgctaatcgtcattgtgcctgctctcttcattggacgatacatgctgggtttgctgtacggccccgctttcctggaagcatcgctaacgttctacctgctgtcactggaatgtatcattggtggcggctcatggattctagcttcggcctttaacgcgctgggacgtccgggactggtattgttccggcaaattgtagcctatgcgatcaccgtcggtctattttttatttgtacaccgatctttggtctggatggcattgcgattgctttgcttgtaggcgcttgtgtacgattggcgttctcactgttctcattcccgatgtttttcaatgttccgctatcacggatcatttttgataaaagtgatattacatttgtcattcagactatacaaaagaagcgcaggaagggagaactgaaagatgccgaatttgcatcccatggctaaactgaaaaataagctgagcgtcattctcgacgtagtcccccaaggttcgaatatcatttatgtcgattatcccgtctataataacggtggggatgtactcatcatgaaaggcaccgaggcgttcttcaaggataatggcatccgtgtccgtgcccgttatagcgctatggatattcccgatcgacttcaaattccgggtgactggattatcgtgtgccacggcggcggcaacttcggcgatctctattcaaatcaccaaaatttgcgagaacgcatcgttcgcgatttccctaaccaccgaattgtgattatgccgcagacgatccactttcaatctgaacagaaggctaatgaagtcgctgccttgttcaatgctcatccggatctacatatgtttgtgcgggatacacgctcttatcagtgggctaaggacaagctgaaccagtgcagtatcacactatgtcctgatatggcacaccagctctggccattgaagccgactacggaaaccgtgaaggatgtattgtatttcctgcgcacagatattgaaacggtgggtggacaaaagaagttcgatgacgaggcagatgccgctcaccggctggactgggatactttgttcactccgctggaagtgaagggaattgtctatttccagaagttttatcgactggataagaaaattggtggtccgttgcctacgcgtacattctggtacaagtatacagaccatctcatgaacaaagcggttacgctgttcagctcttaccgagaggttcgcacttcacggttgcacggtcacattctggcctgtctgcttgatatgccgcatgttgtcattgacaactcctacggcaagaactcgcaatattataatacctggacacagccgaatccaaaggcgcagctgtttagtgaagctccaagtgcgttggagcagccatcttaatagtaagaaaagatacgtagattaatttcaaaggtatgataacggcaaaaaatctcctgaccacttcattggtataggagatttttgcttgtgttaaattaataagaatagttaagagttaagcttgtgaactattaaggctattcatatttaatgggatgatcgctcgttctttcttggcttctattgattattgacagttacctcatattttgatgcgttccagtttacctttgcacccaaggtttgagaaatgaatctgatcggtaccaaaatgctcccgtttatatattttggaggagcagcgagacttactttttttccattaaccaatgcgaaattttggtttacaactagttctatagtcagtttaccttttgtgatggtgacatgatccctttggctattattccaaatgactttagctcctgatttttcaaatattcctctgaaaggaacatagactgagccgttcagtaatttgggagtggtagtcagatccatggtagagccatctacggtcaattgaataggcttcactacaatagtcggttgctttacatttttcaatgtcgagtcaattccaagttgaccgttaacgttgctcccccaactccataatttattgttttccgttcttacgattgtaaagtcgtttccagagtttacttccgatatattagcaagcccctttactttctctggattggaattaccagcagaaatccagacatcgccagtagttgttacaaatgaaacagtgtggtcgaactgagcagagatatcttttaacttctgtggaattttaaactgtttggttttgctctctagcggattatatgtccacccgttgccattcatatcaattgcacttatagcaaaatctccacttttaatcattttaatttttttaagttgtttaagcagctgtggttctttaatattcgcatcttcattgtcgccgccccaatagagcaatgttccatccttggaaagtgcaaaggaaccctgattcgtagctgctatacccacaatattcatgggtagatcttttattaaagttggttcattgatgaaagatgactgaaagttggctaattggccccgagaattatcaccccagccccaaacctgcccgctttgatctaatgctaaaaagtgatctcctccggcagcaattttaacaacattttttaggcttgagaaggttttaggggcaatactacgaccttgattttttttactttgccaactaacaacggtaccatctgtttttatggctagagaactaaagcgacccgtggtgacctgtttaaaagtatcagatgacatagaaaccacaggagaaggtacggaacgatttatgccgtcttctgagcctaattccccatcttcattacgcccccatgcaagtagctttccttgcttgtcaatagcgtaagtatgttcaccactgcttgaaaattgaactatatctggagatggttttacatattcgtttgaatatgcttcttttgaaactaagcaagaggagaaaattagtaaaataactgataaagctatgaaacattgctttgaattttgatttttcaaaatatgctctctcctttttttaaataacttctaatatcatataaccataaacaagaaagaaattgcaaataaatccagtgagtatgcatttatttccataaaaaatgtagacaaatgaataatgaaatactattatatgttttgggtgaaaatttttacaattagggaaggagtatagcaaaaatttttctcaaaaattaggatgaggtgagagtgaatgaaaaaggtaaagttctcaataattatctttctgttattctcttcaattggtgttactgcttcggctaataacgaagatattacggaaaaagttagcgattcagtaacgcaatcaacttatggattagaacattctaaaaatgttacagtaaaaaatgatgctgaggttagccaggaaaagataaacaactttattattcaagccaaaaaagttgttagagaagaaaaagcaaatagtcaatcatttaatgcatctattgaatcttctacatatgaaactattgactactgttatttggacgatactaaactctttttttatgaggattcttcaattaaagatccagagttgattattttaccagttgaaaatggtagagaggaaacacacgttattaaaccacaagcaatacaaggaggatttggaggaagggtattggtcaatagtacgacaggtaactacattgagactagggccactactacatcaagtaactctactttgctggctacaaatggaaccccatatatgtatacagggtttacagcaagaggattggaagttgatgcaggattggcttatagtaaaggagatgctccgggagtttggcagccttatcttaaaataggtggggacgatccactgtcaacttcatatctacttgatggttataatcaggtacaatataaaaatgggtatattactggacagccagttcagatagacttatggaggaactatactagtggtgttgaacataacgctgtaagattaaaacttgcggggactgctatatgtgcagatcttggatgttcaagacatggtgatactaagctgaccactatcttttctaaatcaaatattggagtgaacagtgtagttaattataagttgttagcaactattgctggttccggagcaagcgggcagatgaattctactctaagtgaaatatcaattgacgggatagccaaaacaccagttaaagatgaagtagccaatactcaagtcacaattagtggaaatagtgcatcttttaagctttcaaaatagtatattagtatagtttataaaaccgttctaaggagcggttttatttttttattaaaagccatattgtttgcttacactccactaccgcttcattttgacaattcatttcatgaatagatataatttatgggataaaacttgtaggaatattgggaactccctaacttttgcagaataacatgaaagtatatttatttaaatgaatcgaggctgacgaatgagtaatcaatcgatggacatgcttctcacgaaggatatcgtgcgtgaaggggaaccgattttgcgcacaaaggttgagccggtatgcctgccgctgtctgaagaggacctgcaacagatgcaatggatgctggattatctgaaaaatagccaaaatgaagagctggccactcgctatgatctacgcccgggtgtggggctatccgcgaatcaggtaggtctgaacaaaagaatgtgcgctatttattatgaagatggggacaaaacggtagagtatgcattgtttaatccgaagctggtcagtcactccacgtccatgatttatttggaacagggagaggggtgcttgtctgtagatcggtacgtagccggatatgtaccgcgttacgaaaaaattcgtattaaggccactttaccagacggaacacaggagctattgactttcaaaggttatgcagcggttgtcgtgcagcatgaaatggaccatttggacggcattatgttctatgaccgtatcaacccggaagatccgcacaagctgccgcagggagtgcatatcgaaccttttgtacgtaaatagtttaggaattgtaaagtgtggtgactccgttcgccacatttttaaattttacaaaaatatagatatagaggttacgaagctttaaactggaaacgtgtagattgtgatagagaatgtgaaaatacataaaaatgtaagcgcttatcttatgggagggatggcatgaatcgtggagtacggcttttgatgaataatatgcgtatgcggaataagctgctgttctcctacgtactgattgtcatgatcccggtgctggtggtgggcggttgcgttactttttatttgcgagagcaggcattgaatagtgcaattgcccagacggtaaacaatgtggaaaagatcaagagccagacggcaaatttactgcgtgtgccaacggatatttcaaatgggctcatgttcgataaaaggctgagggagatggcgaaccgacggtatccgggtatggtagagctgatgaatgcgtatcatcaatacaaggattttaatgagtatactcagcaatatagagaagttgctaccatccggttctattcgtacaatccgacgcttgtcaataatctggagtttattccagtggactctaacattgagcggcagcagtggttccagacggctttgaaggggacggcgattaactggttttacattcaggataaggaagataacccggttaatcgcctgagcctggtacggcaaattccatttcccgaatacaataccaagggagttctgatgatatcgctgagccagaccgagttgaatcatatgctgagcaaggagccttttgaaacattgattgcagatcgtaacgggattgtggtcgcagctactcgtccgcagtcggtgggtcagacgttgggagatttacatttgggctttgacgtccagcgtgcgggtaagggaatatatgaagcgaaaatcaacggagtgccctccaacatcatcgtggatgagctgctgcccgcctccagtgtgagcggatttacgattatttcagtgttttcgacggagcatattgtacagggagccaaccgaatcagcctgattggtgctttatgtgttcttgcagtgctggttatggcactgattctaatcaccatcatttcctggctgattaccaaacgactacagcggttgagctatgagctgggtaaggtagccgcgggcgattttcatgtggtatcgagtgtggagggaaaggacgagatcggggatttatcccgccgtttcaactatatggtgagtagtattcgccaactcatggcgcaggtctatgagacgagtgagcacaacaacaggctggaattggcacaaaaggatatcaagctaaaaatgatggccagccaaattaatccgcactttctgtttaatgcgttagagtccattcgaatgaaagcacatctgaatggggaagcggaaattgcaacgacggtgcgtttgcttggcaggctgatgcgccggaatctggagattggtagtggtaaaacgacggtactacaggagctggatatggtgcgatcctatttgcaaattcagcagttcagatttggaaatcgtttgatctatgaagtgaatttggaagaaagcgcgacggacatgtcgattcctcccttaatcatacaaccgctggtggaaaatgcagtcattcatggcctggaaaataaggaagagccagttaccgtgaaggtagatattacaatagaacaaagagagttgaaaattaaagtagaagatgacgggatcggcatggaagctgggcaactgacccgtctgctagatcggatcaggggggcggatgagccggaagggagcagtattggcctgcgtaatgtacatcaacgtctgacattgatgtacggcgaacgttatggactgcatattgaaagcgcattacaagtaggaacaaccgtatacttttccataccaagggaggaagagtcaaatgtataaagcaatgattgtagatgatgagcctgcgattcgtgaaggattgtcctctattattgactgggggaattgtggcttccgtattgtcgatacggcagggaacggacgcgaggctctggataagttcggagagcatcggccggagttggtcattgtagatattcgtatgcccgggatgagtggactggaggtcatacgaagcatacgtgaaaagaacggagagccgtttcattttctcatattaagcggatatgcagactttgattatgcacggcaagccttgggcttcggggtagatggctatctactgaagccagttgatgaggaagaaatgacgacagagttgaaacggatatggcaaaacattgaggacgagaaagaagacggcaaatggggaagtacgccttcccatgagcgtaattggatcgaagcattattgtttccggttcatcgagagcatgctcgtaaggccgtagaaggcagcgattctctgcacaaagcatccgagcaagctgaacatcaaagcggtaacggaaaacatggacaacagcccgcgttaccagccttggactggagtagctatcaggttattctgctggatttacgtattcctgactgggatcgacaagctcggcagtcggcagcaaagcagcggctaacggaattgtgtcatgagcagggcagaggtatcgtgtttgaggctggaatatatatgggtcttttgcttcccgccacgttaaaaacggagaaagatgctgttcagttactggctacttggcgacaggagctaaagccgtgggcaacggaaatttatgtggctgccggtgatcctgtatccattcttaacgacattcccagatcttttgagcaggcactacgattgttagaacgtacgtttttgttccgggcagaaagagtcatgctttccggagacctatacgaattggagacagttgagactgaaatgagtggagcgtctgatcgtgctacaaatgatcccctacgttatgcagaaaagctgtactatgcgctagatatggctaatagtgaagctgcaacccgtgtcattaaggaaatggaagaccaatttccagggatttatcgcacagaatctgcaatcaaggcggcgttcgcccaaacattcacactggcgttgaacaagtatgcagccggacaggatcacagcagaaccgtgctggaggagcactccagctttataaccgatgtatatgcttattccacattgggcgagctggtggatcactcgctggagcatgtgttgcaatggattggccagacagaatctggtggcaagggcatcatcatgaaacaaatgattgactttatacatagtcattatgatgaaaatttgcgactggagttactggcagatatgttcaattacaatagtggctatttgggcaaactgttcaaaagtcatactggcgaggcctttaatgcctacctggataaggtgaggattgagcgagcaagggaattgcttgcacaaggaattaaggtacaccaggtggcggaacgcgtgggatatgcgaatgcagattattttcatagtaaatttaaaaagtatgctggaatgtcaccttcctcctaccgtaatcgggttcaaaagaacggaggaacagatggctgttgatagattcctaggtttaacgctatgaagtctctcttgcagatgtcggaggtacaacctccgaacgaagagaggctcttttttatgatgaaaaaatggatagatcaatcgaaaatgtcacatttgttatggagtttagggcgttttcatcaaatcgccaccattatgacacagctttgacacgatgttcacattttcgattctatttcatttaaatttattctatataatggggataaatctgaagccggatcatgacaaccatggtgaaggtatggagtgagtcattttctaaaaagtgaccgctgcatatgtaagaatgtgaatactatcacaaatggagaagacttcagattataaatactataaatcattgttaagagaagtgcagggggggagcaacatcatggacgtattggatttggcacggttgcagtttgcaaccacaacgattcttcactttgtttatgtgccgatctccattggattgtcgttattagtggcaattatggagacgatgtatgttatcaagaaaaatgacttgtacaaaaaaatggctcaattctggggaacgtttctgctgattaactttgcactgggcgtcgtcaccgggattttgcaagaatttcagttcgggatgaactggtcggacttttcccgttttgtcggtgatgtattcggtacgccgctggcgattgaagcattgcttgcatttttcctggaatcgacctttatcggattatgggttttcggttgggaaagattgtccaaaacggtccatttaatctgtatgtggttggtatctatcggtacgatgttatcggcattgtggattctagctgctaattcattcatgcaacgtcccgtaggatatgagattcaaaatggacgtgcagaaatgaaagattttgccgctctgctaacgaacgagcaactgctatgggaatttccgcatacgctgtttgctgcttttgcgacaggagcatttctgatcgcgggtatcagtgcatggaagctgatgcaaaaaaagaatatggacttttttaaaccttctttcaaattgagcattattgttgccttaatcagcgccatagctattcctttgtttggtcatggtcaggctcaatatttagtgaaaacacaaccgatgaagatggctgcaagtgagggcttatgggagaacagcggtgaccccgctccttggacagttatcgcatggattgatcctggaaaaaaggaaaatacctttgagattaaagttccttttgctttgagttttctatcctatagtaaatttaccggctctgtgcctggtatgaatgagcttcaggcagaatatgagaaaacctatggtccgggagattatatcccgccagtaagaaccacgttctggagcttccgcattatgattgcggcgggatgtggcatgattgcactcgctttatacggagcttacctgacgttccgtaaaaagttggaaggttcacatcgctggttcttccgtcttatgatatgggggatatcccttccattcattgggaatacttcaggttggatcatgactgaaataggtcgccaaccgtggactgtatttggtttacttcaaacgaaagattctgtttcgcctactgttgtggctggagaagtgttgttctcgttcatctcatttaccacattgtatttaattttaacaggtgtgctggcgtttctgttttaccgtacggctcgcaaaggtccagatattgagccgcatcaacaaacggtaattcatgatccttttgctcaagggggtgacaccattgtcgctaaatgatttatggttcctattgattgctgtgctgtttactggcttcttttttctggaaggctttgattttggcgtaggaatggccacaggattggtgccgcgtaatgaccaacaaaaacgtttgatgatcaatacgattggtccattctgggatgccaacgaagtgtggctgattacagcagcaggtgcgatgtttgccgcattcccgcatttttatgcaaccatgttcagcggatattatctggtatttgtctttattttgctaggtttgatcttgcgtggagtttcttttgagttccgcggcaaggctgaagggaaatggtggacaggaacgtgggatgcctgcattctgattggcagctttctaccgccgatgctgttcggtatggcttttgcggctttggtgaaaggtgtacctattcagcaaaacatggatttgaaagctggattttccgatgtattcaatggatacaccgtatggattggactgacagtggtcggaatgtgtctaatgcacggactgacgtttatttccctgcggacgattggagaagtacgggatcgcgctcgtgtgatcgcgtccaagtttcttccggtattgggcattttactcgcgggcatggtggtatggacttattttgcaacggatttatttgcacgtcgcggtccctttatgtatgctgcggttgcggtgggaattgtcgcctatgtgttgacagggtacttcctgaagcagcgccgtgaaggatgggccttcgggatgacaggtgcagtgattttactgaccttcgtatcgttattcgtcggtttgttcccaagatttatggtgagctcgattaacagtgcttttgatttaacgatttataatgcaagctccagtcattacacactgaaagccatgacgattgttgcagcaacgcttttaccctttgtgctggcttatcaggcatggagctattttgttttccataagcgtctcagtgagaaggatcatttcgaatactaatggataaggcatggtttgaattaaagggcattcggccagtgatgctgctactggcagccctttccctgctccagggggccgcagtgattgcacaagcagtcttcttggcaaaggctgttacgattttatttgaacaaaatccgctggtcatggcttggccgtcgctggcgttgtttttcgctgcttttgcaatgaggcatacggcgatctggctgcaacgccggacagctggccgttttgccgaagcttcaggcgcttccttacgggagcgtctgcttgcacgtttgttcgaacgggggccgggttttgcagcgcaggaaggcagcggcaagttggtgacgctagcgctggacggcatggatcgttttcgcacgtatttggaactgtccattcctcgtatgattgacatgatggctgtaactatacttgtgcttgtgtatgttttcacattggatgtcatttcaggtgtgatattgacgactacgatgccaattctggtaggcttctttattttgctcggcttggcggctcggaagcaggcagacaagcagtggcgttcctatcgtctgttatctcatcatttcacggattcgctgcgtggacttcagacactaagatttttgggtcgtagccaagagcatggggaaacggttgggaaggtcagcgaccaataccgcacggcaacgatgcgcacgctgcgggtagcgtttctttcctcatttgcccttgatttttttagtatgctatcggtcgcttttgtcgcggtaggcttgggtctgcgcctgattagtggctcggtgggtttggaggcagcactggcggtgcttattctggcaccagaatattttatgcccatacgccagttgggatcagactatcatgcttcactggatggcaaggaggcttggggagcaatacgctccattctcagtacagaagatgatgcgactaagccaaataaacaggcagctaacgataaaggattggacatcacgggacaggacatcctcgaactgtctgatgtgtgcctccttaatgaagacggttcggctcggcttgaacatgtgtctgcacatgttgaaccacacatgaacatgattggcatcgttggagctagcggtgcaggtaaaacgacgctgcttagtctgcttggaggctttgctgatcccacttcgggcgagctgctcctgaatggatgtggattggctggggatgccaaagctgagtggcaacggcatattgcctatattccacagcatccatacctgtttagcgcttctctggcagataatatccgattttatgaaccggaggcatccaaccagcaggtagagtgggcgattgacgcggttggactgcgtgaactggtagacggtcttccgggtggaatgaatgagctcattggtgaagcggggaggacgttgagcggaggacaggcgcagcggattgcattggcgcgggcattgctcagtaatcgtccagtcattttattggatgagcctacggcgcatctggatattgagacagagtgggagctaaaacagacgattttatcggttttgaaacataagagaatgtttcttgctacccatcggcttcattggattccggatatggattgtgtctggatgatggatcaaggtcggctagaagaagtaggttcccatcagcaattgattgcccgtgagggggcgtattaccgattgctgacggggatgtcggaaggagggaacggacgatatgagagtaacggacaatagcagacaaggctggtttgtaacgtatctgagacaatatttttgggcctttctggtagctgctcttttgggcgcactggccattggatgtgcgggcgcgttgctctttacgtccggtcatctgattacccgttcggccttaaaaccggaaaatatattaatggtgtacgttcccattgtgcttgtgcgaacatttggctttagtaaagcggttattcagtacctggagcgcttggtaggacatgatgccgcactacgccttgtgtcccgtatgcgggtgcgcttatatcgggcagtggaaccactggcgctgatgattcgcagcaaattccgtacaggggacctcttgggactgctggcagaggatattgaacagcttcaaaacatctatttgaagctagttttgcctgcgctatcggctttgctaatttatgcagcaggcatctgggcgcttggacggatggacggaacctttgccttgctcatggcgttatatggcggatttttgctttttattgccccagctacctcactatggacctcactcgccaaacggcgaatgttcaagcaggaacggagtaaagcctatcaggaactgacggatgctctgttcggcatgagtgatctggtgctgagcggacggactgggcatttcctgagcacctttacacaacgacacaatagggctgccgtaatggaaaattcacttcgccggagcgagtggcgttctcattggatcgcacaatgcgttgtaggtggcggggttgtgattatgactgtgtgggccggaggactggtagcacagaatcgtatagaagccacatggctggcatcctttgcccttgtggcttttccattgctggatggcttcgttcgcgctggggaagcggtggttcatgcgccggagtatcaggattcacttcgacggttaaaggattcggagaaagacacacctacacctggagcaggcggaacagcagatattctagaggaacaggctaccgctatgcgattgggccacggaggagacctgctgctgagcaacgtaagctaccgctatgcaacaacacaggaatggaacgtgcgtaatatctccctgcacgtaccacaggggggcaaggttgcattgcttggccgcagtggtgcgggcaagtccacgctactgaacctgattcagggagcattgcagcctgatgaaggtagcgtcactgtcgcagggattcccgtatatacaggtggagcatactccagtctatttgcagtgctaaatcagcagccgtatttattcgacacaacggtagcgaacaatattcggctgggacgacccgatgctacgctggatgaggttcgtgcagtaacagagcaggtagggcttggagccctgattgattctttgccagagggctacgatacccgaatgcaggagacgggtcttcgtttttccggtggagaaaaacagcgaattgcactggcgcggattttgctgcaaaatcacccgattgttttactggatgagccgacagtggggcttgacccgctgacagagcatgagctcatgcagacgatgtttcgtgtgctggagggtaaaacgctcatctggatcacgcatcatctcacaggaatggagcatatggacgaggtgatctttatggaaaaaggggtcatttccatgcgaggaagccatgaacagctgtggcaggagcagtcccgatatcgcaacctgtatgagctggatcatccgagcctgtgaaatgaggtatttaaaattttgattaacttttatatactggttagagtggatgcgtcacatgtagacattcaactggaggggctgatataaatgaaagcacttatctctaagtattggcatttgatgctgattggttttgtagccctgagcatgggcgggtttgtcttgttttattttcaggggagcgtgtcgtcgtttccggccagtcaacctaaacaagctcaggaagagccagacaagaccaaatatgagattgttacagtgggtgtaaaaggggacggtttctatcctaaaaatattgaagtgaaagctggcgttccaaccaaaatcaatttcaagaaaatgacatcctttacttgcattgatgaagtgcagtcgttgaagatcggaatggacgtttacctggatcacgaaaataattattttaccgtcaaggacttgaagccgggggtatatgagtataattgtggcatgtacatgtactacgggacgatcacggtaaaataaatcaaaatagctttctagcacatggatgctagaaagctatttttttcctttaatcaattaggttaattgcgacagtctgtatatataccatcatccacctgtggtgcaatatgcattatcctttatcctttacctctgatcagcttacattgctgatcttttgttttttacaagacttctctcagaaaatttacatgagaacggagcaggcggaatggtgctggacaagcgaagcggtcgcctttttccccggatttctacctttggttgcttattcaagaaatccggggacaacagcgagggaagcaccatctgcatgcgtagtggcacgaatgtaatttttttcatcccatatatctaattttgaactgatttttcccctaattcgtcgggtacccgcttccgagccagcaaagtatgataatagtatctagagatgaggaggagcttgttatggaatcttcaactgaaaccgcttccaacaatggtgctgtgattcctgaatccaaccggggaagaccgcgcaaggctcgcggcccaaagcctgaacttggtagaaaaggcttgtgggacagtgtgaagcagcaaaagtatctttattttatgtctattcctttcgtcatatgggtgtttgttttcagctatcttccgctctggggctggacgatggcgtttcaaaattataagccagctaaatctttttcggaccagaaatgggtagggctgaataactttattgagctatttcaggatgaacgattttatctggtattacgcaatacgctagcgatgagcctaatggggattatatttggttttgtcgtaccgatcttctttgcaattctgttaaatgagctacgtggtatgctgttcaaacggtttgtgcagacaatatcctacctcccacattttgtatcctgggtagttgtagccggtttggtcaccaagatgctgtccattgacggaggcattgtcaacgatatattggtagcgcttcatattgtggatgaaccaattcagttcatggcaaaggggagctggttctggtacattgtaaccgcttccgacatttggaaagagacaggttggaatacgattatttatttagctgcaatcaccggaattgatcaagaacagtatgaagcatcgcgcgtggatggagcgggccgctggagacagatgtggcatataacactgccgggtatccgctcgacgattgccgttctgttcattatggcgattggacatctggtgagcaacggttttgaaaagcagttcttgcttggcaatagtcttgtgacggattattccgaggtgctggatctgtacgcgctcaattatgggattaatttaggtcgcttctcttatgggacggcaattggtattttcaactcgctggttagcattctgctgttgtttacggcgaacggtatattcaaaaaactaactaaagaaagcattatgtagggagggagaggcgaaatgacgaataaggcatttaatgctacccgatctgagaagctgtttgatctgttcaactatatcctcatggctctgatcgtggtgttgacgctgtacccgtttctgaacgtacttgcgatttccctgaacaattcaacggacacggttcgcggtggtatttatatatggccccgccaatttacgctcgaaaattacaaaacgattttccagtatgatggccttcttcagggactgcaaatatctattcttcgtactttggttgggacggtactcggattgatctgcgcgtctatgcttgcttttacattgagtcgggtcgagtttcgcgctcgtaagtttatatctacgtttttggcgttgacgatgtatttttccggcgggatggtgcccgtgtttattttgatgcgtgatctgcatctgctgggttcgttttgggtgtacatttttccaggcttaattagcgcatttaacgtgtttgttattcgttcctttatggacggtttgccgtatgtgctacaggagtcagccaaactcgatggggcgaatgattttacgatttactggagaattattttgccactgtgcaaaccagtattggcaacgattgctctttttctggcagtaggtcagtggaatgcttggtttgatacgtatttgtataatggtggggcgccgcaatggacgacgctacagtacgagctgatgaagatactgcaaagtacgcagcaaggcggctccagtatgacgaatagtaacgatatggctaagcaaatggctcaaatttcaccagagtcgattaaaatggcaatcacgattacggttacgctccccatcttgatggtgtatccgttcttgcaaaaatattttgtaggcggtatgacgctgggggcagtgaaatcataaaaatcgggataccggtagtgaaatagaagttatttgcaggagaagtcatcataggaatataggaggatttatacatgaacaaacactggtccagatttgcactgattcccttgctcgcggtgtctcttaccgcactcgcaggttgtggaggaagcgataaagcagcgaaggaaggcgcgtccagcggcacagacccgattacgtttagcttcttcggagcagatacaagcccgcaatggaatggaatgaaggatgaaataggcaaggaaatcaccaagaaaacaggtgtaaccttgaatgcggaatttgatgtcagcggcggaggtggagatgaccgaattgctttgatggcagcaagtggagaatacccggacttggtttctcctaaagcgaatattaacaagcttgtggatgcgggggccatgattgatctgacagatctgatcaacgatcacgcacccaatctcaaaaagctatatggaccctatatggatcgtttgaaatacagtaataaagatcaatccatctatgtccttcctacgtatgcaggcgtgggacaggagagctttgacgcgacgggcggatttgaaattcagcataaggtgctcaaggagttaggttatccaaaggtaagaacgctacaggattatgaaaacgtactcaaaacctatacagccaagcatccaacgatcaatggcaaaaaaacgataccactcacgctggatgcagacgactggagaattatgattaccgtaacgaatcctgccttccagacgactggagcgccagatgatggtgaatattttattgatcccacaacatttgaagcgaagcttcattacaaacgtcctgaagaaaaggaatatttccgttggttgaaccacatgtataatgaagggctgctcgataaagattcgtttgtgcaaaaaagtgatcaatacaaatccaaaattgccagcggccgtgtcctcggtctgattgatcaggagtgggggtatcaggatgccgaaaatgcgttaaaagcttcaggcaaggccgattccagctacgcgcattttccagttacactttcggagaaatacaaggatagctcctttcaggatacgggctttgcgtctggttatggtgtaggtattacggaaaattgcaaggacccggtgcgggctattaaattccttgattatttagcttctgatgaaggacaagtgctagtgaactgggggatcgagggcaagcattatgagatcaaagacggcaaacgcgtcattcctgccgatgtactggagcaaaaaacgaacaatgcaaccaacttcaataaatccacgggtatagatttgtacacgctcatcagtggacactatggtgacggcgtgaaggacccaacgggtaactactatactgccaaattcccggagcaaattatcgcagcttattcggagccggagaaagaatcacttaaagcgtatggcgtaaaaacgtggaaagatctgttcccggacaagaaagaatttgatgtaaagccttggggcgcagcctataacctgacaacagacaatgaatccaactataacgttacattcaaaaaaacgacagacattatccgcaaacgtatacccgaagctattttagcaccagcttccaattttgatacggtatacgacaacatgattaaagaactggatgccgccggagctgtccaaatggaacagcaatacacgcaactggtgaaggacagagtggagttatggagcggtaaggcttctaaatagctgactgcttttaacgaaattttgaatgccggaatgacagagcgcttgtccttatggtccatacgggattagcgctctgtttcatcttgatgggggagggtttgatgtgacgaaaggcaaaagaccacagtccctgcgtttatggtatcgccaacctgctgaggtatgggaggaagcattgccagtcggcaatggaagactgggagctatggtatttggcggaatcagagaggagcatttgcaattaaacgaggatacgctctggtccgggtttcccagagacggcgttcagtatgatgctttgcgatatttgcagcctgtcagaaaactgattgcagatggaaaatacaaggaagcggaacaactgattaatgcgaatatgctaggtcgcgatacggaagcctatcagcctttgggagatttgtggattacgcaggagggcctaggggaaattgtgcattatgagcgagaactggatttgctgaccggaacggcagcggtcacttttcaaagtgatggagtccgctatacccgtgaagttatcgccagtgcgccagatggaatcatgatggtgtcactgactgcgaataagcttgggaagatccatgcatctgtgcgcataacttccccccatccttgtgaagacgaggttggagaggatgcacattttggtgattcatccaaatgggatagcgataatggcgatccatccgatgagccgatcagggactttattacgttgactgggcgagcgcccagtcatgtggaatctaattatcacggcaatcatccacagtctgtcgtttatgaaaatgatttggggatggcttttgcagttcaggcgagggttattcctgagggaggaaccttgacgaagggtgctgatggagcactgatcatctcgggcgccgataaaatcacggtgtatttggcagcagctaccggatttcagggattccacgttatgccgaatagtgatgcaacggaatcagtagaagcatgtcaagtcattttagacggagcaatttcgttgggaagtgagcaggtgcggcaacgccatgaacaggatcatcgaaagctgtttgaccgcgttgcattagaactgggaggtgatactctaactgacgagtccgttctaccgactgatctacgattagaacgttatcagaaaggtcaggctgacccgggactggaggtgctgttatttcagtatggccgttatttgctcatgggcagctcgcgtccggcgagtcagcccgccaatcttcagggcatctggaatgaccgggtgcagccgccgtggaacagtaattatacaaccaatatcaatacgcagatgaactattggcccgcagaggtatgcaatcttgccgagtgccatgaaccattgctgcacatgattggagaagtggctcgtacgggacggagggtagcctccatccattatggtgctcaagggtggacagctcatcacaatgtagatgtgtggagatacgccggaccttcagggggccatgccagttgggcgttttggccgcttgggggtgtatggctcactgctcacctatgggagcgctatctgtttaccctggatacagcctatctggcagaacaagcttatcccctcatgaagggggcggcagccttttgcatggactggctcgtggaaggcctggagggtcggcttgtgacatgtccatctacgtcacctgaaaataaattcaaaacgccggacggcgaggattgcagtatatctatgggctccactatggatatgacgctgattcgggagctgttggataactgtattcaagctgcggacctgctggaattagacgatgagttccgcacccgctgtgaggagacacgggcacggttaatgccctatcaaatcggacgtcacggccagttacaggaatggtttgtcgattttgaggaagcggagcctgggcatcgacatgtttcgcatctatatgggttatatcccggtcgacaaattcacatccgtgataccccggagctggctgaggcagcccgtatatcgctgcgtcgacggcttgatcacggtggtggtcataccggatggagctgtgcctggttgattaacctgtacgctcggctggaagatggcgacgccgcacatcggtatgttcgcacgttgctgtcgcgatcgatctatcctaatttattcgatgctcacccgccttttcagatcgacggtaattttggtgcgacagcggggattgcagaaatgctgctacaaagccgtccgggagagctgacgttactgcctgccttgccaacggcatggtcggagggaagggtcagtggattgaaggggcgtggcgggatgacggtcggcatggaatggtctggttccaggctcgtccgtgctgaattgaccgcgtctgtccagacgggaagctgcacaattcgctattcacatccgtttagcgcagatgctcgtcaggctctgcctgatcctgaacatggaggatttattttgtcatggatttttaccaaagagcaggaaataacgaaccaacatacgattataattgaaggagaggaagagataatatgaccatttttcaatttccgcaggactttatgtgggggaccgcgacggcagcttatcaaatcgagggagcttatgaggaggatgggagaggtttgtcgatctgggatacctttgcccatacgcctggcaaagtattcaacggtgataacggcaatgtagcttgtgacagctatcatcgctacgaggaagatatccgcctaatgaaggagctgggcattcgtacataccgtttttcagtgtcctggccgcgtatatttcccaatggtgacggtgaagtcaatcaagaaggattggactattatcatcgcgtagtcgatttgttgaacgaaaatgggattgaaccgttttgtacactgtaccattgggatctgcctcaagcgcttcaggatgctggaggatgggagaatcgtcgcacgattcaagcgtttgtccggtttgcagaaaccatgttccgcgagtttcaccgtaaaatacaccattggctaacattcaatgaaccatggtgcatcgcctttttatccaatatgctgggtgttcatgccccgggtctgacaaatcttcagacagccattgatgtaggacatcatttgctagttgcgcatggtctttctgtgcgccgtttccgcgagctgggcaccagtggccagatcggtatcgctcccaatgtctcctgggctgttccttacagcacatctgaggaagataaagccgcttgtgcgcgcactatttccctgcacagtgactggtttcttcaacctatttatcaaggctcgtatcctcagtttttggtagactggtttgcggagcagggggccaccgtgcctattcaggatggggatatggatattatcggcgagcctattgatatgatcggtatcaattactatgctatgtcagttaatcgttttaatcctgaagccgggtttcttcaatctgaagaaatcaatatggggctacctgtaacggatatcggttggccagtggagtcgcgtgggctgtacgaggtactgcattatttgcaaaaatacggtaacctcgatatttatatcacagagaatggggcttgcatcaacgatgatgtcgtgaatggcaaggttcaggatgaccgtcgtatttcgtatatgcagcagcatttggtgcaggtacaccgggctattcatgacggtcttcatgtcaaaggatatatggcatggtcacttatggacaattttgagtgggcagagggatataatatgagatttggcatgattcatgttgatttccgcacacaggtccgcaccccgaaggaaagttactattggtatcgaaatgtagtaagtaataactggttggagaccagacgttaaacgataaacgaagagatgttttgaaaataaggcagatttaggcctgtctctgctcccttttgtttgaacactgggtcttccggggtaataatagtcaagatatgcagagggttgtttcaggtatgtagagaccaagggaataaagaagcaagatatgtgcatactgacaaaaataccggacgagggcgctaaaaattattttagaccgaagggagtggagggtatggctgcaaattttaggaaatcaggatcaactgacgggcaaatgagccggacggtatctgttatcgcttggatcgcctgtattgcaggtattatccttattttgcttgatataggtaatttaactgatcggaatatatatttaatgacaggcattggctgcgttgttgccgggatttttatttttctagttgggaaatcatttgtcattgcacgcaagaaggaagaccaggaaaacggccgcagttaatacaatttaaaaatgatttaaagcaaagatatgccgaaaacaacaatgtggggcttcgagcagtgtaggatgataactgtaaggagtcccgcttttttctttaatataacttctttaagatacacaaataacgtttttattatgtcatctttgtattaaaaagaaattttgaatttgcaagagaaattttatttttagagatgtttttcacaaaaaacggacaaataatcgacaattctgttaacaataaaaaaagtggccacttttctgctatcttatataggggcaacattacaggagttcgtaaagttttgagtaatttattatttaaggagaggggaacaacatgaacaaaaaaccaaaagcgattattgcgttggttttgaccgtgctcacggtagcattgctcatttggacgtgtttttatgctggcggaaaatacgttgttttcgatccgaaaggacccgttgggcaagcacaaaaagagctgatcattcttacaacggcattgtctgcgctaataattgtaccggtcatgattttgactttcttcatcatttggcggtatcgtgatacaccgacaaacaaggtgaagtatcaaccccactgggatgacagtaaaaagctggagaccacatggtgggctattccaattatcgttatctgtattattgcggtcattactgcaagatatacctacttgctggagccttccaagccgttggcaagtacgcaaaagccagtaaccattcaagtgacttcactggactggaaatggctctttatgtacccagaggaaggtatagctacagttaaccaagttcacattcctaaaggtgttccagtccgttttgaactgactgctgacgccccgatgaactcattctggattccgcaattgggcggacaaatctacaccatgtcaggcatggctatgaaactgcatttgcaggccgatcacgaaggaacttactttggttcgggtgcaaactttagcggtgagcattttggacaaatgcgttttgatgtagaagtccagtcggatgaagagtataaaaactgggtcgctgacatcaaaaagcagtctaagccgctgacgaaagacggctatttggcgcttgcaaaaccaggtttgtcccagcctgatgagtattcttcgattccagatggcttgttcaaagacattgttaacaagtatgtagtggagggcgcttctaacccacatgctggacatggtgaagctacatccacagaaggttcttctcagtccggcacagaaggtcatgcggcaatggacatgagtcatatgaatatgagcggacacaattaaatgattatagggaaggaggcccccaatgcttgacaaaataaaagagtttgcatccactttcttcgttactggagatccgatgatctatggagcggacgtctccatcgcattggcaacaatcgggatcgtgtttgtgctcacttatttcaaaaaatggggctggctttggaaaaactggttgactactgttgaccataaaaaagtcggtattatgtatattcttgcggccatcttgatgttattccgcggaggcgtggatgcattattgatgcgtgttcaactggctacaccggatgttacacttctgcatcctgagcattacaaccagattttcacaactcatggcacgatcatgatcctgtttatggcgatgccgttgatgtttggtttgtttaatatcgccgtaccccttcaaattggtgcgcgtgacgttgcgtttcctttcctgaacgcattgagcttctggcttttctttatgggagcgatgttgttcaacctgtccttcgttatcggtggttcgccagacgcaggttggttgagttatccaccgctttcagaactgcaatttagtcctggcgtcggtcagaacttctatatctggggtattcagatttcgggtataggttcattggctacgggtatcaactttattgttactattattaaaatgcgtgcacctggtatgacttggatgaaaatgcctgtctttacgtggtccgtattttcgtcatgtgttattatcattttcgcattcccgattctgacggttactttggcattgctgttccttgaccgcttcggaggaggacacttctttacgcttgatttcggcggtaacccgatgatgtatatcaacttgatctggatgtggggtcaccctgaggtgtacattgtagttttgcctgccttcggtatttattccgaggttatcagcgtattctccaaaaagaaattgtttggatacaagtccatggtttacgccatgttcattattgcgatcttgtccttcttcacctgggcgcatcacttcttcacgatgggatcaggcgcagatgttaatgcattctttgcgatttcgacgatggttatcgcaataccgacaggggttaaagtatttaactggctgttcacgatgtatcggggtaagattacattcaagactcctatgatgtggtcaattgcttttattccgaacttcttgattgctggtttgacgggcgtcatgttgtctgtagcgcctgctgacttccagttccataacagttacttcctgatcgctcactttcactccgctctgattggtggtgtagtgttcggttacttggcaggtctgtactattggtggcctaaaatgttcggtttcacattgcctgaaacgcctggtaaatgggctttctggttctggaacatcggtttctatgtatgttttattccgcaatattctctcggtctgatgggtatgacgcgtcgtctgagcacttacggctgggataccggctggcagccgcttaacctcgtttcgaccgttggggcattcttgatggggattggtttcttgttccaggttcttcaaattcttctgggcatcaagaattaccgtaagctgaaggatacaacaggcgatccttggggtggccatacgttggaatggtcgattccttcacctgcaccggagtacaattttgctaccattccacaagtagaagaacgtgatgactggtgggcagaaaaagatcaacgtgcaaaaggtattttcagaaagcaaccgccaattgaagcgattcatatgccgaagaactcggcgattccattcattatgtcggtattctttttcattgcaggtttcgggttcgtattcggatggtcgttcttctatattccagggctgatcggtgtggcaatttgtatgatttgccgttcgttcttctcctatgatggcgactactatatccctgcggatgaagtaaaacgcacggaagcggcaataagggggtctgtataatggcacaagcagcagcacaccaaagccatgatcatgaccacgggcatcacgatccgcaagaattgaagatgcttggtttttggatcttcctcgtaacggacgtaatcctgttcagtaccttgttcgcaaccttcgtcgtccttcggaacaacacagccggaggaccgggtggcgcagagctgtttaacatgacgggcgttattattgaaacgttcctcttgctcacgagcagcttcacaagtggtctggctgtgttggccatgaacaaaggaagcatgaagggattaattaactggttaatcgtgacggcgatcctgggtcttggttttatcggttttgaggtttacgagtttgttgagttggtacacgaaggagccaattttggaactagtgcgttcttgtcggcattcttcactttagtcggaacgcacggacttcacgtttcgttaggtctggtttggatgattggactcatgttccagttgaaaaaacgcgggcttacaccagagacgaagggaaaagtttcggcattgagcttgtactggcactttttggacgctgtctggatcttcttgctgacagtcgtctatttgatgggggtgatgtagatggcacagcatcaaacaggagcgggttcgcatggtcatgatgattctcacggttcagtgaaatcctatgttatcgggtttattctgtccatcgtactgaccatcattcctctcggtgtggttatgaatcatatgttgagccgcacttcgaccatggttgttattttagccgcggcagtgctgcaatttctggttcagcttttcttcttcatgcacattcgtgagagcaatggaccacgctggaatgtcatgactttgattttcggggtagttatcctgttgaccgttgttggtggttctgtatggattatggaatacaacatggtagcacactaataagtaggatttttcaaaatcactcaagtacaaacgaattaggaaagaagaagcggacttagagccgcttcttctttttttgtgtagcttattaaaataaaaactgtggcttcttgaactcaagtttacatatgtgtaaaatggaattgtataacagtagagtgaaaacgataatactagtggagagcggaggaaaaagtaatgaacacagaattactgtttaaaccttttaagttaggtaatttatctcttcccaatcggattgttatggcgccaatgacacggaatttttctcctcaaggtattccagggcctgacgtggccgtgtattatcgtcgccgtgccgaaaatgcagttggattgattattacagagggaactgctattaatcatcccgcagctgtggagcacacaagcattcctaatttttatggtgagggattaaagggatgggccaaggtagttgaggaggttcatgcggtaggtggcaagattataccgcagctctggcatgtgggtacggcccgtaaaataggtgcagataatcaaccgaatcccgaggcattgcctgtcggtccgtctggtatctctcccgccggcgaaaaggtggttgagccattgacggaggctgagattgcggatattatttcagcttatgcacaggccgctgccgatgcccagcgagtgggttttgacggcattgagcttcatggagcacatggctatttaatcgatcaatttttctgggacaaaaccaataagcgcaccgaccaatacggaggcaacttggtccagcgtactcggtttgcggtggaggtcattgaggcttgtcgtcgtgcagtagggccgaatttcccaattgtattgcgattctcccagtggaagatgtaccattatgaagaaaagctggcccaaacaccacaggaacttgaacagtttctcactccattagtgaaggccggggtggatgtattccattgctcaagccgccgtttttgggaaccggaatttgaagggtctgatctaaatttggcagcttggaccaaaaagataacaggcaagccagtgattactgtgggctcgattggtttagagaaggcctttttgagtgattttgaaaataataatcgtcaaaccgatcaatccagtaatgtagagacaagattagaacaactcgtggggcaagtagaacgagaggaagctgatctggttgcggttgggcgtgctttgctggttgatccagcgtttgcggtgaagttacgtgatcaacaaatagatgaaattattccttacagtgatgaagtattaaaaacgttgaattaagctttattaggctctaagtattgtaaagctatagtgttaggcaagcattgagacttggaagttttctgttacagggcaagctgtaatataagctattcgtaaactctacgaatttgctataataggagcatcaagtcgaaatacacggggtgaaaaggatgaattctgaaacggaagctttggattgcgagccggcttgtcacggttcagatcaggaaattgagcgcataaaatcttcccttgttgaggattccatcgcatacaaaatgtcggagctgttcaaagcactgggtgacccgacacgaatcaagctgatttatgccctggcacaaaaagaactgtgtgttcatgatctgacccaggtgttgaacatgggacaatctgcggtatcccaccagcttcgttatttgcgcaacctgcgtattgtcaaacgacgcaaagaaggcaagacggtgttttattcactggatgataatcatgtggagcagatctttttgcaaacccatcagcacatatcacatcaataatttttgggataaaacaacagagggcgccaagcgattggcgctcttttggcgtttgtccgttgaattcgatttttttgttaaaaagggctagagtcattgacttttgaccctgatcctgaatataatggccttaacaaataatatatgaacagttgctcatatatagttaattggaggccaatgactatggatgctctaaaaagaacggaacggcatgaatggattttggaaggtttggattgcgccaactgtgctctcaagattgaaaatggagtcagtaaaatagaaggggtcatggattgctcggtcaattttgttacgaaaacgttgacgatgaccacaagttcggatcaaaaggaagaggtttttcgccagactgaacggaaggttcacagacttgagccacatgttcggatggtggtaaaaagtgctcgtggacgcctgcgtgaagacagtcgaagcaatgctggtgcagtacagtcggattgcacagaggactgtgcatgcggtcatgagcatcatagtgaaggtgaagggcatacacacgaggtcgggcaacatgcttctcacagccacgctggtcatcatcatggagcacatgataagcaagcccgcacgcacgatggacacgaccacggcgatcatgcacacgagcatcacaaccaccatgcagagcacgaacatggtgaagctacccacactcattcacattcgcatggagatgatagccacgctgggcatacgcatgatcacggtacggacggtatgcgccgcatgattgcgcgtttggctattggtgcggtcgttgcggctattgcctggtggttacctgtcgaaggtgtaggcaagctggccctatttttactggcatatatcatcgttggcggtgatgttgtcttgcaggctgcacgcagtttggtacgtggaatggcctttgacgaatacttcctgatgacgctggctacagttggtgcatttgcaattggggaatacccggaaggcgtagctgtcatgttcttttatcaaatcggagaactgtttcaaggcattgcagttaatcgttcacgtaaatccatcagtgatctgatggatattagaccggactatgccaacctgaagacggctgagtccgtacggagagtgtccccagaagacgttcgcattggggatttgattgtaattaagccgggcgagaagatcccgctggatggtaaagttatagatggtaaatcgcatgtggatacctctgcgttgactggtgaatccgtgcctcgtaccgtagagccgggaagcaacgtgttgagtgggtttatcaatacgaacggacttctaacggtagaggttagcaaggaatttagtgaatcggcggtcaagaaaattttggaattagtgcaaaatgcgagtgccaaaaaagcgccgactgaaaagtttatcacgaaattttccagatactatactccagtagtggttattgtagcgctgttgttggcggttgttccaccgcttgttgtgccagatgcacaatttgcagattgggtataccgtgcgcttgttttcctcgttatttcttgtccttgtgcgctggtagtatccattccactgggcttctttgggggaattggggcagcctcccgttcaggagttctgatcaagggcgggaactatcttgaagctctgaatcatgtgaaatacgctgtctttgataaaacaggtacactcaccaaaggtgttttccgtgtaacagggatttatcctgccggagattttacaaacgaaaccctgctcgaaaccgccgctttggccgagctgcattccacacatcctattgctgcgtctctgcgtgaatcctacggtaaagaactcagagcagaacgggttcagcaatatagtgaaatatccggtcacgggattcaggcacacattgatggtcgtctggtatcagccggaaacgccaagctgatggaacgggagcatgtggcttttaacgtggcgcagcaagcagggacgctggatgaaggaacggtcgtacatgtggctgtagacggaacgtatgccgggtgcattctgatttcagatgaggttaaggaagacgcagcccaaacggttgcttcactgaaaaagttgggtgtggtgaaaaccatcatgctgacgggtgacaatcggacagttgccgaggccgtaggacgacagttgggtttggatgaagtacgggcagaactgttacctcagcacaaagccgaagccatcgagcagttgtctgcaagtaaaaaaacgagcgacaaaattttgttcgtaggcgatgggattaatgatacacccgtactggcgctggcagatgtcggtgtagcgatgggcggtttgggatcggatgctgcgattgaggcggcagatatcgtaattatgaacgacgagccttcaaggctggttacggcgatccatatcgccaagcgcacacgtcgtatcgtatggcaaaacattatatttgcgctagttgtcaaagcggtttttcttacgctgggagcattcggtattgctacgatgtgggaggctgtattttccgatgtaggtgtaacattgctagctgtattgaatgtgatgcgtgtattgaaggttcgttcttacgagtaaaaataaacacctctgggttagcatcggatgtataggcatcctgtgaaaaccgggggtgtttattttataggttcctttttcgagtggtcttgtaccagcaggatagagatttattttgggatgtagggtagttgtgccgaaatgtataaatgtgtggcgtgcctaatacgttaaggtaggggctttacaagtaaggcccatgtaagattcggttgctccataatgagtaagcgttttctttatttggaggggtactcgaattcgtgtgtgccaacttgctgacggaagaaaggatggattaatagcatggaggctaaactgatgcatgtattcgcagagctgttgggtggcaaaaatagccgggatctcaaagttccagagccgggtatggaggctgctgcacagaggttggctatggagacgctaaaggcaggcagccatgaagcatctgctacgcaggaggaagatccgttgggctggctggttggtttagctgagcagggcgtaatcagtcgagcagaggctttgatggctgcgaatccggaattacttggggaaacgatgctgaataacggcaacgatattgggcaagcagtgcgcacactcctaaaatggagcgatgaatacaggcgcacctccatacggatttatgccgatgctcctgcaagtttgagtcgtattggcacagagacagcatcggaaataggcagttatgacggttatagtcttctgcatggtcccttgtcacaggcatctggccgtgtagggaaactatgctatgcctatctggacgtagcagagtctggacagacgattcatgcccctgacggggagcctgatcccatccttattcccggttcacgtgcatctgacacgtacaaaacctttaaccaggcatctggcctgcctggattgtgtgagcatttgtcccgtcgaattatcagtttgctggaaacacaatatgaaagcttattcgagtctttgaacggatcaccactctctatagccctaattgagcagaacaatgcagtgggtattggaagcttgcaagatatgcagctggaggcattgctgcgtgcggcgttgcggagcgtgcggcaggggggagaacccaagctggagattatagtgcgcaatccggctgacgtggacgaattccgggcagcgcgagactggattgacggcgttgcagagcagactttatgcgggcgtcttcggtgcattccatatcgggtaggcgtgcttttgacagttgacccgtctttggtgcctaacgtaagccaaacagggaacaggcaagctgcacggtcgggggagccagccaattccaataacatgtccgaagtgagcgcacgacagatcaagcaggtggctcaagctgcagatctggcacgttttgccgatacggtcattttagaagtcataccaactccatccgatgacattagggctgaggatcagttgattccatccggtgtcgatggtcatgagaacaatagtgatacgataaaatgcataatggaggctgttcgacgtgtaaagtctgagcttcctttatgggtagcaatagatgaaattaaccattctctggataggatttcgatctgggagaatgagctgacgggggtcatttgcccggacacagcggttcccactgtacgccttgcggctgcgcgtctgggactgcaacagcccgcagatcgtcagcacacttcaggaactgcacacaatcatgcgtggaagtttcctttagcctgaagataaccggaattcttgtaatagaggattttgcaaaaatccaataagcgactttcaatgaacaatatatagatcgaaatggtctagttcgtctatatattgcactttggagcgactggaatcgaattttgcaaatcctgaataggatgctttaaatatggaggatacctgcggtggcgcgggtatctttttttatttaggccattgctggtttacaagtggaaaagaaaaggtatataataaaacaaaagtttcgctaatccaaaataattgtatagatgcaaaaatgattatcattctcattgtcaaacatgctgcttcggacttcccgaagcagcatgtgctattttagggcacttaacaatggatatcattctcaatgaaatgctagtacaaggaacaaaatatggaaaggaacgtgacatgatgcaagctactcaacgattacaagatacattgtctccctctaaccgaaccctttcaaaaaacagtggtagcggacgacccggtccgaatcgcaagccgcaatttcagcttaaaagcatgctgaaaaataaggagatgcaagctgctctaggtagtggattgctgatgctgatggcatggggagtctcacattggtggcaatggctatcggtcattctgtatgtagtgtcctatgcccttgggggctggtccaaagccagagaaggggtcgaaacactgattcgagaacatgatctggatgttaatctactcatgatcgctgcctccctaggagctgcggccataggctattggaatgaaggagccatgctgatctttatttttgcactcagcggtgcgctggagagctataccaccgagcgtagtagtaaggatatttctgagcttatggcgttgaagccggaaacggctttgcgcttatctcgtgaggggatggaaacagtcggcattgaacagctgttgccaggcgacctgctgctggtgaagccgggcgaactgattccggcggacggccgaatctccaagggcgtttcggcagtgaatcaggcatctattaccggggagtctgttccggtaaataaggtggaaggtgacgaagtatatgcgggcaccattaatggagaaggcgtgctatatgtagaggttagtcagtcctcggaggacactttattttcaaaaatcattcgtatggtggaagaggctcagaccgaagttcctgattcccagcggtttattaaaacgttcgaatcggtgtacgctcgaattgttgttgctgtcacgctgatcgtcattgtcggtgcacccatcgcattaggctggacgtgggcagcagcgttctataaggctatggtgttcctcgtcgtggcctcaccctgtgcgctcgtgtcatccattatgccagtgatgctatcggccatctccaaccgtgcccgacggggcattctgttcaaaggtggagcacatgtagagaatatggcattgacttctgttgttgcttttgacaaaacaggtacgttaacgatggggtcacctgtcgtcacggattggattaccgccgcagaatacgatgccgatgagctattgcacattgtcgccacaattgaaagttattctttgcatccgctggcgcgagcgattgtagccaaagccgaagctaaattgggacagagagatcctctcccaaccgagcaagtgcaggcactcaccggatggggaatggaaggcatcataggcggggtgaaatggaaaatcggtcgcacagatgtgctggatggacctagtcctctggcagagccagagtggatggagagtcgggcccggctggaagctgagggcaaaaccgtatccatcatcctcgcggatgatcggattgctggaatgctggcactacgcgatgagttgcgtccgcaggctcaagagtccgtgaaacgcctgcaagcgcagggtatcagggttgtcatgttaaccggagaccgtccagaaacggccgctgtgatcgcggagcaggccggagtcgacgctgtatatgctggcttaatgccggaggacaaagtcagccatattcgcatgctgcgggagcagtacgggcatgtcgtcatggtcggcgacggtgtgaacgacgctcctgcgttgacagcagcaaccgtagggctaggcatggggatgcatggcagcggagcagcgctagaggtcgcagacgtggtactgatgaacgatggaatcgaggagatcgctccgacgatagcactggcgcgcaaggcgcagcgggtggtcaaacaaaatatgatcttcgcggtaagtgtcattttgctgcttgtgatcagcaactttgtgcaggatatagccttgccatttggggttattgggcatgaaggcagcacaatactggtcattttgaatggcctgcgcttattgcggtcataggactaataattacaagatgacaaacaggaaggagcattcatacctcttaaaatccaagggggtgaatgctccttcttttgcagcctcgcaacgctgtacgtctatcttcggcgcggcgtagatcgtcgcaagaacaaggaaaacaatagccccgctagtgcaatccctgtagcaatgatgaaggcatcattaatgccatggatcgttgattctgtaacggcacttcggtacacctgttgtagcgccaacgatgaaccactttctgttgaaatgcccgccgtttgcgcgagggtttgtcccaactgtgctaccccttcggttaaaggaacattggcggtggtagcgacattcgcataatccgctacatgaattgtcgttcggctgctcattacagtaatgagccaagcggtaccgatagacccggcgatttgccgtactgtgttggacatggctgtaccgtggctaccgagatgggcaggtagctggtttagaccttccgtctggacggacatcatcagcaatgacattccgaagctgcgaatcgtatagatgatcataatatgtccgtaggtggtggcatcggtcagcagactgaattcccaggttgtgactgctgtaatgatcagtccaatgatcgccaacggccttgcccctatacggtcaaatactgcccctgatatcggtgacatcacacccatcagcagtgcacccggtaacagcagcagaccggattgcagcggcgtaaagccgcgtatattttgcaaatagatcggtagcagcagcatcccgccaaacatcgtcatgttgacggtagccccgactaaggtcgatacggtaaaaatatcatatttaaacacacggaactccagcatcggctgtaccatattcagctcgcgcacgataaacaatacaataaacacaaccccggcagcgagtgtaagtattaccgtattgctgtcccagcccttgtctccagctgaactaaagccatacagtaggaagccaaaaccaagggtggaaaagatggttcccaacagatcaaagttcggtttcgttagcttggatacatttttgagccagcgtatggcaaacagaatatcaatgattgccaacggaatcaccagcaaaaatagcagtctccaactatagtgctccacaatccaaccggataaagttggtccaaccgccggggcaaacatcatggcaatccccatggtccccatagcagcgcctcgtttttcggggggaaacacagtcaggaacacgttcatgaccacaggcataataatgcccgctccgctggcctgaataacgcgcccaaccagcataggcgcaaagccggtactggtagcacagacgacagacccggccgtaaataaccccatcgcggagatgaatagcgcacgtgttccgaatgactcaatcagaaaagcagtgataggaatcaaaatcccgttggttagcatatatccggtggatagccattgaacggtcgtggcagacacattgaagtcattcatcaaatgtggaatggccacgttgagcagcgtttgattcaaaatcgaaatgaaggcgcctagcagcagcacggacagaatacgtccgacggacattttttgatccatgacagcctcctacttgtgaactctgatggtcgcactcattcccgggataatacccagccccttgtaaccttgaatggaaatattgacaggcacgacctgtgtcaccttggtatagttggcagtggtgttagaagtgggcagtagtgaaaaagttgatgcggtcgccaggccgatcttttcgagtttaccgctcagggacgtatccgggtaagcatcaatatatacatctaccgtctgtcctacttgaagatcttgtacagccgtttcgtcaatattggcggtaatccataaattgtttagatcaaaagccttcgctaagggtgtgcctgccccaacaatcgagttgttgactgcagattgctgtacgatggtaccatcggttggaatcgtaacgctaattcggcttccgcctccttctacactaccaagcgtgcttccaccggtgtaggtcttaccaacttcagcattccagccagtgagtttgccagcgcctggagaggcaacggtaactgcttgtccgctcacttgggcattatcggtttttatgtagttggcggattgattatagtaataggcggcggctccaccacctgctagaataatgataataactagcaggttgactaatatggcgcgtgaattcatgtttacatgcctccctagttcttggattttcaaagtatgcgtcaaatgattcataatattcagatgggttttgggcaaggttaagagcgcatgcgaaaaagatgattttgctgacaaaggatgatgcgcataatgacgaccagaatcatgattgtatatgacagtgaaaatgggcataccgaacgtctcgctcgctcgatcgcagaaggagcacaccttgagcatacggaagtgttgttaaagcatgttaatgaggctgatgtgaatgagctagtgagtgtggacgcgattatatggggctgcccaggccattttggtacgatcagcagcggtctgaaaagctggattgataagctgggatatctatgggcgcagggcaagctggtggacaaaattggcgctgtgttttgcacaaccgctaccgttcatggtggattggaatctacgcttctgaatttgattactccgatgcttcatcaaggcatgattattgtaggactgcccgctaatattacggaaaatgcattatacggctcctattacggcgtaggggtaacatgtccagtggagacagaccccaatggtccgcctaatcttccaacgggtgatgatcttgcactaggtcgttctttgggcaaacgggtcgctgagatagcgggacggtaccgtagcgctgaaagagaataggaggctaccgatgaccattgcttttatcgtagtagctgcggttgcctttatttttttgctggtatttaatacaaagatgacgcgcaaatcctctcccaaaactcgccccacggaagaggagccacggcaaagaagcaaacgtccttatcctgtacaggtggaacccgaggcacgtgaaaggatagattctacgcgagagatgccgcataaggatatcgacgtcgaagaacattatgcggaggaacaacacaaggtgcctgatatccagacggataagaaggtagaaaaggatcgcgagaatatcaaagatgcttacggagatcaggattatcgtgcggctttacgtggttttgccaaaaaggacgaagaaaaggatggacgttcccaaatatccaatggagagaaggagactcacaaaagtgaggacgagcagtatcgtgaagcactgcgctccatgaaccaaaaaaaatgaggtttctccatgtgaacatactaaaaaggctgcttatctgtctggattacaggcagaaggcagcctttttgtgttgctcggctatagccattcggttagcccaatcatcgtaattaagccgagaataaaagagaatgtggcgatccgctggttgccatccccgtgactctcgggaatcaattccttgtagacaataaacatcatggctccggcggcaaaagcaaggccgtaaggtaccagtccgttcacccagctgctcaaataaaacccgatcagactcgtaatgatttctacggctccggtgagggtagcaatgcccaaggccttgaaacggccgatattttgattcacaaggaacaacgctacgataaagccttccggggcattttgcaggccgatagagaaggcgatcagattgccgagattttgagtttcacttgcatagctgaccccaacagagagtccttctggcaaattgtgcaatgtaatagctgcgataatgagaaaagatttggactccagttgaaaggtcttggagtctgggtcctccaaatccgcatggggaatgtacatttccatcaccagtaatacgagacagccgagcaggattcccgcagtcagcacgaaccaattggaatgctggattgcttcgggaatgaggttatacacggatgcagaggtcataattcctgcggcataagccaacagaacatcgcgaagccgatgcgtgatattgcgcataaacagtatgggcacggcgccgagtccagtggacagggcagaaataaagctacctaaaaaaacgtcattcataatggggataatccctccatacctgatttatctttatacttcgcttcatgaaaacttcatttgactgtttacagctatttccgcataatgaaattaggatttagaatcagtctaagtcataagaagctacaaaacaagtgattcgtttttgcaatatccgggtgtccacattttgggataagcttctggtggaattacttttagagtatatgcagctgcccagcgcccggtgccgaaaactcgttatataatacttatgatattttaggaggaaccaagatatgtacaagtccattattataggtaccggccctgccggtttgaccgctgcaatttatctggcacgtgctaacatgagcccactggtgatcgaaggaccacagccaggcggacaattaactacgactacggaagtcgaaaatttcccaggttttcctgaaggaatcatgggacccgatttgatggataatatgcgtaagcaagcggagcgttttggcgctgaattccgcacaggctgggtaaacaaagtagacacaacggctcgtccatttacattggatgtagaaggtttgggtgaactggttactgatacgctgattatttccacgggggcaactgccaaatatctaggtattcccggtgaacaggataatatcggacgtggcgtaagcacttgcgcaacatgcgacggcttctttttccgtggcaaagaaattgttgtcatcggcggtggagactctgcattggaagaagccaatttcctgactcgatttgcctctaaagtgacattggtgcatcgtcgtgaagaaatgcgcgcctccaaaattatgcaggatcgtgctcgtgcgaacaacaaaattgaatggacgcttaatcgtactcctgtagaagtgattgcggacgagaatggagtcactggcttgaaagtattaaataatgcaacaggtgaagaggaaatcattacagttagcggcgtattcgtggcgattggtcatcatccgaatacaggcttccttgagggacaaattacaacggatgcgaacggttatatcgtcgtaaatccgggtacttccgaaacaaacgtgcctggcgtattcgcttgtggtgacgtacaggatactcgctacagacaagcgattaccgcagcaggtagtggctgcatggctgctatggacagcgagaagtacattgaaagcctggagcacagcgcactggccctgtaatgatccttggaaatatgaataaatatgttgtaacaaaataaatgatgaggtgatattcatggaaaaagcaatagtatacacatctacaaactgcccgcattgccgtcaagtaaaaagctatttgagtgaaaaaggcgtagagtacgaagaacgcaacattgaaaccaatgaagcttttgcacaagaggtttgggatatgggcattcgtgccgttccattgactttgatcggggaagaacgtatttccggtatgaacaaaaccaagtttgaaaaagtactgaacgcttaatccaacctaagagcagacgacggtcctgtggatcgttatagggtatagataaggcctccatcgcagttacatactgcggagggggcctttttatagtccctaatcttttttataggattttgcaaaagtccgagaaaagtgggcgtacaggaacctaagtgttcccgtatgctttttttcttataaagacacgcgtactcgccccagaaaaggagctgttgctgcataggcggcacctagcatcgtcgaacggctgccaagcgtggagaaacgaatctgtagttgccgacggtgatagggcagggcacgttcgtcaatcacatcacgcatgctttgttccaaccaaggtctggcttctgccagtggaccgccgatgataagcattccggggttgaggctgttcacaatgttggtaatacccacacccaaatatcgcccaatatcatcaaggacgtttaatgtactttcttcaccttgctgagcaaatggcagtaattccgctgtattctgtgcaggtagtttcaatgtggatgctacatacgccttctctgaagcatagagttcccagcagccgcgactaccgcaggagcagagtcgtccgttccaatcaatggtcatatgacccgtctctccggcgtacccccaagctccttgatacggtttgccatcgatgataatcccggctccgatcccggaccctgcactgatgtagaccagatcccgcacctgctgtcggtgatcgccgtccatcccatagtacaactcgccctgtgcgccgacgttagcttcgttatccactacgacgggcagacctagctcggcctcaagttgctgccgcagcggaacctcttcccagcccagattgggtgcgaacaaaacggttccggtttcatccaccatacccggcacccccagcccaatgccgacaataccgtgaggagagggaggagtggcctgcatgagctcctgaacgagctttcgaatctgttccataacaaaggcgggatcatgctgagtaagggaaagggtaagctcagtttcaatggtacctgccagatcagtcagagcgcccttgatgtactgtacgcttacctcaataccgagtacaaagcctgcacggctgttgaacagcagcattaaaggcttacgcccgccgctggattcccctaaccccgtctcatatacaagtccatcggtgatgagctctgccaccagattggaaacggtagccttgtttaatccagtttgactggataactgtgcccgggatagcggagcatgaaggcgaatacgctccagcacaatggatttatttagctttttgacaagcgcctgatcgccagtgacattcatggttaattcacttcctgttggtgtaattcctgatattatatcataaaaacaaacttagtttaagcaatagacaaagtctttcggctgtgctagaatcgtttttgtaaacgtttactataaaggaggaacttataatggcttatttcgaacaggtatctaaaattaactttgagggcaagcaatccgacaatccttttgcgttcaaattttataatccacaggaaattgtagcgggaaaaacgatggaggagcatttgcgttttagcatggcctattggcatacactggttgcaggtggctccgatccttttggtgtagaaacagcggaacgtccatggtccaagtttaccgggctggatttggcgaaggcacgtgtggaggctgcctttgagctgctagataagctgaatttaccttattttgctttccatgatgtggatattgcaccagaaggcgcgtcattgaaggaattttacagcaatctggataccatcgtggatctaattgaggaacatatgaaagctacagggaaaaaactgctgtggaacacggcgaacatgtttagccatccacgttatttgcatggagctgcgtcgacttgcaatgcagatgtatacgcacacgcagctgctcagattaaaaaaggactggaagtgggcaaacgtctgggcgcagataactatgttttctggggaggccgtgaaggatacgaaacactgctgaacacggatttgaagctggagcaggacaatttgggacgtatgttccatatggccgtagactatgcgcgtgaaattggctttgacgcccagttcctgattgagccaaaaccgaaggagccaacgaagcatcagtatgattttgatgcggcgacgacgattgccttcctgcaaaaatatgatctggatcagcatttcaagcttaatctggaagctaatcatgcaactttggcgggtcatacttttgatcatgaagtacgtgtagcacggattaacggcatgctgggatcactggatgcaaatcagggagatttgctgctgggctgggatacggacgaattcccggttgatctgtatgatgccacactaaccatgtatgaagtgctgcaaaatgaaggcttgggccgtggcggtatcaactttgatgccaaggtgcgtagagcatcatttgagccggaagacttgttccttgcgcacatcgcaggtatggatacgtatgcgaagggactgaaggtagctgccaaactgatcgaggatcgtgtgtttgaagactttattgagaagcgctacagcagctttaaagaaggtattggagcagacatcgtatccggaaaagcaacgcttgcttctctggctgaatatgctctggcgaacgaagcgccacgtaaaaacgtatccggtcgtcaggaatatctgaaagcaacattaaatcagtacattttggctgactaataccaggacttatatatgaaacaacggctgcacgatgacaaggaaggaggaactccaatgcacgagaagctaaatcaggagcaggaacgctatgtcattggcgtagatttgggtaccagcgcggtcaaaacggtgctggttaaccgcaagggacaggtagcttatgaaacctcccagtcttatccgctctatcagccgaaggcagggtatagcgaacagcaccctgaggactgggtcagtggcacgttagcatcactgaaacagcttgtggagaaggctggaatcggcggcacagatgccgtggacggtattagcttttcgggacagatgcacgggcttgtgctgactgacaaggaaggccaagtgcttcgtccggctattctgtggaatgacacgcgtacaacagcacaatgccgtcgtattgaagaaaagctcggatcggagctgctgaacatcgcacgtaatcgcgcgctggaaggcttcacgctgcccaagctgctgtgggtgcaggagcatgagccagatgtgctggcccgtgcggcacattttatgctgcccaaggattatgtgcgctactgtctgacaggagagctggcgacggagtattcggatgcggcgggcacgctgctgctggatattgcgaacaagcagtggagcgaagagatcgctgccgcgtttgacctaccgttgtcgctgttcccgccgctggtggaatcctttgatcagacgggtacgctactgccggagattgcggagcagagcgggctttcgcctgaaacgaaggtctttgcaggtggtgcggacaacgcatgtggcgcgattggcgccggcattttgagcgaaggccgtaccctgtgcagcatcggcacctcaggtgttgtgctttcctatgaggaacgcaaggatattgatgtgcaggggcgggcacatttttttaatcatagtgagcaggatgcttattatattatgggggttacgctcgcggccggatacagcttgacttggtttaaggatacctttgcaccagagcattcttttgatgcactgttggcagatgtgaactctattgaaccaggcagccgagggctgctgttcacgccttatatcgtcggcgagcgtacacctcatccagatgcaaccattcgaggcagctttatcgggatggatgcggggcataagcttgcgcattttacacgggcggtgctggagggaattacgttttcgctcaaggaatccattgatattctgagaggaacgggcaaaacggtgaatgaagtgatttccatcggcggcggtgcgcgtaatgaggcatggctgcaaatgcaggcagatatttttaacgcggatatcatcaagctggaaagcgagcagggacctgccttgggggcggccatgctggctgcttatggtagcggctggtttgaatctctgcaagcgtgcgctgaagcttttctgcgtgaagcagcgagatattccccgaacccagaacgtgtggcacagtatgaaggcctaaacgagctgtaccgtgaagtttacttgcacacgcgagagcttaatgagcatttggcggtatatcggtgaatacggtgagctttaagcgtaaataagaagcggctccgggtgtaagaaacccccggagccgctttttcatgtgatgatgagcatgaattaaatacttttcttgattttcgcatgatcttcattcatagaacttacggcacagccaggacatgacttgctcgacgaacaccccgcacaggcgccttgacggctttttcgcaaaaatcgtaccagcacccacgcactataaccgaggatcgccaataaaatgatgatattgatcatggaattcacttccttttatttactattgggcctgacttaaccccaacctaataatttgccacattgatagatcaagacggcgatgatatatgcgacggtcaaaggatagatcacagaaaatgcggtccaacgccacgaaagggtttctttacgaatgaccgctaccgtagccagacacggaacatacaacagaatgaacaccataaagctaaaggaggcaagcggtgtaaaggcctgtctgacttgtagttccagtccctgcatatcaggaacgtggtaaataatattcatcgttgatacgacaacttccttggccataaagcctgtgagcagggaagcacctgcttgccaggtgccaaaaccgagaggggccagtaatggagcgaaccaacctccaacggtggcaagcagactgtcattcatttctgccccgaagccctgcggaccgaaattggacaagagccagatgccaacggaacctgcaagaataatggttccggctttacggacgaagcctttgaccttctcccatgtgctgcggaatagtgtaagagcctgcggcactcgatagggaggaagttccacgatgaagagggagggctcacccgacaaaatggatactttggaaaaaattttggcaagtataagtgaaacgatgattcctaacacatacatcagcatgatgatgcttgccgcatgtgttgggaaaaacacacccgcaaacaacgcatataccggcaggcgggctgaacacgacataaagggcaccagcaacgtggtaatgagacgttctctgggctgttcaatggtgcgtgccgccataatcgcagggacattgcagccaaatccgatgatgaagggaatgaagcttttcccgttcaagccaacggcttgcatcaggcgatccatgagtatcgtgacccgtgccatataaccagagtcttcaatcacagaaattatcagaaataaaatagcaatttgaggcagaaaaacaagcacacccccgactccagccacgatgccatccacgactaggctttgcgtaaaagcggacgcattcaagtgaacgagtaattcagaaatccaagtgctgagtgtccctgaaaaaaatccatccagcatatctgaaaggatcgtacccgcccaatcgaaggtgaacttgaaggtagcgtacatcagcagcaaaaagatcggaatccccagataccggtgagttaatagtgcatctagtctatccgtcaggctgtgcggtctgagtttggaggtgtcgagtgccttggtgcacagatcagcaatccatgctgttcgtacagaacgaatatgctgagcaggggtgatggcatggccttcaccgagaagttcttcctcgcaacgttggatgcgtgcagttacttgttcacgctgtacctcattcgtcatccattccatgacgacaggattaccttccagacattgcagtgcggcccatcggagttgcggtacagatgcatccggcagtaagttgcaaatatcatgaatagccgcttcgactgctgggccgtaatccagttgaaaagcattggatgtacgtcttacctcccgaagagaagcgagcatttgcttacttccactgcctgtacgcgccaccataggaatgatgggaacgttcaattgatcagctaacaattccttatttacacgaagacccgtggcatcggctacgtcagtcatgtttaagccaagtacaagcggacggccatactccagtagttgtacggttagatagagattacgctggagctgggaggcatccacaatgttgatcagggccgtaggaggttcttccagcaaatatcgagttgcgacaccttcatccagcgaaagagggagtaaagagtaggcacccggcaaatccaccaatacggcagacttgtcacgcaggatgcctgttttcttttccactgtgacgccggaccagtttcctacttctgcatacgtacgagtcagcttgttaaataatgaggtttttcctgtgttgggattaccgaatagagcgatcatgtccatgttggaacaacctccagttgcttcacctgattttggcgaaggccgaccagctggccgttgcattcaatgacaataggaccgcccaataaactgattttttttaaccgtatgatggaaccttcgttaatgcccatgtctgttaagcggcggcgcaatgagggatgaagaggggcgagagattgcaaacgcacagtctgacccagtggcgtacgaaggagtgagatacattctggcatagtgctcagcctttccgatctagaatgagaatcaatatcatttacttccgatgccagtaccatatcatgaggaaatctagattgctgtgataaaactctctacgaacgacatgtttgctcattatccgatctgttatatagccgagtatgatgtcacaacctgtcttgaactgcacccttactcgtctgcaaccgacaaaactagagcgtttggggcaactgtttttatggtaagatatagctgtttacaactatgctaagaagggcaggaacgctctgtatgaacagaaaaatcggggttaggcttgtaaaatgtctggttgcgggtgcagcgctggctgtgttgctgccgcaggctgtggagtggggcagcaatgtgtatgcgacgtcggttaagccggctccatccgtatcatcgcagcagcttcagaacaagcttttacaggcaatggctacgcggagtgaaacgctgacctttacatatcaagggcgagtgaacggtctcaagcagcaattacagacggccatccaacaggccatggagagcgatccgtatgtaaattatacgatcaaaagctacgcattcagctatacagggacaacgacctccgctcaggttacgattcgtctaagctaccgggagacgaaggaacagacagcatatgtggatagcacagttaaagcggtgctgggggatattattacgaagggaatgacggatcatgagaaggtaaaggccattcatgattggatcgtcgttcgcctgaagtatgatgaagcacagcaaaagtacacagcctatgatggcctgaaaacgggaagcacggtctgtcagggttattcactgctggcctataaaatgctggaacgtgcaggcattacgaaccggattgtggaaggaagagcagggggccagctgcatgcatggaatctggttttattagatggtcgatggtatcacatggatacgacatgggatgatccaaccccggatcgcgcgaacgaggtaagcacttcatattatctgctaacggataccgaaatgcggcgggatcactcatgggttaagccgtatcctcaagcgaatacatcgtatcgggaaaccttgtcagcactggtaactgccggaggatcaaaggctgttgtgtatcaaaaactgtacaataccctcgaatatccgctgcaagacggcaagggtctggttaaatcatctgccgacattaaggaacaggtacgtaagattgtaaataagggagggacgacacttacctttgcctatcagggaacggagcgaagtctcaaggaggatttacaatccttatatcaactcggtttgaaatccatttcctatcagattacggatctaggaagtaccggcaatcttcgtgtaaccctgaaatggacctaatcatcttgctgtaaaaagctacattaacaaaggagtattttatttatatgcacaagcgttcctttacctatttgcttggcacgcagaccatgtctaatgcggccgacattctttacattatggcacttgtgtctctggtttttcatgaaacggactccatcttctcttcggtgctcgttccgttgctgcgaatgggagcacagatgatcagcggctttttagcaccgctcattttggcccgattccagcttccttttattttattcgtttctcagttcggacaactggttttcttcgctattctgctgggccacttgtggtcagcgggtacggagccgatatgggtgattgtgtttacgttggtggcagccatgtcctttctggacggctggaccacgcctgcacgtaatgcgctgattccccgccttgcgtccggggaaggactcatgcgggcaaacagtctggtgtcggtcagcgatcagacggtgcaattagcggggtgggggcttagtggtgtgctcgtagccatgctaggctcggaaaaaacactgctagtggctggcggactctatatggtagcaatgatcttcactagcttgattcgagatccactagagggcaaagcccattatttgctgcaacctggaacaagggtgcgaggtggagatgtttcggtttccgaaactggtactgagcccgggcaaggacatcatgacttgcctcctgcacagttggaagatacactgtatggcccggaatcagagagccctgcactacctcccaaacgtaaaaaggaaatactccgtgaaggctggagccttatcggagccagtcgcagactgaaagctcttatttttatggatatgattgaccttctagggggttcggtttgggtaggcgcgttcacgcttgctttcgcccagcaggttttgcacaagagcgaggcatggtggggatacatcaatgcagcgtattttgcaggagcgattggcggcggcatcgttgtcctcgcctgcgtcaagcatttgcagcgcaggctgctgcccgccatgttggcggggatggcaggctacgggctgctgacagcatggtatgcactgaacacattaccgccactgacgctgcttatcgtgttgttgatgggactacctgcggaaatgtccgtcgtatcccgccgcacgatgatgcagatgagtgtgtctgtacatgatttgcccaaggtgctgtctgcccaggccacactgacaagtttgaccttttgtatttcgctcctgttaatgggctggattgcagatcatctaggcatcgttaatttgtacttgttttctgcagtgctgacgctgattgctgttatatacggtgtttttagtcgtcgtgccttatccatgtctttgtcagcttcattggaaccttcctccaaataaacagaaaaagcccgtctccgggcatatacaggtgaaaatgcggataaatggtcttggaccaggtttatcagcgtgttttcccctgatatgtggagacgggctttttttagtgttttctattatttatccgaagaagcatctggactcaaatcacattcttttaacggaacgattttagtacgtttgatccatttgtagccgagccacagcagaaggaacagcggcacactcatatacgtagcgatcatcgttttccagtcaatctcctgtccggtgaaggcatccgccccttgcccgataatgacaatgatacacagagcgaaggcaaacaacggcccaaacgggaaccagcgggctttgtatggaagctcactcagactgtggccctgtgcagtaaaggcacggcggaaacgataatggctgactgcaatcccgacccacgtaataaacccacacattccagaagcattcagcagccagttatagactacaccgtctccatacagggaggcgagaaaggctagcataccgacagcggtcgtgatcagcagagcgttcataggaatgcctcgtctattgatacgtccgaggaaacgcggggctttaccttcccgtgccaaagcgtatagtacccgagttgccgcgtacatacccgagttacctgccgataatacggaagtcaaaataacggcgttcataacagaagcagcaatcgcaagccctgctttttcaaatacgagcgtgaacgggctgaccccgatgtcactgatatctccccgcagcagatttggattggtgtatggaatgatcaatccaatcacgagaatcgcgagaatataaaagaacaggatgcgccaaaagatttgacggatggcgcgcggcacattttcacgcggattttcgctctctccagcggctaccccaatcagctccgttccctgaaaggaaaagccggctgccatgaatacgcccaatacagcaaagaatcccccatggaacggggcgtctcctaccgtgaagttggcaaagccaaccgcaggaccacccataatgccgaagatcatcagcacacctacggtcaaaaagatgaccacggtcacaattttaatcatggcgaaccagtattcagactcaccgtagcctttgactgtcaatgcgttcaacgcgaagattacggctaggaataacagactccaccaggcagagtggctttccgggaaccaatatttgatgagcacggtcgctgctgctaattcggcagcaatcgtcaccgcccagttgtaccagaagttccagcccatggcgaaaccaaaagccggatcgacgaagcgacctgcataggtgttaaaagagccggattcaggcataaatgtagccaactcaccgaggctggtcataaggaagtagaccatgaggccaactgctgcataagccagcagcgcaccgccgggtccagcttcggcaaccgcgcctccactggcgaggaacaggcccgtaccgatagagccgccgagggcgatcatcgtcatatggcgggctttgagacttttacgcaaggttgcgtcaggtgttgctttgtgttgcacgttcaaacactccttcatgaaattgtatttcatgtcagggcaagagccagaaggagggggagtatataaatcaaaaaaccgcagggaatacgcctgcggttttgtctatgcattccgcaccataccttcttctataacaagatagctcaacacacgtgtctgtgttaggacagcgtgtgacagttctgctcctttcggttagcagccccagcattcggagtatttacaaagagttagctccgcatacttcggcgggtgtacctttccactggaatctcagacggctcttatcgtctcctccggtgtactgattacatccgcgacctctacctcatcataaaacagggttgatgaggtgtatgacatgatattttattgtatagcgaactacagtatatcgtacctgtacatcttctgacaatcgacaattttttgaaaatcactcgtagaatcttaaattaagagttccgcttggccatctgctgccaaactgtgcccgcggcttgttctcctgattcgatgcgttccagcgccattttagcctgcagactgacctcgaattcgggatcatcgacagccttctccagcgcatcacgtgcatcctcggttccaacctcgtataaaaaacgtgccgcccgccagcgcaccaacttgctgctatccgacagggctccgatcattgcgctggtagcgaccgggtcgccgatgtccgacaacgtgtcgcctgcggtgcggcgtactgccgctgaaggatcgcgcagcgcctcggctagcagatccatcgcctctggtgagcgaatatcgcccagatagacgacgcccagccgccgtagctgcattttgtcatcatgcagcgcttgccggataagcggcaaatgctcaggcgtcggctccagccgatccagcgcagcgtagcgtgtgcgccaatcctcgtgctgcagggccttctccagctcggcatcgctccattcgcggcgttcctctacgaattcgctgttgtttgcgccgtgggcaatcgcctgttggataatctgctccagccgctcttgcggaaaggctgcctccaattcctgctcgacctcgcgtgcaatgtccggcagttcaccgtagcggacgccgtaatcactcagcttgcgttccttgatcagcgttgcactcgctacacgggtaacggcctgcacgaagcggtcggacaaggaaattcgctcctcctgctgccccgccttgactcggatttgcattggaataccacgaaaaaattgcacaaagacctgtgcttcgccaaatgcttctccagaggtttcctctggcaaatcccaattggcgtcagcgccttcctcgcctagccgatcccggacttgacccagaatggtggaccaatctgcattccctttgcggtcaagggctacaaagtcagtcgtatgaaacacgcttttgaccccttcaatgcccagcatgcgccggataaatgggggagcggaacgctcattgtcccgtgtatatgttctgcggatacccgcttccagtcgctcatccagatgcagcatcatggtgttcggactgggagtaggctcgatagatgttattttcatagctcagtacagcctcctgttcaaaagttctccatatatagcttatctgtattgtaactcattctgcgaatgtctccaaagataagttcgcgtatacaggaaaaacacaatgacatatctcacactaattcaggtaaacactaaaaagaaatactgctacattcaatgcagaagcagggttaaaactcgatagaatgaaccaaactgtgaataggttaccaaaatgcgccaatagataagtgaaggaggcgttcctatgttccgcaagcaggaaagaacgctcattattgtatgtatagtaattgcggccatcatgctatatgccgtaattaaaagcatagctcgcttgactccttagttggtaatccagagtgatctgcgatgtttaaaatgtgaaatgaaggagtgaaacccatttgtcttcactggaccctgtattactaagccggatgctgaccggaattaccctgtttgttcatatcgtatttgcatccatcggcgtcggcgtacccttaatgattgcactagcagaatggcgcgggctgcgaactggtgatccgcattatacactgctggcccgacggtgggcgcgagggtttgtcattaccgttgccgtgggtgtcgttacaggcacctccattggtctacagctcagcttgctttggcccacctttatgcgggtggctggacaagcgattgcgctgcctctatttttggagacgtttgcttttttcatcgaagctatattcctgggcatctacttgtatacctgggatcggtttaaaagcaaatattttcacctgatgctgctcatcccggtagcgattgcctcgtctgcctcagcggtttttattacaactgtgaactccttcatgaaccaacctcaaggctttacactcaaaaatggagtcatgacaaatattcatcccatcgaggctatgctaaatccggctacgccgaccaaagtgtcccatgtattggcttcctcgtatacattgagcgctggtgtgctgatggggctggctgcttacagcatgctgcgagggcgtaatcacccttattttaaaaaggcgctgaagctgactgctacctgtaccattgtgtttgccatcagcaccgtgatgattggagacgcatccggtaaatttctggccaaatatcagccggagaagctggccgccgccgaatggcattttgatacgatgacacacgcgcccttcgtatatggcggatacatggataagaacggtgaaatcaagtatgcgctgaaagtgccttatgcacttagtgtgttggctggtaatttgcccagtacggaggttaagggattaaatgactatccggtggaggagcgtccgccgctgtctattcattatatgtttgacctcaagatcaccacaggagtgctgattctcgtcatcccactgctgtatctgatccgcaagcgtttgccaggtcgcaaaccgtaccccagatggctgctgttggcgctcattctagtggggccgatggcgatggtagctattgagctcggatggatgtttgcggaggtcggtagacagccgtggattttacgcggatatatgaaggtctccgaagcagcgaccacttctacgagtgtcgggtggatgctggtgttgtttgttattttgtatctagtgttgtgtttctcggccattaaggtactcagcaagctattccgcaataaggatgcggtggaagagataaggcagctgggcctggaaggggctgaaggcaagtgagctatgaaattgtaggtatcgccattttgtggacgttcctgttcggatatttgcttgtggcatccattgattttggtgcaggttttttcagcttttacagtgtgttaacaggccaccagaacaaaatccacaatatcattcaacggtatctatccccagtgtgggaggtaacaaacgtatttctcatcttttttgtggtgggattaaacgggttcttcccggatgcagcatattactatggtacggcgttactcgttcccggcagtattgcgattgtgcttcttgccatccggggagtgtattatgcatacaatacgtatgggcattccggtaaaaataatatcgtctacatggcgttgtacggtgcgacagggttgctgattccggcggcactatccacagttctcgctatttcggagggcggcattattatagaaaacagtacaggtgtacacctgcaatggggtcagctattaagtaatccctacacgtgggcggttattattctggcgctggtgagcgtgctgtatatctcggcgatgtttttggcctattatgccaaaagggcgggagacaaggtcgcttttgaaatcgtacggggatatgcgctgctttggagcggtccaacgattgttgcgagtctgctcgcattttttcagattaacaaacaaaatccagatcattttaccaatatgctgaacatagcctggatgtttgttgcatccttcatatgctttgcaggagcagtttatctggtatggcagcggcggcatctgggggtttcattcatattggtgatgctgcaatttgcatttgcctggtatggctacggccgctcgcatctcccgtatgttctgtatccctacattaatgtctacgacagctttacaaattctacgatggcgtatgcgttgattacggcgtttgttgcgggtctgctggtgctgatcccttcgctgatcctgatattaagattgtttctgttcgatgcaaaatatgtgcgcggacatgaagggaagaaagggtgagttagagtggctgctttcgagcattttacgattatgtacgagtcacctatcattattgtcgtggcgatagcgtttttgtttatttattcggcacgctttaaaaatccacaggactgacaactacaggtagaacaggccttcctgattgatacgggaggtctgtttttgctgtattatcgcagaatttcctttacagacgtgattgaattatactttacatatatcaggatgttgtatcattttatgttcacactcgagtgacaatatatagttaaattgaaccgctgtgttttttggagaacgggttcatcagggagggagctgcatcatgcccaaagtacgttttaacaatatggatcatgtaaataccgataaaacaatcaagcaattcagacaatggcggcaggagcgacgcagcaaaataaaggattatacgttcgtcgtgccaaaccatcccccggagctggaatttctgcatagcaatcgggagatggcgacagccacctgggtgggacactccacctttttcatccagtatcttgggctgaatatcgtcaccgatccggtatgggcagagcgtatggcttttgataaaaggttggctccgcccggcattcgtattcaggatgtaccaccactggacatcattctgctgtctcattcccattatgatcatttacatttagaatcgttgcggaaattatatcgtgcagatacgctgatgctcgtacccacgggattaaagtcgaaaatgatccgcaaaggttttcgtaactgtcatgagctgcaatggtgggagcattttacggtaggaggggttcgattcacgtttgttccagcccagcattggacacgacgcacgccgtttgatacgaacacttcgcattggggtggatacgttctgcaaaatgagcagcaggtgattggctctgccacgtccgtcacggaatcccatcctcattcgaatacagactcaaaggatgcaccaacgttgtattttgtgggagacaccggatattttcgtgggtttaaggagattggcgagcgctttgccattgatctgacctttatgccgattggtgcgtatgaaccggaatggttcatgacctcgcagcatgtgacaccggaggaggcattgcaagggtttgtagattgtggcgcagatcagatgattccgatgcactacggagccttcaagctggcggatgatacgccaagagaggcgctggatcggctcgaagcggagcgtgagcgtatgggtattgcgaaggaacgcattcatgttcttgggcacggagagacgctgaaaattggacgtcgctgctcaactacaatctgaggaattcgacataatccttatacaagaggattttgcaaaaatccaataagcgacttccaatgaataagatatagatcgaaatgttttagttcgtctatatcttgtacttcggagcgactggaatcgaattttgcaaaatcctgataaaaaaagcggctcggcggacaattaattttgcctgccgagccgctttttttggtttttagctataatgcaggattaaactgcttcggaatcacttgccaaagaggaggaatcgctgttggcgatgggatgacgaacgattttaacttcatagaacgtgattttattttcaataatatagtctggaatttgacgatggctatgggattcgcggaatgcttcgcttttcgtccagccttggaagttctctttttctttccagcgtgtactgatggttacttcctcataatctttcgtgttttcagtcagcagtacttccagaccgagaaagccctccattttttcaacttttccttctttgttaaatctttcgatgagtaaatgtgcattgcccggtgtgattttagatgtatttgtaacgataaccatattaaattcctcctgaatgatgtggtatggtcggtataataaccggatagccatcctcaaatttgatggtagcgttcatttcataaatgtcgcgaagaaaagcagacgtcaaaatctcacggggttcgccggcaacggcgattcgtccctttttaagtgcaatcatatgatgacaataggccgcagcttgctgcaaatcatgcagtaccataacaatcgtcaagccggactcgtgattgatacgccgcagcatatccataacttcaaattggtgggcgatatccagaaaagtggtcggttcatcgagcaaaagaatacctgtttgttgggccaaagccattgcaattcgcgctttttgttgttcacctcctgatagagtatggaacattcgatctgcatagggctggatgcccgtgatcttcatgacatggtccacgatttgctggtcttgtccagtatggcgtaccctcaagcctttggcatgaggagatctcccgtaagcgaccagctcgcggaccgtcaataacggcagcatatccttcatttgcggtagcattgtaatcgactgggcaaaatcacgccgcttgtattcctgcacgggtttgcccagcacagaaacctgaccctgatcctgcttgagcaaccgggtcataatccgcaaaagcgtggacttgcctgaaccgttcggtccgacgatcgctgtgagctgaccagcgggcaaggtgatattcacatcgtccagcttgaaatacccacgttgtaaggagatatgctccccctgaatggctgtcatccgaaactcccccgtttcttgagcaggattaagaagaacggtgccccgatgacggccaacaaaatacctacaggcagttcaatcgggtcaaaccaggatcgtgccaccgtatctgccaggacaaccagcgttccaccgcctacaatggaaatggggaggaggaaacgataatcttccccgattagcagccgtatgacatggggaacgaccagccctacaaagccgattagtccggctacactgaccgctgtaccggcgagcagggcagacagcaggataatgagcatacgttgaagctctactcgctgaccaagcagctgtgctgaatcgtcgcccagcagcagtaaattagcaggtttaattgcaaagaaagaggcgattaatccaatgatggcgtaaggcgccataaactctagatgatgccagcttcttccgtttaatccgccggatagccaaggaagaacggcctgtacgcggtcgctgtacatgaccattacgccgttggtgagtgcgcccagcagcgcgttgatcgcaacgccagcgagcacaattttgacaggcgatgcccctcggtcccaagccagcagataaatgacgattgcgctcagaaaggctcccaaaaaggcggttatcggaagaaggtagctgagctgtggaagcatcaccatcgtaatgacggcggcaagtccacctccagccgatacaccaataatgccagggtcagccaatggatttttcatcacaccttgaagaagtgctccggaagctgcaagacaagctcccaccagtaaacctactaatactctaggtagacggagatccatcaggatcgtgcgatatgtagattcatcattttgtagcaaaacatgatagatttcttgaagtggaatcgacaccgaaccgtaggccagaccgtacacagagacggccagcagtagaatcggaagggtaatccaggcgatggtgcgtcttctggcgcgctgtagtttgttcatctccatcgcctatttcgccggatacagcttttgatgtatcaaatccagcgctttagtgacacgtgtgcccggattcgtaccgaacagatctgaaggtaaaacctcgacctgattgtttttgactgctcggattccgttccaggctgcattttcctgcatttcctttataaatgcggccttaacatcttccgtattgccatgggtcatgatgaagatgtagtcagggtcagcctgtatgatgcgttctgtgttcagctgcgcatattgcgggaaattttgcaggcccggaaaatcagcggcgatgttcgagccacccgcagcttccagaatgtttccacttagtgaatttggcagtgccgccatatacgtagccggggctccgtagaccagcaacaccttcggtttagaggcagaagcggtttccttttgcagcttagctacttgttggtcaatttgctgatttagcttcacggcctgagcctgcttttgcattaattgtccgaacagcgtaatttgcgactgaatatcgtgaactgaattggctcccgtcagcagcagctgtgaaccgactccttcaatggctgggatgtctttttcattcataggatagttgcctagtacgacatccggtttgagcatcgtaattttctccagatctacttcatgagtggagcctatttgctgaacgttttcagcagcaggtacgacggaaggtccattggagttgggtctgcccacggctgtcccgcctaatgcgtaaataatatccagatcgccattgctgagcgcaacgatatgttgagggaccttttgaaaggccaacgtccgttttgagaaatcagtaacttgaatcgtcgcgccacttgtcgtgcttgaagcggtagatacggaagcactggctggtttgtgatctgcggtcgaggtaccattactgcatccggtaactgccaataaaagcgctgcggatgaccacaacacataagatttcatgttattcctcctgcaattttcaagttaaacaataatgataatcattttcatttatgtataagagaatgataatgaatatcactgaggattgtcaattgaaaaaagcaaatttttaaataaattttgaactaaaaataaaagagagtaattcgaattatagaagaaggaactacaaatttttattaaaaaatagcatatatcaagggattacgtacacacaaatacatattgacattttcgaaaagtgtaagatatattggtgatgggtttacttgattttgcgaaattatggaatagagaggtggggagacaagctcgaaaagagctattttttttaaattatcaattgagaatgataatcaattagtttattctcgtggggagggactgctgtcaaaatgaagaaggggtattctgcaattattgctgtgtttctgctggtgagtgtgctgagcttttggccaacttcgtcatctgtaggagccgctgcggcttctccaaaattggcggatggtacatacacgctcaaatacaatatcctcaaggcagaaaatgattcggtgtccatggctaatgattattttgaaaaaccagctaagttgtatgtaaaaaaaggtcaaatgaccatgcaaattaagctgaatcatagcgaatggacaactgggtttaaagtagattacaaaggcaaaatcatcgatacaaaggttatccataaggatgccaaaaccgatacccgcaccgtacaatttccagttacgagtgtgaacagcccgttaatctctaaaatccatgttactgtccctgcgtataactacgatcatgactatacgatccgcttcgcttttgattccaaaagcgtcaaaaaaatagcagccgtccagtcagcgaaatcaactaaatcttccaagaagtaaattcaagccatctttatcgttcataaaatcaacacaaattgaagcataaaaaattgaggagtgtgtgtagatatgaatatagtaatgaatcgctttgagcaattttcttttaagaaggtatttgtagcattgatcatgacagcgcttgtttttgcactcgttgctccattctcagctaaagcggcagcagccgacggcacgtataacgtagactataccgttctgaaggatcaaaccaatgaaacttctcgattggatagctacctgacgaagcctgctcaggttacggtagctaatggcaaaaatgtcgttcgtctgactgtgaaaagcagcaatctgattacaacgttcaaagtagagcaaaatggcgtactgcaagatgcgactgtggtaagcacagatactgcgaacaacactcgtgtagtggaattcgaagttgctgatctgaatgcaaaagtgaatgcttacgctgaaatcacaattccagtaatcggctacacaggcaagtacgatgtacaactgcaattcgacgaaatctaatccaaaataaaacgtaaaaggagattaagaacatgaacatgattatgaatcgtatggaaaaattgtctttgaaaaaagtaatgcttactgtactgatggcagcgcttgtttttgtggtactagctccattttctgccaatagagcgaatgcggctttgcctaatggaacgtatcaattgccttataccgtttataaagatggaacgactcagccatcttacatggatacaaatggttatgtgaaaaaaccagccacactgattgttacgaatggtcaatataaagtgagagtagctattaccaagagtgcttgggttactgaattcaaaactcaacaaaacggtcagtatgtgaatgcgactgtagtaagcacatcaggggatacaagaatagtcgaattccctgtaactagcccgtctcaaaaattgaacgttaaactgcatgtaagtgtgcctgcagaatacacgggtggtattccgtacgatcacgactatgttgttcaattccaattcgacgacagcgatatctaagacttctttttgaaaatataattttgaattgaatactcatttggagcttagtttcaaagctccaaatgagtatattttaagtagggggatacatcaccttgaaaagccgatttaacaaatttataacgacatttgctgctattctaatgttgttttctttattttcaccatacgtaggagcaacacctgagggtgagcccacttcgtcgaatttgcccgatttaagcactacagtcactagtgctacttatgctacttatgagattccggtagaagtgcccagcacatatgctgagtctaccaatgctgtgaccactactaatgcgacctatgcagatggagaatacctgatcgattacaaacctttaagaaagacggtcagcggtagcactagggattcaagcttcaaaacaaactatacctatcctggagatttgatcattaaggatggaaaataccatttttcatttaagtttgcggaatctcaaggtctttcgaaatttttagttgaacaaaacggggaaacggttcccgcaaaaatagaggtggattctgggaaaacttccgggactgtaagcttcgatgtttatgatttccatcaaaatgtaaatacggagtttggatttaatagcagttctccatggtatgtagatactgatccagaccgttcagtgaaggaatggattgagtttgatccttccagtttgagacttaaaaactcaacggagaatccaacggttccacctgtaacaccaccggtaacgcctcctaatacaggagagaaactcgctgatttggactttacccttttgaaagatgaaagcaatgaaaagtcaatgatggatgggtatacggagaaaccaggctctctaattgagcgtggtggtaaacgatatgtccaatttacattaaagaacagtaagcagattgatggtttcaaggtagagcaaaatggagtgttaaccgacacctctgttgtaagtgaagatcaaactgcgaatacacgtatgatcgagtttgaagtaaaagatctgcctgccaagctgaacgcatgggtaagcatcaactggcctgagctgggctacgtgaatacttataacgtagatcttcagctggcctctgcacccgcaccatcagatttggcggatggaacgtactcgattaactttaacgcgctgcacgccacaaaagatcaagcgtcagcgatggcacaatatctgttgtctccagcgactttgacggtatcgaagggacaaaaagaagtctcctttaccattaaagatagcaccacagtaacggagttcaaaacagaacaaaacagaacgttaacagatgcgaatattgtaagtgaggacaagacagccaatacgcgtgttgtgaaattcaaagtagcggatttggacgcgattttaaatgcacaagtacatgtgagcacgacctatccaggtggggtttatgagatggatcataagcttcgtctgcaatttgataagaatagtattacaggaaatggaacctctccagaaacaagttccaatctggatttcacccttttaaaggatggaaccaatgaaaagtcaatgatggatggttatacagagaaaccaggcgctttgattgaacgtaatggcaagaagtatgtacgttttacattgaaaaacagtaagcaaattgatggctttaaagtagaacaaaacggagtattgaccaatacggccgtagtaagcgaaaatcaaacggcgaatacacgtgttatcgaatttgaggttaaagaagtgcctgccaagctgaacgcatgggtaagcatcaactggcctgagttaaattatgtggaaacatataatgtcgatctccaattaggaacggcaacatccccggttgatcctgggacgccaggtacgcccgagaaggttttagctgatggaacgtattcaatccaattcgatgcattgcacgcaacaaaggatcaaaaatcggcaatggcgcaatatttattatctccagcgacactgacggcattgaaaggtaagtatgaagcttcctttaccatcaaagacagcgccacagtgacggagttcaaaacagaacaaaacggaacgttgacagatgcggatatcgtaagtgaggacaagaatgctaatacacgtgttgtgaaattcaaggtagcggatctggatgctattctgaatgcacaggtacatgtgagcacgacctatccaggtggggtttatgagatggatcataagcttcgtctgcaatttgaccgcagcagcattgcgataaaaggaacagacggcggcacaactcccgtgactgaaaacggcagatacagcattgatttctccgtcctcaaaaatggaagcaatgaaatatctgtgatggatggctatatgcaaaaaccagccacgctgctaagacagtccggtaaaaatgtgattcagatcaaaatggacaagagcagctggatcaaaacctttaaagtaaatggtgcagaagctccggtggttgagcaatcgacctccgcagatacacgaacagtacaatttgaagtaccaaatctctcggataaagtgacagtgaatacacatgtcatcgtacctggattggatttgggtggcatcccatatgatcacgtatatgatgtgcaatttcaattcgagcctgctactattcgcagctttgtcgagccttcctctacaggagctacagatcctatcgtaaaattggattttgacaagcttgtcaatgggaaatatgccttgaaattcagtattctgttgtcggatggttccacaggagtggattctccagctcaacgctttatcactaatgaaccagcgcaattggtcgtggaaggcgacaaacggtttgtaggtctgaagctgcaaaacagtaatgaagtgaaggcgttgcgcatttgggacaacgcaagcggagactaccgagacgcagaagtgacccaggaagatgcagcaagcaatacgaagcacgttcgttttagcgtaaatgactttaaaaacaatgtaaaaggccaactagttgtctatgaagcccctaaagtggcaagtgccattccgatggtctttaaggctgaggatcgggtagagaaggtatacgattttgaatttaaattcgataccagtaatgtatcttatcacaaccaaaccaaagcagacgaagtagagcaagggaaaaacaacttgcctgatggagagtacactgcaaacttccgtgtgcttgcgaacggaacggacaaggattctctagcggctccttttgtacaaaatctagcgaaattgattgtgaaagatggtaaggtgcaggcccatgtaaccgttacggacaaccaggctttgaaattattccaaacggactttgaaggccgctatgctaatccaacgattgtggcttccgacacaaaaggtgacacgcacactattgcgtttgaagtgcctgatctggataaaaagttgagtgtgtacacacaggtatatctgcctgagaaatacattctaaatgagaaattcggcggacagattcaatttgaccgtgcatcgcttaaaggtgagggagtcaatgcagttacaaccgcaactgaaccaacagcagcttctacgaacaaggcagcagaaacaactgcatctgtggctgaaacaaaaccagtagttgagcaaccggttcaaacggcttccgagaagcaatacacgattaattacaacgtatttaaagataaaacgagtgaagcttccgttatggacggttatctcgacaagccagctacactgattgaaaagggagacaagcgctatattcaaattactttgaaaaatagctcctggatgccagctctccaagtagagcaaaacggtaccctgaaagatgtggaagtaatctcgacatccggcgatacacgtgtcgttcaattcgaggtaggggatttgtctcagaaaatgggtgcttacacacacgtcattgtgcctggtttggtccttggcggagtgccgtatgatcactggtatacagttcagttccaatttgatgaagaaagcctaaaagcgaagtagcctcaggttgtgataatcaatgtagtctgaataacagcaaagtttgtatgcgagcaagtcttggtgccccggcatcaagacttgtcagcatttacatacccgaaaagttggggctcctactgtttttctatattttgaattgaggtgactggattttcatgaaacggtatatagcattggctcaaggaaaaacatttggtttgtatatgttaatcggcatcgtgatcttgttgctggctggatgttcgggaggggcacaggccgggcagaaccagagcgatggttcgaaatcagcggcaacatctaatgcaaccggaaagtcgtctgacggtaaagctcaagctcctcgtattgtggcgactacggtagccattgcggaaatcacggatgcactgggcctggatttggcaggcaagccgacaagcacgaaagtgctgcctgaccgttacaaggatgtgcctgatgtgggtaatccgatgagtcctgatatggaaaaagtgatgtcattgaagccgacggacgtactgtcggtgacgacactgaaatatgatctggagcctaaatttaaagatttgaaaatcaatgccgaatttttaaattttgaaagtctcgcgaatatgcaaaaagaaatccaaaaactgggagacacgtttgacaaagccgataaggccaaagagattaatggagctttggatgcgaaagtagccgagattcaacaaaagatcaaagggaagaaatcccctaaagtattgattttgctgggagtaccgggaagctatctggtggctacagagcattcctatattggggatctggttaaaattgcaggcggaaccaatgtggttcagggcgagaaagtggagttcattgcccacaataccgaagccttgcagcaatccaaccccgatatcattttgcgcgctgcacacgggatgccggatgaagtagtgaaaatgttcgatgaagagttcaaaactaacgatatctggaagcatttcaacgctgtgaaaaatgggcatgtctatgatctgcctgaaccgttgtttggcacaacagggaatttagcggcaaactcggcgctggatgagctgatgaaaatgctgtatccttcgaattaaaggaagctgatgacatgtccaaaaaaggttggagccttattgttgtaattgtcttactcgttggcgtcatgctgtattcagcgatgacaggcagtctcaaggtggatttgagtcagttggtgaccggattgtggacaggtacagatgatcaggtgaatgtggtcaaggacctgagactaccgagaattttcgtgtccgtaatggcaggtgcagcccttgcagcagcgggtgttttgctgcaagccgtcatgaaaaatccgctggcggatgctggggttatcggcatttcttcgggagcggcattgatctcgctgattgcggtgacggtctttccggcgctttatttctggatgccgttcttttcatttattggcggtgcgttagcctgcctaatggtttatgggttttcgtggaaatctggcttgcatccgattcgtctcattctgatcggggtagctgtgaacgctattttttccggtctaggtcagtcgtttaactatcgaggtagttatgcggtcaccagcattaaccaggttaccacatcaaccttgtctatgaaaaaatgggtagatgtcgaggttattgtgacctatggtgggattgggctaattttagccatgctcgtgtttccttggtgcaatttcttgtcccttcaagataaaacagctaaaaatctaggattcaatgtaacgcgcgcacgacttttgatttctgtgattgcagtgctgcttgcagcaacggctacagccatcgcaggagtaattgcctttatcggcctgctcgttccgcattgtgcccgctaccttgttggctcggatcataagtggctgattccattttcggcattatgcggcggcttgctgttgctgctcgcggatacactggggcggacggtgcttgctcccaatgaaatcccggcttctattattatggccgtcattggcgggccgttcctgatattcctgatcagaaaggcggatcgcacctatggacattaaggatataaccttctcatatgatcggaaaacggatcgtctgcgcgctattaatgctgttattgagtcgggacggattacgaccataattggtcccaacggatgcggcaaatcgacgctgctcagcgtgatgtccaacaatgctgttccccgcttgggccaggtgattctggacggcaaggagatagcccactacaagcccaaggagctggcccgtcaactggcggtagtccatcagcagaacgaggcaccttccgacttgactgtagaaaaactcgtcagcttcggcaggttgccgcataagaatatgttcacagcgagacgtgatgaggatgaggaagcgatcgagtgggcgatagcctgtactaatctgaacacgcgtagaactcgcacgttagatcagctctcaggaggagaacggcagcgtgtatggattgcaatggccttggcacagcggacgccaattttatttttggatgagccgaccacctatttggatatgtactaccagcttgaaattttagagctcattcggcagttaaaccaggaacatggactgaccatagtgatggtgctgcatgatatcaatcaggctattcggtatagcgatgtgatgattgccatgaaggaaggacgtattatagcgaacggcccaccttcagaggtcgttacatctgagctgatccaggctgtctatgacgtggaggtcgtaatcaaacaggatgatgaagcgggcatgtacctcattccgataggtgtcggggtttcctgacgtttacgacgcacagaacaatcaatgctgcgactgaataacgcgtctgtcctcacggcatctcaacgaatttaaaacatgaaaatggttctggtccatgtgcttgtcacgtgacaatcgtagagacagaagcattttttattttatttataagatattggatgagattcaggggcagttatgcttgcactacggttcgaatccgatcttttgtgtgttatactattgccgtcggtaattttgtgtttagcactttactaatgataaggatggtatgcttatatgatcagtacaagcggcgtaacgcttcgttatggtaaacgcccactttttgaagacgtaaatatcaaatttactcctgggaactgctacggcctgattggggcgaatggcgcgggtaaatccacctttttgaaaattctttctggtgaaatcgaagccaattctggtgaggttcacatgacaccgggcgaacggatggcagtcctcaagcagaaccattatgaatacgatgaattcccggttctggaaaccgttattatgggtcacacgcgtctgtatgaaatcatgaaggaaaaggatgcgttgtacgctaaaacggagttttccgaagcagatggtttgcgtgccggtgaactggaaggcgaatttgcagagctgaacggttgggatgccgagccggatgcagctgcattgctgatcggtcttggtattccgcgtgacctgcatgataaaaatatgtctgagatgagcgggaacgacaaggtacgcgttctcttggctcaagcgttgtttggtcgtcccaacaatttgctgcttgatgagcctaccaaccatttggatctcgaatccattcaatggctggaaaatttcttgatggactatgaaggcaccgtcatcgttgtatcccatgaccgtcacttcctgaacaaggtatgtacgcatattgcggatatcgactttggtaaaatccagatgtacgtcggcaactatgacttctggtacgagtccagccagcttgcgcttgcattgactcgtgatgcgaacaagaagaaggaagaaaagatcaaggaactgcaagcctttattcagcgcttttccgcgaatgcttccaaatccaaacaggcaacttcacgtaaaaaacaactggataaaattacgctggacgatatccgtccttcaaaccgtaaatatccgttcattaacttcaagcctgagcgtgaagcgggcaaacaactgctgaccgtagacagtctcagtaaaaccgttgaaggcgagcaagtgttgaacgagttcagtctggtagtgaacaagggcgataaaatcgcgtttgtgggtccgaacggtttgcctaaatcgacgctcttccaggtgttgatgaacgagattgaagcagacagcggagaattttcttgggggattacaactagccaggcttatttcccgaaagataattccacctatttcgaaggtgtggacatgaatcttgtggaatggctccgtcaatattccaaggatcaggacgaaacgttcctgcgcggcttcttgggacgtatgcttttctctggagaagaagcgcttaagaaagcaagtgtgctgtccgggggcgaaaaggttcgctgtatgctggcgaaaatgatgctgaacggtgccaatgtgttgctgctggaagaaccgaccaaccacttggatctggagtccatcacagcgctgaacaatggtctgattgattttgatggtactatattgttcacatcgcatgaccaccagtttattcaaacgatcgcgaatcgcatcgtggaaattacaccaaacggcgtaatcgaccgtacgatgagctatgatgagtacttggaaaatgaagaaatcacaaagttgcgtgaacgtatgtatccggtggaaattggctaaacttcaaaccggctaacttcaaataactagataaacgaaagaggagctccttgaggccattaagatggcaaggagactcctcttttttcgtttttgtaccatgcccatagcttacttggttctggcagtgaggtacgccagacctttgataccctattaaggctatgaggtggattatgatccgcctgtacgacggcgttggttgttcggcttcttcgtattttggcttttcagtgttttggtggaaccgccttgaaagccgccctgctgtgaagcgccggactgctgttttttttgtgccagcttttcccgaatggcatctgcgagattaactttacgtggttcattggcatcgctcatgaataaattcctcctgttgccgccaggttcatgtcaatcatgctggattgaagaaaaacgcggctgtgtcctcattttatacgtttttaaaagaagggacaagggcaacaatgataacacacatctcgggtggggtggaagagaaaacgtctgttttttgtgtgaaggaaaaaatgttttgtgtaacctacaggaatggggtctggcaatactttttcgttgttactacagcgatgcagagtggaaagactgtttctctagacccacacaaagttcgtctgctatcctgaaaataacagttaaccaaagacaaattgttattattcagggcagcgatgctgctatttttattttgggcccggtgagatcgttctgctggaaactatatatttgaaggagtgtcctacgttgtggtaaatgtctatgaagaaatacgaaaaggtgagcgtggggcgtgggtgagcattgctgcttatctcttgctgtccgcctttaagctgattagcggatatatatttgcttctagcgcgttgcgggcggatggcttcaataatgtcaccgatatagtagtgtcggttgctgtactggtggggctgagaatttcccaaaaaccaccggactctgaccatgcctatggacattttcgggcagaaacgatcgcggcgctgttggcgtcctttattatggctgtcgtcggtttgcaggtgcttattgatgggatcgggagcatttttaagggcggaaagcaaataccgaatatcacctccgcgggtgtagctgtgatttgtgcggtgattatgctgggagtgtacctttacaataacagactggcacggcaaattaacaataaggctttgctggcagcggccaaggataacctatcggatgcacttgtcagtgttggggcagcagttggcattatcggcgcacagttcgggctaccctggctggatactgtagctgcgatcgcggtaggattcatcatatgtaaaacagcgtgggatatttttaaggattccacgcacagcttgaccgatggatttgatgagcaagaactgtctgacttacggagtacgattgcctgtatacctggagtagaggggattcgggacgttaaggcacgtgtacacggcaatcatgcgctggtggatgtggtcattgaggtggatccgcaactcagcctgattgaagggcatcggatcagcgaccggattgaggaacgcctgcaagaggttcataacacgatgcatgtccatgtccatgtagaacccaaattatagattaattattaaattgttagtattaaaagtgactttagacctatatgtaaaaggcgtatacgcttccttttgtgacgtttggattatatctctcttcctgctgcttttactataatgaaggcatgtccggctatattcgtcggaattggatatgctcttcaaattcgtaaaaacagccaggaggtgcaacattgagaagacgcgtgatgggaatgctcatgacgtcagccgcgctgttggcagcaattcatgtggcgccgggtcaggttgacgcagcggcatcaacagcatccacaggacagaaggcggttattcaggcggctgtaaagcttagatccggtccttcgactacaggggatgtagtcagctttatgaagcagggagaggccgtaacggtattggagaaaacgaacagctattggtataagatcaagacttctgatggagtaaccggatacactagcagctccgacaagtacataaaagttggcgctaccagcgtcgctgctgctgtcaccccgtctaccactcgtaaatcggaagccacagagtcagttaaaaatgtttcagctaaagaggcagtggcctcagtgaatagttctgccggtcaaacgaaagccacgattcaaacgtccgttcgtttgcgggcggaggcatccacttcttccgaggttttgggctatttgaatgcaggggatgtcgtaacgattaccgacccaagtaatgcttattggttcaaggttaccaaagctgatggtacggtgggctacgtcagctcgtctccacagtatattcgtattggtgagggggttgttgtgcagcagcctgtgtctgccccggtgacaaccactcctgatactaccgtaatacctgcgacagcctctcctgtgtcaactatgaacatgttttccggtgatgcagcggctgcaatagaccaggttattaacacggggatgacttatctcggaactccatatgaatatggttcagatcgcaacagtacggctacttttgattgctcggcatttacccgtcaaattttccgtcaggctgtaggtatccagcttccggcagattctcgttcacagggtgagtggatcaagcaaaacagtcagccgaatacggacatgactacgctgaagcgtggcgatttgctcttctttacaaattataatgcatcttccggggcgtacacgtccttggataactcctcccaaacgattacacacgtagctgtatatttgggagacaacaagcttctccatacgttttctgtagcgggtggcggtgtaaaagttacggatttcagcaagccttggcaggatcgtttcctgtttgggggcagcgtgattcaataaagcgccgctaactgttaaaaagctgcatcaaaaaaggatgtttcacagccctgttaaccagggtgggaacatcctttttttataaacatttagaatattgctcttgtgcagctaacatccgataactatgaaacccgttttcttccggtaaagagtgaaatgacgaacaataccagaaatatcacaaataatattttagcgattgtagcagctatggacacgacgataccaaaaaaacctaagatcccggcgatcacagcaaaaattaagaataaagcggaccattttagcatgttctgtatcctcctttagttgtatataatgtggcatactcacgctccgatagagcgtggttgcagatgacagtgacttctatagattattcgtggctgtgccatcgttatatggtgttttaaacggtgcgagagtccgtgaatcataacgtttggagcggagaagaagccagcttggacgttgtttcgtgtctgaatctaaagggtaactatgcagtaatcataaacatcatcgtgaaagacgaaagagaggttacgctatgttaacacaggtcagcatttttattattgctatcgcatttgcagttctcgttattttcctcatcaaaacgttaaaagcagcacaaggctctctggataaggtgactcaaaccttgcaggatgtacaaaaaacgatagatgaactgagttatgaagtaaaacaaacggttcgacatgcgaatgacatcaccgcagacgttgatcataaattgaagcaagtggagccagtgatggaatcggttagaaacttgggagaggtactcagcgaagtgacgctggctgccaagcaggcttcaacagcgttaatgacacggtttcagaaatcgcatagcgcggcgagtaatacctccagaacggatcacgcgatcaaggcaacgacaccgaatagacctttgaccgcaacggagcggacggttcagagctacaatgcgacttatgaggagcctgcggccaaatcggctaaaaactggttgggttatgtagacatcgctgctggggtgtggcagaaaatgcgtcagtagcatgcatagtggctgaatcgtaaactacaggaaattcattgaaagggtgagatttatgatgaagacgttattactagctgctggtttgctcactcccttttccggacaggatacggttcagcaaaccgtttccccgcaaacagcggggcatatggttaggactgtgcagacgatacccgctccacatgctgtaccagcagattttcataccttaaatggcatatcattggatgacacccgtgcggatgtgttgaagaagctaggcaagccacaacgagtcaaaaaggatatgctgctgctttctacagaataccaatatccagatgttgtcgtaggtatgcgtgaggacgtcgtttcttatgtgcatgtagatcctgctgctggtcgaatcaaggtaaatgataagtggctgccgctgcaacggaaaacgttggatcaggcgctgggtggctcgcaattcacagcggaagacggagaggtctatgtacgcggacaacgtgcaatcaaagtgtttatggatgagaattctgataaacctaagtatgttgagttttttgatgaaacggagtggtaatcgatttttttgaggcgtgacataacatggaagtttcaaatggatatgtgaagtgtaatagtcagagaagtcaatccttaaaggagcgtgagaaacatgaatcagaccaatcataaatcttatgccaaagtggtagataacggtgtacaagccgttgaagcagtaaatgagttgcgtaacacgggctatcgttatgaggatgtgttcgtgctcgctcatgatcaggatcggacagatcgtattgccgatacggtggatgtcaaggaaatcgggattaaggaagagggcgttttcgattcattagccaacttgttccgttcccgtggcgatgagcttcgcgctaaaattacttctttgggatttacagataccgaagctgacttttatgaaaaagaactggatcagggtaaagtgctggtcattgctaaaaaagcgtgatattgctgttcaccataaaagcagagtgacattagattcgaaaaagaggaagttgaccgcagcacaagtgtttcgcgggtcctccaaaaacatagataagganntccttatctatgtttttggaatgccttcttacggaaacactacttctaatcaacaagggtgttgccgtttaagtaggtatagtataatacatgagttacagataaggagaggccaatgagaattctaattgttgacgataacccgacgaatgtcattattattcgtgaaatactgaaaaaagaaaattatcgggatgtgatctctgctagctcggccgcagaaatgttggagcatctgggaatcggcgaccgtaccattagtcttcggccccgtccttccgatattgatctggtgctgctggatatgatgatgcctgaaatggacggcattgaagcttgcagtattgtgcaggaatatgagcatttaaaagatatcccgattattatggtaacggcggtaggagattccaaaaaattggccgaagctctagatgtgggagccgtcgattacgtcacgaagccgatcaacaaggtagagctcatggcgcgaatccggtctgccttgcgtctcaaacaggagaaggattggcataaggatcgggatcagcgaattcaggatgagttgaagctggccgcgatggtgcagcaggcggtgcttagtcctgccatccatgacccagtgctgcaagtgaatgcgctctatcagccttcctttgaactggcaggggatttatattcatggtatccgttaggggaggggcgatacgccatcattttgctcgatatgatggggcatggcatttcttcttctctgttttgcatgttcattgcgtctgtacttaaggatacggtgaccacatatgtggagccagagaaagtcatacaagagctgaatcgccgttttaatcaactggatctgggcaagcagctggtacagtattattttacggcgatttatatggtgattgatacccgttcacggcgaattgactatgtaaatgcgggacatcctcccggtttgctgtttaaccaggatggcagcattaccaaatttgaccgtgcatgtagcccggttggtttgtttgataagattgatgcagaaatgcacacgattcattatgaaggaactggacacatcgctttgtatacggatggtttgctggaggcggtggaaggtgaatatgaggagcagttggagtatctgactgggtgtctgcgtaagtatgaggaatggaatgaagaagcgatgctggatgcattttttcgtaatgaggtgccacaggatcgtgatgatgataagtgcctgatctggatttcattgaaagagggagagagcttgcatgaaaatcagaaataaactgctgatcggctttggatcgcttatggcaatcctccttgtgctgacgctaatcagctatgaccgtatggggagcctgaatgagcagctgaatcaggtttaccaggaccgatatatgaaggtccggaaaacaacggctattcgcggtcaggtgaatgatatggccaaagttatggccaacctgatcttgaatcctggctcctccgtcagcgaggccaaacgtgagcttgatgatatttctgctactggaacgaaagtgctggcaagtttgcaaacaaattcaggcactagtgaagagcagcagcaggttgatcgggtagccgtcgcctggaatgaatttctaagttacgaacaaaggttagtttccttactgggacaagatcgcattgatgaggctaacgctttccgcaatagtactggtttgcctgcacaagaggaggcaatggatagcattaatgcccttgccgtttttcaggatcgggagattgataacgacatgaagcaagccaatcaggcttatgaggaatctgtgcagattaccacaattttgatggccgccggtctgatcatgggcttactggttattttgtgggtgctcccaagcattgccaaaggtctaaatatcgttaatctcatgattaatggttttggcaagggaaaatacagggccattagccgaatgagtgtttcttccaaggatgaaatcggggaggtcgctcgtgtatttcaacaaatggccggagacttggaagaaaagcggagatttgagcattctgtccttcaaacgcagaaggatcaaacttggcttaatgccaatactgctcgagtaactgagctgttccgtggtgtgaattcactggagcaggttgctcagatgttcattagtgagtttacgcccatcttgggaggcagctatggagccatctatttgcaagggaaagatgtagaagacaacctttttaagttatacggttcctatgcaaaggtgactggcgaaaattcgattagggacgttatccttgtgggcgaaggcttgctcggacaatgtgttctggatcgtaagccgatcttgattacagaggctcctgacggatatttgtccataggctctgccttaggagaaagtaagcccgtgggaattatgatttttcctattttgttcgaggatgagtgtatcggtgctgtagaaatagcgtcactggatcgcttcagtgatctggaaaccaagctgtttgctcaattagtagagagcttggggatcattctgaacaatatcaagggacggatgcgtgtagagcaattgctgcgcgaatctcaggcacttactgaggaattgcaatgccaatccgaagaactacaaactcagcaagaggaactcaagcgctccaacgaaaatttggaggagcaaacagaagaactcaagcgttcagaggaattgttacaacgtcaacaagaagaattggagcattttaatactgaactgattgccaaaactagagcgctagaagaacaggttcgagaagtagaagaaaagaacgacgagatcgaacatgcacgagctcagttggagcaacaggcaatgcagctaggaattacaagcaaatacaaatccgagtttttggccaatatgtctcatgagctacgcactccgctaaatagcttgcttattctttctcagctcttgtctgagaacaaggaaggcaatctcaagccaaagcaagtggaatatgcacaaaccatttatatgtcaggcgccgatttgttgaaaatgattgatgaaattctggatttatccaaagtggacgctggaaaaatggatattaaccatgaagcggtccacttgaaggaactggaactgtttgtggagcagaattttgctccggttgcagcccaacgtgagcttcaactgcataccgaaatcgaagagaacctgccggatgccattatcagtgacggttatcgtctcaaacaaattttacgtaatttgctgtccaatgcgttcaagttcaccacggaaggttctattactttcaatgtatcccgggcaaacggagagcagcttcctggtctgctaaatccacgaagatcctatctggctctatctgtgcgtgatacgggcattgggattgcttccgataaaacggatctgatcttcgaagccttccaacaggtagacggtacaaccagccggaagtacggagggacaggactaggtctgtcgatcagccgcgagctttccagattgttgggcggcgttattacggtggaatccgagcagggacagggcagttgcttcacactgtatttgccggaacaaacgccaacggctgaggatatggattctcattcgagagaggaatttaacggtacggttgtgaattcggattttgagaatgtcgcagcctcggcagagacagatcttcccatgattatgcctgcaaaacggttgccattatatcagatgccttcgaaaaacaaagcggcggacattatacatccgggggatgaccgaaacgagattacctcgcaggataaagtgctgctgattattgaggatgatattaattttgctaatattttgtacgatatggcccgtagccggggctttaaggccctgatcgctctccaaggagacgatgggctcaacatggctcggtcttatttgccggacgctattatattagatattcaattacctgtgatggatggctggtccattttgggcgagctaaaaggaaattcatcgacacgtcatattccagtgcatgttatttcggtcatagatgatgtgaagcagggcttgatgatgggcgcgattgcctatctcaaaaagccatcttcgaaggaaagtctggataaggcattttcacatatcaaatcgtatacggaccagatggtcaaacgtcttcttgtggttgaagatgatgataatcagcgtaaatccattattgagctgatcgatcatgatgatgttgccattacggcggtatcgacaggtcaggaagcactaaatgagctggctacccagcggtatgactgcatggtactggatctgatgctgagcgatatgactggttttgaactgctggatcgtattcgagagaatgagcagctaactgatctgccgatcattatttatacaggcaaagatctggatagcaaagaagaaacgcaacttcgtaaatatgcagagtctattattattaaggatgttaaatcgccggaacggcttttggacgaaacaacgttgttcttgcatcgtgtagaggcgaaccttccagaggacaaacgcaaaattttgcagaagctatacaacaaggaagagctgtttgaaggtaaaaaaatattattggtagacgatgatattcgtaatgtatttgctctgtccagtgtgctggaaagctatcgtatggaggttacctttgcggaaaatggaagagaagcactggaactgctggaacagacacctgattttgatctggtgctgatggatatgatgatgccggaaatggatggatatgaagcgatgcgacgtatccggctaatgccacaattcgagaagatgcctattattgccctgacagccaaggccatgaaggatgatcgttccaagtgtattgaggcaggcgcttccgattatgtgaaaaaaccgattcaaaccgaacagcttttatcattaatgcgggtttggttgtattcgtaacccaaaaaaatgggtaatataaatcgacacatgattggagcggcataggcaaaacctatttaggaattggagagagattatgacatctaaggatatggcggataatgctgctaatgaagtgaaatcgaatgatactgagcgggaaatgattgagattgagctgttgctggaaggtatacatcggctgtacggctacgattttcgtaactatgctctgccttcgattaagcggcgtgtttattatcatgcgcagtccgagaatgtaagcacgatatcaggactacaggagaaggtgctgcatgatcgcagcgccttcgatagactggtacaaagcctttccattccggtgaccgagatgttccgtgacccggagctgtttctgaacttcaggcagaaaatcattcctattttacgaacgtatccgtacattcgaatctggcatgcaggttgttccactggtgaggaagtatattctatggcgatcttgctgcatgaagaaggcttatatgacaaggctcgcatttatgcgacggatatgaataacctgtctttacagcaggcgaaggaaggcgtatacgggatcgaccgaatgaagctgtataccaaaaattatttggagtccgggggcacacaatcgttctctgaatattatacagccaagtatgattcagtgatgtttcatccttttttacggaaaaatattatttttgcggagcacaacttggcgacagaccggtcttttaacgagtttaatgtgattttttgccggaatgtcatgatctactttaacgacgaacttcgcaaccatgtacatgggttgttttatgatagcttgagtcattttggtgtgttggtgcttggggccaaggaatccatacattttaccgattatagtgattcctacgagccgctggaccggatagaaaaaatataccggaagattaaatagagatgcttaggaggattccatggggcttcatgaaccgattcatatattgctggtagatgacagacctgagaacctgctcgctcttgaggcagtgctggagagtgaacaatataatctggtaaaagccacatccggggaagaagcgctgcgatgtctattaaaagatgaattcgcacttgtagtccttgatgtgcagatgccgggtatggatggaattgagactgcgaagttaatcaaggccagagagaaaacaaaggatattccgattatctttatttcagctaacagcaaggaagcggagcatttgtttgcgggatattcagctggtggtattgattatatggtgaagccgttcatccctcaaattctcaagtccaaaattgaaggcttcgtgcaaatgtatctgacaaacaaacgcttgaagacacagtccatgctgcttcaccacaagacgcaggagctcgagaagatgaacagcgaactgattgccgccaaggaggcagcagagattgctgccaatgccaaaacggaatttctggcaatgatgagccatgagatccgcacaccaatgaacggtgttattggcatgattgatctgctgatggagacagagctgcagaccgatcagcaggaatatgctgatatcatccgtcgtagcgcagacgcgctggtagcggtcattaatgatattctggactttaccaagctggagtcaggcaaaatggaggtagaggaatatccttttgatttggtttcctgtatcaaggaagttttcagcctgtttacagtagaagtcaaccgaaagaacttggagctggtttattttctcgatgaacagatgccaccggtgttatatggagatatggggcgattgcgacaagtgttgattaacctagtatccaatgccgtcaaatttacagaccggggcggggtatatgtcttcgcatctgtcaaagagcaaagcgacaatggacttaccgttgagttttctgtgaaggatacaggcattggcattgattcggctaaggtcggaaggctatttcagcccttttcccaactggattcttcaatgacgcgtaaatatggtggtaccgggttaggactcgccatttgtaaaaccttagtgaatatgatgggcggagatatccgtgtagatacgagcggagaacaaggcgtgacgtttcattttacaatgaagcttggctttgctaaggaaaatgaactggagggggagtccagccacgattgggaaattccacatcaggagtctccaagtcgtaaacctgtactggtggtggatgaccatccgatcaaccagaagctaatggttaatatactggataagctcggtttagcttcagatgtggcagcagatgggcaacaggcgcttgatatggtcatggcgaatcaggactatgactatatctttatggacttgcaaatgcctgtgatggacggtctggagtgtacgggtagagtgcgtgaacaattggcgggaagatcccaacctgccattatcgccatgacggctaacgtcatggagggtattcagcctcgatgtattgaagctgggatgaacgattatattagtaagcccgttaaaatcagcagtgtaaaacaggcgttgctacggcattctccggaccattttccaatgcagccgggtaaaaatcaaatcaatgaagcctagatggtggcatttggtagtgtttaaaaagttataccgtgattcaaacgctcgtataatgggttagtatgtagggaaatcttttttcgggagagtaggcctatgaatacaaataaaaatgagaaatttaatgcaattacagaaacaaccgatggcgtaaataccgtttatctgagtggagagttggatctttcggtagcacctgattttcgtctggtgatggagcctttggtgggggagtccagccaagatttgattattaacttgagagaccttaaatacattgacagcacgggtattggtatcttgttatccattttaaaagcaaggcatgggatggaatctcgctttgctgtccaagaggtaccgcctcaaattcaaaagctgtttgatatgaccggtattgccaaattctttgtcccccaggagaattcccaataggaaaggaaagaaaaagaaatgaatgctcaaattcaaaaagtagttcttaatttgccggcaactgctgactttgttgatattgtaagattaaatttatacggtattgccgcgaaaatgggattctcttatgaggatattgaagacatgaaagtggctgtatcggaagcctgtaataactctgtcctttatgcatatggtcatgaggggggagtcgtggaagtgacatttgaatttgatgaagcttcgttgtccattcgtgtcaaagatgaaggggagagctttgaacgtgtggaggacccgtcccgtatcgcatccttgcatgacaaggagttgaatgatgcgcagataggcggattaggcttttatctcatgcaggcgcttatggacgatgtccatatcttgaatgagacaggaaaaggcaccgaagtggtgctggtaaagcgcctaaccagaagtgaggaaagagtatgaatgaaaaggtaactcccccggagtcgatggatgaagccgttggtctaatctgggagtaccagcaaaccaaagataacgagattgctaccgtgctgatccgcaagtatgagccgatggtcaagatggctgccgggaagatctcccgtaaccgtccggacttatacgaggatttatatcagaccggtcagatggctttgatacgtctgcttcagcaatacgatatcagcttgggtatcccatttgaaccgtacgctatgaaaagtatgttgggacatatgaaaaattatttgcgcgacaaatcctggtacatccaggttcctcgccgtattaaggaaaagggtgcgcttgttcaacatgctattgatgaactgaccgttaaattggaacgttcccccaatgtggatgagattgcgacctatttggatcttaccgtggaagaaacgattgaggtgcttgcaggccgtgagtgctatcactatgtttcactggactcgcctttatcccaggaagagagtgcagctacgttaggcgagctcattagctcggatgctaacgattatgacactgtggaaaaacgaatggatttgcagcaggctttaagccaactgaaggagcaggaacaaaaggtgcttcttctggcatttcaggacggtcaatctcaacgtgcgattgcacagacgttgggcgtatcgcagatgagcgtttcccgtattcagaagcgggcaacagaaaagctgaagcagattatgtctaattcctctatttcatgagaagaccgcggaattcttggcttaacatatttggcgtcacatcgtaaggacacgttattccgatatgggaagcgtgtcctttttataaagcgaaaaaggttgggaggaaggttggaatccatgacagcatttgaacagatttcttcctttcgtggaggatgggaatggtgggacatcagtgctgggaattggcaagattcggtcatacagcacttgaaggagaagctcccagaagccgcggaatggctggacaaggtagaggacagtccatccagctttatatctgtgcgctttccagatggcaatcagcccttaatgtacgggtcgttgatttactccgttcaggaggagatcgacagtcagcgtaattgcaacaagttttattttctggttctaaaccaaaagttagtgacgttaaatctggatcaaaatacccgtgaaatcatgcacaccgcggaacgccaaaaaatgctggaacagtgtgaggatgcagctgacggcatgtttgtattggcgagagccgtgcttcattattttcatacaggtatggataagttcgagatcaacctgagaagactggaagaggagatggagaaaaggaatgcccgtacgctgatggattctatattgaatgcacgtttcgagctgttgtattggagcaatatgttcattcctttttcagagctggtgacggcttctcgggaggcatatctggatcaactggaggagaatcgtttttttaagcagttactttaccgtgttactcggatggaaggacttttcctgcattatgaaaaggaaatcgacacattgatctccattgacgacgccatttccgcatttagggggaatgagattacgaagacgctgaccattgtcaccgccgtatttacaccagcaaccgtagtgggcgctatatggggcatgaactttgaaaatctgccttggattaaaacaggctggggttttaccaccgtgattattgccacattgctaagtatggcgggaatgtacggctggctgatgatgaaggggtggacaggagacttattgaaggctaacaagcgcaacaaattgtagcggctgattacagctgttacaatttacaaataaaaaatgatccatcgtaactggaggctctttgaggagtctattaccggttacgatggatcgtttttaaatgagatagggacaattacttagtaccttggctcattttgatatatcctaataattcggcgatgaaatctccgatgaccggaagatttaattgcaccaggaaactgagcaaccaagcgagcaaggcgagtatgaccactgtacccagcgtaagaccgagaccacgtgcaatgcctgcggtcagattgctcataattcttcttttagtgctggagtagttctccagaatatctttgaattctgctctttcgagcgtatctgctatttgatctaagcgtttgttaagccgcttgacctcatggcgcaactcaaaaggatgctcatttacatcaaagtccctctcctgatcatgtgttttaacatgattatgagtagaagaagtctgcttggatgaaacttcatctggctgatcttgagcctgtaggggatgaaaggttcttttgttgttcgcggtaagatcatctccataggaatttggcttgttcatcgtcatcccagcctttctatcatttaaaaacagccagcttcttgcatgctggctgttcagtgtagggcttatttttttgccatcagaatgtgtagctattaggaatttgcattcaattgtttttgcgtatccttggccgcttgagccgttgcatccataacttctttatccgctttggctgcttcattagcgacatctgcagaagccttggttacgctggatacgatattgtctttgctctcggataccgttttggctacatctgctgttttggtggaaacggttttggccaaatctgtcgctttgctgctcactacagatgccacgtcctttgttttatcggagacaactgtaattttatcagacagatcactacgcaaatcacgacccggcttcggcgcgaacagcagggctgcggcagcaccaatcaaacctccaataaataaaccttttgcaaaacctgaagtacttgccatattttgattgtcaatgttactcatgttatatcactcctcttatagaattaaagaataaaaaatatatataaatgttaggtagcccttcttaatagcctggacaccagtccgagcaagaacacgaacaatgcggttccgagtatggctggaatgactgcaaaatcaccgatgaccgggccccagtctcccaatagcatgacacctagccaagctcctacaaatccagcaatcatagagcccgcaatgccgccaggcatttcatgaccagccagtgcatcgccaatcaatccgataataatagccattacaatacttagtacaattccccacacaaggatcgcctcccttatcctaagttcacaaaaccataacgtttttgatgaaggctgagcttcgatattgctgagccttgcttacttcgtatataaacgtcgtgacccggagtgaaacaaaaagccgactcagacatttaccggtggggagtggaaggaagcttcatgcgcgctcgccaatagatcacaggaacggtaaacaccagccaaattatacctgcaatatagccacccacaatatctgtaggaaagtgaacgcctagatatacgcggcttaatccaatcaagagaatcagtagtgcacccagagcgcacggaagaaagagcgaacgcccacgaatctttcgttctatggcccaaatggcaaataccattccgaaaaatcccatggaaatcatcgcatgaccgctgggaaaactataacccccggcttcaaccaaatgttgaagtgacgggcgttcccgttgcaaaatttccttaatgagcgtattcagcacccacatcgccgtaaagctgcttaggatcgcaaaggaataagcttttgaacgaagactgacccaacacaaggtagcagcaccgagggcgatgatcaacgacatgcggaatgaaccgaaagatgtaatgaatatagcgatagttagcagttggtaacgagcagctgctgtgtctggaaaaacggcatcctgtatgcgttcatcccaatatagaaaaggagctgtgcccatccacttcacagagtaggcgatgagaagcaacacagcgatcatgataatagatgcatacagactacgacgcaaatagcttggtaggaaccgggatggttggggttcatgagatagcatatgtaataaatctcctccttatggctgtgatagattcaatttttcgtactattaacttaactaataatgaacttaagagcaaaacccgacggagacgacaggctgattgaggcatataagcccggggtaaagggatcgtatcacagcgtttgtaatgccagggccggaagtggaatagtcatcacgaagcaaagctgctttacggaactgtaatccatggaggtgttaaggatgattaaaatagtgacatcggcagaaagacatacctcaaataaaggatggattcatagtgagtttagcttttcgtttgccgattatgaagatccgagcaatgcccattttggctgtatgctagcccataatgataacgagcttgaaccgcagcaaggcttcaaaagacatccgcatcacgatttggaaatcgtcacctatgtaattgaaggccaattgcatcatagcgacagcttaggacatgagcaggatttggaaagcggctcgatccaggttctgagtgcaggcaccggaattgaacatgaagagcgaaatactggggatgaaagaccggttcgttttttgcaaatgtggtttttacccgagagtcctggcattcagccttcttatcaggtgcaaagattcaagcacagtgaacgtctaaatcggcttcagcctgttgtgtctggttcagaagtggagggagcgttatccatcgcgcaggatataaatctgtatctgagcagattggaaaaaggacagcagcttgaatatccgcagcaagaggagcgccgcacccacatctatgtagttaacggtcatgtggaagttacgtgccaggatggggattttcagttagggcctggcgatgccgcgcgaattcaaaaaagctgtacattaaagatacgagctacaggcaatgaggatatatctgaattggtgttagcggatttgccttgaagcatccttgagtgagtgaagaagtgtatggaaatgcgtatatgcaatcgaaaaaataaagctcgtatcccgttgcacgtctgttgagacgagcgggaatacgagctttatttacgctgacagggccatcatgaaggctgttgttcatgatgataggttgtaatacagctaagctgtattcctataagctaattcaggaggacttacgcaatctacccagttcagaaacaatagcttcaacctctgaaatgctcaggttaggcttgcttatcaccatatcatagacatcatggatgtcctcgtattgctccagcgagaaagcggatgcctgcatagcagcaccactcgccatacggagcttggttttaataccctcaatcatatactcaatgttggcatgagacggtacagacaaatccatcgttaattttccatcctttcataacaggggaagttgcctgtattgtatcatgtttttgttgtagaatgtactgaaagccagattaccgatatacaaccgaatcaaggaggatggacaaagttgtctttgtataatcgagcttccgcacctggtcgctcgtccttagaacataatgtaaagaaaacagatcgagatggacttgcgccgtttttccgagaaattcatcatcagcatgctatagataagttgacttttgtttgcatcggtacagatcgctcctcgggtgattcactcgggccactggtaggcaccatgctcaaggagcaaggctttccgcacgtgattggcacaatgacggagccctgtgatgcagatcatctggtttcatacttggagtgcattccccaagatcatcatgtgatcgccatagatgcttgtcttggacagcacggctcaacgggaatgtttcttattgcgcgtgaaccgctaactcctgcgcgatcggtggggctgtctctgccgtctgttggtcattatagtgttgcagcgattgtgaatgagcgcagtcccaagccctattggacactccaaatgacgtcgcttcacttggtcatgaccatggctgcgcatattgctaatgcggcggcttatgaatttggtttaaaaacagcttcgcaagattttccagagggttaccgtttcagatattgatggtctgcttaataatatacatcagcatgttctactcactaatatattcagatccaatagattatatacagagaaggaagggttccacatggaaaaggtattatgcgaaggaacgacgatctgctatgccgaacagggaaaaggagatccgatcattctattgcacggattttgcggaagctcttcctactgggatgaggttgttcccttgctatcccaaagctatcgttgtattgttccagacttgcgtggacacggacgcagcgatgctccactaggagcctatactattgatcaaatggcagatgatgtgcttaaacttcaagaacaattggacattcctcaggctgcctggtttggtcactccctaggaggctatcttgccctttcggcagtgcagagacatgcagaacgcctgacagcctttggactgattcattccacagcatatgcagatacggatgaaggtaaagaaaagcggaataaggctgtatccaccatccaaacggaggggattacgacctttgtagatggactcgtaccgggactgtttgctcctgatcatgtggagtcaatgtctagccaattacttaaagtcaaagaaattggctacaaaacaccaccacaaggagccgtaggagcatcactggctatgcgcgagcgtactgatcgtcgggatgtattgtcggcttctgcattgccagcccttttagtagcgggggagcaggatcaggcggttcctccagcgcggacgtttacaacagatcgggccggagtaactcaggttagcctaccggaagtaggtcacatgagcttgttcgaggcaccggagttattagcgaacaccatcttgacatttttagagcaaaacttgaaaaagtagactgaggtaagcccaaaaaccggaacaattctgatgtgataattagaaggttctggtttttgggtagtcaattatttttaggtgtgtaaggtgtctaatttatattgcttttgttaaaggcaaacgctgtcggcaaaccgtcaatactctccagatttttctcataggcatattttttaagtgcttcttctcccatctgaatcgagacttccttcagcttttcccgttcgctcgtgtatgtcataaagggaaccgcaaaaccacatgaattctgcaccatatgaacgtccacaacaatgatttgtcttgcaccgggaagcgggttgaagagagggtacagttcattccattgcttagtatcgggcagtgcgacggtaccagtaccatagagctttagtacactgggagcgccctcaaatgcacaaaacatgattgttacccgtccgttctcgataatgtgggcgcttgtctcgttgccgcttcccgccaagtcgagataggctaccctttggtccgatagaatacgaaaggaatcatatcccttgggggaaaggttaacgtgccctgtcttggatagcggtgctgatcctacaaagaaaatgtgctgccgctgtataaacttttgatgttccggtaatatcgagctaaattgtttacccaaactccatcatcctttctcacaaaaatattcatataaattttgtttctaaagaaattaattattataaataattttatggaatgattaaatatactgattattttttgtttcgtatgaaacaaaaatatcacaacactaacgaagaagcaatattgatttaaaaaaaacgtcattcgctagtcacatgatcagctataaagtactgtaccgtaggaattcactgccatacgtgagcattctgacttcctgatcattgatgttattaactgagggtgaaggttataagtggtatttctgcatggtagggcatttggcttttagacaaggatgtcatacaatcagaagacagagtttctggttgtctaggcatcgggatgaaaggaagggaacggcttgcttagaaaagattatttgctcagtatgatggaagaattgacatccgcagtagcatcggtgctcggtctaaggcgtgaaaataaacatgtcgaagcgctaaaacagttagatgatctgctcaacaagcagtttcgtcttcgttcagatctgctcagacgattaccgccggaacaaattattgagcttttccgattgggccctggaattgaagcagacaagatccagcaggtggctcgcattttagaggaagaagccgtgatttacctggaaaccagtagaacagacgagagcatacgaatcttgatgaaatctcttcatttatatttgtacagcgatacgaatggcgcgactcgtgatctgcaggtcctgcctgaacgaatagcgtgtatcgtaaaactggtgcgtgaatatgagcttccctctgaaaccagcaaactgttggctgttcattacgagcgagaaaacaggctggacgaagccgccgatgtctggtttggattggcatgggagcagccagagcttctatccgaagcggaggcgttttacagtcacttactggataagaccaatgcagagctggagctgggtggaatttcacgccaggaagtcaccgagggtttgaccgagatcacccaattacatgaaagaaagtgagatgtaccttttggattcactgcgcgaacttatataccaattgactacgggaggatccctcataacagcgacgctgagtcagcttcgcaaacgggaggatgcttcttttactaaagtacaaatcaaaccagtggaattgaaaaacaagctgcattaccagtttgcttttcattacagcaacaaagtcattcatgaaaatctgacccctgacgaagctaatgagcgaatgactgccttgtttgaggacacgttccgccaaggacttctatgcgccaaggatgcagactaccaagtgctgatcagtaaaaaatataaagtatccattctgacaaagtcaccgagcaaaagtaaagccgacctgtctcataatcgcaaaaagcaatatgtgctcgaagaaggggagcgaattcctttcctgattgagcttgggattatgaatgaggacggtaaggtactggcccgcaagtatgataagtttcgtcaaattaaccggtttctcgaaatggtgcaggatgtattgcccagccttccggtaggccgcccattgacgattgtggattttggctgtggcaaatcgtatttgacctttgcgctgtatcactatttggctgtacagcaaaagcgaccattgcagatcgttggtttggacttgaaggcagatgtcattgaaacctgtaatgttctggctcaaaagctgcaatatcgacagttggagtttctggtcggtgatatcgcagactataacgaactggaacaggtggatatggttgttaccttgcacgcttgtgatacagcaacagatgcggcgctggaaaaggccgtccgctggggagcatccgttattttgtcggttccgtgttgccagcatgagctgttcagccaactagaaaatccagtattggagcctttgctttcccacggtattttaaaggagcgtttttctgcactggcaacggatggaatccgggccaaactgctggatatgatgggatatcggacacagctattggaatttatcgacatggagcatacacctaaaaatattctgattcgtgccgtcaaagggcaggcgggagaacaatccgttttgtggcgtgaatacacagcatttcgggattttattcatgctgatccttatttggaacgcgcttgtgcggatttgcttcccgaaggagcggggaagaagcagacacatagctaggaatatagtaaaagtggagccactgcggggtggctccacttttttgtagtttacagttcatggttgcagtacgccaatatctatccgccataggcgcttctaaaagcggtgcacaagacatcgcgatccaccttccacaatgccgcgagctcctcgctgacatcttcgtcccaccagtcgcatagtagtttgcgattactatggttttccgcaatccagataaggtgtccgacgaccttgcggcagtatagctcctcgccctgcttgaccagatcaggagcaatgtgaacaggcagacgtttgcaggttcgatacaactctttggtacatgcgcggcggataccacgagccgtgggtaaacgggattgtgaattgtcatgtttggggaatttgccgggaggcatattgtaccccctcctctctctcccaacttatgcgggcagaggagccggggtcactgacctccctatttggtcgaagtggcgacttgttctgccgctgtgatacactaatgaaaatagagaaacaggcagggagtgggaagagaattggaccaaatatctagtatcattaattatttgtttgagatcattcgtagtcttgggtattttggtattatgctaggcttgatggttgaggtcattccaagcgaaattgtcctcgcttatggtggctttttagtatcctcgggtcatattaatttttttggcgcagtcgtttttggaacgattggcggggttctggcccagttgttcatttactggattggacgctatggcggcagaccggtattagataagtacgggaaatacatacttatcaaaaaaagtcatgtcgaccatgctgaagcctggtttaacaaatacggcacaggggtcattttcacagctcgctttattcctgttgtgcgtcatgccatctcaatccctgccgggttggctcgaatgaacgtatggcgctttattattttgacgacgctagcgattataccttggtctgttttgtttatatatttaggtatgctgctaggagacaagtgggagcaaattgacgaagtggcagcaccttacatcaaaccgattttgctggttgcccttgcgctcttgatcatttattttgttatcaaatggattttgtccaaaaacaaaaaaggaagtgtataacatgagccgtactaatgtatcgcaatacttcggaaagggcttaagccctgaacagtttatggagggcatggaaaagaacaaagaagccttccgctctgggtacgatcagtttgtgtggaatcgcgaagaggatcgagagtattttgaaagcctgaaccatcgggatgatctgcgcgtgcttattttggctgccgactggtgtggggatgtggtacgcaatgtgccagttgtgttccgtgcactggagaatagcgggattccgaccgaagtattaatcttggaaaaccatcaggcgctgatggatgacttcctgacaatgggcggacgtgctgtaccgattgtgatttttgcggatacaggaggtcacgtacttggccactggggaccacgccctgcacatgtccaacaaattatgatcgaattcaaacgtgaaaatccagatcgggaagccgatgattatcaagaaaaaatcgcagttgctcgtaaagaaatggctgaaaaatatggggagggaaccgaggtccatcctgtgattgttcaggaattacgtgagctgatctcgggattttaacttatggcgctatctattcgcagctttaatctcggtccacttcagacgaacgcttatttgcttcaaggggatgatccacagcgcgccattattattgatccaggaatgaatccgggtcctttgctgagggcgattgagtctctgactattgaagctatcctgctgacccatgcccattttgaccatattggaggggtggaggagattcgcaatgccaaaggatgtccggtgtatttgcacaccttggagcaagactggctcacatctcctaagctgaatggctccttgatgtggccagaggcatctccaccaatctcaaccggtcctgccgaatacgatttggcggaaggtcaacaattgaacctgatcgggcacacgttcaaggtgttccatacaccgggccattcacccggaagtgtcagctttttgtgtggcaaagatcttttttccggggatgtgctattccgtcagggcgttggacgcacggatctgacgggtgggcgggaacgggatctatacgattctattcaaaacaaattgttcccgctcggagatgacgttacagtctattccggtcacggtcccaaaacgtccatcggttatgagaaagctaacaatccgtatatccggtaaatgtgatgaaactttcaggaggggcaaaatcaaaggtgtgacaagttttgccccatttcgacaacaaattataaattacgtatagacaaaggtttttatttttgttaacataaatttattaaagttacatactaaactcgcgaagcacgcaagctgtggatgaatcccggtttgcgttcttttttttgcccattaagaggataaacaggcatgaggccgtcagatcacaagggggagcaagaatgaaaagaaaacatatatatggggtacaacgtgagattggaggtagtttccgtgttcccaatataatagatattgaagattctgtggtaggttccgaaccgaagatcataacttggaaaaaggtgagacgacagggcggaatcccctcacaaaactggcatgtgaggctgaatgaacacaggttgggacgtggagacggtcgattatgaagatacatagatgatatagacaagctactttttttttagtagacttagcagataagttcagacaaacgggggggctaacgatgcatcatttaggagctagaattatgatcgtcgcggatgcttttgagcagaatcttcctgtgggcgaacatggttatatcattgcttacgaccgtaatgcggacaatgcttttgactatgtcattcgcgtaccgaaggtgaaccgcaatttttttgtaccatccggggacatcgagctggaggagagtattctcaagctagaagccgagcggattgagcgtgaagcgctgatagattatgcccttgctactcataatgagcaactgttcaagcatgtaatgaacggtggtcttgattcggtagagactgaagaagaagaaaccgcggcagagttgttgtcacaggctgattttatcagacaagtcaatttgcgtgcttggatatagggggtcggctactgccgactctttttaaaaatatataatgggcacaatctcagctcttatagttatctcgaaagagcaccgagaggtgctttttttatattcttttagcaacatttccctcattggtgtacagtttgcttctgtaccgcgtcaaagattgaattgtaaagggttctatcctataattaaaaacgttatttcaaagttcggtgcagcattttttaatatcaggattttgcaaaattcgattccagtcgcttattggactttttgcaaaatcctcatatacatgaggagggttttgtatgaacatttccacggaagatgtccgtcacgtagccaagctgtctaggttgaatctgaccgcggctgaagaagaaacgatgacaggacaattaaacgccattctccattatgcggagaagctgaatgagctggatacggagcaggtaaaaccgaccactcatgtgctgcacgtcagcaatgtcatgcgagacgacgaagttcgtgaaagtttgacacatgagcaagtgatgcgcaatgcacctgaagaagaagacggacagtttaaggttcctgctgttctggaatagatctcatatttgaaaggaggatgcaaattgagcttgttcaataacacattgcccgagatacataacaagctgcatcaaaaggaaatttccgtgagtgatctggtgggacacgctctggagacaattggtgcgcgggaagacaagatcagagcttatattaccgttgacgaggaacaggcccgtgcatccgcacgtcagctggatgatcagctgatttccggagaggaaagaggattgttgtttggtctgccggttggtattaaggataatattgtgacagaagggctgcgtacaacatgtggcagtcagtttttgaaaaattttgatcctgtttacgatgccacagttgttagcaagttgcgcgcagcgcaaactgtgacactcggtaaaatgaacatggacgaattcgccatgggcggctctaacgagaactccagctttttccctgcacgtaacccttgggatttagaacgtgttcccggcggttccagtggcggctcggctgcggctgttgcagcgggggaggcttatttcacgctcggttcggatacaggtggttccattcgccagcccgcttcttactgcggtgtagttggcctgaaaccaacctatggtctagtatcccgttttggactggtggcttttgcctcctctttagaccaaattggacctattactaaaaatgttcaggattcggcctatgtcctacaagctattgcaggttatgaccagaaggactccacttctgcaaaggtagacattcctgattatttgaacgctttaaccggggatgtaaaaggacttcgtatcgctgtgcctaaagagtatcttggtgagggcgtagatccacaggtcaaggaaaaggtgctcgacgcactgaaaatgctggaaggattgggcgcggtatgggaagaggtatctcttccgcacacggaatatgcggtagcgacttactacctgttggcttcatccgaagcgtcgtccaatctggcccgctttgacggcgtacgctatggtgtgcgttctgacaatccggacaacctgcttgatctttaccatcagtcccgtacgcagggttttggtcccgaggtgaagcgtcggattatgctgggtacctatgcactcagctccgggtactacgatgcttattatttgaaagctcaaaaagtgcgcacactgattaaacaggattttgatcgtgtgtttgaacaatatgatgtgattatcggacctactgcaccgacaactgctttcaaaatcggctcacaagtggatgatccattgacaatgtatttgaacgacattttgacgattccggtgagcttggctggcgtgccagccatcagcattccttgtggtcttgcagatggaatgccagtcggactacaaattatcggaaaagcctttgacgagtcttccgtgctacgcgtagctcatgcttttgaacaaaataccgaatttcacaagcagcgtccgcagctgtaatttgctaaaaaggagggaacctattcatgtctacaactacatccaaatatgagacggtcatcggacttgaagtgcacgtggaattgcatacgaagtctaaaatattttgtggatgctcgacatcctttggagcaccacccaactctcatacatgtccggtctgtctcggtcatccaggggtattgccggtattgaaccgtcaggccgttgattatgcaatgaaagcagcaatggcgctgaattgcaccattgctgatgtgagcaagtttgaccgtaagaactatttttaccccgattcacctaaggcttaccaaatctcacaatatgatcaacccattggcgaaaatggctggattgatattgaagtgaatggtgagacaaagcgtatcggtattactcgactgcatctggaagaggacgcagggaaattaacacatgttgatggtggctacgcatctttggtcgactttaatcgggtcggcacaccattggtcgagatcgtttcggagccggaaatatcttcgccggaagaagccaaggcctatctggaaaaaatacgtgccattatgcagtattgtgacgtatccgatgtgaagatggaggaaggatcacttcgctgcgacgcgaatatcagtcttcgtccgcatggacaaaaagagctgggaactaaagcggaactgaaaaacatgaactccttccgtggagtacagcgcggactggaatatgagcagttccggcaggagcagacgctggacgaaggcggaacgatagtacaggagacacgtcgttgggatgaggcgcaaggtaaaaccttatccatgcgtggtaaggaacaggcccatgactatcgttatttcccagacccggatctggttacactgcatatagatgaggaatggaaagaacgcatccgtgcttcgattcctgaattgcctgaccagcgtaaagcacgctacacttcggaatatggattacctgagtatgatgcgcaggtgattacgtcctccaagccattggccgatttgttcgaggatagccttcaattcaccaaggatgccaaagcagtatccaactggattatgggggatctactcggctatttgaatagtgccggtgtagagctgtcgcaggttaaattgaccggtcggggcttgggcgaaatgatcggactgctggagaagggaacgatcaatagcaaaatcgccaaaacggtcttcaaggaaatgctggaaagtgataaactgccacagcaaattgttgaagaaaaagggcttgtacagatcagtgatgagggtgcaatcttgaccattgtcgaacaagttgtagcagctaacccgcaatcggtcgaagattacaaagccggcaagcaaaaggccatcggcttcctagtcggtcaagtgatgaaggagagcaagggaaaggcaaaccctggccttgctaataagttgctgacggaagtgctgaaccgctaatggcatagatttgacagggggcttgtcttttagggacaggccccttttgcatagacgctgagaacgattggcgcgaacaaactttaaaatcctgatggcattttatgagtttccttaggagggaaaacagcatggttaccctatgttcattggaagatgatgatatcgtcagtcagatatggcgtctacagcacgctgcctataggctggaagctgagctgattgggtttgatgagattcctccactgatggatacattggatacgctgagaagctgtggagagtctttttatgggtggctggaggaaggtgaattgctaggggcactggctgtgcagtctgagtcgcccgattcgcttacccttacacgtatgatggttcacccagatcattttcgaaaaggcattgcagactcattaatgaagcatgttttgaatgaatatcaaaatatcccgttgtttatcgtctctacaggaactttaaatactcctgcggtgacattgtatcgaaaacatggctttcgctccgtatctgcggccgaggtcgccccaggcgtggaattaaccacctaccatctgcataagttggaatagcattgagatatcattaaattggcattaaaaatgcacataagcccacaaaccgcgcacccggagtgggaagcacgacataaccgggaggagtgacttgaatggataatccgtggattatagacgattcacatatcattttacggcttttgctgtccatgcttctcggtggattcattggctttgaacgcgaacgttccaatcacgcagctggtttgaggactcatattatggtcagtcttggttcgacgctgattatgctactctccatttacggctttgccgattttattaaagaagctaatgtacgcatagatcccgctcgtttggctacggcggtaatcactggcgtaggctttttgggtgcagggacgattatgttcacaggtaaatccattaccggactaacgactgcggcttccatttgggtcgtggctgccattggtcttggggtcggagcaggcttttatttcccgtctattgcggcaacggtgctcgtgtttttaaatttatgggtatttaacaaagtcgaactccgatatatgcgtggacgcaagcgtcatcttattacattgtacggattgtcgtctcacggattgctggagcagatttcgacttatttagagcaagaaaaagtggaaatacgtaaaataatgattaaagaacatgaaaatgtcccatttcacgaattacatccagatcggcagagtatggaggtttccctagaggtgctgtcccgtcatgattttaatcccgtacgtattgcagctgatttacgacaatgggaagatatagctgcagtttcagttgagtaatagtctacctttttttaacagttactcttaaatccgattggggtactatgtaagcattgaagtatttttcagcggagccacgcatgggattcaaaggggaggatggcatgaactcggaacaaccgttaccgtctggagaggctgggcagctacaagcgccggaacagcgggaacaacccagacaggggaagcgtctaaaatacgctaaatttcgcaaagtgattgccattatcatggccgcattgttacccggactgggacatctttttttagggctgtttattagggggcttagttttattgtgttgctcctgctagatatttttgcgatgctgtatgtttcttctgatggcttgaggattaacatcccattacttattttgcttggattgttcatacccgttttatatttttataatgtatatgatgtattacagtcagcagattacatggttcgttatcggcgtaagccagatcgttatgcacgaatggatgctaaaggccagcaaagtagtcctttttatgcatgggagagaggctttgcttttgctgtgctgatggtggcaggcggtgggcttatgattttgttttgcatgaaacctcgctggttgagcaatttctttgaggattatggattcctgacgctggccattttattaatgatgatcggtttatccctttttctaagggaagcctttctgtcctttaagcgtaaaaagttgaaagaaagagggtgaagctggcgtgcaccgtaaaataagagtcggtcgctacacctcttcgcttctgttgatggctgtaggcattttgcttattgtagatgtgtttcaaaatactgaatatatgcttcagctcctcgtttggtggcccgtaatcttcgtgctttggggactggaatatctgattttttttgctgtgtactatcggaaagaaggcaagtctgacaacggaaggcgattcaggcctgacctaaaggggattctgtccgctttggtagtggcagcctcggtttttatcgtgacccagcaaaatcattatatgtatctgtggaaccgggtcagtctcaatctgacgtcagcctctatggattttagtcaggctaaagagaatcggtatgatatgggtggtgtactggtacctgtaactatgcagacgtccgatttagtagttgattcggttaatggtgatgtaacactaatcagacggcctgtgtccaatatagaggtacgagggactctatgggtggatcaagcgcctgctgccgaagcggacaagattgctcaagcttcttcactgacttctaccgacggcaagactatcatgattcgtccagaggcaaagtcgtacggagcatcaagcaaacgtcagccccgtgtgaatatgctgatcaccgtgccggaggaccggcggttcaatgtgcaaattagaacctccaacgggaatatttccttgaatggagttgatgctattgacagcattcggctcgagagcggtaatggaaatctcactgttaatgacgctatcggcaatgtcaagggaggcacgttgaacggtcaggttaaattgcatcgaatttctggagatgtggatgtgcgcacgaaccgtggcgacatgcaagcaggcgatattgaaggaactgtgacactgcacaccatggtaggtgatattcagctcgctcgttcggaaggggacatcaccgtagatactcagaatggtgacatgaatgtgctgaattctacagccaagctgaatgcaaattcgcttaatggctctatcaaagtgcatagcgagcagataggcggagattggaaaatatacagtgctgtcggtgatatcgtattggatcttccgtcgaatggagattttcagttagaaggttcaagcagttatggtaatcttcaatccgattttccatttaaaatagacagtaaaagtatttcaggccaaaacgggacaggcaagtatgcgatcaacgtagagggcaacagtaatttaaccattaaaaagttactgatgccgtcgttacccgacttggatgattccgggggtacgactgcgcccgatacatctgaaagctctccggctgaacccggagctcctgagtcagatacctctataggaacatccggcgacaatacggcgcgttgacaagaaacttgagtagaccgtacaatgtgagtaggtttagaagtaagttgtaaatagatgcgtggtaattgataggatcgtaagtaagggataaggcggtggacatatatggcggcacgcgtccagcatgctttggaacttctgaagaagacaggtgtacgcataacaccccagcgtcatgccatattaaactatttaatggaaactatggggcacccgactgcagatgaaatatatcgagcgcttgagtccaagtttccaagtatgagtgtggctacggtttataataacttaaagatgtttatagaagcgggtatggtacatgagttgacctatggagataacgccagtcgttatgatgccaatatttcggagcactatcacatcatttgcgaaaaatgcggaaaaattgaagatttcagttatccctatttggctgatgtggaacgccatgccgcgttggaaacaggcttcgaggtgcatggacatcgtatggagttacacggagtatgcaaagcttgtagtaacaaacaaacgtaacgaaacaaggaatagaagttttttgtgcggtatgtatatattgtaatggatattggaaacgtgaggaattccccataagcggggatttaccgcgtttttttatttaaatcactttatttttgtaattcaaagtttatacaatggaggttcaatattggccagaaatcattccagacgccgccgtaaacgttcacgattcaaaggagcggcaagcctgctattatttgcagcgattatatgcgcaattactgtcgtatggtttggtaatccccttcacgagaaacccgattggcagggcagtgtccgtcctatttttatgcagggcaagttgactgggtatgaagctcaaagctcgggcaagaacatgctgatgccgcttaaattggtgcaaagtcaaattgatcctacagttcgctatgaggatgatagccaaaccgtcattatggcgacgagacaaagcctgctctatatgaaggtttcgaaggcacaaggggaactgaatggtaagacatatgcgctgagcgtagcccctcaggtgatcagtggagaggtatatatcccgatagaggctgtacgtgaagtatacggcgtttctatacacgaagaccctgtaactggtgctgtcatcctaatgaaagctggagagaaggtcaggctggggagtgtagaaaagaaggatggcccacaggatgctagaattgccttacgtaaagaagcctccagcctatctttcattttgacagatatatctcagcggacgaaggtacgtatttggtccaaacaaggagattggtattttgttcaattagacaatggctatgcgggatacattaagtcagaccatatcgctgaaggagaagagcttgtgatcccttcggttaaagacgatttgtccatctcggaaaaacattgggagggtaggccagtaaacctcgcttgggaagctgtctataatcgcaagcccgatccttccaagtttgatcctatgcctggagtaaatgtggtgagtcctacgtggttcagtgtcgtcgatcctgagggcactgtagaaagcaaggcagatcctgcctatgtcagctgggcacatcgcaaggggatggaggtttggggcttgttgagcaacagctttaatcccgaattaacaactgaagcattgtctacctttgaacgtcgaaaggcgattgttgatcagatgatttcacttgccctagaaaatgatctggatggtattaatattgactttgaaaatgttcatacaaaggatggccccaatgtcacccaatttttgcgggaacttaaaccgatggctcgggaacatgatttgatactgtccattgatgttacgcctaaatctcaaagtgaaatgtggtcagcttttttggatcgaaaatcattgggcaccatcactgattacctcatggtaatggcatatgatgagcattgggcggctagtccaaaggctggttctgtcgcctcgctaccatggacggaagcgtcaattaagcgaattattcaggaagatgaagtgccgcctcaaaaagtgattttaggtattccgttatatactcgcgtgtggtccgagactcccaaagaagggaagattaaggtcacctccaaatcacttggtatgaagtcagcagccggtatcatagccgattttaacttgaagcccaagtttagagctgccgaaggccagaattatgtcgagtatacagaagacggcgtggtcaaaaagatttggctagaggatcagatatctctgaaggcaagagtagaacttgccaaatcgctgaagctcggaggaattggggcgtggaatcgaacctttgcagatgaaaacgcttgggtaacactgaaaaaaataagtgaataagataaaaatttatacaattgaagaaggaagtttcttatttatgtagaaatgatcacatgtatccaaatatccaatttgcggtcatagccgccttgcagatatggagggagaagtgcagctaaccaaattaaacctaatgtatgatgaattgttgcgggaagattcaataggtattatttcgtacagaaagccgggagagtattttcacggttcgatgttgtatgactttgatgaactcattctaattattggagaaagcaccaagccggttcgttctattcaacacttatttatgaatggcttaagatgtcaagtgttgtacgcaacgctcagttgtctgaaggaatggattatcgctggtgaacaagccaacattatagattatgtactagaaggtcgtattgtctgggaacgggatgacagggtccgtcttttaagacaggaaattgttgattttaacgatccactacgggagcagaagcgatttcatgagttctcccgctttctggtcaattacgttcatggtaaaagagcgttgcgagaagggcggatcattgacgcttatcaaagtgttctgaaagcattggatcattgggcatctattgaactcattgaacgggggatttatccaaagactcacttatgggttcaggtacagcctctggatcgaacgattgacaaactgtataacgaactcacattaagtacggaaaccttggaacaacgggttgaattagtattgcttgcttgtgaattttcagtgatgtcaaaaatggaggagtgctcatctccgctattccgtatattaggcagcagacgggaaccctggtctataaatgaacttattaaccatccagaactaaagaatcttcaattggatcttaccgtcgtgctccgtaaactggtatatcgttcacttattagagaaacagctgccggggattttagggatcgtgggcaaaatcgtgaactgcgttactcccttatttgatgtgcagggtagatttgtcaggaagaaaggttgttaaatcgacttttcttcctttttttgtacgtgatgtagtatttatagatagttacaaaatataaattattaatttaggttgacgagtatataaaatatgtgctaagttataactcgccccattaagcaacatgaataatttagaactgtttaaagaaggataaaagtgttgcttcaagcgaaaaaaataaattttcaaaaaaaagcttgacgaaaaatgaggttatgtgttacattatttaagtcgccgctgagacgcggtggtgaaacaaagtgagacattatgcaagtttgatctttgaaaactgaacaacgagtgagtaaaacgattttgttcgcaaaatcaaacaagagatatttttatctcgtcagtttcaaaatgagcttatcgctctttctataaaccaactttggttggtctttaatggagagtttgatcctggctcaggacgaacgctggcggcgtgcctaatacatgcaagtcgagcggggttatgtagaagcttgcttctacataacctagcggcggacgggtgagtaacacgtaggcaacctgcccacaagacagggataactaccggaaacggtagctaatacccgatacatccttttcctgcatgggaga

SEQ ID NO: 2642 - DNA, 109026 bp, Unknown
  Kingdom: Bacteria, Phylum: Firmicutes, Class: Bacilli, Order: Bacillales, Family: Paenibacillaceae, Genus: Paenibacillus
tatcttaatgacattgccgtttgacggagggctttttttctttttgtcaccatttccctatattttcgtaacaaatatcgatttgtagatgacaaaattgtaacgagtgtagtatgatgttcaaggttcccaacattttcatgcggataaggttacaaaattgtgatattatgcagtaagccaaaacttaccgggacagcatacggttatgacaaacgctgaatgctgggtctaaactatgggaagtgcgggggacgtaacaacggcagtcattccgatacgtcataagacgatgtggaatatgcctaggggtgaattgcacaagcatagggcttctcctgagtccgaatccgacagctaacttcgcaggcataacagaggaggtacatatctttgaaacatctaaaacatattggtaaaacgatgaaatttgcggtgcttgccgcagctattgcagggctggcacagacagctggagtagcggatgctgcttcgcttcacactgccaaagagggcgataccttctttttgcttgctcaacgttatggagtatcggtagacgagctaacgaaggcgaacccaaacattgcttccaacaatatatatgcaggtctgcaaattaaggtacctggtgaaaaaagtgtgaaggcagcttcggattcgaagccgcagcttcttacggagaaagcaccagcgaatgaggggccaacgattgaagcgtggggcaaaacattcaactatagcaaaatagttgacgttaaggcttcagcgtattctgccgcagccgacgagaatggtaaatggggagcagtggactactacggcaatccgcttaaactaggtacaattgcggtagacccgaacgtcattccgatgggcacgaaagtgctggttacaggctattcccacccaggtttgccggatcattcttttgtagctgtcgctcgcgatcagggtagcgccattacaggaaagcggattgatatctttattcctggcaacaaatcatttgtgaacgactttggatttcaaaatgtgaagctgtacgttattgataaatagcattgtacgtatatacggtttaattaaacataatatatattatgtaaacttaatacctgtatcctaccgcatataactaggtcgcaggtcttatccataaaaaaaagctgtcttgacgagcagaaaacttctgctggtaagacagcttttttacgttgctttagctgtagctcaatcataaacatatggttatttccgttccgatgtgtggagtagccgggggactgtcacaaatttgtagcccttagcttttagagagtgaattagacccggcagagcttggacagtgccttgcaagttggaactttgacctccacctgcgtgcattaaaataatagagccaggcccggtagctgggatcacattgcgttgaatttgtgttttacttaatcccttccaatcgagagagtctacattccaattgacaatcatatagccatgacgacgtgcccattggatttgaggctccgtgatttcaccgtagggtggacgaatcaacttggggcgaaaacctgcgctggcttgtaaaatacgttctgtttttgtaatctggttgcgaaagcgttctggtgtggccttcctaaaatccggatgagtataggaatggtttcctatagcatggccttcacggataatacggcgtatgatccccggatgcttttccgcacggtgaccgacgatgaaaaaggtggctttgatgccattggcgtgtaatacgtccaaaacctgcggcgtatacctagaatcgggcacatcatcaaaggttagggcaatttggcgggtgtgtgggccgcacattttaaaaatgtccgcatgtttttttcgcagcattgctaatgtaggagttgctcgatctgtgctctgatgtacagaagaagcaacagctgtttccttgggatggggcgttccggtgttgggaggcgcatccgcgtgaacgggtaaacttgagaatgctagtaacagtgccaagcatggcaacactcccctgtacggcatatgtatcccccctttcccgtgcagtggtacctagtggtgctctcgactattatgtacctgtcctattaaaaatatgctgttaaccaagttcggctcataaacgaatggaaagaagcccacgatgaaacgattatcaatgaagatgatggagctaaacgtacatattctcttaaacatgaccgataacaggagcattttcgcaagttttagccttacaacgaattcggtatactagtgacagctggtgtataatggggatgcaattcataattatacagacatggaattgaaggaaggatggataaaagtgaccgacttgtttactccttatcaattaaaggggctttctttaaaaaatcggattgtcatgcccccgatgtgccaatacagcgtggaggccaaggacggaaatccaacggaatggcatcatgtccattatgtgagccgggcagtaggaggcactggacttattattgtggaaatgacagcggtccatccagatggacgtattacggatcgtgatttgggtatttggagtgacgaacatatttctgcatatcgtaagattgtagaggaagtccacaagtatggtgccaagattggtattcaactaggccacgctggacgcaaggctgaagatgctgagcaacctgtgggtccgtccacgattccttttagcgaacgctttaaaaagccgcacgccttaaagacagttgaagtcagggaactggttcaggcatacaaagaaggcgcacgccgcgcgatggaagccggttttgatacggttgagatacatggcgctcacggctatctgattcatcaatttcattcgcctttaacaaataccagagaagatgaatatggacaggatttgtcactgttcggtgttgaggtcatacatgctgttaaagaggttcttcctgctgacatgcctgtgcttatgcggatatctgccaaagaatacgtcgaagatggatataacgtggaatacataacaggcgtaggggaacgatatcgtgatgcaggtgtggatattttccatatctcttctggtggtgagggtccgattggttctggcggaggcccgtctgcgcgtgccggctatcaggtggatttggctcataccatccgtgaaaagctgaatgtccctgtgattgctgttggcttactggatgattatgaggacgcccgccgggttgttcagcaaaaagaagctgatctggtagcaataggccgtgccatgctgcgtgatccctattgggcgctgcatgcatcgcgggagctaaaagtacaggccgacatcccagagccttacttgcgcggtttttagatatttttgaaaccctctttgcaaagcttgcgtaaacatgtgtacagagcttaaaatttaagcattcaactctaggaggaacttcacatgtctattttcaaacgattaagagatcttacgatgtccaacattaacgccattatcgacaaggcagaagatccaattaaaatgacggatcaatacattcgtgatatgcaagaggacctggaagatgcagagaaagcggtagccgctcaaattgctattgaaaagaggttcaaacagcaatacgaagaacaggctgctttggtaaagaaacgtgaagaacaggcacataccgctgcaaaagcacaaaatgtagatctggcccgtcgtgcgctggaagaaaagaaatctgctgaacaaaaaatgtacgagttcaaagctggttacgaacagaacaaagctgcagccgataatctacgtggcaagctggatgaaatgcgcagacagctgacagaaatgaaaaacaagcgcgaaacactggttgcccgttataatgcagctaaagcgcaaaccgaaattaacaaagctatgaacggttttagctctgatacggcaactgccggattgaagcgtatggaagaaaaaatgctgcaagcagaagcacgtgccgaagcgagcaacgaaatgtcctctaaggaaaaatcgttggatgaggagttcaaagagctggataagaaaagcgccgtggacgatgagcttgccgctttgttaaagcaatacgaaaataaataagaacatttagcaatgccaccaagtgtgattgctcaggaagcgaaggagaaacgtttctccttcgcttttccctgcctggaggcgcaaaacattatatgaaggtcaagaagatgtggaggatggtatgaaatgcattttttagaaacgatgaaagcaatgcttgtatggactggtgcgggggctattttgattttcgcattaatgtatgtcgactctttatttacgaagtataaggattttgccgaagtgaaagctggaaatatggccgtaacggtacgaatgattatgaagctggttgcacaaggctatattttgtcagggtctatcgctacagctaataatttgctcgaagcgcttgtgtattctgtgatcgcctttgtcatcctgcttgttttggaagttattgtacgtctgctgttgcggtactgggctcagtttgacctggataaaggtacacaggaaggtaaaattggtttcggtctgttttcaggagcgctgcatctagttggcgccttgatcattacagcatgcttctaggctaagaaaggcaggaatataaccatgggtgtgtggaaacgaatttcaaatctatttgctaagccggagccgccaaaagcagagaaaagcatgcttcacttaaatccaggtgatatctgtgaagtgtcgcttgttacctatgaagtggtaggtcgtgtacataatcgtgcccggaatgccgttgttttgacgcttcaggatggtaatcaagtcagttatcttcatattgaggaacgggaaacactgcaattcggactatatcaggccatcgacggcagacttgacaaccctgaggaagtgccgaccattttagagctggatgatacaacgtatcatttggaggagcagtattctgggcatgttaccgtcatgggccgtgctcctttccgacagggtggagagcagcatgtttggcagtaccagtctgatgattatcatctgttgcgggtagagtggcaggacggtcgctttatgctttatgaaggagaagaagtgattaccggagacgtcaaggttattcgggcaagctaggagagggttacacatgagcaaacgcacctggcagtatgcattaaagatcatggtggcgctgagcttgttcgtatccgtgttaagcggctgcggcgcgccaagtgtaaaagatacgtatccgctggaatcggttagtggcagcggaaactcgacctcgtatgtataccgggcagctggcaagacagttccggaagtagcggaggaattgaaagaacagcgtacaccggaacaaatgtcaccgcagagcaatgagcggatgtttctggtatatagcgatgagtggtaccatttgcagcaagatccagctaagaaggaagatacactcattgagattgacagtaaaaagtatgtcgaacaaaattacagttcaagctttctaaaaggatacttaaccgcaactgtgctggatgctctgtttgattcgttgcgtggttcaggctcctatcggggctactccagcagagatgtataccgaccttctcagggccaatatcgtgcccctacggtgcaggagaaaaaagcgatcccgccgattacggtggagcgtaaaggctcggttacccgtagaggaaagaactcggattccagtgttggatcaagcggaagtctgttcgacagagggtccagcagttcaccgagcagaggctcgatttcacgtgaccgtagcgacagcggtggttccagcatatttgattcgccgcgtagatcttatagtaagcccaaaacacgtagcggttcaggtaaaatcagccgacgaagtcgacgatgacgggtatcgtcaatttatttgaaaacaaaagattcgcggaactgtggtactgatgcacagttcctttttttatttttagagatgacgttggtgatcatctagcggcacagccatcaagtagaagtggactgataagggaaagcagccgcaacctacacctttatggatataataatgtagagataatcaaaactctgtttgattgaagggattgaaaattaaatggtactatctatttcttggccagatctttcacaaagaccatttaatctaatggtggaacgaaaaatggagtgttctccgaatgtcctgtatcaggcgtggacgaagcagtttgacagttggtttgcagccccaggatcagtattaatggaggctgaattgaacacgaccttctttttcgaaacgcattttgaaggcaagcgtcatccacattacggaagatttctaagacttgagcaaaacagacttatcgagctgacttgggttactggcgaaggcagcaccaagggagctgaaacagtggtcaccgttgagcttaaacctcacggtaatggcacgcatctttacttaacgcatgcaggttttccagatgagaattcaaggaaccaacatgagcaggcttggccgcttgtaattgagcagctcgacaaaaggatgatgccagatagataattcagaaggttacaggctaaaactgcaacaagaggacgattttaaaatcgttcttttcatattttttgacgacaaaaataatatttaccttacataaaaacaaatattaccagtttactagattatttcattgccacatctattagtaaaatatacaattacaacaggcgaaataagaggatggtgtatctgtgttatctgcttttttatatatattacttggtgtattcgatgctttggccgctgttattttggtcttaaagctttatatgcttcccgtgagggaatatcgcacaaaaatattattctatgcaatgggcatagctttgttttcctttctaatgagggaagttataggcttgcctaaattagatttgccgcttcagtatttgttaatggttatcttttttagattcggtttagggatcaaaacccatctagcagctttttctgctggttctggtctaacagcctacattaacctacaactttttgtatttctgtttgcaaattttttcggagtagcagaaccaggtgttattaatgatacttctggctcttctatttacgttattcagttatcttctattattattgcgtactttatttcttttgtgatgggaaaatataactttggattctcgtttataattcagcctccacatgattttttaagagctgaaaattacttatcgtctctaaataagctgttgattctaggtgctctaatatcagctgccaccatttttattactttgtatatgctctatagctcaaataccataggattactatccatttcattgcttactttcggtttgtcgtatttcttttcagagagaggagattacgagggtgctagaagcgctatcaaggtacatcgcaacggaaataaaaaaagctgatcctgatggcccaacaagtgtagaagtgatggagtatgcgcttggtataaaaattaccgaagtatcgtcgatactaatggttgcggttatcgcttggatgaccgggcatttttggggggcgttattagctctagtaactatcatgtttgtaagaaaattttcaggaggggcacacttcagtaatcttacattttgtgtctgttttacaacggcaatatgtgtaactatacccttcgtctctttaaatttatcaacaatttcgattattaatgcttgttcaatattagtgtttttagtttatgcacccaatcattttatttatattcataagaccaataaccacaaatattataaaactgtatgtgttttggtatgcgcagtgaatttttttatacagtcccacataatatgtttagctttagctattcaagcattcagcattcttcctttatggaaaggaggtgaacgaaaatggataaaagattggcgagagctttaaatataagactgggaaaatacgctaacgaatctaccaaaaatgaaaaaacagtatttggtgctaaaccgataccggctgagcttaagaaaaaagaaaagaactgatgaagtaccgcgttttcaatttggggcattgcttttatacgatcgggctaaccgcacagacttgcaaggaagcttttcagctatcacgacttggttttgtgagatcgagtctaacgcatttggaggtacgattcgaagaatctgacttcacttgctctatgtctcataataagcttaaagcacttaaaaagttatagaaatgacccgtagaattcacgggttatttttattgccatacatacttagacaccccccgatttgccagataacggttttagcgttataacagaaagagggcattttagaagaacggagtgaaattatgaatcatacatcattaaacgcagaaaaattccagcgtaaagcagttcaggtggaagaggcgcaaagcaggatagctagtcatgttaaacagggtgaaagggaagacgtagagctggagcaggcgcatggacgttctttggcaatggatttgaccgcaccacacccgtatccccgttttcgtcgctcaggtatggacggttatgcgatccttggctcggacaccgaagtctgctcgtccggtcaggaaatctggttacatgtgattgatgaaattccatgtggcaccgtatcggacaagcgggtggagactggaatggctgcccgtatcatgacaggagcgcaattacctgaaggggcggacacagttgtcatgctggaagcaacacagctgcgtgaggaaaacggacagacatatgtcggcttgaagaagcgtatggagattggcaaaaatgtaacacagattggtcatgagattcaggaaggtcagcttttgcttagtaagggaacctgcctgggagcagggcacatctcggtactggctacttttggagtacatcaggtacctgtttacagaaagcccagggtggccgttttttctacaggatcggaattacttgcagtggatgagccgttacaaccggggaaaattcgaaacagtaatacatatatgctggcttctcaaattagagaggcaggaggagagccgttcattttacaagccattcatgatgatttgagccttgcccgtacctctgtacgtgaagcgatagctgcctatgatatcgtggtcacgagtggaggagtatcggtgggggattttgatattatgggtgacctggtacgacaggaagatgtgaatatgctgttcaacaaggttacgatgcgtccaggaagtgtgaccacagccgctttgattgacggcaagctgttatttgcgctttcaggcaaccccggtgcgtgctttgtaggctgtgagctgtttgtacggccgacgatccaaatgatgttatcttcggcacatccatatttacaaacctggacggcgaagttaggcgcagattatacgaaggtaaacaactatacacgctttgtacgcagctctctggagatacgtggtgggcaagtatacgcgattcctgcgcaagtagatgaatccagtgtcatggtgaccattaaggacagcgactgtctgatcgtgattcctcctacaacagaaggattacgcaaaggtgaagaggtgcgagtactggtattacaaggtggacaggtaacgtgaatacgaaacatccatttgtatgtcaaatcgtcggattcaaaaatacggggaaaacgacctttctcggagggttgattcgttatgtgcagaagtcaggtctacgcgtagcagtgatcaagcatgatggacatgaatttgaaatggatcatgagggtacagatacgtacaagcaccgacaggcgggtgctgaaggcgtagctattgtttcggctggaagaacagccattttagaagagcatagtcagcctgtcaccagtctgatccggcattttcaggcctatgattgtgtgttgctggaaggcttcaagcaggaggattatccaaagctggtcatggtgaaggaacaatcggatgctcagcttaccggtaagctgacaaatgtacagggagtagcggtttgggagcatcaaatggattgggctcaaggtcactactcagatgaaatgatacagatatttcctgccgaggccaacggacccgcaggccgctggctactcgaacagattcaaaagcagatagaagaaatgaggaataagcaggggtgagacatcaatcggctgagtcggttagagtgtctacccgccgttcgatcgccttggacatggttttgtcagtcaggtgggcatacacttctgttgtttctgtcgaagcgtgccccagttgttcctttgttttgtaaatatcattttgtaaataataatcagtagcaaaggaatgacgaagcttatgcacggtaaggtaaggcttgccgaaacgcttggcgtacttgatgatcattgcctgaatagctcttttggtcatccgtttgccttctgtactgccgttaggacgtgcgacaaagagagctttttctttttttggggcgcggtaacgggtatgtcttagggacaaataaagtatgagatcatctttggattgctcgcggaaatacaccggcgttttaaaggtttcgtcgttattgcctttgcggtacacatataataatttattgtttatgtctaaatcatctagattcagattgacgatttcagatacgcgcaggcctgagttcaaaatgaggctggcgatgcaggcatcccgttccttatttagttcataggagtataacgcctgcttgttatcggccaaatcgtgaccatagccttcataaatataaccgatgaattcaagcagttcttcctcttccagtattttacctttaagcttggccgccgtatccttgggtttatgtatacgcttgatttcgaccttggccataatgttgcgtttgagcaatggataaaaattttcatcctcagcgatctgactcaaataatgaaaaagcgaacgcagggacgatagcttacgtgaaatggtaatacgggagttggagccttcgcgcttcgtagacaggaataatcgaaagcctgtaatactgtccatatgaagtgtctccaattcttccagtgtaacttgggcatttgtttctccagtagacaagccttccgagcgaagccatgaaaagaaagcttcgtaatcccgcacatattctagtaatgtggaaggggacaggtcgggcagcttgtaatccataaattgctgcacgtaccatggtaatcccggcattttttcatctagtttgcgccggtcgatgatcttttgtatattcattgggttccacctcgtccggtcataatatatatgtattttagcatattttgcacagcactggatgggatgtaattcgaagttaaagaacagattgaaccgccaagagaggtgaaagtatggggtataatatcaaatcggaactgaagctgtctattaagagtgtaccggagtcgcaaaaggacattattgtacagctcatgcaattttatttatatgattttacagcctatcttcgaattgatgtcactgagaaggggacattcccggcttatccagacttgtatcaatattggacgagcggtgaacagaagctgccttttctaatttggagacaggatattcctgtaggctttgcactcgttgaccgaatgtccagcaatcgagaagctgactactacatggctgagttctttgtacttcgtccttatcggcataatggggttgggacttgggcggctcatgagctgtttggacgttttaacggacgttggaaggtgacccaaatgagcaccaataggccggcacaatctttttggcgaaaggtgattggaagttatacgaaaggcgagtacaaggaacagacacatccggtaagagggaatataagtcagtttttcaatacctgaaaaattcgaaatagaaaatcagtaatgaaaaagagtcggggagagtatcctgtcggctcttttttgttgtcaattcaagtcttctaagagaccagttggacccgaaaagaaatgcaaattagcaacaaaaagcctattcttaaatgctatagaaggagggagtccgtttgtcatcattgctgtagattgaacatttatacggtcgaatttcacactaaaaaaggtttactgcaagcactcgacaacgtatcactaacgatcaggacgggagaaatggtctgccccaacggtgaatccggcagcggaaaaacgattacccccaagtcgattatgcggctaaccgattatgaaaacggacgaattgcccaaggacaaatacggttgcagtacatagatttgaccgttttgtcgcagcaggaattaagctcacttcgcggcaaaaagatggcgatggtatttcaggagccgatgtcggcgtttgatccggtgatgtggtcctgatctgctatggttcgcgatttccgtatgagtttttgggaggacgcgccaacgaatcgggatagcccgtgccattgctctgtatagtggttatgtacttgggggaacttgtagaattgctccaagtgacgagttgtttcaggcatcctgcctatccgtatacccgaggacttgttgcctcgatacctaatccaaatccgaaaaaccgccgggagctaattacgatacaaggtgagattccttcgcctgcgaagcctccatccggctgtcgttttcatacccgctgtccactagcgacctcgcgttgccgtgaggaagaagtgccaggactgacagcgattagcacaggacattatgccgcttgtcattacccgtcctaggttcaagacaccgctttgatctactatcagcatgataaaagaactacattctacaggccgttcatggtaagataaggatagaagcatataaattcaataggaaaagagggtattatgctagaaaaatgggttcaggaattaaaagatggtgaacaagagctgattgcgtggagaagacatctacatcagcatcccgagctttcttttgaagaaacgaatacgtctgcatttatcgccgatcaattgcgctcttttggcattgaggtaagaacgaatgtgggtggaaacggtgtgctcgggtttttagaaggcggtcagccaggtagaacgattgcatttcgtgctgattttgatgcgcttcccattcaggatgaaaaggatgtgccttataaatcgaccgtttcgggtgttatgcatgcctgcggacatgatggtcacacggctgcgttacttggagtggcacgcgtattgagccataaccgtgaggccttgaagggaaagcttgtgtttatttttcaacatgcagaagaaaaaccgcctggtggagccaagtttatgattgaggatggctgtctggatggggtagaggcggtatacggtattcacctcgcctctgaaattccgcttggtaaaattggattaaagagtgggcctgcgatggcggctgtcgacgcgtttacgatccagatcaacggtaaaggcgggcatggcgcacgaccgcatcagacggttgactctattgttatcggcagtcaaattgtgaacgggttgcagcaggtggttagtcgcagggtggaccctattgaatcagcagtgttaacgattggggtatttcaagctggaactgcctttaatgtgattgcagataaggccaaaattgaagggactgtacgtacgtttaataaggaagtgcgtaaggaagtcgagaatgaaattcgcggtatcgtcaagggcttgactgaggcttatcatgccggatacgaaattgactatttgaatggctatccttctttggtgaatgccgaagccgaaacggaacgtgtacgcgagctcatcggcagactgtatggagtagacgcttttttggatttgaagccagtcatgggagcagaggattttgcttattatttggagcagcgaccgggagcattcattcatgtgggtgcacgcaatgaggatgaacgaacgcattttgctcatcaccatcctcactttgattttgatgagcgagcattgctcgtctcaggacatatatttttagctctggcgcttgaatacttgcaataatatgcatatgtttatgactgatgacagtattaacggaagcaatgcaagctggaaccgcgcatagcgcggttttttgttgtaaatcaaagtattttgacatccataaagaatgaaaatgaagtaattaattcattatatgaaaaattcataatagagttaaataaaaggtgttaaatcttaaggaagtccaaacctcatattataagctgaggagcacgagataatattgcattatcttgatttttcgcacaaggaaatgagaaaaagatgacgaatctattgagcaagacaccgatgtaagcgctaacaaaacgagtatcgcaccgtatatattggttgaatggaggtgagcctgagaaaacatttgtcagatttgtgagaagcaacgataacgataggaacgtattcagaatcggctgattactttgatctcagaatgactcgcatattcaaatgataatgaagaaggaggttgaattcattgactaaggcaaaaaacaggttgagaattgcttgtttggcgcttgtggtagcgggtgcttcctggacaggaatgatagcaccggctcatgctgctccaagtgacgattacagttggaaaagtgtcgtaacaggtggaggtggtggttttgtacctggcattatttttaatgaaacggaaaaagacctaatctatgcccgtacagatattggaggagcttaccgctggaatgctgccaatgagagctgggttccgctgacggattctgtgggctgggaggattggaacaaaaatggagtcgatgcactggcgactgatcctattgatccgaatcgcgtatatatagctacaggcacgtatactaattcatgggataaagaaaacgggcagattatgcgttccaccgacaggggcaatacgtggcagacaaccaagcttccttttaaggtggggggcaatatgccggggcgttcaatgggtgaacgtctgacgattgatccaaataagaataatattttgttctttggagctcgaagtggtaatggactatggaaaagctctgacttcggagcaacttggagcaaggtgagcagtttcccgaatccagggacgtatgtacaggacccttccaatgaatataccagcgacattgtcggtttggcctggattacctttgacaaaaaaacaggctcttccagtaaagcaacgcagacgatctatgtaggtgttgcagataaaaagcaaagtgtctatcgcagtacagatggcggaacaacctggtctgctatagcgggacagcctacgggctatttgccacatcacggtgtgttatcagcggacggcaacttgtatatttcttatagcgatggagctggtccatatgacggaacaaagggtgaactgtggaaattgaatacagcaagcgggcagtggactaacattagccctattggtagcagcagcgcggacaatcattttggatatggtggactgacggtggatgcccagaagccaggtacacttatggttgctaccttgaatgcctggtggccggatgaaacgatttaccgcagcacggatagtggggcaacctggagtcctatttgggaattcgatggttatccgtctcgcaagctgaaatacaatctggatataagcggtgcgccttggctgactttcaatgccaaccctgctccaccggaagcatcgcccaagctgggctggatgatcggagatctggagatagatccgtttaattcagaccatatgctgtatggcaccggagctacgatttatggctctaaaaacctgaccaattgggataaaggaggaaagctagatatttcggtagccgctaaaggggtagaggaaacagcgattttggatttggtgagccctccagttggcgcgcctttggtgagcgcagtaggtgatgtctctggtttcaagcatgacgatctgttcaaggctccagctaaaatgctggataatccgacctttacaagcagcgaaagcatcgattatgccgagttgaatccttcttttatggcccgggtaggtaaagcggattataaaaaagatccaaatgccaaatccatcggtttttccaatgatggcggagccaactggtataaggcaaatagcgagccttccggtacaacaggaggagggagcatcgccgtagcggcagatgggaatggcttgctgtggagtacatcggacaaaggtgtgttctactccaaaactggcggcaacgcatggacagcaagcacagggattccagcgaatgcaaagatcgtctctgatcgagtgaaccctaataaatattacgcatttgcctccgggaaaatatatgtgagcaccaatggaggcgtatcctttacgccatcagcggtaactggcttaccgacagcaggcaatgctgatattgacgctgtacgaggagcagaaggagatgtatggttcgccggaggctccgaggatggagggccatatggcttatggcattccaaggattctggcgctacgttcaccaagctctctaatgtgcaggaagcggattttgtaggctttggtaaggcagcgccgaaccgtacgaatgcagcggtatttatcgttggtaaaattgatggtacacgtggattttaccgttcggacgatgctggcgcaaactgggcgcgcattaatgatgacaagcatcaatatgctcgagtgaccaaaattattggggaccctcgggtttacggacgtgcttatctgggaacgaatggccgcggcattctggtggcagatcgtgtgggtggtgatcagccatctaccgggcaagcaagtattacaccaacgactgcaacctatggagtagataacagcaataccgatattactgtcaagcttacacttaacggtaatacgctagaagcgatcaagcagggaagcgtggtgctgaacaagagtgaagattatacggttagtgaagaaacggtcgttcttactaacaagtatttatcgaaacttcctaaaggagagaccacgctcaacttccattttagtacaggcactgatgcgttgttcacgattacggtgaaaggagatacgccaagtgagccgggaacaggcgagggcgttctgaaggtgcaagccttcaatgggaatgtatccgccacaagcaatacaatcagttccaaatttaaaataaccaatacgggaacctcatcaatttccctagcagacgtgacattgcgttattattacaccattaacggggagaaagcacaaaatttcttcacagattggtcgagcgtcggtacagggaatgtgattgctagcttcaaaacattatccaatgctaagccaggggcagattcttatgtagaaatcggctttaactcggctgcgggttctttagagcccggtcaaagtgtggagttgcaaacccggatatcaaaagaggactggagcagttacacacaaaccgatgattattcatttaatcccacagcaaacagtttacaagattcttctaaaataaccgcttacctgtctggaagcaagcaatggggaattgagccctaaccttaataaggataatcctaagtcagccactctaatgagtgagctggctttatttttgatgaccttgttgtcctgcattctttttttggggaaaatgcaacgacaagttgaaaacagtaactaatagagattcaaattaaattatataattatttcactatatgaaaaattcataatagaaaaaaactatttctcgcatacaatctccacaaaacaaacacaccactttaagtagaaaaagaaacactgacgggaacatatgttcttttatctcgaaaaaggaaacgctcctgtccttagacaaaaagcgtctctaatccattttttatattgatcatacacctcaaacaagatgccgggatgctgaaattaatagggtcatcgtaatgacattcacaatcgtggaaagtaatactgtttgtgcggcaaaatcgggttcgtttttatattcttccgccaaaatactggtattaacgccggtaggcatacccgatgcaatgagcaaggcttgagcgggaattcccttaagacccagcagcaagacgagcataaaaccgaccattggaccaacaatcaggcgtagtaccatactgatgtacacggcagtccggcgcaaacgaaagggatattgcacaatttgtgctcccaaagtaagcagagccacggcaaccatcgactgactaatataattcaaaggttcagctagtaaattaggcaatggactatgcagcagatttaggagcaaacctagcgcaagcgcatagggaacaggcatttttaaaaaattaattaatatttttcgagtattggccttgccgttttgcacaacaaaagtgccgtatgtaaatgtgacaaagctttgaaaggtcataatcagagcttgaacggaaatggccaaagggtcacctttgaacaccaactgattgattggcagaccataatttcctgaattatctagcattacactatttgtaaaagctccacgcattccgggactgtatttcagagatctggcgacggtagtgctgattacgtacagaatagctatgtacaaggcataaaaaagtgaaacctcacccatgagcattaaagaaatttccgagttataaagacccgtaaacacaactgcgggggtgatatagtaaaaattgattttagctaaggtatacaaatccagtcgaaaataatattgcatgatacaaccaaaaccgataagtacaaaaataggtaaaacaacgtccaaaagaatggtgccgaacatgtctgtttcatcttctttctattatgcgaatgtaaaggctgatacttaaaaatgcatgtgtaattctcattatactgtgtaaataggttaggcgtataataaaattttatagtggttttggcaatctggactgcggctatattggtgtcccacacattagttaaagaaaagataaaaaatcagcttagagaagccgttaatacatctagggacatttgagcccggtctttactataaggaggaatcgcatcatgagaaacacttggacagctttattagcgtgtatactggtcttgggattggcagcaggaaccgctgaggccaagcagggacgcggaaatgatcatgagaacaaacaggaagcaaagacgtctgttaaagacgggaatgaaaagagtggggaagagctaatcaatccccatgactcagacaatgatcagtccaaaaaacaaaaggacaaagcatccggtaaaaaggatgaaaacagtaaaaaagaaaaactcgcagaaatcagaaaaaccgaacctgttgcagtaacggatgatacgtacgaagagtccaaagaccataatggtcacaagggacgcaacggttacaagggtctgcttcacgcggtagaaaatacgaaggataagccggcaggagcggttattgcgaatctgctgcttacgaaatacccggaccgtttgactccagagcaggttgctgaacttgaattgatccggaattctggtaaagcactgactgaggcagctgagctactggctgaaaacggaaatgtgacagatgccgtttacatgcaggaggaggcggtactggctaatgtgtccgacctggacagctacaaaaagctcggtgaattctcgaagaaggctggacggccgtcgggtatgaagctgttcgtgaatggtgaagaatacgatgccaaaccgattaaccgcaaggggaccacacttgttccgtttagaacagcttccgaagctttggatgcaaaggtttcctgggatccgaaagaaaaggctgttacagtcacccgtaacggcgtgtccgtcaaattatttgttaatagtccgaaagcatatattaacggtcagccgtattctatcgagcagccagcatccatagtggatgggacgacaatggtacctgtaagggtaatcggagaggccttggggacaaatgttaaatgggagcctgaaagccagtccgttgttgtatacgagcagccaacaacaactactacatcaacatcataacgtgttgtaaacaaacaaaattttgaaagcaaaaagggcccctgactaaatgtcatgcctttttattttaccttgcaattaatgatttcgtattcatgatactaccgagctattcgcattatgtgctggtcatgtgtacaattaaatagagaacactgagaaaagggagtgttatagatggatttaggattaacgggaaaaacagcctttgttgcaggttccagtaaaggactcggcaaggcaagcgcacgggagctggcacgcgagggtgcgaatgtcgtcatttcaggacggaacgaagcagagcttcagcggacgaaggcggaattactggaaacagcgagtggccgcgttgaatatgtagtttgcgatgtaacaaaagcagaacatatctcccaggccatccgccgtacagctgatttgtttggcaccgttgatattttggttaacaatgcgggtgggcctcctgccggtacctttgatgattttacagatgaagtgtggatgcaggcctttgaacaaaatttacttagtcatatccggttgatccgtgaggtgttaccttatatgaaaaaacaacaaaacggtaggattttaaatattgcttcttcctcagttaaacagccaattccggggttaatcatttcaaatacgctacgtactggagtcgctggattggcgaaaacattgtctctggaattagctcctcataatattctggtacatactgtagcaccagggagaattgcaaccgatcgcgtgcgtagcttggacgagcatcgagctgagaaaactcagcaaaccacggatcaggttcgtaaacaagcagaagagggcattccattggggcggtatggagagcctgaagagttcggtaaagttgttgcttttctggcgtcttcagcttcatcctatttgacagggagcaccatccttgtggatggcggaatgattaaatcgttataaaataaagatgcgtgccagcctcaggtttaattgggagctggcacgcttttttaaaatttatctagggtatagaagatcttcattcacggcctggaagctcacaaccctcatcggtacatataccacctacatcttgtttggacgagctgccgcttatcatggtgaaaggtgagcgttcattccatgctttttgaagcgcatcatgaaatacttcctccggctgggcaccagaaacagcaaattttcgattaaatacaaagaatggtacaccctgaacacctaactcagcgccttcggattcatcagctctaacttcgtcggtaaaacgatcactggctaatatagcagccgcttccttttgatccaaaccaacctcagtagccagcgctaccagcacttcatgatcccctgtatgcttgccttcgatgaatacagcctggaataaacgctcgctcagctccagcattttgccttgtgtttgagcccaaagtgttaagcggtgagcatcaagagagttcgtcggcaccatggcatgaatattataatcaagacccgcagagcgtgcgttttcgttcattcgatcattcatagcctgagcctcttgcagactgaccccatatttagcggatagttcttcattgatcgttttaccgctatctctcacagcatccgggttcaattcgaaactcttgaatgtcaattgcacctcattgcgatgtggaaattgctgtaatacttgctccaaacggcgtttgccaatataacagaatgggcacatataatcagaccatacttcaatattcatcaggaaaaagcctccatgtatacgtattttattgagtaaccgggagtagtgctccccactttagaatgtgcataaaggtggaacttcattagttacaacaagaattataaagctaaagcattcaacgtgcaaataattaatgcttgtcaaaaaattaatgctatgatattttatatgtgtaaccggttacacattggagttgaacctacactatgacaacaattaaagaagtcgccagctttgcaggtgtttccgtagcgaccgtatccagagttattaatgaaactggatatgtacatgaggatacacggcgaaaggtagaggctgctgtgaggcagttaaattacaagcccaatgaagttgcacgttctttgtataaaaagaaatccagattaatcggcctgctgctgccggatattacgaacccttactttcccttgttagctcgtggggtggaggatcgaatgcaggaaaatgattttcggattattttcggtaatagtgatgaagatcgccaaaaagaattggattacatggatacttttgttcaaaataatgtcgttggtgttatttcttctaccaatgatcccgatgccgactgttacgctaaactgaagatcccggtcgtttttctcgatcgaacttccagtgacagcctctccgtatttgcggatggagcccatggcggttgcttggctgctcaagaaatggttgcccgcggcagcaaacaaattacagtcatgcagggccctgcacatattcgtccagcacaagaccgttttcgcggggcggttgaagagcttcggcaatccggaattgcttaccatgtggtcgagacaacttccttttcgttcaaggaggccgagtcgtgggccaaagagctgtttagcaagtacccggatacggacggagttatcgcaagtaacgatatcgtggctacagcggtgatgcatgaggcacatagattaggaaagaaaatcccggatgatgttcaaattatcgggtttgatgatataccattaagcagtttgttattcccgcctttgtcaacgatccgacaacctgcttatgaaatgggctgggaagcagcaggactactcattcagttgattgagcagtcgcaagtaacgaagtcaagcgtacctaatcttcattcgaaagtacttacctattcaagcatacaattgcccgtcaaatttatagaacgggaaacgacgagaaaggtggattatgatggctaaaatttcgattatcggaagcagttctatggatctcgtagttacttcgtccaaacgtcccggtgctggtgaaacggtattgggtgaaagctttacaaccgtacctggaggtaaaggagccaatcaggcagtagccgcagcacgactcggagcagacgttacgatgattggacgtgtaggggatgaccattttggagaacagattttacgaaattttgaagaaaatcatgttcatactggctatgtgaaaccggttacacatatggaaagcggtacagcgcatattgtactagctgaaggtgataacagtattgtcgtggtaaaagcagcaaataatgaagtgacacccgcctatgtggaagaagcgcttgacgtcatccgaagttcggatattgtgctaattcaacaggaaataccaacagaaacggttgtttacgtaagcgagatttgtgcgaaataccagatacccttgttgctgaatccagccccggctcgtgaagtggaagaaagcgtaattgcgaatgcgacctacattacgccaaacgagcatgaagctgccattatgtttaaggatatgagcctgcaagaagcgttgcgtaaatatcccaacaagctgtttgtgactgagggcagcaacggtgtacgattcttcgacggagaacaggaagtcgtggttcctacttataaagtagaggccgttgatacaacaggtgcaggagatacgtttaacgctgcttttgcagtggcactggccgaaggaaaatcgctggccgacagtgtgaaatttgctaatcgtgctgcgtcattgtccgtaaccaaatttggagcccaaggtggaatgccaacccgtcgtgaagtggaggagcaaatataatatgaagaaacatggaatcctcaacagtcatatatccaaaatactggcggatctcggccacacagactatattgtcgtggctgatgccggcttacctgttcctgaaggcgttaccaaaattgatttggcccttaaactgggtgttccatcctttcaggacgttgttgatgtcattgcagcagatatggtgatcgaaaaagtaacgctggccgaagaaatcaaacaagaaaatgaacaagcattgcagtatattatgcgcaactttgcaggggagcaattagaacatccacagcttaataagcagactgccgtcattgagttttgctctcatgaacaattcaaggagctgacccgttatgcgaaggcggtcattcgtacaggagaggctaagccatttgccaattgtattttgcaggcaggagttcattttggataaatcaatgttgaataaaaaggagggtacagcatgcagattcaaatgaaaggaattcacaaagcctttggaaccaatcaggtactgagtggtgttgactttgatcttcgtgaaggagaagtacatgccctcatgggtgaaaatggtgcaggaaaatcaacgctgatgaatattttaatcggactgcatcggcgagatgagggaacgatcatcattgacggccaggaaacctattttgccgaccccaaagaagcggagcaaaaaggaattgcttttattcaccaggaactgaatgtgtggccggagatgactgtgctggaaaatctgtttatcggcaaggaaatgacatccaagtggggcttactagacagctctaaaatgaaagcgttagcaaatgagcaattcagcaagctttcggtaaaccttccattaaacggtgaagcaggcgagtgttcagtgggtcaacagcagatgattgaaatagccaaagcactcatgacggatgctaaagttatcgtgatggatgagccgacagccgccttaaccgaacgtgaaattcagaagctgttcgaggttattacttctttgaaaaaagatggtgtttcgatcgtgtatatttcacatcggatggaggagatattcgcgatctgtgatcggattaccatcatgcgtgacgggataacggtggatactcaggcgattcccgatacgaattttgatgaagttgtacggaaaatggtaggtagagagctgactgaacgctatccggtaagaacgcccgctttgggagaagtggtgctggaggtcaaaaatgccacgcataaaggcttgtttgaaaatgtgaattttactgtgcggtctggtgaaattgtaggtttttcaggcttgatgggctcgggacgaaccgagatcatgagggcgttatttggactggatgctttggatcgtggtgagatccatgtacgtggaaaaaaggtgactattcgcaagccggatgacgcggtgaaactagggattggcttcattacagaagaccgaaaagatgagggcttggttctggatttttccattcgggaaaatatggtgctgccaaatctctttagctttacctcaaaaggatttatttcaggtaaaaaagagttggattttgttaacactttaattaagcgcttacaaattaaaacccaatcgggtgaaacaacggttcgcagtttgtcaggtggtaatcagcaaaaggtggttattgccaaatgggtaggtattggtccaaatgtactcattcttgacgaaccgacgagaggtgtggatgtgggagccaagcgggaaatctaccagttgatgaacgagctgaccgaacgtggagtcgcgattatcatggtatcctcggaactccctgaggtactcggcatgagcgatcgtattgtcgtggtgcacgagggaaagatcagcggagagctgagcagggaagaagccacacaagaaaatattatgacgctagctacaggaggacagtaatatgacaactatgaatgaatcaaaaagcagcaaaggctttcaaatgtcacaaatcacacagaagcttggcccgttgttgggactcattattttggtgcttatcgtatcggtcttaaatcccagctttttggaaccgcttaatattttgaatttattgcgccaggtatccattaatgcgttgattgcgttcgggatgaccttcgttattctcacaggcggaatagatttgtcagtcggctccatattagcactatccagtgcgtttgtcgcaaatatgatgctggctgggttcgatcctattttggcgattatcatcggctgtgcattgggtggcgtgatggggatggtcaacggcttgatgattacgaagggtaaaatggctccgttcatcgctacactagcaaccatgaccattttcagaggattgacactcgtttataccaatggtaaccctattacaggactcggagacagtctggtatttcaattgttcggtcgtggctatcagttcggtattccggttccagcgattacgatgctcattacctttgctgtcctatggatcattttgcataaaacaccatttggacgtaaaacgtatgccattggtggtaacgagaaggcttcgattgtatctggtattaaagtaccgcgtgtaaaaatttggatttactctctggctggaatgctctctgcattggcgggagctatcttgacttcgcgtttgaactcggcgcaaccgacagcaggtacttcttatgaattggacgctattgcggctgtcgtattaggtggaacaagtctctcgggaggacgcggacgaatcgtaggtacgttaattggtgtgcttatcatcggtacactaaacaatggcttgaacttgctgggggttaactctttttatcaaatggtagtaaaagggatagtcatcgctattgctgtattgattgaccgtaaaaaatccgcataatacacctaatctgcgtagaaggagacacaaaaatatgaaaaagcttacattaatcatgactgcattgctgctcctgctcatgacagggtgttccttggaaccgcccgaatgggcaaaacctaaagcggccgcgaacctgaaggacatcaaaatcggcttgtcgatctcaacactgaataatccattcttcgtatctctcaaagacggagttgtggcagaggccaaaaaacaaggaatgcaggtcattgttgtggatgcacaaaatgattcggcgaaacaaagtaatgacgtggatgatctgattcaacagggagtaaacgcgttactcattaatccgacagattcgtcggccatctccactgtggtacaatcagcgaatgcattgaacatcccggttattacactggatcgttctgctgacaaaggcgatgtaaaagcactcgtcgcttcagacaacgtagagggaggacgaatggctgccagatatgtgattgatcaagttggaaaaggtgccaaggtgattgaactggaaggtgttccaggagcatccgctacccgtgaacgcggaaaaggctttcatgaagtagcagataaggatctgaaagtcattgccaaacaatcggccgattttgatcggaccaaaggtttgaatgtgatggaaaatctgctgcaaggcaacccggacgttcaggcagtatttgcccacaatgatgaaatggctttgggtgcgatcgaggcaatccaaagctcaggtaagaacattccagtcatcggttttgacggtaacgaggatgcgcttaaatcaattaaggaagggaaactgacagccaccgtagctcagcaacccgagcttattggtcaattggcggtacaggcagccaaggatgtacttcaaggtaaaaccgtgaaaacatcaattcccgctaagctggagttagtggatcaatcgaaataaaaagggcgcttgacccaacatattaagctattcggactgatgctgtaatgcgcatcagttctttttttggctattctacgatgacgatacatacacataaatggaagttttttatttttgtattgtaagaagagacggtaaaagatagaataacaattatatgataatgagaatcactatcatataatgaattgtatatatctaaggaggacgtatattgtgcaacaaaggtacagattaaaatgggaatccacgctttgtcttgtggttcttttgatgggtgtattgagtgcatgtggaaacgcagctagcaacaaccagacaaacgacaagaccagcattaatgatccttccgggcaatccaaaacggttgtcatgcgcgaatatactgatgccactggcaataagatcagtatccctgcaaatccacagcgagttgtcacgacacaatatttggatgctatgctggccttgggagttaagcctgcaggtgctgcttcccatttgttggaaggcgactatttaaaaggtaagattgacggagttgcggatattgggaacccgacaaatgtagaaaaggtgctggagttacaaccggacctgatcatcacaacagaatataccacgcccgaagtgaaggagcagctagagaaaattgctccaaccgtagtcgtttcgtttggagaaggcgatgtatttgagcaactgcggaatgtcgcagccgtgctgggtaaggacaaggaagccgagcagtggatcgctagtttcaacaaaaaggctgaggaaggtcgaaagaagctggttggaaaattcaaaaaagatgaaacggttacgatttatatggcctacgataagaatgtgttaagggtatacggagcgcggaatgtaggacatgttatttaccgttcactggaattgaatcctcctgagtacatacgccagaagctggcgaaggacccgagatttaattatgtttatgatgttatttcaatggaaaagttacctgaactgtcaggagaccgaattattatgctggtttatgatgaagcgagcaaggacggcatgcttaagcaaattgagcaaagtgcattgtggagaaatctcccggctgtcaaaaaccacaaagtgtatttcatcaaagccgatccgtggtttacctactcaccgctagccgttgaccaatcactcgatgaggctgttaaaatgttttccgttgatccgaagtgatcagttcaattgaaataagaaaggagaagtcataaccatgcttagacgattttttgaatactatcgtccttaccggactttgttcatcattgatttctcttgtgccttgctggctgcactgctggagttggcttttccgcttgcagtcaaccgggtggtcgatgatttgctgcccagcgggaactggaaatggattttatatgcctgtctagctctactcgggatttatgtcgtcagtgctgcgctgaactacgtggttacctattggggacacaagctgggcattaacatcgaatcggacatgcgtaaaaagctgtttgatcgggtacaaaagcaatcttttcgtttttttgacaataacaaaacagggcatctcgtgtcacgtatgaccaacgatctgatggatattggggaaattgcccaccacggacccgaagatttgttcatcgcgttgatgacactagggggagcctttggtatcatgctcggtattaactggaagctggctgtactgactttcatcattgtacccctcatgatttacttgtctctttatttcagccgtaaaatgtctgctgctttccatcgtatgttttctgatattgcggattataacgctcgtattgaaaataatgtaagcgggattcgtgttgttcaagcgttctccaacgaagcacatgaaatggaacggtttgctgaaaataatgggcgtttccgtaaaacgaagctgatcgcgtaccggattatggcctggaattcctcgattagttttatactaatgaagctggtttcattgtttgtgctagtatgtggaacatggtttgttattgaaggacagatgacctacggggaatttatcgcatttgtgatgctgtctaatgtattcctggggccgattaaacaaattaattctgtcatcgaaacgtatccgaaagggattgctggcttccgacggtacctggatttgctggaaagtgaatcggatgtagaagatctgcctggggccaaggcggttagccatcttaatggagatattcaatttgcaggtgtaacgtttggttacgaaaacaaagataaggtattacgcaaagtggacctatctatccatgcgggtgaaaccgtagcacttgtgggtccttcaggagcaggtaaaacgacactttgcagtttgttgcctcgcttctacgatgtcgaggaaggtagcattactattgatggaatggatatccgtgaaatgaagctggaatcgctgcgatccatgattggtatcgtacagcaggatgtattcctctttgatggaacgattcgtgaaaatattgcttacggtaagctggatgcttcggaagaagaaatctgggatgctgctcgtcgagctcagattgaagaccttgttcgctcatatccggatggtctggatacaatgatcggtgagcgaggtgtgaagctctctggtggtcaaaagcaacgtttgtctattgcacggatgttccttaaaaatccgccaattctcattttagatgaagcaacatcagcattggatacagagacagaagccgcgattcagcaagcgctgacagagctatcccaaggccgtacgacactcgttatcgcgcatcgtctggcaacgatcaaaaatgctgaccgcattatcgtagttgcagatcaagggattgccgagcaaggcagacatgaagagttattggcagtaaaaggggcatatagccgcctgcaccaagctcaatatggaacttaaataggccaatatgacaccataaatagagagaggaatgaacaggtttgacaaagaaaatgtggattgtaatgatgcttctgtcagtcattttagctcttaccgcctgtggtggaaatgtaaagcaaccggatgaaaagcagaatcaaacatctagcgaacaaaagtcagaggaaatgaaaacagtcaaaacgattcatggagatattaagattccggttcaccctcagcggattgtagtagatatgtaccagaatgatttattagcactaggaattaaacctgtaggaagtgttaaatattatctggataatccgttttcgaaggagcttgtgcagggcattgcaagcattggagaccgcagcagcgtatccattgagaaagtattggctctggagcctgatttgattctgattggttccaaagatgcttctgattatgaaaaatatagtaaagttgctccgaccctcgtcattccatatggaacgtacaagaatgtgcatgaggaactgacagcttttggtgaactgctcggaaaagaacaggaagccaaaacatggcttgcccaatacgatcagcggatgcaggctgcacgtgacaagctaaagggaattgttcagcctggagatactttcaccgtaatggaagcttcggataaagaatactatgtatatggcgataattttggcagaggaggacaggcggtatacaaaggactgaatttgtctcctccgccgcttgtccaaaaagaattatttggtgagactcaatggaaatcggtgtcaaaagaagtcattaatcaatatgctggctcttatatctttctgacggttaacaaggatttgagcggttacgaaggagacagcatatggaaatcactgaatgcagtccggcaaggtaaggtttttgagctccaggaggatcgatattggtacttcgatcccattgccattgtagggcaagctgaagaaatcgcagatttgatcgtccagcagaataaagagaacgccacacagaagtagtcgcttcggtgttgttggcagccctttggtatttataccgaagggctttatttgttcacaatagggcagagtattaggcattcctcgaaatttgctattgatgccgttgccacattaatttacaatagtaaagattgcatgataataattctcattatcaacatcatcttcaacacagttcgtgatagctacatactattcaacagtaagggtgaacaatagttatgaaattatcagaatcatcggatagccccgctcaaagtaatcataaccagtcgccgactcaattccactcgcgaccttgggcggcttcgcttatcctgacagttgggcttggacttttagcgttcggtatcgcgctatccctatcttttggtgcagcctcaattaggctggaagaggtatggaacgctgttttccattttaatcctgaattgcaaaatcatcaaattatttgggaaatccgtctacctcggattctgggtggggttttaatcggaatttgctttgctgttgcaggtgcaattatgcaaggaatgacccgaaatccgcttgctgactcgggcttgcttggactgaactcgggagccagcttggcgatggcgatttgctttgccctttttcctggctcttcctttttacagttaatgttgtattcctttgttggtgcagctctggctgttgtgatggtatatggtacaagctccatatccaaatcaggtcttacgccagttcgtcttgtattggcgggtgcagctgtcacggcattgctgtctgccttaggagatgcgatcagtttgtactttgatgttggacaggatttggccttttggtatgccggagggcttagtggaaccaagtgggttcagctcggtatagttttgccttgggttgtggcagcttttatcggtgctctcatgttgtcgcgctccattacgctgctcagtttgggagacgaaattgcgttgagccttggtcagcgaactggggtggtaaaggtagttggaatgattcttgttctgattttggcgggtgcagcggtgtcgttggtgggttctataggtttcgtgggattgattattccccatataacccgcaagctggttggcgtcgattatcgctggattattccatgctcggccattatgggagctttactcattgtgtttgccgatctggcagcccgtatgattaacgcacctgaggaaacaccggtgggcgtacttattgccttaattggggttccgttcttcctttatctggcacgtaaagaaaggagggcactgtaagatgaataacgttacgaatggggctattgccaaagctagtcatcgtaaaaaaatccatgattggatggttgtattcattctgctcgtattgctcattgctgcgtttaccataagtgcgaatacgggaaccatccggctttcgccaatggagctatttagaaccttgtttggacaagggactccacagcaggaattaatcctatttgaattccgattgccacgaatggttatttcccttcttatcggtgcaggtctcgctgtttctggctgcatcatgcagggggtttcgcgtaacggtctagcggaccctggtattctaggcattaatgcaggcgccgggttgatggtcatgctgtttgtattgctttttccatctatgcaaactacgaattcattgtttttacttcccgctcttgcactgattggatcaggagcagctgctattctcatctacgcgctttcttacaagaaaggtgaaggaatttctccgacaagactactgctgagcggaattggcgtagcggcgggtatcagtgctgcgatgatcattatgactcttaagctgacacccgaaagttacacgtttgtagctaattggttagcaggaagcatctggggctcaaactggaaattcgtgatggctctgttgccttggctgattgtattgcttcctttcgcatactacaaagcaaatgtgatgaatgtgcttaatctgggggatcagacggcatcggggttgggtacacctatcgaaaaggaacgtattctccttctcgctgctgcggttggattggccagttctagtgtttcggttagtggcggtatcggctttgtcggtttggtggctccacatttggcgagaaagctggtggggccgaagcataaaatgctgctggtaacctgtgctttagtcggagcactcctggtacttgtagcggatacgatcacacgatccttacctttacagaaagaaatcccgacaggtttaattgtagccatcattggtgcgccatacttcttatacctgttgagtcgctccaaagggtaacgtcacgaaagagtaccacctgtcaattaaaggctacgcaaacaaataaccttcaacaccactaaggaagtggggctgaaggttatttgtttcatttaatttagcagcctttcatctcaacgggaagtattcaaggcatgagaggtttgatgcagctctctgatcattttatgcaacgtgtaattttcctgacgtgtcacgccgtgttgattttcctgaaccagcaactgatggatgtttcgttttagaatttcacttcgacgttccagcatttcggtactcataaataaatgaacactccctttgtcatgaataaacctacatttttgaaatgagcataggctgaatttaagtttgcctttcgacttctttaagtatatcgtgctggatgatcaagggaaaacggagcgagacagcaaattgctttttctcatcatccatgccgtgtcgacagcgactcaccccatgagttcttagatatacttcctgatgctagcgataacaggggattaggcgtaattaacttcatgtatataatttgactagctcatgtatagatgaacccgaacagttaaagcgaatgtatatggaatcacttatcagtttgctgaaagctatgggggggagcaactagaactgcaaagttgtattcaatgcaatcattggtttattccatattagcgagctcagttaaccaaattttgcagttctaaatgtcggagtcattacaactacctaatgaaaagaaaagattaagaggctataacatttttgaagtggggagatacaataatgattatttaaaaatcgaatgaagaaattgagattatggggggagctggccgaattacgactattctgccagtccgcaccacttgcctttgaggccgaacttttcaagtcgtgtgttgtacgccgtagacgtatactggaagccgtgatccgaatgaagcacggctccggatacgtctattttgtgtgcattcataataccaatttcttcataccccggaccgaaaagatccggaatggtggagaaatagctgctttatcaacattatttgtattgtggatataccggctgaacgactacctgctcaggatcatgaccgaagaacaacagattcggcttaacctcctgcacaatctgctgaatgcgggcgattgactggcgtgcctgttcacggttaaaaccgtcaaacggcacgtcgtttgcgtaattctcctgcgtgtaggcaacatcaatcgtcagcatgaccggacccgattcctttgttgtgaccagcgcggactgatgacccggcgaatgccccggagtatagaacagttgcaaacctggaaccagctcatgatccccttgaagcagtcgataattcaagtccgcctgcacgcattccggtggcgcatactccagattaccgatcgcagcgtctgcttcggtctgctgcacataaatcggtgtattcggaaaatgcggattgcctccggcatgatccatatgcatatgagagattacgatggcatggatatcgtccgggtgatagccgatccgatccagtacagccacgatactatcatcggctgacatatggggaatgaagcgcccttcaaacggtgtgcttttaaaataatttggattgtcgataaacgaatccggcataccggtatcaatgagaatcggaccgtgatctgtctccagtagatacgaccagatttgcaggcgcaccagtgccccgggctgtgcatgatggttgagtgaggagcgatcaatatcaagctgaccgatcggtaaccagtacaatttgttaatcatacaatcatcctccaatcgtagtttacataataattattatgtagttattaatcgaggtttcggctgacggaaagtgatgtttgtattttcgtttgtaagctccgggtgctgaagcctcgtgctgtcgttgtaatctcactctttcgaaaattaattttttaatagtttaaatgaaaaggcatgtaggcgtccagcagaaatttgccgtcaggcaggccagttcatgcttttcctgtgaacaagactgtttatacgctctgctcgaaatttacccagaagctggttcacacggtcattatctcgaaataagactattggctatttagttttgttttggatatgaataaattacattaggtgaacttttcttgagcgtgttttaatttgtctacattgtgggaacgcccccctctgaccctatgccacgccgttaagtgctttgaaatgtctgcttgaaggcgatactaggctggacaagaggaaaaacgctctatttgcccttgaaaagcgctaaaaaaacagcgtataatataaattatacgctgtttaggtttaaaacgacttttagaatccctcctgcataagatgtcgattggattgtcgataaaaatcagacgaaaatgatcgttttacagtatatttcggaatatgaactgaattggaggcgagcgagatgaaaaaagagatgcgacatgtggaactcgatacaactgaagaaattgatgaaatatatactgaggagctggaagcttttttgatctggatgaaggatgcaggatatacgatacatacgcaaaaaaattatatgggggatgtgaagcagtttttacggacgttgcgtgaaaaaccactcgatcaggtgaagaagattcatgttatgtcgtatttgtctaaagcgcgggagggaggcgccggcgatagtacgcggaaccggaagcatgcagcggtgaacagtttctttaaagcgctacaggaatttgagttatgcagcacaaatccggcagcgggaattaaaaaagcaaagactgaaaagaatcgtatgcccgtctatctggatgaaaaggatattcatccgtttttgctcgcagtggaggggaaatatgcaaatcgtaatatagctatttttctgctgatggtctacatgggattgcgggtgggggaggttcattcattgaatgtctcggattacagccgagaaagacgtaccttagatgtgttcggtaaaggacgtaagtggcgtactctcccggtaccagaagccgtgtgtgattttgtagagcatgcgttggaggaaagattgacgccgtggagaggtaaagaggatgcgatgttcgtatcccaaaaaggccgccgtctggcagtgcgcaccattcaacagatcgctacagaaacgttcgaacgattccagcaagataagagtatggaacgccgggaggcatattccagccataagctgagacatacatttgcgacaatgctattacgtaagggagcagatctgcgtaccgtgcaggagctactggggcattcatccattcagacaaccacagtatatacacatgtcactgatcgggaaaaagaaaaagcaatggataagctggatattcagataccaatatcaggattgtgagtatatgttggaaaattgagattaaacaaaaaaagagtttacataattattattatgtaaactcttaatgaggagtcatatcccgactcgcaaataaaatcaacgactttgtctcatcaatattgtgaacgttgtgaacttgtgagagaaccccacattagaacttgacctggaacgcgtttcataagctaggttaaatgtataagcttttaatccactcttgttagaaaataaactcagattctagtgtatattggaggattttatatatgtttaaactggtagtaagtttggcgagcacggaaaagggatctggatcttaggggacagtgctacgcggattaaaaggatggagtcgtcgtcaaagagtttacgattgaacacaatctagcattacaagagatatcgaaagtttttctaatgattttattatcatagcatgtacaacggaagcagcatttgttcattctcatattcaagacgaatactataaaattgtgaaaggctcgtataaagaagtggttaagattgattcatttgatcaaatcaaaattagctttcttaaaataactgtatatgatccagctggaagaagtcccttattaagaaaacatgttgaaaagactctactgggtcaaatttatatcgttgattctgaagcaaattggctggatattacagcacttcatacccataaaggggagacggtaagaaaactccaagagatattagggattactgaggatgagaaccccaaattgcatcatgaaaggactatacgtagcatgaaaaataaaatactggtttttgatattggtggctcttttattaaatttagtttgtattttcaaggtgagtttatgtgtaaggggaaagttaaaactccattggactcacttgagaatctacttgtagctttgaagcaaattcataatcagtttatagatgaatgtgaaggtatagctgtcagcatgccaggtattgtggattcagcaagtggccatatggtgcatggtggttcattacgatatataaatgatataaatatgatcgaagtttttaagaaagcgtttcatttacccgtagcaattgaaaatgatggaaaatgcgctgctctgggagaagcatggtgtggttcattacagggaatcgctgatggtgttgttctggtcgttggaaccggaatgggcggtggaatcatctctcaaggtaaattgctgaaaggccatcatttatcggctggggaattctccttcatcagaactaacaatgagtatgcagacaatgttgattatttgcttggtatgcaagggagtagttctgtattatctaaaactgttgccaaagctaaagggcttcctgcagattctatgacaggtgaaaaagtattcaagctcattgaagaaggtgatcacacggtccaagcgatttttcacgaatactgtaggaacatcgcaacacaaattattaatttgcaaacgattcttgaccctgaaaagtttgtaattgggggaggcatatctgcaaatcctttgctggttattactattaaagaagaactagagcaactttatctagagtcgatcttaaattttgtgcgtgcagatattgagcaaagtaaattaggcaatgaagcgaatttgctaggtgctatatataactacaaacaaacctatcatcttgattgataacaaaagttatatttcgatgtctgatttatcttgtcctgtctataaggaagcatatagtttacataatatatattatgtttttagtgtggtgaaatctgcaagtgaatcactcttatcaagtgtccacttgcagattcaagtttcactgacaatataaaatagcttatttttcagttgagaatatacgcatgcgtctatatttcattttccgggggagattcaatcatcagtccttcgacatgcttacgtcccagcagttttcgttttttgcggttttccttggtttctaaaacaatatccagatcatagtcgtcaggatacaattcagtagcagcgatgtgaaggacgagcctctttttgttcatggttagcttctgtccatggatcaaaatcccgacattaccccgttcatcctcggttttgtatacaattccagttcgatccagatagcctacataaacactatcgccaagggcaaaaggcttggttttgagaggaatttcttgtttaccccgttttgtgactgtctggtctaaagcctcttttttagggaaaggcttatttgcatcatcagacttttcattatctacagaagggggaataacaaacgattcctgtgtattccgagacgctctgcctgcagaaatggcctcagaacgctcgataatacgtgtccacatgcccagcttcaaggcaattgcatatgcatagctttctccggcctctccaatgcgaagtcggtacaaaggttgtagcgtttcggtatcaaactccatacgagcattctgaaatcccggtgtgttttcagcaaaatgcttgatttcgctaaagtgcgttgtagccactactgtcgctcggcggcgatggaattcttctagcaatgcgatagagaggcctactccttctcctggatcggtgccggatgccatttcatcaatcagaatcagagtagagttgcctgttgtttctaaaatgctaatcatgttgcggatgtgtgcagaaaaggtgctcaaagcatgttcaatgctttgtccatccccgatatctaccacaatttcctcgaatacagccattcggctaccatgcaaaacaggtaccagtagtccagattgcaccattagtgttaatagaccgacgcttttaagggccatcgtttttccgcctgtgttcggtccagtgatgatgagtgaggaatatccttcaccaattgagaaatcaagcggcaccatagtattggacatcaatgggtgacgtgcaccttggatgtctataatcccgtcaaggttaagttcgacagggacagcatccagagtcatggcgtatttggcttttgccaataaaaaatccagtacacctacagtctctgtattgatgcttagttcccggttgtatgactcagccattgccgtcaggtctcccagcactttcatttcttctttagattcttctgccatgtttgcgctctgatcgaattgcagattcgtgatttcggcaggttcaacgtaaaccgtctgaccacttcccgattcatccagtacattgcctttcacttgtttacggaattcttttttgattggaagcacgtaacggccattgcgctgactaatcatattttcctgcataatggatcggtgacggcttgtgagagagtcaagttttctcttgatgcgttcttcagtaaccgcaatttttttgcgaattttagctagttctttactggcgatatccgtcacacgtcccgaatgaatacatctttcgatttcggatagaagtggctccatgctatacatggaagatgcataagcgctgacggttggagcagcgtccgccttggaatgcatatattttatgagttgaatgcagcttcgaatgaattgagccatatgagaaaaatcacgctcgctgaacatatacccggttccgagcagttgaagaatgtgctccattccttccaacgaaggaacagggacgcttgctccgtggcgaatgatctgtaacgcttcgttggtttcgtcaagacgaatcttaatggtacggatatcagtaattgggcacatagaagcagcgtgatgcttacctaggtaagaaaaagcacattcggaaactcttgttttaatttgatcatattccaaacgcagcattgtagtttcgttcatgaataaatctctcctttagttgtgtagtcaggattttggaaaacttgctattaaaataaaaaagggcggagaatgaacaaaacgttcattctccgcccttaaggaaagagggaatttatcaacaaataagcctgtaatacagcttttgtagttccgagttccgtgtttccaattcattcacgcaacagctctttgctaagctatttggatcgaatggaaacgttaaaagggaagttacaaaatctgaaaacaaaaaaacgtgctgaacacagcacggaataaggcctggatgaagataatcccgaaggcgatttatgatatccgcatgttcttaactaatatcaggataacaacacagcaagaaacaaacctgtccccgaagggtgcaagcgcctggtgttactccctgaatatgcaattgcttagttaagaacgttcaccgacatcaaaatctctcccttaattgaagatataaccatactatacgattggacaggcgttgaagtcaaggccgacttctttaattcgatacatgaggatcataagattaacataatgtatattatgtatacccagtatcaatgttttttaaatgagaatgatgatcattataattgtaatcaagagcatgaagaatgagagtcataatccgtatgaaatcatgatacaaacattaagaaaccgccccggaggatgccatatcatatctccaggggcggtttcttgtgctgttattcagaatcatcggctatgacagcttgtacaggctgcctgtcacgaagcaatggtaacaacagcatcgctccgaccaaaaacaaaccggcgctcacggttatatacagtgttcagggaggattcgtgtttgagtgttccgccgatactcataccgacgaccatcatcccggagaacagaggagagagggcaccaccgacgcggccgataaaagcagcttcggcatttttcatcatcatcgtgttgataccgatatgaatgcaagaataaaataggccgctgaaaacttgtagtgccatagtcaacacaatattgtgcgaccatccgacaccacaggttgtcagtgtgctgaccaagagtcaggctaccagcagcaattgcggctgtacttttttggcaacccccataatcaggccgcctcccaccagcatagccgctccgttcgccattaatggccattgcaggaattccttgttttgtccaaggttctcgatggcgacaaaaatcattaatggttgaataagtccaaccgccagcccaattacggtaaatgttcccccaagcgtgcgaagtgtgcggttattccatacataatgtattccttgtttaagctcttgaatgaaatgagtgggttgatcatctatctcaagtgcttgttcatcttggggaatacgagtcagaacaagcgccgagatgagaaacaatattccggttatagacattgaaatgaaaattccaaagtgttgataaataaatgtaccgataactggaccgataaccataaataatgccatgagatattgaaaaagggccatcactccctgaagctggtctggtgctacatgctgcttaaatatcttcattgcagacggctgagaaaattgagatagaatggccgaaaagaaagtagacagcaaaagcatctgccatgacccgtaccataatgccaacaagacaataaaaatagaggccgcggatagcaaatcgcaactaatcatagtccgtttgggccgccaacggtccgcaaatgttcctccaatgatagcgaacagaaaaataggcatgaattcagcaaccgaaatgagcgatacgtagacgggatcattatgagtcaaatctgttacatacaacagtatggcaaagttgcgcacccaaatgcccaaatttagcagcgcattggaggcgataatagtccttatatatggatttttaaacaactacaaactctcctttcctgttttcaaggcgcaaccccttggtatatcgttttatataaacaaaatttatttttgtctatataataatagataatataataaattaactaatgtttagtcaaatgtttttttgaaaccaagaagaaagtagagcatggaaataaagaggccaatgatccttaaggacgggaataggactctgaatccgatgtaccttttaaaatcatagtgatataattacgcgtacatgcctgaaaaggagcgaatggaacataaatgaactttcaagtggattttttatctttttttgtaattcaggtagatggaaaagaaggacagggtggtaagtcctataagcattacgctacaatggacgactacgattatgacgaaagcgatgttaaaaaatttttggacggggaatttactcgtattagcaagcggaaggttgaaaaaaatcccagcacagagcaggcaccgaccaaaatcggccgctttatcgtcgaaccggagcatgaattgagcagtaatccgaatttcaatatgttcgcccgactgcgggcagcagaggataaggaagattttaaaaatgcttgtgacgatctggtgcggatgtatctggatacgagcgcagtacgcggcggagcgctgatcattgtacaggctaccttgaatacacactcggatgatccgtttatttttgtgcttaaatgtgattttgaacccaaaattgccagaattactgaaagcagtctggtgagtgaggtcgaaatggctatttctgcccgtaatatgaaatccatcatgtatccttacatgcttgaggaggggatgaacgatgagtgggagcttaaaattcaccagtcttcgcatgcccgatattttgaagattttttgaaattcgtgacctatgagcaatccatgcccgaaattgtcaatgagcatgtcatgggcttcgttcagaactatgtagaaaccaaatggccggatgcatctaatgaggaaagacaacaggaagagcgtgatctggaattgtgggcggctagcgaaaaacgggatttgcaagggaaatgggaaccccttcaggtcgtagaggctgcacagcatattgtcgagctgaaaccagaaattgaagttcgtttcaaactagatgatacggccgtgcgtgggctactgtccgactttggcgccaagctgcacatcacgaaacttcatgatagatatgcacttattattgaaggcgatgcatttacgtttgaaaagggattttcaccgattgagctgctccaacctgaatcgtttgaaacggtggctgagcggctaaaagagaaacgccagcatgaaaatgaggatggcgatacgccaccttggtaattcgaatgcaaagcaagacgaccaattgaacttttacattataatgactaaaataactggcctctcaacggatattaccgctgtggaggccagttttgtttagcttttatgttcccaatctacatatgaactttgctaatttgatctttcagcttgtccgcagattgaagcaacctggcacgttcctcgtcattgagcggaagatccaaaatttcacgtaccccattgtgatctacgatacttggaacacctaaatatacgtcagatactccgttataatcttccagcaaggtggacacattaagtaccgacccctcgtccccgagaatggcggctacgattcggtcgagagccagcccaatagcataagaagttgcgcctttagcatctataatttcataggcagcattcttggtattttcaaaaatttcatttttcgtttcttcacccagttccagcggagttccagctacgttggctgtgctccatacaggtaactcagagtcaccatgttctccaataatatgggcgtggatgcttcgtggatcgatgcccttttgctttccgattagatagcggaagcgtgcgctgtccagcaacgttcctgatccaatgactctgcttgaaggccaaccactgcgtttccaagagatgtaggagagaatgtccactggattggttgcgatcagcaaaatgccatgtgtattgaccttgacgatattatcaataatactttcaaaaatttcggcattacgcttcagtaaatcaatgcgcgtttctcccggcttttgtgaagcgcctgctgtaacaataatgatatctgcatcacggcagtcttcataatcacctgcccacactttgacaccaccgagaaagggaagcccatgattcatatcgagcatttcccccttcgcctttttgacgttgacatcaataaagacaagttctgacatgcgttggcgcagcagtagggtatagccggttgttgtgccaaccgctcccatgccgacaatagccactctacttcgtttgtaaggttttaagctcataaaatcctcatctccttctcgggttgtataccttttcattttgggatattacttaaaaatttatctttccaactcagtgtaccctatatactaacccaccgcaaagaaatatgacatttttccttgacttcaaaggcgagctcgctaataattaatcgaatgataagaacacgcactaaagcgttgcagcaccgatattgacgcatgaaattatggaaagaggattcggcatatggacttatttcgaaaaaaaacaggactgctcccgcatgaggaaagcggatctacaggtcgcttaaagagaacaatgggtgcctttgatctcaccatgctaggtgtaggatgtattatcggtaccgggatttttgttattactggcaaggcagcagcagaaaatgcaggtcctggcttgatgctctcctttgttattgcaggtattgcctgcgtactagcagctttgtgctatgcggagctttcatctacagttcccgcagctgggagcgcttatgcgtatagttatattgtatttggagaaattttggcctgggtactggggtgggacctaattctggaatatggagtggcggccgcctctgtgagtagtggatggtctgcttactttcaaggcttgctggctggatttgatgtacatttaccgctggctttaaccgcagccttcgattcgaccaaggggaccattattgatctaccagccgtgtgcatcattatgctcatcacattgttactgagtctcggagccaaggagacggtccgattcaatttaataatggtttgtgttaaagtcggagttgtattgctatttattgggatcggtatcttttatgttaagcctgacaactggacaccatttttgccttatggattttctggtgttttgagtgctgcggcaatcgtattttttgcttatttgggtttcgacgccatctcaactgcagccgaagaggttcgcaatccgcaacggaatatgcccatcggtattatttcttctctagcgatctgcacagtactgtatattgcggtttcagttgtgctaacgggaatggtaccttatacgcagttgggggtaagtgatcctgttgcgtttgctctccgctttattcatcaggatttcgtagccggattgatttcagtcggtgcgattgcggggatgacgaccgttttattggtgctcttgtatggtcaaacgcggttaattttctccatgtcacgtgatggcctcttacccgtttttttatctaaaataaatgctaaaactcaaacgccaattcgaagcacttggctggtgggcagcattatcgcattggctagtggattgttcccgttacatgcactgaccaatctgacgagtattggaaccctattcgcttttgctgtggtatcggtaggagttatcgttctgcgcaagaaacgccctgatttgaaaagaggctttaccgtgccgtgggttccgttgctcccacttttaagtgctttggtttgcatcggtctgatgcttcagcttcatattagcacctggattggattcattgtgtggctcctgcttggattattgatctatttcttctatggataccacaaaagtttgttaaaccgtaaatcttaataaattctagtataaaaagagccggcatcctgcacttttgtggagggtccggttttttttgacattacgcgaaaagtgtcacatagagtcgtttatggtataattctgtttcagataagcttttggcacgtgattacagcatgccatcgagggaggattttatatgaaactgcgctggcgtgcgctcttggggggagtactgctgctgacgggcattctactgactgcctgttctgctgaagccccagatacgttaactaaacctccgattgaggaacctgatgaccagggtcagacaattacaattaatccaccagtgactccaaaggtgggcgatcccaacgccaaatatgtagtacagacgcgaatagcggattttcatttaattgataacaataaagggttagtttggggggttacccataatgagctccggctttatgatactcatgatggcggaaagacatggaataatatttccccctccgaaaacgtccaatttcaagacaagcttgaatatggaaaggacatcagtttcactgattctcgtcacggttgggttgtccgtcaaaatttggacaaaacagcaaccgtcattctgagaacagcagatggaggacagagctgggatgtttcagcgcttccaagcggggaccatgtgagctcgattcaatatgtaaatccaactactggctggatcatggcatatgtaaatctgaatgagcaggatcaacaaaaactgttgtatcacaccactgacgggggagccacatggaataaagttgcgcaaagttcgggtatgacatccaacaaatcaggctcaggtttacccgatcggggcagcctggcggggatgagcttttcttccaacaatcaggggtttgtagcgatcaatctagataacagtgttaagttgtacaagactttgaatcaagggaaaacctggactccggtagctaacagaatacagggctgccctcaggccaaagcagaagcccagcagtctctgaaagggagcagtgcctcgtactggattccggttctttgctatggggataaggccataaaatataacggactgtttacaaacgatacagggacacaatggaacggtgtgcctttgggtctgagtagcaacattaattctattatccctggccgtacgtttctaaatgaaaaggaagggtggatcataaccgagaccggaatgagccgtacaatggatggggggaagacgtggacaagtctcacaggcaacaaagtgctacctttgaagttaaaagactacccacgatcggttaagctccgtttcgcttcttcttcggtgggttggcttcttttggaacgccttgatgacaagaagtcactgctgctgaaaacgacggacggcggtgcgaactggagaattttataatcgctataaaggtgatttccctgggtgtttttcccagggcgttttatttttaaaaaatttaaattttatacgactatatgtgaaaaaaatcacaaactaacaaataagccgctgttatactaaacctgtaaacaacgataggagtgataatcatgagagcgaatcaggatcatatgttaacccaatactaccttcaattttgttatacttgccaggatgcctatggttgcacgactgaagaggactgcaagcagtgtgcagagcgttacgctgaagacgaaaatcatgaagttctggatgaaacacaacgttatctccagcttgtacatgtgtaaatcgatgcatcattctgatatcgccatatcttgagccctcccggataattccgtgggggctcttggcgttcttaagggttgctatcaaatttgggcaggaacatacatatactgttatagaaagcttaggtcaggtcaggatgcccggtagtttccctgtgaaatgcctggcggagaggagtgcggtgcatgggttttgagtcattatggatgttcgattggctgggcacggtactgcccgtatttttcgttgtcgtgttgggtattgtcgtgttgtctgcaggcagggaagtcatggaatggagtcggaataaaaggcagcctgtattgacggtcggttcccgaattacagccagaaggacacatctccaacagaggcgacaggaggaacaagggactcgtacctatactttctattacgtaaccttcgaggtggaaagtggcgaccggatggagtttaaggtatctggggaagaatatggtcaatgcgctgaaggggatgagggacggcttacttttcagggtacaaggtatatcgggtttcagcgacttaatcgctatagcttggaacaggttaaaatgtagaattcagtctaattattttttggattcatttacagccttctgcgagatgccagggtagggggctgtagatgtttcttgtacagccaaatttggtacatatatactagaacagagtagttcagaggaggaatgatttgtgtcatttgagggacaagttgttattgtaacaggagcggcgcacggcatcgggagagagatcgcttttgcctacgctgctcagggtgcccatgttgtatttgccgactacaatgaggaggagggtgccgcagccgctgcagcggcccggaacgagggctatcaggccatttttattccttgtgatgtgcggaaggaagaggatattgtagcgctaatccgtgccacggaagaagaatacggtacgattcatacgctaattaacaacgctggcgtgtccaaatggaaatctccttatgagttaacgatagcagaatgggatgacattctgaatacaaacgtacgcagctgttttattgctactagggaagcggctaaggtgatgaaacgaaacgcagaaggtggctccgtggtcaatatgacctctacacgagctttcatgtcagagccggatacagaagcctacgcggcatccaaaggagccattgtggcccttacacacgcgatggccatatcgctaggaaaggaccggattcaggtcaattgcatcagtccagggtggattgaaaccggggattatgagcaactgcgtgcagaagaccatcaacagcatccgtctgggcgagtaggaacccctaaggacatcgcacgggcttgtctgtatttgacacaacccggcaatgattttgtaacaggcacgaatctggtagtagatggtggcatgacgcgtaaaatgatttatgagccataataaaagcctgaatgagtagtcccagtcttggggctatttttttatttttctggactgtcacccattgggcatttgtaccatacgatagggtatgtgatggagaagcgaggaggggacgcggtggctgtaatcaagaccaactcagaagatgtaaggaccctcgcccggctgatgcgggctgaggctgaaggtgaaggcgagatgggtatgctcatggttggcaatgtcggtgtgaaccgaattttatccaattgcctagatttccgggggatacgtcttatgaatgacatggtgtttcaaagccccggaggttttgaagccactcagaaggggtatttttatcagaaagcccgtgatcgggacattcgacttgcccagcgtgtaatcaatggagaaaagctacatccggcatccaatgcattatggttttttagaccagcaggaaactgtccgggcacttggtatgaccagaccaataccggacgttttaaagcccactgcttttttagcccgtctgtacaggattgtcctaatgtatattagacactttacagaatggcttgaagaattaaattaaaaccattttaggaggaatttacatgatttcacagcaagcttaccgtcccgtatcttatgcttccggcaacggatatcccgaatggccaagagggatggctccaatgggaaccatgcagccgcagcctatgactggctttccacctcaagtaagtagtggcagccctatgacaccaacgggtaccgtagtgcaggttcagactccgcaatacgagcaatcatacatcgaaaatattttacgcttgaacttaggcaaaacgggaaccttttatatgacctatgaaaataaccgggaatggaatgcgaaaatattcaaaggcattctggaagcagcaggtcgggatcacattattattagtgatccggcgacaggcaaacggaccattctgctgatgctaaacctggactatgcaacgtttgatgagccattgttgtaccaatatcccggcgtcatcgggaatccgggtgcatccccggttcgctgatgccttcatatatatgagtctacatcctctgccagacggcaggggatgtattttgtttataatctttctcaaatatagtagctttcttgatggtaagcggcgaaaacgagagctttatgacctaaatgataggggggctgttttttctgacattgcttgtggtttgactgtatagagtatagttatataattaaatataagctgatgaatgatctaatcatttatgcggaatatggctttagaagccggaaggagtgaatgtgttgggaagttgacgctgcttatgatgtgttatcgttctgtctatgatgaaactatccgaaggaggtgcgcctgtctgccgtaatgacggctgatggggagcatattgagtgaccctttaccgagtatgtttaacttatttattgtttttgcattagtactattgaatggtttttttgtatctgcggaatttgccatggtgaaggtcagaggcagccgtattgaaacattggtggaagcgggcaataaaaaggccgtgtacgccgccaatatgttacacaacttggacgcttatttgtctgcctgccagttgggtattacactagcatcgttgggactaggatggatcggagagccggccatcgcacatttgatcgaacctgtatttacagccgctggattaggagcggtatatgtgcacggtactgccgtggttattgcatttattgttattacgattctgcatattgtgttgggtgaattggcgcccaaaacgatagctattcgtaaatctgagaccattacgctgtattcagccatgctgatgacttggttttacaagttgatgtatccattcatatgggcgttaaatggaatggcgaacagcctgctgcgtttattccgtctggagccggtatctgaaaatgacgattccgcgcataccggagatgaaatacgcattctgatgaaagaaagcaataagagcggactaattgataatacggaattggcgcttgttgataatatatttgattttaccgacacgaccgccagggaaatcatgattccgcgaactgagatgatctgcttatacagtaatgagtccacagaagaaaatctcgcgattgcgacggaaagcatgagaacccgttatccaatctgcgccgaagataaggaccatattatcggctttatccatattaaggaccttctacgggcgaacacactggatacccgtacgatgattcgaccgattcttgctgtcccggaatctacgcaaattagtgatctgctcaaacgcatgcagcgcagcaagacgcaaatcgccattttgattgatgaatatggcgggacatcgggtatggtaacactggaagatattatggaagaaatcgttggtgaaattcaggatgagttcgatcaggaacgtccgagttgtgagcagattaatgacgaggaattttccattgacggcatgttattaattgatgaagtgaacgatcgctttggactggatctggatcatgaggattatgatacggtagggggctggctatactcacatgtcgaggttattcctccacagcctggccagactgtagtgtttgagggatgtatgttcacggtagaagaagttgaaaacaagcggatttcacgtattcggctgacaaaacagcctattatcttggaagaagcaggagtctcataacggaatacggaataaatcttgagagcgaccttgaacgatgtggggtcgctttttaatttgcctcctttacagaaaggacatgaattgatatgatgttcgtgttattgtcaacctaaacacaatcgcttgggttgacaataaaaaagaacttcctctacgttgaaaatcttatccatttacatgatcattaaattttgggaggcaagaagtatgaatttactaaacgaggttatagattggggcttgttggctgaaaaagcgatccaaggcagccgtatatcgctggaagaaggtatggaggtactggaagccgacgatgaggaattattaccaattatgcaagctgcatttcaggtgcgacatcacttttatgaaaaaaaagtaaagctcaacatgatcatcaatgccaaaagtggcctgtgcccggaggattgcggttattgctcacaatctatcgtatccacggcgcctgtgagcaagtacagtatgctggacaaggaatcactgttggctggagctagggaagcagtagcgcggagagcagggacgtattgcatcgtagcttccggcaaaggtccaacagatcgagagctggatcaggtgattgaggcagtacaagaaattaatcgcacgatgccgctcaaaatttgcgcctgcttagggattctcaagggagatcaggcacggcggttggcagaggctggggtacatcgatacaatcataatttaaatacaagtaaggccaactatccttcgattacaaccacacatacatacgatcaacgcgtcgaaactgtgaaaatggctcaatctcacggaatgtctccatgctctggcgttattatcgggatgggggaaacgaatgaggaaatcgtacaaatggcttatgccttacgggagttagatgctgactctattccggttaactttttgaatccagtccctggaaccccgttggaaggagcaaagcgaatatcacctatccaagctttgaaggtgctggcactgttccgcttcatctgtccatccaaagaaatacgcgttgcaggtggacgagagttgaatttacgctcattacaaccgctatgcctgtatgcagcgaattcaatttttgtaggagattatttaacgacagaaggccaggaggtcacatttgatcatcaaatgattgaagatcttggtttcgaaattgagatgtgtgccctttcaaccgtataatagaaattgtacaaacttggaagggagagttaaacgatgagcgaaaaagtatttattagtccaggtaaatatgtgcaagggaaaaatgtgattgataaaacaggtgagtatgttaagccattaggtcatactgccttggttattgcggacaaactcgtttgggagattgcagccgaccgcgtagtaaaaagtctggaacaggctgatattacggcggttaaaatggagtttcaaggggaagcatcgaaaaatgaagtcaaccgtattgcggatcagggacgaagcgcccaggtcgatattgtcattggtgtaggtggtggtaaaacgctggatacggccaaagccgttaatgaactactcggttcctcagttgtgattattccaacgactgcttctacagatgcccctactagtgcactatctgttttgtacaccgatgagggtgcatttgatacgtatacctttttcagtaaaaatccgagcctgatcctggtggacacgaaagtcatttctcaagcgccgcccttgttcctctcttcaggcatcgcagatgccatggcaacgtggattgaggtccgtgcggtcattgaagctcgcgcaacgacaatggctggtggtttgccaaccttggcggcagaagccattgcgtccaagtgtgaggaagttcttttcgattacggtctgcaggcttatgaatccgtgaaacgcaaagtcgtcacacctgcgcttgaagccgtagtcgaagccaatacgttgctaagcggtttgggctttgaaagcggcggtttggcaggcgcccatgcgattcacaatggttttaccgttctggaaggggatattcatcacctgacacatggtcagaaggtagcttttggcaccttagtccagcttgctttggaaaaaagacctttgtccgaggtggagcggtatattgacttttatctaaaactcgatctgcctgtcacgctcgaagacattaagctacaggaagcttcccgagaggatttgtaccgggtagctcaggctgctactaaagaaggcgaaactgctcacaatctaccatttgctgtcacagcggatgatgtgcttgatgcgattttagcggctgaccaatattcacttgcctacaaggctaaaattggacataaaagctaacttcatacgaaataaagtagattcaaaggtcgctgatcagcgaccttttttctattttttaacttgcaacttatgttataaggtgtatatcttgggcagcatgttttacgtgaaatcatctttatccatgcatcaaaccaccaatcgaagagttgtaaattgtcttattgtctttttcatcatcagcgtgatacaaattgtttttggaattgcagcgaattcttggattaacacgttgtaaaatagatctaacagcctataggaagaagcaagaaggctctcacgcataaagcggtgggagccttttttgccgtgttagatcgcccaatttcctttacggaagataggttcctcagtaccgtcctcggtaacgccgttaatgtccatttcagctgaaccgatcataaagtcgacgtgagtcaggctggaattcaggccgttggcagccaactgctcttgagtcatatccttgccgcctttaaggttaaatgcataagcattaccgatggccaagtggttagaggcattttcatcaaacaacgtattataaaataaaatatttttatcagagataggtgacttgtgaggtacgagagcaacctcccccagatagtgtgaaccttcatccatttctacgagatgctgaagagtttccaaaccggtttctgcctgtacatcgacaatacgtccattttcaaaagtcagtgaaaagttgtcgatgatatttccgctgtagctaagtggcttggtgctgctgaccttaccgttcactcccgttttgagcggagctgtaaacacttcctcggtaggcatattggctacaaaagtatgtccctgttggttgacgctttcggctgctacccacagatgatcttttgccaattcgatggtgaggtctgtgcctggagccagataatgcagctttttatagcgtttggcatttaaaatatcagctttgctggaaagggttttcaaatgctctttccacgcctccacagggttatccagatccacacgcacggtgctgaaaatggcatcccacagtttattcatttgctctgaagctggcagatcagggaatactttggcagcccactctgctgaaggataagcaatcagagaccaactgaatttgtcggccatttgatactctcgatattgacgtaattcatgtgaccgcacacgctgggcaacagtaattcggctggacggaattccctgaagcaaatccggattttctgcaatgacatgcagtacagctgcgccattttcgacctcttcagtcatttcggcagcgtaccatttgggagcaatattaaaagtttcatcaggagctagttcatactgtaatcgagtaatagtctcatcactccattttactgtaaccagcttggccccagcactatacgctgatttgacgataagtctcacgagttcggcggacaaaattggtgcatgaacgatgagtgtctgcccaggatggacattggcgccgacccgaacggctaactcggcatatttttgcaatttttgttgaaaatctgacatgtaactttcctccatttcacgaaaagccttaaacaaggcttgggtaacttgcacagtttttttgcaaattccacacatagcttatatattgtacaatgtaaagaaaaggttcacaaatcagttttggtactatttagtgaaaatgaaagggcggatagatgaatgacagagcaaaattcacctcaggaagtgaaagaagtacatattcaacaggcacaaatgacaaaagatgagaatggtgcttatctgggccaagtggtatttaaagtagagggacagagttctgtatatgaaatcacattccacagcaaaaggggaaaggaatgggattacagtctccattttgcgggagagccacgggtggaggaagagatgctgcaaatggatagctggattgaagagaacgatgatttgttcgactatttgctagatacggcatggagcaaattacccgagtaatgtaaacatggtctattttcgtgacaagcggattatatttagcagtgtccgcataatctgctgacatgggggaagcctaaaggtcgatattatcaggaaattccatgtgaataggagggtgaagctttggcaaatcatctgttcaccgaaggaatgacggcaaatgaagaggctgctcccgatctcctgagcttacggacgctgtttgtaaatatgtgttttattggggagccgggaagccgttcctgggtgctggtggatacggggatgacaggatttacagactcgataatacgcctggcagaggaacggttcactggccctccgatcgctattgtgcttacacatggtcattttgatcatgtaggttcggttattgagttggtacagcattggggtacacctgtttatgcacatcctttggaattaccttatttgacgggaatgaaggattatcaaaaacctgaccctagtgtagggggaggtttaatgtcgagcatttccttcttataccctaatgatgctatagatctcgatgatcgcatcacatcactgccgccagatggcagtgtccccggtgcccctggttggaagtggctgcatacgccaggacatacacctggtcatgtatcgctttttcatgagcgaagaaggttaatggtggccggtgacgcttttattacggtgaaacaggaatcggcactggccgttattttacaggaaaaagaaatacatgggcctcctgcgtattttacgacagattggcaagctgcgcagcgttcggtggaaatgctggccaagttaaagcctgagattgcagtcacaggacatggtcattacatgcatggtgctgagctgacagatcaactggagcgactggcgggagattttgagcacatggctgtacccaaacagggccgttatgtgtagtgatgtgtgaaggacgatgccttgcggggcatcgttttttgtgtggacgtggaatttttttgctcagcatggtatagtcaagccaaaagctaaacgctttcattaaacatcgtcatttcatcaaggaggattttttgatgacacaacaacatgctgcaattggtgatctttattatggaataccggcgattcgtcttaaatttggacgatatgaagcagttgccctgccgggaaacggcgcaaatctgatttcttttcgtgacaatgaaacgggatattcttttctgcgtgagccagatgctgagagcatagaggcttttaagcaaagcccgtctgtttacggaattcctttcctgttccctccgaatcggtatgaggatggaaaattcctgtggaatggtgttacatatgagctgccgataaatgaagaggcgacccacaaccatctgcacggctttttacacactgttcggtgggaggttgaggactacggttctggggagcaaggtagctatgtggtaatgaatcagcatgtaagggaaggacatcccatgttccgctatttacccttcacttttagcatgaagttaacctacagcctggacgaatttggcctgcatcagcgttatgtgatccataacgagggcgatcaaccgatccccaacttatttgcctttcacacagcgattcgcgttccgttcgtacccgatagctcgcctgaggattacaagattaaggtcacaatcggtgagcgtcgtgagctgacggaacggttgttggccacaggtcagttccagcctttatctccggaagaggaactgctgaagacgacgggagttagtccttattttgcctctatggataatcattacacggcagctccgcaaaatggacgcaactacatggaactgacacacagtaagacaggtgctaccctcgtatacgatgtaggcacagcttataagcattggatgatctggaataacaaagcgaacaaggaattcatctgtcctgagccgcaaatgaacatgatcaatgcaccgaatcgtccggacctgccagcagaggagatcggattgattgcactggctccaggccatatttttgaagcaaccagccgtttgtattgtattacacctaataaatcgaaatcctaacatttaaatttatccttataggcctgtatcgtgtccaacggtgcaggctttatttgggtatataagcataggtaaggaccaatggggaaggaggacgaaaaaggttgcagaatgacaagcagtcgtagtatgatacgaaacaggagatgatcagatgaattttccttttcaagccgtcaaacgcaagcaaatcgccgatgaagtggctgaacagctgcaacgaaaaattgctgctggtgaatggaatgtgggcactaagattccaaccgagcctgagctcatgaagctattcggagtcgggcgatctacagtacgtgaagcggttagcgttctggtgcatgccggtctattagagaaaaagcaaggacacggaacttttgtctgccaaccgacgacttctcaagagccattggattaccgtctaagccgtgctgaaattattgaggtttatgaagtgcggagtgtgttggaactagagattgccagattggctgcattacgtcgtaatgacgaggatttacgcttaatgcgtgcggcgttggaccgtcgtgctgcaactttggccgctggagatttgactggatacctagatgcggatatcacttttcacttggctgttgccggagctacacgcaataaggtgcttacagacgtatatggcagctttgtagaggccattcgcaaggcattgaacaatctcattaccgatccagcgatgcaaaatcattttactctgcagcatgaaaaaatatatgaagcaatccgggatcaggatggcaaggctgccgaactttatagcattcaacatttggacggcaccaagctggagctgcaaaagcatatgggaagttcataatttttttatccttaaacatcagatgatcagatgaatatgatgatcttttgagccttttacttgagcatctcctaaaatcaaaccaaaggtggtatctgtatgcgcaaaatatgggtgttggacacaacgttaagagatggagagcaatcaccaggagttagtttaaccagcacagaaaaggtggaaattgctcttcagctgcaaaaattaggcgtagatcggattgagaccggctttccagcaacctcgcctggtgagattatcagcatgcaggagattgccaaacaggttacccaagcaacactggttggttttgcacgctcgaaagaacaggatattgatgcagtcagagaggcgctacgaggagctgaggatacctgtcttcatttgttcctggctacctcacccattcaccgccaacataagctgcgaatggataaagcgaaagtattagagaccgctgctgctgccattcgttatggacgcaagtatttcagcaaggtagaattttcagcagaggacgccagtcgtaccgagctggactttatttgtgaagtcgtggatatggcgattcgtgctggagcgacggtcgtcaatttaccggatacggtgggatatgcctcgccggatcagttcggtgaaatgtttagaattgtaaagcaacaagtgcccggtatcgaaaaaatacaactcagcacacattgtcatgatgatcttggcatggcaacagctaacacgctggcggccatccgtaatggtgtagatcaatttgaaggtaccatcaatggaatcggtgagcgagccggaaatacacctatcgaggaagttgcactggcccttgataccagaactgagctttatggtgcacaaacgagtctggttttggaggagctgtatgccaccagtcgactggtgagcaaacgtacggggatgtcggtaccgggaaacaaggccattgttggagccaatgcgtttgctcacgagtccggtatacaccaggacggaatgcttaaagagcgtacaacgtatgagatcgtgtcccctgagcgtattgggctgaagacgagtaaacttgtgttgggcaagcactcgggtcgacatgcatttaaagaaaaactggcggacatggggtttgatgctttgacggaggaacagctgcaagaggcgttccgcaaattcaaggccttgacggataagaaaaaacaggtgctagatgaagatttgcacgtcctgatggacgaaagccgcaatgcctcacctcaaatgtacacactggattccattcaggtgtcttatggcaatcagtcggttccagtcgcatccattcggttgagtaaacaagatgggacagcaattgatgaagtagcaatgggtaacggttctgtagatgcgattttccatgctatagacaaggccagtggtgaagaggtggagttggaggattattcgatccaatctgtaacatatggcaaagatgcgttgggggaagtacacgctattttgaggcaaggtgagtacacagctctgggaagaggcacaagtactgatattttggaagctagcgccaaagcttacatcgatgcgctgaacaagctactgggcagaaaagaagtccatggcaaaagcaatatcaccattagttgaacctagtagccatgcttgtaaattaaatttcctttcgcctcctctggccgcatcgtaaaaaagcgcttgcaaaataaatgataacatttgaaatttaatgtataataggcaagagagagcaccatattttgtctgaattatataggccaagaggaggaaatgagttgaactaccgcatcgaaaaggatacgttgggcgaaatcaaggtaccggcagaccgtctgtggggagcgcaaacacagcgcagcaaggaaaattttccgattggctcggagaaaatgccattagaggtcatacaggcgttcgcggtgcttaaaaaaagcgcggcgatcagtaactataagctgggtaagctatcacaggagaagcaggacgccattatttatgcagcggacgaaattctcgcagggcgggttgatgaccatttcccgttggttgtatggcagacaggaagcggtacgcagtccaatatgaatgtaaatgaagtgattgctcatctgggaagccaatggttacaagagcagggaaaagatacgaagctgcatcccaatgatgatgtaaacatgtcgcaaagctcaaatgatacgtttcctacggcgcttcatgtagcgggtgtcattgcagttgaggaccgtttgttgcctgccattgataagctgaaagagacttttcaacagaagtcagagcaattcaaggatattataaaaattggacgaacccatttacaagatgcgacaccgctgacgctggggcaggaaataagcggctggtatgccatgctggacaagagcaagcgaatgatcattgacacggtgcaatacatgaaggagctggcgattggcggaaccgcggtggggacaggaattaacgctcatccagagttcggctcccgaacctctgcggaaatttctagtttcactggcaaaacgttcacttccgcacccaataaatttcatgcactgaccagccacgatgaagtggtggccgtacatggagcagtcaaagcgctcgcggccgatttgatgaaaatcgccaatgatgttcgctggctggcaagtggtccgcgtagcggcttgggcgaaatcacgattcctgctaacgagccaggtagctccatcatgccaggtaaggtgaatccgactcaaagtgaagcactgacgatggtcgttacgcaagtaatgggtaatgatgcagctatcggttttgctgcgagtcagggtaattttgaactgaacgtgtttaagccagtaatcatctacaattttttgcaatctgttcatttgctggccgattccatgattgcttttaacgacaactgtgcgattggcatcgagcctgatctcgctaaaattgagcacaatttgaataattcgctgatgctggtgacggcattgaatccacatatcggatatgaaaatgccgctaaaatcgccaaacttgcacatgcagaagggctgtccctaaaagaagcggcactccgcagcggactgttgactgaagaacagttcgatcaatatgttgtacctgcgcatatgattcatcctaaagcctaaagcacgacgatagtctctgcttaagccttataaaaaatatacaaaccagctcatggagtgcgatttagcacaaaccatgagctggattttttgattttattatataattttttatttaggattagtattctgtgtgatttgagggtatatagatagaaggcgaaaaattgaacatctattttcaagataggagaagccgtatggaacagacaaccgttattaatttgattgtacttttgctgtccggcttgctgctggtcggcgtgctgactaccaaattttccagccgtttcggtatgcctgcgctcgttttgtttattgcggtaggtatggtgctcagtcagtttatttattttgataatgcctttatcacacagctagttggcattctcgcgctcattgtaatcttgtttgaaggcgggatgcagacaaagtttgcagacgttaaaccagttattcgacctgcgttatcattatcaacgttaggggtcatcattacgaccgtagtcattggcgtatgcgccaagtttattttaggcgtaagctggatggaatccatgctgtttggcgctattgtcggatcgaccgatgcggcggccgtgttttccgttctaggaggtaaaaacatcaaaaaacgaattacctcaacgctcgaagcggaatccggcagtaatgacccgatggctgtatttctcacgataacattgattgagctgatacatcaccctgagcaatccatttggatacatatcttgttatttttatgggaaatgggtttcggtttagtcgttggttttgtactcggacgcataggtgtatatgcgattaataaaatgaattttgattcatccggtttgtatcctgtgatggcgctggcatttgcggtcttgacgtatgcggcggcatcgttactggaggcaagcggattgctggcggtttatgtcatggccattgtcttgggaaattccgacttgacctacaagcgatccattatccattttaacaatggtttcgcctggatggtgcagattatgatgtttgtcctgctcgggttattggtctttcccgatcaattgctgggcattgcgtggcaaagcttggcgctctccttcatcctcatgctcgtggctcgtccaataggcgtattcctaagcttacttttttccagatactctgtgcgcgagaagacactgttatcctgggcaggactgcggggggcggtacctattgtactagcaacctatcctttactggatgagatggatgtaggacccttgttttttaatgttgtatttttcgtcgtgctcacttctgcgattattcaaggtaccactatttcgtggctagcggtgaagcttggcttgatggaccctaacgagacgtcatctccttcactgctggaattagtttctctgggaaaaaccacttcggaaattaaccacattcaggtacaaaaagggatgtcgattgcgggcaaagcgattcaggatatacagctgcctgaagatattttattcacagctataattcggaacgagcaaattattgccccgagaggtacgacggtgattgaaccgggcgatacattgtatgtgcttagtcccaaactcaagcgacagcagatgaaagaactgttcatgctgctcgaaccagaggctgctccgtaaaaagcgtagagtacccttaattacagtccttcacattcatgtggaggactttttcctgtgtttttttcagagtggatgaatctgttaaaaaattgacactatcattctacaaaattagtttatgatattgtcgttagatgtcgctgcctatcgttacggatcatttgatgggccatagtgatgaataagatagaagtcaccaataacaggagagatgatgaatgaaaccggaagtcttgccaaagcgtgcagcagctcgcaggcagaaaaatagaaaaaagaaacgaaaagggaaattcggtcgttttatactgcgactgttgattgtattcctggtagcaggaatagggggtggtgcgtggttgttcttaacgacatctggcaaggatatgcgctatttggctgcggatacgctgatcacgacccaacatcgtcactgggcgaagtactttatcggtgaagcagaggcgaaaaaacgtgtggctgaatattcggcccgttttgaagcgatgggggaggagaaggacagacatacaatcaatctgcctgatctgataccgaccaaagtacaacaaacgccgctggttgaagtggaagaggtatcgggccgtaactatcatggctatgttatgacggttcatgaccccactaaaattcggctcggggttccttccaaggtcggccggggagaaagggtatctagtatggtcgagcgtttaggggctgttgctggcgtaaatggcggtggctttgccgatcccaactggaatgggaatggttttaaaccgattggcgttgtcatttcccagggtgagatatactacaatgacatgggcaaaaatgcgtctgttcaaatcgtaggtattgataaacaggggaaaatgatagccggccactattcgttgtccgagttgtctaaaatgaatgtgcaagaagcggttacttttcaaccacgcctaatcgtgaatgggaaaggtctgattcgcaatgcaagcgaggggtggggaattgctccccgtaccgcaatggggcaaagagcagacggggccattatattcgtgaccatcgacggtcgtcagcctgggtacagcattggtgccaacttgtatgatatgcaaaatattttgcttaaacatggagcggttatcggtgctaatctggatggaggttcttcaacagtgctcgtcaaggataattccattgtgaacaagccttcttctgaatacggagagcggtatttgccgactgcgtttctcgtatttgagcatccagagactgttagtatcccaaacatatgggaaggtctgaatcctggagacattgacgcagccaaaaagagatagatcaggaatgattcccggccgataccaaacaaattatgaaaaccttcaagctgccgtgggaatcgcgtaccgatgcccagcaggcgatgaaataagttaagagcagcaatagcaaatgaaaatataagaagcgcggatcgttgaagtaaagatacttccggtacgcgctttttttgatggaatttgtacttttgttgcttcgtgcttgcgtaaatatcgattaagcgtcattatctgcttcgagaaacacggagatcagaattcgtgcgttgttttctcctacgtttttggcatagtgggggatagctgctctccagctaaaggaatctcctgcttccagggtagctgaatcctcgccttgctccacgtataccgtgccctccaagataaaatgaatctcatcccccccatgagcatgctcctcttctgtagacgagcctggcggcatatccaccagcatcattttaacgtttccttgccctcccaaatgatcaacctggaggttgtttttaccatataaggttttacggcgctcgtccttgcgaattacttgcatccgttcctcatctttaagaagcagaaaagcgagagggaccttaagcgcattagcgatactgtccaatgtagcgatggaaggggaggttttattattttctacttgactcataaacccttgcgatagtccggttcgttcgcatatttgctggatggataaatttttacgtttacgagcagcgcgtatgttgcatcctatactcatagaatgttcctcctttaaggaaatataatgtatactaatttaatatttatcataccaaataatttgttgacagactacagtttcttatgataaattcacattacaaaataattatttctattactaataattcgagtttgattcacactaatgtgttgcggcatagattcagacaggattatttttttaaccaaattattagtaatataaattaattattcatatgcacttgtatgagtgtaataaacaaacagaatggagagataaacatgagttcagcaagcagaaacatttctacaattatgcgggtggcactgggaattttgtttttggcacacggaattgctaaattccaaatggggttgggtaatgtagcaggctggtttgccagcattggcgttccaggatttctaggttatgtcgttgcggtgattgagttagtcggcgggattgcattgattcttggattgcttactcgttatgtatctgggcttttggttattgttttgatcggcgccatttttacagcaaaactgtccggcgggttgatggggaatggtcaaggcgctggctatgagctggatattgcttttattctggtagctcttcatctggtatttgcaccaacgactcgcttgtctctggactctttgttcgggcgtcgtgagtcaacagaaaagtgattttggttgctttagtcctccaatccatgtagaaagagggaaatctcatgacagcacatatacatgacaacaccaaaattgggcaggtttcattaaaagttagtaacttggagcgttctattcaattttatacagaggtggttggttttcagctactgcgtcaaacggcgaataccgccgaattgactgtcgatgggaagcatgcgctactgatccttaaatatattgaaaatgcagttattctgccgcgtcaatctgctgccgggttatatcattttgctattcttttaccaaaccgtgtagctctgggcctgtccttacgtaatctgctggctcatgagattgaaatcggacagggagatcatgatgtaagtgaagccctttatatccatgatcccgataataacggaattgaaatctatgcagatcgtccccgtgatcaatggaaaaaggatgctaatggattttacatgatgggaacagatcccgtggatgcagaaaacttggttgcgatttccgaaaatctaccttggcagggactacctcagggaacgataatcgggcacgtccacttccatgtgtctaatttgctcaaagcacagcaattttattgcgatgtgcttggctttgacattacgtgccgatatggctcttcagccttgttcgtttccgcaggtggttaccaccaccatatgggcttgaatatatgggcaggtgaaggagccccaccagctcctgagcacgctgccggattggattattttgaattgatcgtaccagatcagaaggaattggatgccattgtcgctcgtttagaggcagcaggctatggagtgcaagaacgcgagggcgccaagtatgtagctgatccgttccgcattcaaattaaactaattaacggtcaaatctcgtaacaaagaaggcacgtaacaaaaaagggtattcctattaagccgtaaaggctgggaatacccttttttcgtatacttagaacaagctccagtccaaatcccgagacatcttctctagcaagtgtacaccagctgtactgttgcccatacggttcagagaaggtccaaccagcccaatgccatatcgtccgggtaccatcgtcataatactgcctgatacgccgcttttggcaggtagtccgacttgaatggcgaattcccctgaggcgtcatacatgccgcatgtcgtcataaatgttttggcgatctgtacatagcggcggggaatcagcggtatacctgtcactggatctcgaccattgtaagctaatacaagtcccatacgagctaaatcagtacagttcaatttgacagcacaatgtctaaaataaacttcaagcacatcctccacatgacctcttaaaattcctttttccattagaaaataagcaagggaacggttcaaatggcctgtagctgattctgaatcgtagacatcctgatcatattccaatgtgtcattgtgggtaagcaggcggaaaaattggagaacacgggcaaatctctcttctggactgttcccgcgaatcagagaggagactgcgattgctccggcgttaatcagtgggttaaacggaatgcccggttcaactagttctagctttagcatggaattaaaacggtctccggtaggctccatacccactttagagaagacaacgtcctctccattatccatcaaggccagaatgagcgtaaatacctttgagatactttgcatcgtaaattggatttccgtatccccggctaccacggtctcacccgcaccgttcattacaacaacacccagcgcgtcggctggtgctttggacagttcgggaatatatgctgctaccttgccgtgaatatactcatgacggctttgttctacccattccggcagtttggtctgtaatctctgccactccgatgtcatttcttttcctccagtcgagtaaccaatctgtggtattttattgtagagcaaaaagtagctatatacttattttaaagaaattttcagttgaaaaacaagctctgatgtcatttctttttctccagttaaatacccaacctaatgtaatatcggtattatggtttatcctctgtagtcttcattcacctcatccaactgcctatccgaaatcacttctaagtgccacacatactcttttttagcgttggctcataagaaagattcccatttttaaaaaaagttaataggagaaggagatgaagtggaacatgttacacggtacgttagcggattacccgcgggagaaaacgattcatcaattgtttgaagagcaggttgagcgcacaccggatcacatagcggttgtatttggggacaagcacttgacgtatgttgatctgaacaaacaggctaatcaactagcacatgttttgcgggctaaaggtttagataatgacgaggctgtcggaattatggtcgaatgttcattggaaatgatcatcggaattttcgggattttaaaagctgggggagcctatgtgccgattgatcctgaatacccgaaggaacgtatacgctatatgctgacggattctggtgcaaatctcctgctgacccggcttccaatccaccaacaaacagagctcgccagtgttgtactggatttgttggacaagcggaactatgggaaagaaacagggaatctcacatctaatcaaggttccgatactcttgcttgcattatgtatacgtccggctctaccggcgaacctaagggcgccctgacgatgcactacaatattatacgtgttgttaaaaagacgaattacatccaattctcgtcaaaagataggatattacaagtggccagtttttcgttcgatggttctacatttggtatttatggggctttgcttaacggaggcactctcgtattgaactcacaagatcaaaccatgaatgcacgtgagctatcaagcgtcctacggacacaacagatcacgaaatgcttcgtcacaacagcactttttaatgcattggtggatgtgaatcccgattgctttgcaactattgaaaccttgctattcggtggtgagaaggtttcagtcagccatgtgcgtaaagcgtttgcccgtctaggtccgggccgtttaattcatgtctatggaccgacagagagcacggtatttgctacttattacccgattgatcatttggacgaaaatgcaaatagcgtaccgatcggcaaaccaatcagcaacacgaaggtttacatcttggatcaagagcagcatcctctgccgcagggagttgcaggtgaactgtacatcgctggcgatggattagttaaaggttatttgaatcgtccagagctgacagaagagaggtttattcagtcatcatgggtacctggaggcaggttgtatcgaactggagattgggtgcaagagcaagcggacggaaacatcgaatatattagccggatcgacgatcaagtgaaaatacggggttttcgaattgagcctggggaaatagagtcgcatttattaaaagtagatgatatacaagaagcggcagttatcgcccgtgaaaaggaggacggtcaaaagcagctggaagcatattttacggcgaccaaaaaactgacagcagatgaaattagaaccgctctctctataaagctgccaaattacatgattccatctttttatatacaactagagcaaatgccattgacactgaatggtaagctggaccgcaaggcactgttggcccttgaagagaatatacatggtggtgcagaatatgtgtctccgaagccgggactggaaacgaagctgatggacatctggcaggatgtattgggggtgcagcagttcagtgttttagatagcttcttcgacctcggtgggcattctattcatgcgcttacattaatgtcgagaatggagcgtgcaggatatcacgccactttaacagacatttaccactataaaacgattcgggcactcgctgattatcttcgttcaactcagaatagtgttatagggtcccaaaagcagcaggacatcatagaaacaacacaagagttgatgtcttggcttcaccaagaaacagatggtgtttacgagctggtgaaataccaagtaagggattttattcacgaagttagagatattcaggtgctttactacgacacggcggccgacgtaaaccatatcatgcggatcatggatgggaaaatagctcaagagctactgcctcactacattgtaccactgcatcaaaaagctaaaatggctgatccatactggaccatggatgaagaggagtttttccagcgtctgggcttaaaaagcatggatctggatcaggcggcaagtttacgcaagcggctggaagacgattatttgagaaaagatcagtggattaaaacagggcaagtggcacaagaatatccgctaagtggaattcaacaaatgcaaatctcgtttcatacacctccaagcttaggtatatttaggctagatgagtgtgtgaattacgattttttggatcaggcttacgctctttttatacaaagtcaaggattactgagaagcgtcccggtccaaagagatggatggacttattggagggaatacgtactttctagcgatggtttgccaaagctcaacatcattgacgtgtcggattacaatccatgtggtcctattacggacatgataaatgattatgtaacgaacacccgattcgccggagaacatactttgttccacatgtttgtgctgaaacgaaacctgcgtgaacattatgtcattactatttatcatcatgcgatatgcgatcgggtgacctcggaagtagccgaacgacagttgattgcttactacaggagtctgcttcaaaatcgaccccttcctaaggatgaagtgaagccctatgtggagtatgttaaacaaatccaaagtggaccgaaaggaatcacggaacaagaattgatatcagcctttaatttggaagcgttccaaaaaagcaagcaaaacctcttccaagctccgaagcttcgaacgagcacagaagcctacctgtttaacgtaagtatccctgctgaagatccttctttggagtttgcgctttctgtctatacaaagggcttgcaaacttatttaggtatggataagctaccattgttatttttatatgatggaagaaggtacgacgaggcggcttattataacacggccggtgaatttatcgattttgtgcctatgctgatggaactgaagcagaatccagatgaaatgatgcagtctgtcagaagcagactagatttattaaagcaccacacgattaattttatgcatctttttacgagtcctgattacaaagacaagtggaaacgtgccagaacacttgcacagtttgggaagcagtacgagcaactagacttattcatgtttaactatttaggaaacagtgccaaagcaggctcaaaatacaacaattattatgatgatactgtcataaagcaaccaaatccgctgccgatctattcactgttcaattgcattgcttcttcctacacggacggccttattttttctatacgatgcagttacgagatagaggttaaggaagtcagggctgctttttatcaagctgtaggtatggcatcccggataggggaggtttaataagtgatggaatcagccaatacatcttatcagagttgttctgataggccgcgacgttacttgcctttattttctcaccatagtggaaatgccggacagcccgaaggtcatgatcaagcgctttacaagattcgtttggggacaagacaggtcaaaacgattatgggttttgtacagcatcatcagctgggtatgccttcttttataacagccatatggtccgtactgttatcccattacgccaatcaatatgctctgcctgttttatattccgtggtatcagacaaagaagggaaaggatgtcgtctggattatccactactcattcatatacagaaggaagatcatcttctctctttgatacaaaggatacaaatggaatggaacaaacaacttagtagcgacgagtggagagaggatttttcgcagcaaactaaagtcgatcctctattaggggggaagaaggatttcttcaatgtgggtatctcagaaatttatgatgactttccttctccaagtttaaatgcggaaaagtcccctcccctttatggtatagatcagccagaaatcgcgctctgctaccgatatggccaggatgtattggagtgcgcaatacagtatgatggctgtcgtttgggaaaaaggcaaatcgctagattcgcaggccatttcaaaacactgctggcaaatgcactccttcttccggagaagacggtactatttcaccccatgctgaccacaagagaacacagacagatgcaacaatggaatgatacggaacaggcctatcctttggataaaactgtggttcatttgatcgaggagcaggctggccgaacacccgatgcaatcgctttagagtttggagagcagaagctgacctactatgagttaaatcaccaggcaaatcaaatcagccgcatgattttagagtcgtattcgatacagggacatggcgttctgccgaccggcacgctgattgccatcgtcttggatagaagcgcagatgtgatcccgtcgatgcttggagttatgaaagcgggcgctgcttatcttccggtcgatccccaatatcctggggaacggctgcgatttattttagaagatgcacaggcccaaatgattataacgcacagccaattagtaagtaggctgaatccatatatttctcaaatgggtatgggagcacattcgctgatttgtgtggataaatgcttggtacggcagggctactatccctacgaaaacttgaagatcaaggttaaacataatgatctggcttatgtcatctacacatccggttctactggaagaccaaagggaacgcttattgaacacgctggtctggttacgttgatcccttatcttgttgaaaagtttggtatcacctcagattcaagagtcatgcaattcgcctccattagtttcgacgcttcggtctacgaatggatcggtacgctatcagtaggcggaacagtggttgttctgtcagacgaggaactgcctccttatgcagacatttcagatattcttgaagagaaaaatatccacattgccatgctgacaccatctgtgctgcgaacgatgaaacatagggaactgccaaggttacggacaattgtatctgctggagaaccctgtacgtctgatattgtagactattggggaagaggaagacgattcgtgaacgcttacgggccgaccgaagtgacgattatttgttctacttctgtctgcagaccagggaaagaaataacgatcggcaaacccgtctataacaaacgtttattcgttttgaatccattcggcagtcctgtgcctgtcggcgttcccggcgaactatgggtgggcggtatagggcttgccagaggatatttgaatcgtgaagaactgactcaggaacggttcgttcacaaagaggttgtaatcagcagtgaaaatccaccacacagtgagcggttatataaaaccggggacattgtgaaatggacgccgggtggtaaattggtatttatcggccgtagtgatgaacaaattaaaattagagggtatcgtatcgaactgggtgaaatagaacatcagctctgccaacatcccgacatcggtcaatgtatcgttcaagcctggaaagacgggtcctaccataaactggtggcctattatactgccgtagaagaactgaaagaggccgatctgacacagcacttaaactctgtattaccagcttatatggttccttcatatttttgttatctggagtcatttccagtaaatacaaacggaaaagtcgaacgtggagctctccccgatccgaggggtaacttatttattcaagctgatgaagtagtggaagcagacgagtacggtttcgaaaagcgcttgctttggatttggcggcagattttaaaaagaggagatatcggggttaacgaccatttttacgcggttgggggagactcaattcttgccattcaggtcgtatctatggccagggatcatggtatcatgcttactccaagacaagttgcggagtatccaaccattcagaaattagctgctgtggtgacttggacagacaatgatcaaaaggaagatctcagcgttgacttgacaggcgaatttggtttgacaccgatccagcactggtttttcgagcaacagtttgtagagccgcattatttcaaccaatctcagctgtttgtactcagtgattgtgatgctgtgaagctggagactgccattaatcaattgattcgattacatccagagctttcaatggagatcgtagtcaaggaacatgtgtattcgcagcgctaccgaaaggatgcttccattcaactggctagctacacccttcaacaagtcgattatcccgaatccgaaatttcaagcatatgtgatacgtggaacagacaattgaattatgagacgggcgccatgatgtatgcaggagtaattcaaggtcaccctgacggtaaaacccgtctgtttatgactatacatcatctagtcattgatggagtgtcttggagaatattggtccaggaattgtatcaattgtatcagggtatagcgctgcctactgttttaaatccatacaaaaaatggcattctgtattgatgagttattctaaacataaagatactttacgtcatattgaatattggaaaaaggtgcagcatcaaactgcagcatttgtgctgccagtggaccattcaccggctcgtaaaaagagcagtgaatcttcggaatgggtttcgatgcttactccaaacgatacggaactgcttttgcaccattgctcccaagcttaccataccgagattaacgacctgctacttacagcctggtccctggcgctctccgcttggtctgggcagaagacgattgcgtttcgcttagaaggtcatggacgtgagcactttgtatccgatatagatctgacaagaaccatcggttggtttacctccatgtttccggtatgcattcagattacggacagttccccattgggagcgacgattaaatctgtcaaagagcagttgcgttgtattcctcaccgcggcatgtcatatggcgctttaagatactgccatccgaatacagaagtccgttccgagttatcagcttctgaacctcaggctcttttcaattacttgggccagtttgatcaggggaatgcgagcgaattaaaccagtggttagggtttacaagtgacgcagcacaggattatagctcgccgcttaatcatggaacaagcctattggaactcaactgttccattgttcatggcaagctgcatttgtttatgaaatatagcaaacgtcactatgaaaaagccaccattactcagttgttagatacttttataacacgtttgcttgctattatcgaacattgcagccggactgaacaccaagaattcacacctagtgattttccatcagtgtcactgaaacagcattcgctcgaccagatcgtaaagacatatcattggcaatttggtttggataaaatgatgtacctaagtcccttacaagaaggactgctgttccattatttagatcatcctagttccgatcaatactttgtgcaggttagttggaaatatcatggcaggctagaggtagaccgttaccgggaagcctggaacagcatcatttctgaaaatgatagcttgcggacttgctacatttgggaggctttggacaagcccatacaatgtattgtccgaaatgtagaatgggattggacatttttggattttgaagcagagcaaccagaacagcaacaggagtgtatcgaacgctggttgacaatggatcgtaatcgccgttttgatctgagtcagcctgcgttccgcataacactgattcagaccgcttcgaatgaatggacgatgatctggagttaccatcatattttgctggacggttggagcctgccgctactactgagtcgggttcatgaactctatgcttgtagcctgcaaaaccggatgccacagcgcagcttaacccgttcttttgaaacttatattcgttggttaaacaataaggatcgcacggaggccgagtcattctggaaggcatatttggctgacgtaacggagccgacccatctgccgatagagaagggcatacttcccgatgtacatcaaccgattgagaaccagcagatcgagactttttgtatcgattcgagacgaaccaagcggatcactgattttgtacagcaagcacaagtttcgctaaatacgttggtgcagttcgcatggggcaaagtgctacaagtctatcaagatgcggatacaaccgtatttggcatggtcgtgtccgggaggggatcggatcttgcacaatcggatcggatcacgggtatgctgattaatacgttacctttggtcatgcactggaatgtggagcaaaccatcactgaatatgtacaaaagctgcaccaaaccattcagaaactaaacgactacagctatgtgagcctgaacgaactgaatagctggtctggtattcaaggacatgtcatgttttacagcatcgtagcattcgaaaattatttgaacgactatcggcagcctgaaaatgaattgaagatgtcagctatggaggaacgagagaaaacgaattatccaatgacgatcaccgttgccaatgacggggaacagatcaccatcaagtttatgtatgatgcagatcgactgaaacaagaaacggtttgccgactggcagagcatctgctaaatacggtgcaatatgtgttggaatatccgaatcacaccgtcggagacgtttgctttatgaacaaggatgaatatgaacgaatcgtctatgactggaacgatacgtatacagcatatcccagagaacgttcaattattgatttattccaggagcaagcgaaactacggcctatgcagccggcagtaattgcgcacaatcaggttatgtcctaccacaccctaaacctaatgtcccagcacattgccaagatgttaacggatgatgctgatgacaacaatcatggaaagtttatcggagtttacttgccgcgctctcttgaattcattgtctccatcctggcgatcatgaaagcgggatatgcctatgttcccattgaccccgattttccggcggcaagaacccatgaattaatcaaggacgctggactggacaccatcctcacttcacaagaaggagcggaacgtatctcggaagccagttggggaatccatttaatattaattgatacagagcattttgaccaaaatggagtggtgaaacaagaagagaaggagaacatgattgctcccaatgaccttgcttatctaatgtatacatcaggatcgacaggaaaaccgaaaggcgttatggtggaacatcgcagtgtcattcgcttggtcaaaaacacctcttatttcccgttttcctctgatatcagattgctctatacgggttcgcctgtttttgacgcttctacgtttgaaatttgggggacattgctgaatggaggacagctgtttgtagtttcaaaagatgatcttctaaatatccatgtgctggagcagcggatgaaggagtggagaattaatacactatggctaagttccgcactgtgtaatcactggattgaagaaaataaaaagatatttgctggactccaatggctgctcataggtggggaaattttgtcagttaagcatataaatcgtatccggcttgcctatccggaactttcgattctcaatgtatacggtcctacggagaacaccaccttttcgacgagctaccggatcaaaaagccttttgagcagaatattcctattggcaagcccattagtaactcaacttgttatattctggacaagtggggtcgtgttcagcctgtcggagcaatcggggaattatgcgtggggggagacggggttgcaagggggtattggcgacaaaaccaattgacactgcatgcgtttgcaccgaatccatatcgctctgccaaagatggtgaaagaggtacaaatttaattctataccgtacgggagatcgggcgagatggctaccagacgggaatatcgagtatattggacgggctgacgatcaggtaaaactacgtggctatcgaatcgaacttggagaagtcgagttccgtcttagcagctatcctgtagtgaaagaatgtctggcctttgtccgggaggttcatggcgatttgcgaatgatcgcttactatacagcggaagaggagcaacgagtggagcagcttcatacttttatggctgaaggtcttccatcttatatgataccgtttcgttacgtttggctgaaatcgttcccattaacggctaacggaaaaatcgatcgcaaaaagcttcctttacctgaaatccatagtagtgatagagaagtaaatgctggatcgaagactgaattggaacaaacaatagaagaagtttggggcatggttctgaagctagattacattggcaaaaatgaagactttcatacgttgggaggacattcgctccatgcgctacgcatagccagtctgctgcaaaaaagcggatatccggttacggttaaccaaatatttcgcgaacagacgatcgaacgtttggccctctcattgagcaatgcaatgacggatacaacaactgtccttagtccaaatatggatatcccatatattcagtctataagaaaagcatatccggatgacggatttccgctatctgctgtacaaaaacgtttttttcaaagagatctcgtgaatcgtaacatgtttaatgtaccttacctggcccggctcaaaaattgcatccctacagaattgctgaacacgtcgcttgagtcactattgaacaaacatgcggctttgcgactatcctttgctcaactggaagatgatgaatggtatcagtttgagcagaaaataagtgtagaacaggtagtctcttacgtggatttgcacatggtctcgggatcacatgacgcctacatttcggaatactgctcgaaagtgcagcgtgaattcgatatcaaagaaggacccttatggaaagttgtgttgtttgaccattattgcgaagagagacaacaggtgatattacttctgttccatcatttaatttctgacgggatttccataaacatttttttagaagagttgagacatcttctcctgccgggaaaagggaatgatctggcgttacatgcggaggaggagggaagcagttatcgggattggtgcatggcgttgacccaatatgcggcgaaagacttttttcctaaagcatccactttctggagtaaggttgtggaaggcggccaatctttacaggttgacacggaatcggagatacagccacttcatcgccacatgagaactataacgtatgatttacttgaaggagaggagcatattcttcttctaaaagcattggctgtaaagcaccatactacgccactgagcatcttactgacggcattgtcacaggcttgttttcaattgaaaaagcaatcagatttgctgctgcatgtgatgtcttatcaacgtgagtcctttttgccgggtatcgtgattgatcgtacaattggttttttcgccggagcatatccccttcgaattcagatcccggaaggagacctgtccgacaattgggaagtagcactgggacatgtcgtacacacgttgcggcatattccatctgaaggcatggattactttattttacgtcatttgatacagaatattaatccaaatacggaaccactaaaggacggaacacacatgcttttccattaccaatcagaggaaatgaacgggatagccgatgagttgtacgagcctttatccatttcttacggaaatacgaacgccgcagacaatccctctgcttacaagctaaatataacagcagggcttagacgcgatagattaagtttaacctgctattatagttcactacattataaggatcagacgatcgctgaactaatacgcttcataagcgaacatctgtgccaaagcatcggtgttcgcccatataccatgataggggaggggagcttcagattatgaaagtatatgaattttgcccatttttcaatgaaaatcgcattgcagatattaaaataaaagaaaatgccggctggattgacgagctgcacgtgatcgaagccaacaagacgttcagctatttggataagccctgcaactttaattcagattatgtgggtcccaaggtgattcatcatccatttcacgcggatcaactgtttcgtgaacctgagaagcactcattgtacttcgatgtggatagctgcggcgcagataactttgaccgctggtactggcgtctgctcagctataacagtgcgttttataatgaggcttgccaaagaaacagaagtacctctatcttacaggataaagttaaagacgatgatgtgatcattttggctgattttgatgagatcattgacagtcggatggcggatcgtattgtttcggaagtgaagaaacatcaagttattacaattaaaatgcactattctgtattcttcctgaatcttttttgccaatctaatcacggtgctcctcattggagctaccgcgtgttcgccatgaccggtcggtacttcaaaagtatgcctttctcacccgactatctcaggaagaagggaattgctgaagcgttatatcatgacatttattgtctggaggagccagctggattccaccattcatggcttgaatatcaaaaaaccgcgcttcccaaactgcaagcttttgctgccaatgtagaagataaaagtatattaaatgcagagtatattgatcaatgcttacatgataaaaagctgtactatatcgataccgaactttatgttgataactcaaaatcgtttttgagcagtctacaggaacttgaaacagatgatctttggtataagtaaaggaagttagattagctgcctgagaaacccggttcacacaagatcagggtttctcttttgctttttttcaagctataagggggagctacgccaattgggaggagtaaagcgaaaagaaatcaaataaaactgccgacgagatcggcagtttagtttaaagatcttctgatgatcaggttattcatcggaaggttattttgctatgtaatcagaatcaatagtagctgtttgaattcaatgaacttatgatggcaggcaacagagcaacagccataatgatatagatcacaattacaatagctgcccaaagaaggcctgctttagcatagttagctttactcggattagtcgagccgctaaatgcccacacaaacagcataataagtccaactaccggtatagccatcagaagtaaactgatcatccactccttgaatgatacaggaggcgggtaaacaggggctggtctggatggtgctccttgctgattgaattgcggattaaactggttagacaattagatcttctccctacgtgattagtatgttgtgtttcctatattgaccaaaacatcatacatgatatgacaataagcaacaagtgaaattcagtaaacagtctaatagtactatcaaatgattaaaaataggactatacaccctattgacgaagcagtttttatatattactgtattgatattaacattttgtttttatcaattaattcaaattaaaagttacatagagcattcgtcacttttgaattaaaagcgacaaatgacccatatatgaacaggtaggtgaggcaagtgacagatggatcgaaacataatcacagtggcttgacggaagaggagttcttggccctgtatgatgcgaatgaatatgagcgcccatccgtaacagtagatatgctgctatttacggtaatggatcagctccaacaaaattatcggaagctgcctgagaagaccctccagcttcttttgatccaaagaggggagcacccttatatagggcaatgggcgttgccgggggggtttgtaggtatagatgaaagtctggaagaggctgcgcgacgcgagcttaaaacggaaacgaatgtggatcagatttatatggagcagttatatacttggggagatgtggcacgtgatcctcgtatgcgggtaatcagctgcgcttacatggcattggtggatcacgattccttggaggtactggcgggggatgatgctgatgatgcccaatggtttgagctggattacagcgtagctcaggagacgcggacgaagcagccggaaggttacacatgggaacaagacattgacatcacattgaagcatggggacatccatctatcagccaaagtaaaaataactgaaattcttaagggaagaaccattgaaatcaagcgagaggtgctggagtcacaaggaattgcttttgatcatgccaaaattattgcatacggtatagagcgtctgcgcagcaaaatagaatacacagatatcgcatttcacctgatgccagctctatttacactgagtgagcttcagcaggtgtatgaaattattctaggtaaggagctgttggccgcagcttttcgtcgcaaaatagctgatctcgtggaagaaaccaatgagtatagaaaggcggctggacatcgtccgtccaagttataccgatttaagcctcggtcgcgttttatgtagcataaggaatatgaaatgaggaatctttatggaaaagtttacatttttttatcgcagtcattcgccattttcgcaatggtatccttctgattttgtcgtggatggattggagtttaactgtgccgagcaatatatgatgttgaaaaaagcacagctttttggggatgaagaggcggccttgaaaattatgcaagcacctaccccaagggagcaaaaagcccggggccgcagtgtgcgcggatttgaccaatccttgtgggaggccaattgccggcaatttgtatatgacggtaattacgccaagtttacacaaaatccgaatttgctcaagcacctgcttaaaacgaaaggaaccactctggttgaggctagtccaaccgacaccatttggggtgtaggcttagctgagagcgatgctcgtatacggaaccgcaagctatggcgtggcacgaactggcttggggaaatattgacgaatttacgtgaggatgtattgcaaaaggaggaatagtcaccatgagaaatacaatgaattcccggagtaaccgggatgcacgatcacatatggcgcaggagacactaaccattttggagaatggatattacacgaatatcaaacaggttcaagtaaatatgacaaaagagataggaaatgcggtcacaggctcgaagttatatacaccttctcaactggtagctgtaaagcaagaaacagagcaaagaataaaaagtatattggggccttcttcccgcatagaagaacagacgattattgcaaaattggaaattacgggagaaagcacgttacaggcggcatacagactccaggtagaggagaagctgacccacgtggcgtgtttgaattttgcatcagctaaaaacccgggaggtggatttctcggaggcagccaggctcaagaagaaagcttggctcgttcgtcagcgttatatccttgcatttcacaaatggaagagatgtatggacataatcggaagctgcggagctgtttttattcagattatatgatttattcgcctgtagttccggtatttcgggatgatcagggaacattgttggagaagccatatcaagtcgacttcctgaccgcacctgctgtaaatgctggagttgtgcgagaacgggagccagagcaggtgaatcggattggggaagtgatgctggagcggatccgttacgttcttggaatggctaagcaaaacggcgtagaacatcttgtgctgggagcctatggttgcggagtatttcgcaataagccagaagaggttgccctctggttcaagcaagtgcttgtagatgaaggatatggtttgctgtttgaccggattgtttttgcagtgttggatcacaaagcagaccaacatactttaaatagctttaaaaatgttctttcttgaagtgaaggcagtgcataaaaactgttttactataatattccatgaaaaaggaaggtgctgaatgaatccatcttcgaatataacctggcatgtgtccgatattgataagcaagcgcgtcagctgttgaatggccataaaagtccggtactttggtttacagggctgtctggttcgggaaaatcaacggtatcctccacacttgaaaaagcgttatacgcacgaggcatacacacgtttattttggatggagataatgttcggcacggtttaaatcagaatctaggtttcctgcccgctgaccgtaaagaaaatatccgccgtattgctgaagttgcaaagctaatggcacatgcgggtgttctaacgatttgcgccaccatttccccttatcgtgaagatcgtgaaatggtaaaggagattttacagcaggaaggttgctatgagatttatatacagtgcagcctggaggaatgtgagcgacgcgatccaaaaggaatgtacaagaaagcgcgtgccggagaaattcatcattttacgggggttgatgctccctatgaagcaccgctggagcctgatctaatcgtatccactgaaggtcgggagataacccagtcggttcaggatatcttggattttcttgataggaagcagctgctattatgattttatgatgaattctacatgaatattgtctgaaagcctcaatggcaaaacttcgagaagtgatcaaagtaatcattatagaaagtaaaaatgaaacatatatattggtaaataaatatagtactgcatatacggcaagccttatggggcttgcttttttatttatgattttaaactaattctaaatcctagattataataattataaaaaggtattgatttttgtttgtgcacaatttatagtgaaaggcacatagttaaccaattcattcaagaggtgatttcaatcatgagtaatcaaccaacgaacctgactacaagctggggcgctcctgttggagataatcaaaattcgatcacagcaggctcacggggtcccacactaattcaggatgtgcatctgctggagaaattggcgcattttaaccgggagcgtgtgccggaacgtgtcgttcatgcaaaaggtgcaggggcgcacggatattttgaagtcactaatgatttgtctgcatatacaaaagcaagcttcttgtctgaagtgggcaagcgtacaccgatgtttatccgtttttctactgtggcgggtgagctgggctcgtccgatactgtacgcgacccacgtggttttgcggtgaagttttatacagaagaaggcaactatgatctcgtgggcaataatacacctgtgttttttattcgggatgccattaaatttcctgactttattcatacgcaaaaacgtcatccccaaacccatctgaaaaacccgaatgcggtctgggatttctggtccttatctcctgaatcgctgcatcaggtaagtatccttatgtctgaccgcggtattccagctacacttagacatatgcatggtttcggtagtcacacgttcaagtgggtaaattccgaaggacaggcagtatgggtgaaatatcattttaaaacagagcaaggtgtgcaaaatcttgatgtggatttggctgcgaaaattgccggtgaaaatccggattatcatacagaagatttgtttaatgccatcaaaaaaggtgattttccggcatggaaacttcatgtgcagattatgccggtagaagatgcagatacgtaccgctttgatccatttgatgtgacaaaagtatggtctcaaaaggattatccgctgattgaggttgggcgcatggtgctgaatcgtaatcctgagaactactttgctgaggtagagcaggcgacattctctccgggttcatttgttcctggtattgaagcatccccggataaaatgctgcaaggacgtctgtttgcctacggcgacgcacatcgctaccgtgtaggtgcaaatcataattcgttgccgatcaaccgtccgcatgcagaagtacacaactaccaacgcgatggtgcattacgcagtgacagcaatggcggaggatctgtttattacgagcctaacagtctcggtggacccaaagaatcacctgcgcacaaaattgctccttttgaagtgtctggcgaagcgcaaagtgtagcctacgatcatcatgatcactacacacagccgggcgacctgtaccgcttgctcagtgaagaagagcgcgcacgtttggtccgaaacatcgtaaatgcgatgaagcccgtagaaagtgatgaaatcaaactgcgtcagatcggacatttctacaaagctgatcctgaatacggacgccgtatagccgaaggtttgggcttgaccgttcctcaaggcgagtagaggtatctgcaaactctaacctgaaagccgtatgaatatataataaaaggatgtcccaacaccacgtacatggtggatgggacatcctttgtttttgagagcgatgtaaatcaggtgctgctatatcctctgcaagcgaggtaaatagattacaagaaacagtgaccgtcctagtgcaaatacgataaaggatagccaaagtccgtgattcccatattggggaacgcaccagaagagagcgatcaaaaagcagagcaatgagatcagcatcgaattacgaatcggatacgttactgtcattcctgtaaacacaccatagaacaccagtcccagcccggctgccagcggaaagaccacaagccatccattataagggcctgtaaagctaatcactgtagcattatccgtaaatagcgagataagcggctctttcagtgcgaaatacaatcctcccgtcactacgctggtcaccagtgtccagaaccaggacaagtgaataaccctttgcagcattttacgatccccggcacccctagcctgacccgtcataatgctactggcgttggcgaacccatcaaaaaagtaagccataatataatggatctgcaacaaaatagcgttcgccgccaactgatcggttccaaagctcgcactgcgcgccgtaaacagattaaacattgtcagcagacaggctgtgcgaatcatgagatcaaggtttgttgccatgacatttttcaactctgaagctccaaaccaacctcgccaattcatctgtccgctttgcttccattctctccaaatcgatgagcggaacaccagaactagacccaatatacatgcaagggcctctgcaatcagagtagcgcttgctacaccagtgacattccaatgcatcatctgtgtaaatacaatagctaataccatattgattacgttcattgaaatttgcaaaaataatgtagccttcacacgggataatcccatcagccagccaagcagcacatagttcaccaatgtaagaggggctccccaaatacgaatggtaaaataaattgctgcctgcgccgctacatcctgagccggatggattagctgaagagaagctagcagaattggcttttgtaacacaatgaataccgcaccaatgagtagagcaatggccagtgggcgcatgagagcagctatgctctggtcgttattttgtgcccccgcggcttgtgccgtgaaagccgatgtgctgactcgcaggaagccaaacagccaatataaagtattgaaaataagagtgcccaccgctacaccgcctaaatacgcggaatggctcaaatgaccgattacagctgtatccaccgcaccgagcagcggggttgtaatcgtcgaaataattaaagggatagctaaagcaagataggctcggtgggaaggcaacatgttgaaaaaacctccagtaatgattgtgtataaggatggcgatccgaatgaaataatgcttctttgggaaaatgctcaaccacactgccttctttcatgaccatgattcgatcactcataaagtgcacagccgccagatcatgtgagataaacaggtaagccagtcctagctcatcctgcaaatccttgagaagatttaaaacggtggcttgtgtagtcacatccaaacttgccgttggctcgtctaatacgataaaatccggctctgtgctgatggcacgcgcgatggttacacgctgcttttccccaccgctgagctgatgtggaaacttgtccagatagctggctggaagctttaccatatcaagcaaatgttctgctatatcccgacgttctgaggacatacccgccataaaggaaggaacatagtacttaagctggtccagtggctccagcagggagtgcaggatggttagtctggggttcaaagccgcagatggatgttgaaatactgcacccagcctgctgcgaatccgttttaattcgctcagctttagccctcggatagactgtccatccagtctaagctcgccttgatcaaatgggtccagtgtcaaaatacagcgagcgagtgtacttttcccactgccgctttccccgacgatgcccagacattctcgggaggagatcgtcagagcaacatcttgcagcaccgttttgcctccagcgtaagccttcgtcaaaccggagacggtcacgacaggattagaagtgtcttgccgttgagcgcaggtggcttggttatccatgtaaagcgctcctttccattgcgttctgttcttcagtgctgttgtaaggtaaacgtgctggagcgcccggagacagcggcggaatagccgccagtagacgacgagtatacgggtggtccggatggttcagcaccgcttgcgtgtcacctatttcaaccagtgaaccttcgcgcatcactgcgattcgatctgcatacttgcgtacatgacgcaggtcgtgagtgatccacaagacggaaatacccgtctccgtccggatttggtcaatgagttggagcacccgatgtgctgtgagcgtatccagcgctgttgtaggctcgtcggcaataagcaacttcggctccagcagtagtgcagccgcaatagctgcccgttgcaattgaccgccgctgagctggaacggatagctgcggtacacacgctcggcgggaagctgtacgcgctccagcacctcgatacagcgctgtttgcgcgccttgcgatcttgtttgccatgggcgcgcatcagctcgtccagttggctgcctacacgcagaaatggggtgaaagccccgtggtagtcttgaaaaatgtaagatatttcactacccagcaaagaacgtcgttgtttagcggatagggctagcaaattattgtccttccacgcaatgattccttccgctgtaacagaagaggggagaaggccgccgatagcgaacgccgtcatgcttttgccgctaccgctttcgccggctagagcacaccattctcccggacgaatggcaagctccagttgctctacaatcgtttttacatttgtccgaatcgttaagccttcaatagtcagcatgtacagctcactcctctgtccgggttttaacatcataacggtcgcgcagtttgtctccaaatacgttcgctagtagcactgttagcacgacagctatccctggaaccagcatcaggtggggagccatttgaaaatatgctcgtccttcattcaacatagtaccccattcgggaattggcggctgtggacctaagcccaaaaaagatagggaggcaatcattaaaatgattttgccgatatccagcgtagccagcacaagaacattcccaattgcatgggggagaatatgccgcatgacaatccgcagggaggaggtacccgccagtatggataacgaaatgtaatccttttgcttttcagccagaacggtactacgcaccagacgtgcataaccaacccattttaccgccgtcaccgcgaaaataagatttactaagcctggtccgagcaaaccgctcagtacaatggcaaaaatataatcaggtaatgtcatgaaggcatcgaccacccgcttgaatacacgatccatccagcctccaataaatcctgaaagcagacctagagggaccccgacaaccagcgaaacggccaaaatcaataaactggttccgacagtcgtccgaagtccagctatcactctcgatagtacatctctgcccaaatgatccgttcccagccagtgcgtagcgctgatcgattgtagtcgattccccatctggatgcgatacggatcttgcggtgcaagaaacggaacgactgtaattgctgccagaatgagcaggatggagagcgatacgatccatgttttggacaatcgtgttctagtgagctgcccgtttcccgcatgtacggattttatcatgataaacgtttctccttcaaagcgatttcaggattgacccaacggtaggacagctctaccaaaatattgatacatacaatgaatgcagccataaatacggtatagccctgaataatggggtaatctcttgcagcaatggcatccacaatccatttgcccagccccggataggcaaatagcacctcaattacgactgtgcctcccagtaggctgcctatactctcactgaataccgtaataagcgggactagactgtgacggagcatgtgtctgaaaaaaatgcggatggggctgattccacgggcttgcgccgctttgataaagtcttgccccgagctttcaatcagacttgcgcggatcattcgtacataaacggctgccattgccaatcccaaggtaagagaagggagtaccaaatgaaaagcggttccttcacccatagacggcaaaatgcgcaatttaactgcaaaccattcgataaacaaaagccccagccaaaagctgggaatcgaggagccgattaaggcaaacacacgactggctctgtcaatccaacggttacggtagagcgctgccatcgttccgagcgggagagctatcagcagcataatgaacagggagcctccggtcagcagcagtgtataaggcagtttctccataaactctgtgaataccggacgatgggttaaataagattgtccaaaatcaaactgaagtaactgaatcaaccacttaccatattgcacaggcaatgattgatccagccccagttggctgcgcatatccataatttgctgattggacacagctacatcatcgactcggagaatgctcctgacgggatcgcctggaacaagcttaagcagacagaagctcacaaaggaaagaataagaaagaacaaaaccagttcaagaaactttttggcgatggatttgaacatgctaattcacatccaggtcctgggtcagcaagtagtattcactttggctagttacccagttatgtacgtaatcgcgataggccactacgttgttaggatggaccagaaaggattgcagattttgttggtcaatcagcgtgacagccttcagcgccagcttgttgcgttcttcctcattcacggttgtgttcagctgtgaaatcatacccgtgagttctggtacatgcacacgcccataattcagtgctccttcaggcatgtaagccgcattcagaaaatagcttgcatcgccgcgcggggctgtaatgctactataagtcgctaaatcccaatcctgatgtgcggcgagatattcgtcaatattatcaacctgacggatatcaatcgtaatgccaagttctttagcgttagcctgaatcagctgggaaatgagtggaagctccgctctcgactggtaagttagcagtgtaagatgaagcggcttgccgtcggggttcgcaacttttccgttctgcactgtatatccagcttgcttgaagccttctcgtgcagcattcaaatcaaactgtttcgtaatatattttggtgaaaaaggaaagtcggacaagaacgggccttgagcaggggttccctgaccagacatgataccactggcaatctcatcccgattgatcaggttatcgaatgctttacgcacagccgtctttttcagatcgttattgttcatattgtaaatcagctgatgcgttcgcaaactaggaagcgagtctaccttaacagtagaatcagctttcattagctccaagctttcaattggcgggcgatacacaatatcagctgttttggcttgaaaagcaagctgacgcgcattggcgtcttcgttaaacatgaatttggcatgtttcaactttacttcaccgttccaatattgttcattgcgatctaaattcagttcacttccagcacggaagctggcaaccttgaatggtcccgtccctgatgggaggtcacctgtagctgtggtgtctataatagccgtattcggatgaaccagctcagacacaaattctgggaaaggcttgtctatcgtaatgttcaaaatttgtctatccgcatgaatatcacggatatgcagcgcatttttgaccgatggattgagctttagcgctctttccaaagaggctttgacagcagcggcattgacggctttaccgctatggaagttcacacctggtcggatgttgaaggtccagtgctgtccgtccttgctgtcccatttctctgcaagccaagcttccagcttaagatccttgttcactttgatcagtgtttcacttactccagcacgaacagctgtgtaatttacatcagcatgaggatctatagaagggctttgcacgttaaacaataaggtgacacttttatcttgtggtgcagcagatggagagggtgaagctgacggagatgaagcgcaggctgccatcatcaccgccattaccgcaggtataaatagtttaaaatacgaacgcttaaacaacagggagtcctccttaatagtaatcgtaatttttacgctttaatttataaaccatatcgtaaccaaatgaaggaactttgtaaatatgtaattgatgaatgtgtatgtaaattcatatgaaaaaaaggctgcataaccaatagtgagatggttagcagcctttaagtatatttagatatgtttaatttggaatggctaaaaatttatgaattaatgcatgggtgctttggcagtgccatgttcaacatgaactctgcggatgaaaaacgcaaggatcaacccgatcacgctgataatcatcgcaaagaaaaatgaattttgtgatccgattgccatggcattggccatttcatttacggattcaggcatactggattgactcaaatagctgtccatgcctttcgagagaatgcttaccgctacggctgtaccaatagcaccagcaacttgttggagcgtgctcataatggccgttccgtctgggtatagatccatagggagctggttaagtccgtttgtctgagctggcatcataatcatggaaatgccgatcatcaagcaactatgaagcacaataatgagtacgagagttgaagttgttgtaatgccagacaggaaaaataaaacagcggccacgatcacaagccctggaatgacaagccatttgggaccgaatttatcgaatagggagcccataatgggagacaagagaccgttgataatcccaccaggcagaagtaccaaacctgctgttagagcagacaaagccagccctttttgcaaaaagagtggaagaatcagcatcgtagaaaggatcgtcatcatacataagaacaccataataacgccgatcacgaacataggatacttaaacacacgcaagttcaacataggctgcttcatcttcaactgacgtacagagaacagtatcaacgataccagaccgacaatcacaggaagcagaaccatcaggctagcccaaccttcgccaccttctccggatttactgaaaccaaacacaacaccgccgaagccaatggaagacaggaggatagataaaagatcaattttaggcttggtcgtttctgaaacgttttgcataaataaaataccgcaaatcagcgagagaaccaagaacggaagagaaatccagaagatccagtgccaagacagattttgcagtaccaatcctgcaatggtaggtcccacggcaggtgcaaacataattaccaatccgatgatccccatagccgcgcctctcttttcagccgggaaaatgatcaagatggtgttaaacatcaacggcaataacaacgctgtaccaatggcctgaagaatacgtgcgatcaatagcactgaaaaagtaggtgcaagtgcagcaacgagacaaccagctattgaaaacagcaacgatgtcacaaacagctgtcttgtcgtaaaggtttgaatcagcaatcccgatacaggtactaaaataccgagtgtaagcagataagcggtagtcaaccattgggctgttgcagttgtaatatgcaaaatctgcatcaaatcattcagtgcaatgttaagtgccgtttcactgaacatcccgataaagccgctaaggagcagggcaatcataataggtagcaccttgaacgttttgggttcagagggtgaactcgattgactcattgtattcatgttgtttttgttcctccaataaattaatggtgttgaattataacgatcggtctatatataataaacatgttgttatttttttgtcaaagtataagttataactactatataatgaaggatgctgtatatggctggtaaacccgaatcatacgagaatatcgtacaaaccgcatcgaagctcttttttcatcaggggtatcacgcgaccggactgaatcagattcttgcggagagtggatcaccgaaagggtcactttattattattttccgcgtggtaaagaagaattggctttggagtgcataagaagagggaatgagtttataaagcaaaaattaaaacagacactgaacgggaatgataatccagtactagccattcaggattttattcgtaatacagctgaggaggcagaccgtaccggctttaacgacttcatgccgattgggttctgggctgctgcggaaacttcctgtattagtgaatcgctacgtcatgcctgtgtgaatacgtttacagattggcagcacatctatatggagcgccttcaggattcgggctgggaagaggaaaaggcacacagtctggcggtacttattatttcgatgctcgaaggtgcattgattttggccgttacgcaacagagcagtgctcctatttataatatcgtggattacattccacagttggtcaaataatcctgtctcttcgattttcaatcgctcctaatgagccccaacaagcaacttaaaaaagccgatgttttcggttttgagaactcggcttttttgtggttctgagacataattttactcacattaccagcaccaaatgatgaaaagtatggtaaaatagaatgaatttgattttgattttgcacgaaggaagggtgatagcaagtggcaaaagcgaaggtacccaaacggcctactcgggatgaatttgtactggaggaaatcgggaatcagcttgtagaagcacaacgagagcaatccgaagttgtattgaccgtatggggacgcgaagaaacaacccgtggacaaattgttaaaatggacccgagaacaggaaaggttcatgtagagagtaatggagaaacggataaagttccttttatggatattatgagtgtaaattacccgagagattagttgttgtgattacataaatatagcagatagggaagaaaagaatgaccaagttagagtctcccttactgcgtgggaaagtaacaatttacaattcgcgtatacaaaaacaaccgagtggtttagagccatcggttgtttttgtatactgctgcatgagtgggaagaaaaagcaacgttattgtgttggcactttcccttgtacatgcttatgtagcttttatcgggctggtatgactggcacgtgcttcggctttcttaagcaccttacgatcaaaaatgaaaggaccaaacggcaacagcgatgcaatcaaggctgcaagactttgcaatagcgttatttttcgcagaatcagcatgaccacagtcgctacaacataggccacgaacagtaccccatggatcatacccacccagcttaccatttgtggcattccagctgcgtatttaagtggcatagcgatacacacaagcagcagatatgaaatcgcttcaatattaccaataacaccaaacatcttaaaggcatttttgaacataatacacctccttctcctattgcttaaaatttaatatatcctataatgcaatgttattaaacggtagaaagttacgatatatcgaatatttatagctgaatccaaaggttatgtcagagctttcacatgattgaagtatctcccaccaatgcttcatttcgttgcttccaacgtcccacagcttagcgtgctcggaaacgataatcgtaatttcgtttaaattgttgaaacaaacaatggggcttagaaagatggcttggagtaagaaaaaacactaagctggtgtagttcgaaggcttagcatatattgtttgcgcgacccctatctgtaaaaatgctagtgtgaagcctaaacattttgtatggaaattccgataacagttaaatgaatgtctgtacattttagtgtgaattttaaaagctggattgcagcagaagggtttgtaagcttgacttattagttttgacaaataaaatttccatactggtatcaaggagagcatagattatgaataaaaaacgtttgcgtcaatggatggctccgttcgcaacggctacactgattttgaatacgggatatggcattttggcacccgatgcagtggctagcgcgttgtcgactgaaaggcataacttaaatctgacaggcctgaatacagcacagttacataccaaattagcaaccactcaaggccgtcatgtgcctgttacttcgggcacgaaagtgactacgttaacaaaaggttatagtcagaatacctatcttaaccaaatgctaaaagtaatgtcgagtcaaatggttactgcgaatatcgcaccggcagaggtaagcaatctgacagcggttcctacagaaacaacaaaagtaaatttttcctggagcaatccgtcggacattaattttgaccacataaaagtggtaaatgtcactaacgatgtatatgtagataacattcgaagtaactcttatatgatgagcggtttacagccgaacacgacatatacctttcgcgtgaaaacggtgaataagagtggagatgaatctctaggtacgacaatacaggctaaaacggcttccgttgatggtcctgtggataagacacccccaggagaggtaagcggactgacagctacgaatgtaggatataacgcttttaccgtaaattacatattgcctaaggatgctgacctgagccaagcgatcatctatttaaatggtaaggaagtgcagcgaactacagggacgtcctattcattcagtggattgattgcttccacaaactatacagtactggtcaagactattgacaaatccggcaacatatctggaggaatcagtattccggttacgacctcagcactcaccgttgatacagtgcccgaagtgacaggagcttcagtgacatcagttaataactatagcgttactgtttcctggacaagacctagcggaattaatacggtcagtctgtataaggatgggcaactggtaactgattcaacaggatcatcctatacattcaacaatctttcggcaagccagacctacacgttcacgattaggtccaagcgaagcacaggtgcattgtcctctggtgtgagactgactgccacaacggacagtacgtcctccaattcgtcagaagtgtccaatcttgaagtagatagtaagagcgacacctggatcaaaatcacctacgatatgccgagtaaagccgacaaggtaaagatatatgttgatggtgattatgaggggactacaagttctgagtcctataaaatcacggatttgcgagaaggacgctggtatgagataaaggtcgtgactgtcaatagtaatggaagagaatctagcggtgtaaagatatcagaacgcacggattcggatggttactactcttcttcgtcatctagttcatcgaactatgagaaggcgagagatttgatgcgaattgcagaaaacagtctgaatgcctccgactggcgttctgcgagagatgcaatcagtgatctgccgagcggaacccgtaaaagcgatttgctggatcggttagatgctattcgcaatagagcaattgggaccagtagttcatcatccgggacgagttctactacaacaacaacttctggtacaacgtcctcctaccctaacaatgcggtttcctcatattcaacttcgttcaccctgacaccaggagctaaatcagcttatgtcgatggtcgtgctacgacgatggctcaggctccgcgaatcataaatggggcgacgatggtcccgctgcgctttatcagtgaacggataggttacgaggtaaattatgaaaaagcgaccaaaaagatcattctgactcgacctacagacggcaaacaagtagtgcttcaggtcaagaattctacccttgccgtgtatgagttgaacaactcccggagttattcgacgaacatcacagctccggttattgttaacggctacacgctggttccattacgagtgattagcgagctttcggggtatcaggtgaactataatactgcatccaaacaaattacgattacaaaataaatacttctgcaaaaaagggttctaaagttttcactttagaaccctttctgtgtattaggaagtgtatgtagaacaatgacaatctgttactctgtaaacaagttattttgattgaaaagaatatcgagttgcttaagctcgccacttgttagtcgaacacccagagtttgaagattggactcgatttgatcaggcttggttgcacctggaataattagatcaacggctgaacgcgttaatagccaagctagcgccttttgcaagggtagttctaattaattgtcggcttagagtatcatcgacttttggatacatcattgaattacctaccacacctgctccaaaaccaagtttaaatgcttttaatcctgtttttcctattgctattgtattgttcatgtttataagcttccttttgtatgatgtggaatccttggagggaatctaatgcacatcttacaacctggtgtaaacactaggtcaagcagagcaattcagttttaaaaaaagattaagtttgggtctcaagcggcaaaaagttatggccaaatttttgcccggtttgcaatttcaattcaatcatatccttaatttcctgaagttcttgcagctgctgatctatctttttttggtaattgtaaagcctatcataccattcattatttgatatgttgctctcatctaattgaagctggataataggttttaactccttcagcgacattccggcttttttttaacacttgatcattaaaagtgcctctttgtgtgaattgttatatatcctgtgcccattatttttgcggccacgggaggaagaagacctattttctcataataccgtaaggtatcctcactgatttggaattgatccataagttctttcattttaaaatttgttgtcatctctcgtcaccttcgtaagggaatctttaacgcttaatgatattcgaacaggcattaaaacgaaattcatgcggggtcaatccacatcgttccttgaagattcgatagaaatatttcatatcatgaatcccgacttcaagtgcgatcgtttgaacgcgccaactagtatctaatagtaagctacaactctcgtgaatacgaatatcctgtagcatttttgtataggtcattccgctagcttttttaatttgcgttgaaattgacgtgagctaattaaaaattgcttacaaatttgatcaaccgacaatactttgaacaccctgctacaacgatgaatacgttttccgagaatcacatgactgaagcttccaaatagagcagacattgtattccttcaagatgttgttaaatggggagagtataacttacccgaaggaagccataatccaagaagcgtagccccttatgttctggaaaatggagagggcggccgattacaatggcaaacaccatttctcgaatattaagcggcaaccaaaccagagttggtatgggtatctatatgatgggaagctttatggcgggggctatcggaacgtctattcttggttccgtacttgatcaaggagtacaaagcaaaattatagcatcatccgttcagcagcacatatagtaatccaataacccatgttccttataataatcgcgagtctgtgccaggagtgttttcattccgatggcaaaatgataaaacgctactgaccttcatatgtcagtagcgttttaaattgtttcaataacaaacgaggaagaggtgtgtgccttatgaatcgaaccaagcttaagagcaaattatttatttcggtaattttctcattatgtcgctaatgaactgacggaatctcaatgcttacctgtccgccgcctgtctgggtggagttggtgatgatcagctttccgccatgtagattgacaatggattttgttatatacagacccataccgtaatgtccatttattcttctggacgagtcacccatatagaactgctcggcggcctgtttgaggccttctggagagaagcctgggccttcgtctaagatgctgaaccgaatgcagtcttccacagactctacggtcagctggatctcgctatattcaggcgcctgatctacagcattagaagcaacattcataatggctcgctcaagtagaactgggtctgcatacagcgtcttagggaggttatatgcagcgaatgctacagatatttttttgacagcagccaaggccattatctgatctttcactttcgttaaatagaagtcagcatccatcgtttccgcccgcagagtgacaagcgtttccgcttttgaaatttcaataagagtcttaatatactgctccatctgcctggtgctttccgatatataatccgtatagttcttttgctcttcggactgattggtctcggatagcagctctacgtttccacgaacgatagtgagtggtgttttgacatcgtgtgctagggcggatatttgctcgcggcgggatctttccagattccactgtttctgaagcgaagtctttaaagtttctttcattttatccatggaatgcagcacctgatcgatctccatcacgccactgaattcgattgagaagtccagatcctgtgcttgaatttgtttggtggcctgctgcaacccactcatcttacgtgccagctttcgtccgaaggaggaagccagcaaggcacctccccccagaaaggcgatacagaacacggcaaaaaaggacaattccgcgttcggcaggtattgacgcaggataggaagttcaaactgagccgagacagaatagcgcatcacagtaactttatcattatgtgagacttttacatagttatagggaaattgataagcagtatcgttctgctgcgtaacactccaagcagtttgagcctgcttttcagaaaggtttccctcattgaggcggccttccgaagtgaatgatgcgtatttatacagtttctgccgagaatccggctgtagggtcttgccagcttcaatgattgtcttgtcctcccgcacctgattctcagcatagttcgcggggagaatggtcccccaagacatcaggacatagaagatgagaaccaggaacagagcgagcgcaatcgtcccgatacagaacataactaaataacccagaaaaatggttcgtagtttggttgtcttgcgtgcttgctgtactttggttacttccatcggtacccaatcccccaaaccgtctccactggcgaaacctctactttgccaagcttggctcggatatttttaatatgctccacgatggtggcggaatcgctgtccccatccaagccgaagacagcttcgtaaatctgctctttagggaacacctgtccccagttcagggctagaaacttacatatctcatattcgcttttggtaaacgggactacaacattctgaacggtgatttccttgccggacagattgaaatgaacttccccgatgcagaatacattacgccgttcacgattttcccgtctgagatgggcgttgattcttgcgcgcaactctccagcaccaaacggcttgacaatataatcgtcggccccttccccaagccctaacatcacatcgttctccatggattttgcggtgaggaacaggatcgggcagtctattttgctgcgaatttcccgacagagtgtgaacccgtccatggtaggcatcatcacgtcaagcagaatgaggtcaaaggctccaagctgcatggtgagaacctgtggggagtcggagaccaccgtgacaacatggccatctttctgcaaaatattttgaaggagtgccaaaacggcgggttcatcatcaacggccaacaagtttgccatgcttaattcacttcccttgctttctttactctagtctttattccgacgaattgtgtccttcccaacgacaaatccataatcctaataataccatgatgactacggtccctactacgcaatatctgactcccgaatcaagccgtatagcttcaggaatagatactgctgcgtttatatcgtattgcacccagatcgtgatgaaccgggcagcccaagcagaggggatgaatatccaattatgatcacccagccctgtaagaagcaaagcggacaatagactctccataatgcctagaccgatggaagctcccttgccgaaccgcaaactaatgaaaaaatgcagaaaatagaggaagacactggacataaacagaatgcaggcagccaacacataaaacttcaagccatacggtgactctctcataagatatatatagccagccccaaagcctccggaggcaagcagcacactgccaaatcccaagatcaggagcaggctgagcttgctcaggaaaggtagcagcttcactggcgagatcaatagctgctggaaattgccagcgactgcctcctgctcaacagcaatggagcagacaataccaatcatggtaggaagaaccacggccaagacctgcaaatagccgtccacctttgaaatcggtgaatacggagtaaaggaatagtaggctagaaagattgctatgcctaaaagcggcacaaacagctgcacaagcagtaagggctgccttctaagtttaagcacatcggatttcagatagcggaaaaaagaaatcatcttatttagcctcccgcttgcggaaggacatcgccgtcagtatcgacagaattatgaacaggcagattgtgatcactaggccgggcacaatcacgcctttatccaaaagcggatctcctgaaggaacggcaagcccattaggtagcactttaatgacggcgcacattaatcgggctggaatagcataagggaccgcccaccacacagaggacgtagcgaacaaaatggtgcaagatacgttgcccagcatgttaataattagagtggcaaacatgcctattcggtccgtcaggaacaggcaaagtggaacttgccacaaaaaggtgatgaataggattagagttgcagcaacgcttcctgctagtgtcacggaagttgagaatacgaatccgccaagcgttatccctataaataggacaataaaggaaaccattaagagtcttacgcaaaccccgattttaccgtaccatacctgagccaaatctacagccatgccgaggacagcatggtatttcagcttcttgccatccttttggatcactcctgagcacattaaggtgagggcacctggcagcagcatgaaataccaccaattgtagctggcactttggagcatacgtccccccatgagtatggtacacagaagaagagtagctatgggggcaagccagaccaacttttttgtgaaggtgcgctttaattttagatgttcggcggctatatattgctgcatcctactcatccccttttcggtattcctgtgcaatctgcatgaacaacgattccaggttttgccctggagtgaccgcctcttgataagctaatacgccgccggcaatgataccgacatggtcaacgatttgttcgacttcggataaaatatggctggaaagaattacggtaattccttgcttcgggaaggagcgaatcaactcgcgttgctcctgaataccaatggggtctagtccgttggttggctcatctaagatcaatagcttgggatgattgaggagagcaatggcaatgcccagccgctgtttcatacccatcgagaactggcccgagcgctttttcccggtatgggtcaaatcaaccatgttcagcacttcatcaatctgcgaatcaggcaatcccagcaacgttgtacgaactttgaggttctctctagctgtcaaattctcatagagtggaggggattcgatcagtgcgccgatctgagcaagatcttttcgggaccagggttttccttgaaataaaatctcaccggatgtcgggcgtagcataccggttaacattttcaaggtggttgattttccagccccatttgggccaagtagtccatagacggaattctcctgaatagacagtgtgacgttgttcaccgcctgttgtcgtccgaaggttttgcagagatttttagtctgtaaaataatgttatccatatcagttcatccttttcatttgttctgacaactactttaaagatcaattctaagaactttataaggatttaaaatattaatttcaaactttatgcattcatgcactattcgctataatggatacagtgatgtaggaaagggatgtaatcatgaagaaggtcatcgtaatcggatcaggaattctgggggcatcgacagcataccatctagcaaaaatgggcgctaatgtcattattgtagatcgtaaagataaaggacaggctactgatgccgctgctggcattatctgtccctggctatcacagcgacgcaatcaggcttggtaccagctagccaaagcgggagcacgtttttaccctgggttgattgaagaactcaaaagcgagggagaaacagaaactggctatgctcaagtgggggctctcagtattcatgatgatttggagaaaatcaaaaaaatggagaagcgggcgcacttacgacaattggatgcaccggaaatcggtgaaattacccggctaaatgaaaaagaaacccatgaacggtttcctttgttagtagaaggttatcattctgttcatattagcggtgccgcccgaatagatgggcgtgcgctgcgggatgcgttggtccgatcagcacaaaaaaacggggcggtccttatacaaggaaatgctacgcttcaatatgagtccgaccatgtaacgggagtagtggtcggtgcacaaagcttctcgtctgacaaggtcattgtttgtgcaggtgcatgggccaatcaactactgttgcctttgggcattcattttaaggttagttatcaaaaagcacaaattatgcatttgcaggttcctaataggcaagatacaggcacttggcctgtagtcataccgccatctgatcaatatctgctggcttttgataaacagaagattgtaataggggcgactcacgaaaatgaaatcgaaggttacgatacgagagtaacagcaggggggatgcaggaaattctggataaaggtttagcattggcccctgatttagcaaacagcacttttcaggaggtaagagttggtttccgtccttttacacccggttttctaccggtgatcggagctgttccaggctgggatggtcttatagcggcaaatgggcttggagcatccgggttgaccatgggcccctttattggaaatcagctggcaaagttggcacttggaatgaatgtagatatcgatatcaatgattatgatattcgaaaagcaatagatgaaagttgagccttgactgaggagaacaatatatatacttactgaaaaagtcgccatattggtattatccccttcta

SEQ ID NO: 2643 - DNA, 72758 bp, Unknown
  Kingdom: Bacteria, Phylum: Firmicutes, Class: Bacilli, Order: Bacillales, Family: Paenibacillaceae, Genus: Paenibacillus
gtttttgacataaggtgctggtgcggctgacatttctcgtatgagggatgtcagcgtttcttttagggaatttgcgtactcatccattggcgtaacctcctcgttttttcaaggggcttcgccacatatgaccatcttcttgtcaagtcttttttttctttttcatgcaaaaaaagagcgggctatcttttcgataacctgctcttgttcctgatttagaacctgcgtcttatcttaatgacattgaccgttcggtctgccctctttttgttcccgggctgtaaatatggtttaatggagagagggcaaaatagagataaagatgcacaaagataggagagcttgtatgactcaagaggagaaacaaacggaattacgctggtatggcgcaccgctacgcgtccgttatcaggaaagcgaccagatgggggtcgtatatcatgcgaattatttgaactggtttgagatcgggcgcaccgaaatgatccgacaggcgggttttaactatcggagtatggaggaacgaggagtcttgctgccagttattgaaatcaatgcgaaatatgcgagtcctgctcgatatgatgatttaattaccatttataccgcaattacggacttctccagactacgtctagactatatctatgaggttcgacgggtaacggaagatgagcatcaaaggtatctgggaaaggtatggacccaggcagacacgctgccgggagagctgcttgtcacagggatgacacggcacgtatggttgaacaccgaatggaagcccgttcgactggatcaggcgctacctgagctttacactgcattaaggtttgcttttacaggcggggagggacagaagtcatgatgatgcgtaaacgtctgtggctgttgctgctgctcattcctttggcggagctgtacgggtttatatgggtaagtcactggattggagcgggcaaaacgattttactcatcattctgacgaccctaatcggggctgccatgatgcaatttgaaggtcgtaaggtgattgccgatgcgaaaaatgaaatgaaccggggacaaatgcctggccgtaaaatgctggatggattatgtgtttttttcggtgggagtttgctgcttatccctggatttttaacagatattattggttttacgttggtgtttcctttaacacgagcgttgtaccgacgctttttattgaagtggctggagaaaaaaatgaaaaacggcagtattacgtttcggcggttttgacgtgagctgccgttttcctatccgtgatctagcggactcttccagcgagaatatagttgcgcaagtcctgaatgacattcgcgcgattcagtgcatcaacgacaatgagtgatacaggtccgataattagtcctaaaacgccaaacagcttgagcccgatgaacataccgatgagggtgggaagcgggttcaagcccacgctgctggccagcaccttaggctccacgatctgtcgtccaatcaacaggatgatataaaggatcgacaatcctacccctagtgccaaattaccagacatatacgcatacagtatccacggaatcatcacaatgccaacccccaaataaggtagcaagtccaccagcccgatcatcaaaccgatggtaaaggcggattccacacgcaatatgaacagcccaacaatgaccgttaatgccgtaatggagatgataatgaactgtgcacgcaaatagccgtacagtgctttacgcaaatcgtgccatatatccgacaatggcttgcgaattgtatcaggaatcgtgtttgagagcatccgactatgtcggtcccaatccttactaataaaaaaggctgctaatacaataaccattagaactgctcccatattaggcagagaggtcagcaagttcaaaactccattaaaaaattgagcgactagcgtagtgacagccgaactgacagtttgagttgtcttatcaatgttactgttaatggtatgttggtaatccggattatcccggataaaatggttaatttcaataattacattttgaatcaaatcactttgtgtccaatcgataaacagacttttaaaacgctcaatatgtccgtcaaaagtcatggccaactttataacttctcggaccatgcgggtgattgccgcagataggataattgcaattccacctaaatatacaaataatgagaccgtgacagccgtccaacgtggcatacgggctttgctacgcagaaaactaaccagtggattcatggcataagccacaagccaggcgaataggaaaggatagacgagagggaaaagcacatatatgcccagtaacagagctacaatcacaattgccacccatagagcacgaaatatgcggttcaggattaaccggctcaagctttcacggctcctttcttttatgatagtctttcataaaataaatgctctactatacatatgcgggaaagggggaagacaagacctgtgtaaaaaagtgcaaatgaatcaatattttttgtaaggggtttcaaaaatttatttatggaagcgataaaacatttgaatgtgttggaatagccctcaatgttcacataaacgacaaaatccagtatagtgaaagaaggtttaaatattgacatatggcgttaacattactcagctatttaaaagacatatcttacttttgaaaatgtttacattgcaagtccgttcacaatgtttttacaaaggagagatgtaacgatgacagcgactaaaggtctggaagggatcgtagcgaccacttcctccataagctctatcgtagatggcgttctcacgtaccggggttataacattgatgatttggctgttaacgccgattttgaagaggtagcttatttgttgtggtttggaaaattacctgataaagagcaattgcaggagcttcgcaaccagttaagcgaatacgctgctattccggatgaaattgttactcaattaaagttatatccgaaaaatttgagcacgatggctgccttgaggtcagccgtatcgtctctcgctttgtatgacccagaggcggatgatatgtcgagagagtctaatgtgaccaaaaccgtcaagcttcaggcgcaattgcctaccattgtggcagctatagcacgtatacgcgagggcttggagccgattgcgcctaaaaaaggtatttccattgctgaaaactttttgtatcagctgactggcaaggacccggaggagacggctattaaagcgttcaatcaggctctcgtgttgcacgccgatcatgaattaaatgcttctacctttgctgcgcgtgtaacggtagccacattgtcggatatttattccggaatcacgtctgctattggagctttaaaaggaccactgcatggtggggccaatgaggctgtggccaaaacgctggaggagattggtggcttggatcaggtggactcctatattcaggcgaaactggataaccgcgaaaaaattatgggctttggacaccgagtctataaaaacggtgatccgcgtgccaagcatttgcacaaaatgtcccgcgaactgggggaaatgaacggcgacacaacgttgtttgatatgtcagttcgaattgaaggaattgtaacagggcaaaaaggcttgaagcccaatgtggatttttattctgcctctgtgtatacccagttgggtatcaagagagacctgtttacacctatttttgctgtgagtcgtgtatccgggtggaccgcacacattttagagcagtatgaaaataaccgcctgattcgtcctcgcgccgaatatacaggtccaatggatcaaaaatatgtatcaccagagttgcgttaaccctttgtcgaaggaagattgaggttgtataccctgaatttaaaaaataaggtacaatagaggggacgacgagagatgtacgtttttgtctgtgataaagatcatgtctttcgtcctgtacccattcatatctgaggaggaaaaggaacttatggcgaaatttgaaaagtttgagctcccaactgaaggcgaaaaaattacgattgataacggtcaactacgggttccgaaccatccggtaattccgtttatcgaaggtgacggcacgggtcgcgatatctggaaagcttccaagcgcgtactggacgcagctgtagaaaaagcatataacggcagcaaaaagattgcctggtatgaagtattcgctggtgagaaagctttcaatacatacggcgaatggctccctaacgatactttggaagccatccgtgagtatattgtagccatcaaaggtccacttacgacacctattggcggtggtatccgttcgttgaatgtggcattgcggcaagaactggatttatacgtatgtctgcgtcctgttcgttattttaacggtgttccttctccagtgaaacgtcctgaattggtagacatggttattttccgtgagaacacagaagatatttacgcggggatcgagtatgctgaagggtccgaagacgtgaaaaaggttattcagttcctccaacaagagctgggtgtgaacaaaattcgtttccctgaaacctctggtattggcattaagccagtttcttccgagggttcaaagcgtctggtacgggcagccattcagtatgctgttgaccacggacgcaagagtgtaacgctcgtacacaaaggtaacattatgaaatttaccgagggtgccttcaaaaactggggttatgaagtggctgaggaagaatttgcagataaagtatttacttgggcccaatatgatgtaatcaaggaaaaagacggtgaggatgcggcaaatgcagctcaaaaagcagctgaagatgcaggcaaaatcattatcaaggatgcgattgctgatattgcacttcagcaagtcctgactcgtccttctgaatttgatgtaattgctacgctcaacctgaacggggactacctgtccgatgctcttgctgcccaagttggtggaattggtattgcgccaggtgcaaacattaactatgtaacagggcatgctatctttgaagctacacatggtacagctccaaaatacgccgacaaagacgtagtgaaccctggttccgtaattctgtcgggcgtaatgttgcttgaacacttgggttggaaagaagcggctgacctgatttacaaagggctggagacgtccattaataagaagattgtaacttatgactttgctcgtctgatggatggtgctacacaagtgaaatgctccgagttcgcagataccattattagtaacctgtaaggaaggggaataccacttgtccattcaacgtaaaaaaatatccattgttggcgccggttttaccggtgccactaccgcattgctgctggctcaaaaggagctgggtgatatcgtactgatcgatattccgcaactagagaatccgaccaaaggcaaggcgcttgatattttggaggccggtccggtacagggatttgacagccagatcacgggcacttccagttacgaggatgcagctaactcggatatcgtcattattacagccgggattgcacgcaagccgggtatgagccgtgatgatttggtaaatacgaacgcaggaattgtaaaatccgtttgtgagaacgtgaagaagtatgcgccggattctatcgtcattattctgagtaatccggtagatgctatgacctatactgcttatcaaacgcttggattcccgaaaaatcgggttattggccaatcaggtgtgctggatacagcgcgatattgtacctttattgcacaagaactgaacgtttccgtcgaagacgtacgcggcttcgttatgggtggtcacggtgatgatatggtgcccctggtacgctattccagcgttggaggtatacctatcgaaaccctgatttcgcaggaacgtatcgaagcaatcgtacaacggacacgcggtggtggcggtgagatcgtcaacctgttgggtaatggtagcgcatattatgcaccggcagcttcgcttgcacagatgacagaagcgattgtaaaagataaaaaacggattatcccggtcattgcctatctggagggagagtacggctatcaggatttgttccttggcgtaccgacacttcttggcggtaatggtatcgaaaaagtgttcgagttggaattgacagccgaagaaaaagcagcgctcgatcaatccgccgaatcggtccgcagtgtgattaaaatagttactgtatagattcaattttctactaaaacgctatacttttacttgaagaggtgttcccaagccatagtcatggccatcggacacctcttttacttttaaacggaatatagaatctattcgttttcttccttatttcctttgctttggaccacttccccggtataatagagttcacatgcattgatagttacatgaggatttttcaaaaatccttacatagaaaagcatgtcccaaaacactgaaaagatggtagtcattcgttggaatatgatcgttctatggaaaaagagtttgtgagaaaacaaagaaatggaggttataaagaatgttttttattcacattattggatcactggcgatgggtttttatttattgctccccttcgttgtgggcaaaatcgacaaattggctccaagtgcgcaggaagggacgatatcggctgtacagctattaaaccgtctggctcaatttgcactgattcttgtacttattagcggcatctatatgatttttgtttgggattcttattcggtagtatggatcgttgttgtgttggtgttgtttcttgccatttccggtattgctggtgctatgggtaagccattacgcttgtcactggaagcggttcgtaaccaacagccgattacgcaatacgctggtaaaatgcggatgttcagcacgctgctggctgtcttcatgattctaattacgattttaatggtatacagccatattatttaattatgcatttggtgagagcctataatccaatgatgacaaatgctaaattgaaaaaaaacggtctgtgctgaataagcataggccgtttttttgtgcactcaaataactacatttttcttttttcgtttaacgaataactttgtgtggtaaatcaggagtagagtggatgcaaatgttgcatcctaaaaaatatctgattttgaagggagaatgtacaatgcctaaaagtaatcaacctcagcaaactttgcccccacagcatcaagaccaacaaccggggattgagtccaaaatgtcgcctgcacctcagtttgaaaaaccaacttataaagccgctggcaagctaacaggtaaagttgcacttattactggtggggacagtggaattggaagggctgtagctgtcacgtatgccaaagaaggtgcggacgtagctatcatctacttgaatgagcataaggatgcggaagaaacaaaacgtcaggtagagcaggaggggcgcaaatgcgtattgattcctggcgatatcggagatgaccaatttgccaaaaaagcggttcaacagacggttaacgagttgggcaagctcgacattgtcgtgaacaatgcggcagagcaacatccacaacaaaagctggaggatatcaccaaagaacagttggagcgcacattccgtacgaatattttcggtatgttcttcctgacgcaagcagcattgccgcatttgaagaaagggagcacaattgtcaatacaacatcgattaccgcgtacgctgggaacaagacactcattgactattcatcgaccaaaggggcgatcacatcctttactcgttccctttcactcaatttggcggatcaaggtattcgggtgaacgctgtagcaccagggccaatctggacgccgttaatcccgtctacctttgatgccaagacggtcagcgagtttggaggagcacagccaatgaagcgtccgggtcagccggaagaattggcgccagcttatgtgtaccttgcttcagacgattcgtcttatgtaagcgggcaggttattcatatcaatggcggtgaagttataaacggataagaggacaaaggaaaggctggggccgtgttatgccctggccttttttcttttcacagtggaacataatgaaggtagcctgtagaatgagacttaacttacataaaggatgggcatattttatgaaatcgtttcgtttcaggcttaccctgatcatgctgattttgattggcgtatctgtccttgctgctggaatcacgatgggacaaatttttaaaaattcgaatatgaaggtgctagaggagaacatgggacgggagatcgacctgctacgcgctacattcccatttgtgaatgcagatgccctgtccagtacggattatgtatcttattattctcaaaaggcgaaggaaattgcccgtctgacggaatcgcgggtgaccttcattcgcaaggacgggacggtggttggcgattcgttaagcgatccgcgtaagatggaaaaccacgcatctcgtgaagaaattcagcaagcctcaacagagagaatcggacgcacgattcgttacagcgaaaccttgcagcggaacatgctatacgttgcagagcctgttgtatcggacaagggctttgacggatatatccgtttgtccatgagtctgaaagcggtggaggagggagtacgccgcggctggacggctatcgggattggactcgtattgctatttcttgctgctggattggtgagctatcgtattgcccgcagtctgacttcgcctattgagcatattacaggggtagccaaccgcatttcaggactggattatgacgcaagggttggtgtgcagcgccgggacgaagtagggcaactgggggaagccattaatcgtatggctgacagtctccaaaaccaaatgaaaacgatacgtgacaatgaggatctactccagagcgtcatgagtaatatgacaggcgggattctaatgattgatgcaagtgagtgtattgcgcttgtaaaccgtgagtctgagcgaatgctcggtgtcgtgggtaaacgggtgacggacaagccgtatcatgagctgaagaagcactatgagctcacaaagctaattgagggcagcatacaaagccgagagaggctgcatggtgaggttcatttgtacaatcccgaggagagactcgtgttgctagacggtgttccgatgtatgaggatgaaggcggataccgggggatgctattccttttacaggatattacggctattcgacggttggaaaatatgcggagcgaatttgtggcaaacgtttctcatgagctaaaaacaccaattgccgcagtcaagggttttgccgagacgttactcggtggcggggttaaggatgaggagacggcccgttcatttttgcaaattatatatgatgaaagcgaacgattgaatcggctgatcggtgacattttggagctatccaaaattgaatccaagcgttctccgctggattgctcgccggtgcacgtttcgtcgttcatagaatcattgctggaaaaactgaacaatgtagctgccaaaaaaagaattacgctacacatggatatcccggatgagctgtttatggaggcggatgaagataagcttcagcagattttcctgaaccttttgtctaatggtattaactatacacttgatggtggcaaggtaaagattaaggttttaacgatccagcgggagaatggcacggaaaaggtcgtatttacagtcagtgatacaggtattggaattccaaagaaggacctgccacgtatctttgaacgcttttaccgggtggacaaaggacgctcgcgcaactctggcggaacgggactgggattatcgatcgtcaaacacttggtcgatttgcatcatggcaccctttcggtggaaagtgagcttggattgggtaccacatttacagttgaattaccgctattgcaacaggaagaatgaactataaccttttttacattctgttaacaatgccgtgataaaataaacgggtgtcgcatgagtatggaaaagatttctggattttgaccaatgcgcctttaataggtaaacaggagatgaagttatttatgggacaacgcttgctggttattgaggatgaaccaacgcttgccagattgctatcctacaatttgatacaagaaggcttcgaagtggacacggaggatcatggcagtgcagggtttgaaaaagcctccagagagtcctacgatttgatcctgctggatttgatgctgccgggaatgaacggtctggacattctgagcagacttcgccatcaggggctgacaacgcctatcattattttaacggccaaaaacggcgaggccgaggttgtccaagggctgaagtcgggtgcagatgattacatcacgaagccttttggcgtttctgagctgttggcacgtgtaacggctgtgctgcgaagaacttccggcggggatgaaggagtgctgtctgatcagaaagatagctccaaaattcaactgggcgagctggagatttatcctgagaaatatgaagtcattcttggaggtcagtctatcagcctcagaccaaaggaatttgaggtacttctttatttgtcccgcaagccgggtgtggtcctgacccgggatgatctgatgaatgctgtttggggttttgactacattggtggtcaacgaaccgtggatgtgcacgtcagttccttacgtaaaaagctggagctggatcccgactcggttcatatcgattcgatccgtggagtggggtacaagctggttgtaaataaaaaaagaagcgcttctcatttattataaatgaggagcgtttttctttatccagggaagtgtccgacgacttttgtgtccatttcgtgattttacatttcattaacaaaaatagacgctagaatcaacaaatgaccgatatgatgttcccgtcactccaagtagttaaaaaaaggggacttcagaacgatgataacggaaccaaagacccagccgagttccactgccgtgattgaacgtgaagcatacaagccgattactacctatgtgtcatgccgggaggttccgatcattggtacggatatgtcttgtaaagaactgttagcacttatgaaaacacaggaagatataccttgtgtcattgttgtggataaaaatgatcttccattgggcattattatgagagatgcgtacaatcgccattttacgggtagatttgctgcggcgttgttctatgataagcctgcggccatatttgccgatcccaatacattaattgtggatctgaaaagccaggcatcggacattgtggaactggcgatgctgcgcgaagatcagcgtttttacgattgtgtgttgattaaggaaggaacacggttactcggcgtactcacgattcgtgatatcctgtccgtcgtgcagcgaatgcaaagagaagcggacgaagagcggggcgatgtgattcggcatagctatgagggagtccagcgtattcagctgactgtgctggatgcagctaaagaggccgatgacagtgtgcggctaacccggtcaatgagtgagttatcccgccgtggcaaagttcaactggaagatgttttgctctcctatcgtgcagtcacggagcaaatgaagcgccagcatgagcagatgactgcgttgacccaatcgctgaatgacattgcgggcatggcctcatccattcgtgcactggcagatcatagcggactgctggcgatcaacgcgtccattgaagcggcgcatgctggagaacacggacgaggcttccagattgtgtctcaggaggtgcggaatatgtcactccagacgaaaaccttttccacgcagattacaggcttactcacccatatcgagcaaatgctgcgtgacaccgctgaactgacggatacgagtatgcagcagattcatacaggctctcaatatatttctgccggaacacaaacttttgccaaactactgcaggctgtcaatgaaattgaagccaaaaacagtgaaatgtcccgttccgcagaggaagcggctttgaatgcagccgaaatagcgcatgagctagagctcatgttaagttcttgatcattttacataccgttaacaaatccaccacactaaatttacacacagcttatataatcttcatattgtgcaaatcaggtgcaatgcttgaggatcataactgcaacacgaaggagatcataaatccatgaatgattccgtaatccggatcgataagctgaatttatattatgagaaatttcacgcgctgaaacatataaacctcgatattcctgaaaaaacggtaactgccttcatcggcccgtccggctgcggcaaatcaaccctgctgcgtacgctgaaccggatgaatgatatgataccgggaacgcgtattgaaggcactgtgagtatcgcaggtcaggatatatacggcgatactatggaagtagaaactctgcgtaagcaggtgggaatggtttttcaacagcctaacccatttcccaaatcgatttatgataacgtggcctacggcccgcgtctgcatggagttcggcaaaaggacaagttggacgaattggttgagcaaagcctgcggcaggcggcactttgggaagaggtcaaggattttctgaagcgttctgctctgagtttatccggtggacaacagcaacggttgtgcattgcccgggcgcttgctgtacagccagatattttgcttatggacgaggcgacatctgcgctggatccgatctccacgatgaaaattgaagaactggttcaggaattgcgagacacgtataccattgtcatggtgacgcataacatgcatcaggcagcgcgtgtgtccggtcgaactgcgttctttttgaatggtgttgtggtggaagcggcggatacacagacgatgttttccacgccgcaagattcacgtacagaagattatatttcagggcgatttggctaaagcctacagatgaatatgccagaaggggtgacttcgaaatgatacgtagaaaaggttttgatgaagggttagatgaactgagagccgtactgcgcgaaatgggtgcacacgtttcgaaggcgctcgatcaggccattgaatgtttgcagaccaaaaatacagaattggctcagcaggtggtcaaaaatgatgcatcccttaatacgctggaagagaatattctcgatatgggttccaagctcattattacccagcagccggtagcgaaggatttgcgccggatcattgttgcatttaaaatttccagtgatctggaacgaatgggcgatttggcgcttgatattgccaaggtgacacttcgcttggaagggcagcagatcattaagccgctggtggatattccgcacatggcttccattgttaaagaaatgatagatgatgcgatcaaatcctatttggatgaaaatacagatctggcctacaaaatggccaaagaggatgatcgagtagattccatgtatagccatatgatcagcgatttgtacgcctttatggtagaaaagccggcagaggcttcacaagccatgctgcaactgcttgtaggacgatacattgaacgaattggtgaccatgctacgaatatcggtgaaagcactgtatatctcgtgacaggggagagaccagatttgaaccagtagagctttcaggtatatagcggttgtttctgacccagacttgtctttgagcaaaaggcaaatttggttaggaagcagccgtttttttctgaaaaaggagtcttgtatgttaagataggaagagaaatgcgtaaaacgtaagaacgttacgaatgcattgatgaacttgcgaggtgctaaatggataaactcatgcttatagatggtaacagtatcatttaccgggcgttttttgctatgccaccgttaacgaattcgagcgggcagcagacgaacgcggtgtacggatttacgacgatgttattgcggctcttggaggagcacaaaccaacacatattctggttgccttcgatgccggtaaaataacgtttcgccataaaggatacgaggattacaaaggtggacgggagaaaacaccgccagagctgtcccagcaatttccgttgctgaaagagctattgaccgcttttggcattgcccagtttgaactggatggctatgaggcggacgatattataggcaccctctccaagacagcggacgaagccggtttcaatgtgctggtcgtgaccggggacaaggatatgcttcaattggcttcagaccatgtcacagttggcttgacccgcaaaggggttactgaggtggagacatatggacctgagcaaattcaggaacgatatggcctgatgccgctgcaaattattgaccttaagggtctgatgggcgatacatcggacaatattcctggtattcccggcgtgggtgaaaaaacagcgctcaagctgctgcatcaatacggttcagtcgaagaagtgctggcgcacacgaatgagctgaagggcaaaatgaaagaacgcgtagagacacatgccgatgatgcgcgaatgagcaaagatttggcgaccatttatcgggatgtaacgttggacaagcagctggaagatgtggcctttggcgggctgcaagcagaaacggccgggccagctctggcgaagctagagttcaagtccttgctggagcgtttatccttttcaggtgaggttggcagtactggggtagatgtagaggaagccgcggctgacgtaacagtgctggatgagcagcggattagcgaattggtagaagtgttggatcatgtggatgtgctgcatgttgagacgcatggtgataatccgcatcatgctgacatcgtaggtctgatatttgccgcaacggggcagcagtattttatgacgctggatgtactgcaaagcgatgcagctacacctattcgcgaatggcttgctgaccctgaacgcaaaaaacgtggtcatgatctgcatcgtacggatttggctttacactggcatggaattgcgtttgcaggggccgagtttgatgtgcaactggcagggtacttgctggacccgaccgatgcaaaccagacattgagcggattggcagccaaatatggtttgtcttcgatccgtccagacgaagaagtgctcggtaaaggagctaaatataaagtccctgacgtggctgtactgtccgatcatgtggcgcgtaaggcagcggtgattgaagctttggtgcctgtacagcaggcggagctggaaaaaacggaaatgcacaagctgtttcatgagctggagatgccgttgtcccgcattttggcggatatggagaagcagggcattttggtgaatgtagaagaactgcgcgctttggggaaagaatttgaagcccagattgcaacgttggtgggtgaaatttacagcattgctggagtagagttcaatctgaattcgcccaagcagttgggtgagattttgtttgataaactgggtttacctgtcattaaaaagacgaaaacggggtactcgaccgatgcggaggttctggaaaagctggccccctatcatgatattgtgcaaaatattttgcagtaccgcaccattgccaaactccaatcgacgtatgtcgaaggattgctgaaagaaatttcggagaaaacaggtaaggtgcatacgtatttccggcagaccgttgcagcaactggacgcttgagcagtcaatttccgaatttgcaaaacatcccgattcgtctcgaagaaggacgcaaaatccgcaaagtatttgttccgtccgaaccgggctggtctattttggcggcagactactcacagatcgagctgcgggtgctggctgatatttcggatgatgaacgtttgaaggaggcctttgtccacgatatggacatccataccaagaccgcatccgatgtgtttggggtagcagcggaagatgtggactccaatatgcggcgttctgcgaaggcagtcaactttgggattgtctatgggatcagtgattatggtctgtcacaaaatttgaatattacgcggaaggaagcggctcgttttatcgaccagtattttgatgtgttccaaggcgttcgccgttacatggatgatattgtgaaggatgcgaagcgggacggctacgtaaaaacgctgttggaacgcagacgctatttaccggagattaacgccagcaatttcaacctgcgttcattcgctgagcgtacagcgatgaatacgccgattcaaggtaccgcagccgatattatcaagttggcgatggtacagatggatgaggtcttacgtgaacgtaaacttcgcagcagaatgctgctccaagtacatgatgagcttgtgttcgaggttccgcctgaagaaatggaaacgatgaaagagcttgtcccggctaccatggaagccgcattaaagctggctgtgccgctcaaagccgaagtaagctatggcagcaattggtatgaggccaagtaatatatttcaatgagtagatagtcccaatttgacgctgcttccgttataatatagggtgaggtgaagacatcatgccggaattaccggaagtagaaaccattaaacgaacgctaaacgagcttatcgttgataaacatatagatcatgtcaccgttaatttgccgcggatcattcaacggcccgatgatatccacgcttttgcgatggaattggccgatcaccggattacaggggttgagagacgcgggaagtttctgcggattttgctggacgggctggtgctggtctcccatcttcgaatggaagggcgatatggattgtattcgcaacatgatcctgtggaaaagcatacccatgtcatctttcattttaaagatggtacggagctgcgttatcaggatgtgcgccagtttggcacaatgcacttatttccggcaggacaggatttgctggaaaagccgctaaacaagctcggtttggaaccgatggacgaggcctttacacccgaaatgctgcgtgtcgctgttggaactcgttcgacttcgatcaaggcagcgctgttaaaccagtcatatgtggtgggcatcgggaatatttatgtagatgaatcgttgtttaaggcggggattcatccagcacagccagccaaaagcctaacggatagccaatttcatgtcttgcatgaagctattgtctccacgctgggtgcgtcgattcaggttggaggctcgtccattaaatcgttcgttaatggacagggtaaaacgggcgacttccagcatcaattgcaaatctatggacgtaacgcaaagccttgcgttaaatgtggcacattgatcgaaaaatctgtcgtagccggacgtggcacacatcattgtccggtctgtcagcctatgcgttaagacttgcacagtcaccccaagcccatccctctcatatattgttccaagtaccaatactgcggagggtttcggttgttataaggccctgccttcgcaatgggagggaattggagtggctaatcattggggaggcctgctgttactggcatttgcgctaagtttggacagtttcggagtcggtgttacatatggtttgcgcaaaatgaaaattccactgttgtcgattgctatcatctccgtatgttcaggtttggtgattggcatatccatgcaattgggcgcattactatctcgtgtcctgtctcctgtatatacgaccgtttttggcgctgtcatcctgatctgtatcggctgttactctttgtttcaagctctgcaccacaaagaggattcgtcagaggattcagtggaggcctctcgggggctacttcttacagaacagactgatccagtgagcagatttgttcttggggagaagaagagtatagaagatgctgataccgagtctttccccagttcaagaaaagatctgtcgacagaagcttctgtggagcagcaggagcgaacgctattttctctggagttccgcaaatggggacttgttattcggattcttcgaagtccgtctgctgcggatatggaccgttccggcagtatatctgctaccgaagcggtttggctgggcattgcattatcggtcgatgcgttcggagcgggactcggggcagctatgcttggttttcagccactgtctactgcgctggctattacgttattcagtggaacatttttgattgcagggatgaaggcaggcttctttctatcagcatttcgatttatgaaggcgctgggtgtattgccggcattattactgattatgatgggcatattgaagctgttatgaggtgaaagagcatgaatatcggattaaccggaggtattgctaccggaaaaagcaccgtgtcggctcttttggtcgccaaaggtgcgctgctgatcgacgcagatgccattgcccgggaagtcatgcttccggggcatccggtgctggcggcggtcatagagcattttggacaagctatagtgaacaatgacggaaccctgcaccgcaaaaaactgggtgagattgtattcggagaccctgcccaacggcaggcacttaacgatattacccatcctgctattcgtgaggaaatgcgtatgcgcatggaagcatatgaacgggaacagccggacaagcttgttttagcagatatcccgttattgtacgagtccgggctggagagcttgtacgaggaaattatggttgtgtacgtaccacgtgatattcagctccagcgtctgatgctcagagacggtctgacggaggagcaagctggacttaggctgtccgcacaaatggatattgaacaaaagaaaagcttggccgatatcgttatcgataatagcggagcacagactgagacgaaacgacaaattgatcaattttggcagcggaagggacttgcatgaacattttgcgaaagaaaagagtcctgctcactttgtttgtcgggtttgtcctaatcctgttccttaattcaaattggatgtcctggttctatccaattcaatataaggatgagattcggcagtattcacaaacgtatgaagtggacccatttttggtggcgtctattatccgcgtagaaaccaattttaaaaccagcaagcagtcgcataagggtgcactgggcctgatgcagattatgccgaatacggcaaattggattatggacagcgcccagattcaaaaggttccgctggagagtgtcaagcacgagcctggcaccaatattgagctgggaacctggtatttgcataacctatccatgaagtttcaggataatcctatagcaatcgtagctgcttacaatgcagggccagggaaagttcaggagtggctagataagggagtgtgggatggaaaagaagagtccattaagcaaatcccttttggtgagacacgacattatgtacagcgggtcatttattactacaggcaatacacgaaaatttataatgatttttaaatgacaagttcatgacatgatgagccttttagctttaaaatgaaaaaagcgcaggacaggctgtttttagcagcccatccatacactttatcttgttatttctgcattattaccgcgattattggtattgacctgccaattgttgttcggcgatcgttacgaggcgtttagtgatgtagcccccgatcgaaccgttctcataggaagtcatgttaccttggtatccatcttgaggaatgctgatacccagctcttgagcgatttcatatttcatttgctccagagcgccggaggatctgctgactaccagattgttggagttgccattgtttccttgtgccattgttgttcacctcctcgcgatatggtaaacatattatgatccgttttgacaaaattattactaagaatcttcgggaatttattggaaaaagaaagtggtgagattatgaaatgtccgtattgtgcctacaacggcacgaaagtgttggattcgcgacctgcgaatgataacaagtccatccgtcgtcgccgtgaatgtgaacagtgtgccaggcgttttaccacctttgaaatggtggaggaaacgccgctcatggttatcaaaaaagacggcagccgtgaagagtttagtcgtgataaaatgctgcgcggtctcattcgggcctgcgagaagcgcccagtatccgtcgagcaactggatatgatcgtatcccaggtagagaacgctatccgcaacacagcagccacagaagtggatagccagcagatcggtgagctggtcatggaacagctttacccagtggatgaagtcgcctacgtacgttttgcgtccgtctatcgtcagtttaaagacatcaatatgtttatgaaggaactgaaaacattgttatctaaagatacagccagcgactgatcgctgactgtatctttcttgggacaaagtgggaagatgactatattttttttataaaagtattgacacaggaataaaaattttatatgatatagaagtcgcttgaaacgttgaaaaaacttacttacgatggggccttagctcagctgggagagcgcatcgctggcagcgatgaggtcaggggttcgatccccctaggctccaccaaacttatattatggactcttagctcagttggtagagcagttgactcttaatcaattggtccagggttcgagtccctgagagtccatcctttagaaaaaacggcagagatgccgttttttttgttgtttatagatttattcccagtctaaccgggaaccgttatgggttgaatgagcgtgtaactgactgcacagaaaacagatcctataggaaatagaagtcgatactgaatagcaactcatttttcgcaagtgtagctttgatcgttgtttcattgcagtttgtattttacaataacatgagttaagttcctaatcattgaactgaactaagtaaaaactaatgtgatgtcaaaaaggagggggaacgatgtatcgtatcattgatttcgtgctcaatctgctccatgcaaagcctgcgaaataacaaggcgaagcttggtatggagcgaatatatttcgcctgtaaggaatagttattggcagacgcaggctttgcccttaaaatgtaaaatttattttaaggagcgagccctacatgaattatttaaaggcaactgatctgcttcctgatgatttgcttaaggaagtacagcggtatatacaaggagaacttatttatatcccaagtcgttcaagtgagcgtaggagatggggagaaagctcaggcgcggccctttattatctccttcggaatgaagagatacgcgcaagattcagcaagagggtgcccattgacgaactctcagaacaatacggactgtctgtagaccgcattaagaaaatcgtatactccaaaaaatgaaaaatgtgcccgcagagatgatctgtgggtttttgttgtccttatatataagcagaacgttacaaacacttgataaaagaacttggcatatatctgaagttccagaatctttacaataaggttattacagaaaagcaggaggtaaataatgaagtatactcagaaaaaattcgaaacgcatgactttttaaggattagagattttttgaaacactccctgaaaagtagtcctgatcttaaaaattggttcatagatcgctggaatttctgtagatattggggacaaatcatgcacaatacatttgaaacatggcctgaaactgttggaatttgggaggatgaacatcaagaaattgttgctgttgttcacccggaaggagaagataacataggtgaagcttatttccagcttgcagatcgtgatttttcaaatgaatttctaaatgaattaatagattatgctgaattgaaattagctttacatggtgagaatgtagctactttagatataatcgtaaacgaggatggagagcaactgaaggagcttttgaaaaaaagagagtacatcttgcaagatgggaaagaaacgacatcctgtatgaatgtaccgcatgatgtaaagctggaattgccaaacgggtttagaattgcggatgcgaatgaagttggggattttgaaaaaggctttgctcatggaagagcattcgggtactacaagggcgattatccagatcataatgtcgctgagcgatgttatatatcattgagaaatgcccctgattatataccggaattcgatgtagtcatcctggatcataacaatgaagtggcttctttcactacaatctggtacgacgagttgaataaaataggaatactggagccggtaggtacgatacctaagtatagaaaaacagggcttggaagagctgttatttatgaagccataaaaagagtcaaggacaaaggtgcagaaagaatttttgtaggttcggatcagcccttttatctgtcgatggggttttcattagcatactcaaaagaaatatggcaaaaaaagagcatcattgtttaacgctgatttacataatcggcaaggattttgagatactcgtcattcaccaattttcttggggcgaatacggctgttaaaaaagttagagattttgaacgcgcgattttttcatccatcatggaatggtcggcttcaggtaaatgaatcacggacagtagctctgcgggtattttctggcggtagactcgctcggtatcctgtacatcaacattaatatctttgccagccagaaccaagagtacaggagaatggaagtgacttaattcttcagtggaatcagaccgaaaatttttgcctataaagctccatctttctttggacatcatatcgttaggatcggctatgcttaggtattcttcataagaagcatgttttttcagtaactgtagaatctcttgatcgtagttcaatgtcttttgaatttcttgaggagtagctccttcttgctccatttcttttctggtattaaattgtccttgggaaatccagttcacggcaggcgatacaaggatgctgaatgcaatatcatgttcctctttaacgatcttcggaatgacccatcctgcttgactggctccccataggccgattttttgcttatcaatcatcggcaaggttttcgcccagtctattgcatatcggatctcctgtgcgcggtcctccatgctttgatccagccaattgccaggggcactattaataccgggcttattcaatgacagggaggcataacccttggaggcgaacttttcccacagtggtttgtatccatcatcatatgtgtcattaataggaccatccccatggacaaaaacaaccaatccaaccttttccgagtagttcttaggcaaagctaatgtacctgttaacagccctttaggcgtcgtgatttgtattttttcttctgtcatcttgtaggaattttgatatagaacaatgagtattaaggcaacagctagagctgccgcaataccaaaagtaagcttgaatgtttttttcaatggtgttctctcctcgaatgcaggttctctttccaactcatcagatgccatacaggctccttgaaccaaaaatgccgtaacccattatatttggattgttctacttcaaacgcaagtttgtgatacaaacggatagccccttggttcttatgcgctacatgaagcgtcaatgtatgaaaaccagattcaaccgtaaattgctgtgcgaaagctagaagacggcgtcctattccctggttacgatgacttgaacgaatcgccaaatgatcaatgtaacactcatctgcagcggggggatactccagcgcatgcatacctgtcaaaaatttaaatatattaaagcaaccaaactgttttatgagcggagccaaagaaatgggggttgtttcaggaagtgaagaagaggagggtttccatttaagagaaagaacaccgataacttcttcgttttctttggctacaaattgtttcatagatgtagaataaggattttgaacccaaacctgcattaacaactgctgtatagcttgatcctccagtgtaacaagagattgaaattttgctttaaacgattcgactaaaagactgcaaacagcttcatggtcttgtttctggtatgcaacaatgtcaaaggattttgcactcatgtaacgccctccaagatttattctactttaacctgaatttcgtattgtagcttgttgttgtcgaacatcgaaagataagatttttctactaggacaatcctgctttgccagttatattggtgatgagctacatatcgttccatttgtttaatttcataatcaatctcaggctcttcaatgacggaaagatgcttataaagatagttgccttcttccagaatatagtcagccagatccactgtttcataacacagcttcacctgtccggcatcagacaagtaatgcaggtcattttcaaataatcgaggtggggcagggcggtgttcaaataagtttccggcagtgagctcttgaccattctccaatgcaaaccatagctttaaatgacggggacctaatcgtttgacctgatattcatcatttcgctgagtcaggctatcatgttcttctagcactttgtgaataaactgttcatgcattttcaagttagctatttcagcctgtaccttctgcaacgaatgctctaaaagccggttataatcatcggcagcataggaagtcatacattctagaatctggccgacagggacgtttaatttgcgtaataataaaatatgcgaaagctgataaatctcatgaagcccgtacatccgatattgattttcttctgtatgtgatggatacaggattcccttttcttcgaaatatcgcagttgatgtacagatacattcatgagctgagcaagctggctgatcgtaatgtgttctttcaatgacaggactccttactggtagttgaataactccactataaaccttaggtcagacctagggtcaatagaaaatatcaaatcaaatcttggataggcgtaggtgtcgagtatttgatgccataccaaggggagactggagagtttacctgtcggtaataacccgttataatcataagattagtgagcataaacaagatgctcaggatgaaggttagaatggggaaatcatgttgaaaacttttaaaaaggtatacattgagataacgagcatttgcaatcttgcatgcagcttttgtcctcaaacacagcgtgtcaaaaaatttattgatccggaagtctttcgaaatgtgcttgatcaggtcaaaccacatacggattacatctatttgcatgtaaaaggagagccgttgctccatccgaaaattgatcttttgctggaaagtgctcatgagaaaggcttgaaggtcaatattaccaccaatggcaccttgctgccgaagaccggacataagctgcttgggcaaccagcgctgcgtcagatgaacttctctctccacagttttgacgggcatgaaggctccgtggatcgagaaggatatttgggtaatattttcacgtttgtaagagaagcagtaaaacacaatgtcattatttcgttccgtctctggaacctgactcaggataatttaactaatgtgcagcgtcagcgcaaccgggaaacacttgaacgactggagcaagagtttggactggactatcggattgaggaaaaggtgataccgggcagtggggtcaaaatcgcacccaatgtttatttgaatcaggaccatgaatttgaatggccgagcctcagtgccccagaagatgacggaaaaggcttttgccatgcactccgtagccaggcggcggtattggtggatggaacagtggtcccttgctgtcttgatggagaaggtgtcattaatttaggtaacgtgcatgagcaatctttttccgacattgtggaaggggagcgtgctaaccgtctgtacttcggtttctccaagagagaagcggtagaagagttatgccgaaaatgcgggtaccgcaaacgatttggaacataatcatacaggtagagctccaatcgacagtagaatgaattgcaagaaagatagcccttttgcagggctttttttgcatatattttgatgtatacatatatataatcaatggatttggactgttcagaggaagttagatacaatcgattgcttgtgagaatgattatcaattataatgaatttaattctgatagcgcggaataagaagtgaaggaacggtttggatggaggctgaacaaaagcaacgaagttgaatgatcacattttgctgtggaatcatgtttttatacaggtgatggatgttcgtcataagaagatcgaaaaaggggaggaactacgaacctatcgacttcctgccagtgcgtttttgtatgccgttcgtggaaacgcacgggtacagttggtaacagtattcacagggtagagcgtttccatgtactgcatggtggaaaaggaatgtgcctgagtatccaggcggaagaagggcttgaatatttcatcattttgtacaaggcaacgttggctatgcctggtcgcaaggagattgcacaattgttggaaaaggaaaatccttgtgagaatcagtatgctttcgcacctcattacccgctgcccctgtacgatcaagtgaagttgttggagcaagaatggcgtgaagcttctggacttggcaaactgcatgttaaagccttatttcatcaatttgtatatgagttgttgcagcagttgtatgggcagggcatcgaacctcttaagcccgaccttgtatcgcaggctgtagcctatatgcgtgagcattttagtcggcctatgacacttgagtccattgcggaggagctagaatgcagtactggacatttatcaaggttgttcaaaagtaaaatgcataccactccgattcattacttgggccaagtaagagcagatcgagcagcagaactgctaatgcagacggacgccactttgcaggagatcgcagagcgtgtgggatatccagatgcccattcgttaagtcgcagcttcaagaaatataagggactatcttccgtacgattcaaaaaggagcgggagcatcctgcccagaagcaagatcaggatatgccccaaacgatgcttaaatctgcccttcagcggacatctttcacacgtgatactgatattgattatcaatatcagtatcatgcggaaggggatttattcatgcacggaagagttaaaataacggctatgatgattatgttgtgtttatcattaatgctgggagcttgctcggctccgacgaatacaaatggaagctcgcaaacgaaggctaatcatacagcgacatcatccaacagcgatggacaagcacagacaagaacggttaagacattaaaaggcgatgtggaagtacctgcaaacccgaaacgagtggcatcggatcagtatatggggcatcttttgaagctggggattattccggtgggggtcagaagctatatgctgaatgaggcttggattgatcgatcgggatatcccaaagagaagttggccggaatcaaagatctcggtgattttcctatggatttggaggaactgaccgttctgcaaccggatttaattattggttcaatcgaaaagaacatcgacagctaccaaaaggtaggaacgaccgtgttcttgccgtattgggagggcgaatctacagcggggccactggataaattccgtagtatcagtgaaatctttggcaagcagaaagaagccgagcagtgggagagacggtttcaattgtacaagtcgccaataaatcgatatatgttttggcagcgaaaggcggcaattacggaagtccgaccatttatcagatgctaaagctgccacctaccaagaaggcattgaatatgaaagaaggatttgaaaatatttcacttgaggttttacccgagtatatgggagatcacatctttgtatacggttcagaagatgaaggggctaatcagattctgcatagtgagctatggaaagaccttccggctgtaaaaaaaggacaggtttatatgtacggttattcagcgataaagaggatgagtttgtgatggaagatccttattcattggaacttcaattggatacgatagttaatctcttattagcccacaaaaaataaaaggatgtacagaacatctcctatctaaacaaggggaatcttttagaatttcaagctgtgatagtcatatagacaaaatccgcttaacacaaagattcctaagtgtttggcggattttattatgtctatatttcttcttctctgtatgttttggtgtatctttgaaattcagatttttgattatcgtaataatcagctctcgtccaaaaaataatttgagagaatgagtcggaatgttccaaataagtgattaaatatacaatttttactttatcactctctacccatacttcgtattgcaagccttgattcccgtttatattgacctttactggtcccgtcgaaataattccttttccagaccttttgagtactaattgagttgaaaactcagcgtaatcttttaatgtgatcattgaggatttctcatacggcagttcggatttccaatccttgatgatcgtcatgtatgcatcgtttttttcataccaggcttgaattagcgcatctggattaagaattaaaccagtcttccatatataagggagacgaatttgttgcttggcatcttcacttttaaatgttttcaaaatagttgttgagcgaaggtctggcttaacttgtgagtcgcttaagactttcaaagagctggctatagttgcaaattcgtgatgttgttctactgcagagcctccccttgaatagattaatacttgaagatagtgctgcttactctctaacatggcactgaagtaatagacctgttggccattgtatttcccgctataatcggctgttctggcggttgtggaatcaatctggattggggtagtatccacagccttaaagttttctagacccaatgcggagatttcttcacgttgctgtacgaattcgtcgagcgtcatattatttgcaaaagctgacttggggacacggaaaaccagacctacgttctttttttctttgtcacaaacactaagcaccgaatccagttgtccctgtttaaatttacgccagccagcgggaatggtaagagccacaagatccttatccgaggtaacggtatgagccagcggctttgtgacgggtaaaacaggctgactttctttgtctaccactgttgtactatgagtcgcattgtctacatcagaatttgtttggactgtagttgcagcattatttgaggtgcagctggtaagcatgagcactgcgatcagtgcaataacataaaatcggaaatgcgcaaaattgaattgcatggaaataactccctctttttcatatttacaaaggaaattttacccttttataaaattataaaaaagaggcgtttgtcctgttttacgtagcttagtcgcttatggtagtcgttactgtgacattgttgacagaggttgaggaagcactagagttgaaattaataacctcaatgactactattgcaccaacaatcaggcctgtatttataattagatttgtagcagaaagcgttgttaagccgcctcgctgcaacgtcccatttacaaatacattgtagtatccgcttactagtcggaaccacaagactgtttgccgcgactgaagtaccactatcatttgtaaaactttgtgccgggatggtggtcactcctcctaatatatcacccagcacgacaatagctgtgtaacgattaaccgctggagtgacattgatgcttgttgtgatagcaatgtttccagatacgatactgtctgcttccagatagagaacctgccagaaaatgatcttgatattcaatttgttgagttcttctcattcatagatacggttgagatgaagataggtcggcaaatgctgttgcgtctgtctctaaacgtagataattactcggatgttatattggtgtggaatccgaagcagaagtgcctgggttattatgacgaggagcatcaggaacatgcggatgtgtgcagctttgccgagtttcttgcacagccggaagattatctggagaagattattgagggtgaatatttatcataacaaggtgagccatgaatgcggtatgcacgcagtcatggctcttgttattttaaaatacagcgctagtgtacacagtgcctaatgctcatcaggaatggttacgtatgagctgaatgagatttagagtagcggtagataggggttcgttcttacgggtacagatggcgattgaattaagaagctggatgtcttctacatatacccggcacagttcgccacgttctacatattcacgcacgaccagtgaggacacaaagttggcaccatatccggcaataactgcggtaatcgcctcatgcagccctgtgaagtttagggtgacctggggggcgggggcattataggttcgacataaggaaaataatctctcccgtgttgagctccccttttcacgcataacaaagggttcatgcatcatttccaataaagaaacctgctgatttgcataccgatgatctggagccaccacgaaccacaattcatcacgaaataattcttcagtctgaatcgtatcgggatactgctcgggcagtcctccgtagatagccaaatccacttctatatttaatagctgctgcaaagcatcgttggaatttgtagtgttaatcgtcatttcaacatgttcatattgttgtttgaattttgcaatccaggccggaatgagaaaatgagccggtaaataagtagccgctagccggatatgaccatgggctccatcacgataatcttgtgaaaattgttcgatttgctgttctacagcaaagagccgtctggcgagtacagcaagtttttcaccagcatccgttaaggcaatccctcttccttgcggcatgagcagtgtgagagatatttctttttcaaattttttaatctgggcggtaatcgcaggttggctaatatttaaaagttcagaggcacgtgtcacactccctgtagaggcgaccacgtgaaataagcgtaatgcatgcaggttcaaggctagactccctctcttttcgattgactcatacatttaaattatgaataaagcaaaaacatatattatttttataataataattcatttacaatcaaattgtaagttaaaggcaaaggagagtggagcaaatgcattcaacgaatacgtggtaacaagtagaccagtatatctcggagtgtctgattccgcatgatgctgtcttggaacaagtattggctgctaatcaaaaggcgggattacctccgcatgatgtagcccccaatcagggaaagctattaaatatccttgctcaaatgcagggagcgcgacgtgtgctggagatcggtactttgggaggctacagtacaatctggttggaaagggcgttgccggaggatggagaaatcgttacgctggaagccaatccgatccatgctaaaattgcccggtcgaatatatcgttggctcagttggatggaatagtggaacttcgggagggagacgctttagagcagttagcacagatgaaagaggagagagttgccccctttgatcttatttttatcgatgcggataaacccaataatccattttatctggattgggcacttcgcttctcacatcctggcaccgttattatcggtgataatgttatccgtgaaggagaagtggttcaagcttatagcacagaccctcgtgtgcagggagtaagaaagttttatgatatgctagctgaggaatcaagaattacagctacagctatccaaaccgtggggagcaaggggtatgacggtttcgtcattggaatcgttaagggctgaacgctaagcgtctcgattggctaaacacaaaggggagcagtcctcgtgtttagcctttttctgagcagtagaaaaggtggggacgaattgtgcgcataatggtaaaatagtattgatggaagctttagaacgtttttgaacgtttactgctgaattcctatgtaagaagaatgaatttacataaaagtagatgtattttctttaaaatgtaaacgcaatcatgatgattggagcaggaattcaccattttgtaaaaaaatgaattagaaatgattttttttgaatctttttgaagaaaagtgattgttttttgtcaagtttgtggtacgatatgaacagttgggggaatgatgatgctgacggaagaaagatacaagttaataatacagcgcttacaagaatgtggtgttgtaaagttgcaagaattggctgatctgttgggagcttctgagtcaacgattcggcgcgatttgatagatcttgagagccgtcagttgctcaagcggattcatggcggggcaaccttgctgaatcagaaaagtcaggaacctggcatggaagaaaaaacattcaaaaacgttcaagaaaaaaacgcggtggcccgtatagcagccaaagaaattttggatggcgaatgtatttatctggatgcgggaacaacaacgatggcgatgattccttacattgaagctaaagacgtgacggtcgtgacgaatggactatcccacgtagaagcactggtaagcaaaagaatcagaagctatctactgggagggatgatgaaaattcataccaaagccgtaatcgggagtattgccctacaaaatttggacaattttcgattcgacaagtgctttctaggaacgaacggggtggatatggaaatggggtatacaactcctgatcccgaagaggcgctgatcaagcgacgtgctcaccagctgtctggcaaaacgtatgtgttagccgattccagcaaaattggagaagtaaccttcgccaaactgttcgagctcaaggaagctatacttattactgaatcgatgccagaacggtcacgccgatccatcgctcagaaaactaagataatcgagggataacaatgatatatacagtaacgctgaacccttccattgattatatcgtggaagttgatgatttgaagcttggtgatttgaaccggatgaaacgtgatttaaaactgccaggtggtaagggaattaatgtatcacgtgtactgaaccagttgggggcagatagcacggcgattggttttctcggaggattcacaggcaggtttatcgacgatacattgcgggaagaatccattaaaactgattttgtaatgatcgaagatgacacgcggattaacattaagctcaagcatggcgatgaaacggaaattaatggtttgggacctgcgattcgtgagcaagaggccgatgcgttggtgcaaaagctggcgggactccagaaaaatgacattgtcgtcttgtcgggaagtattccaccgtcacttggaggagacttctatgatcggctgattagcgtatgtcagcaaactggcgctgaattcgtcatcgacaccacaggtgaggcgttgatgaaggcactggttcataaaccgctgctcatcaagccgaatcaccacgagctggctgagctgtttggcgtaacgattcattcaaaggaggagatcgtcacttacggtcgtaagctgctggaagcaggcgcaaaaaatgtactgatttccatggcaggagaaggggctttgttcattacggcagatgaagtgtatcacgcaaatgtaccagcaggtacggtgaaaaattctgtaggcgcaggtgattcaatgattgctggattcgtgggtacgctggctcttcatggcgatccgatcgaagcattccgtgcaggagtggcatccggaagcgcaactgcgttttccgatgatctggctactagagagaagattgaacaattacggccgcaagtcacgatttcaaaacggtaattcggctgcatcatgagcttattatgcgtgtatcgacacgctgatcgaacttaggagagtgtgaaaaatgagaataacagacctgatgattaaagaaacgatgatcatggacctgcaggcgacgacaaaagacgaggcgattgaggagcttatcgctagtctcgaagcaagtggacgtattaatgaccgtgccttgtttaaagaaatgatttacaaacgtgaagcagagtctagcactggaatcggcggcggcattgcgatgccgcatgccaagactaaagccgtgaatgaagcgactgtcgttttcgccaaaagcagtaaaggcgtagaattcgaatcgttggacggtgagccggcaaaagtgttctttatgattgcggctccagagggagcagcaaatacgcatcttcgcacactagcggctctttcccggcttctaattgataccgatttcattgacaaactgatgaatacgcaaacaccggatgaagtatccgagctgtttgataccaagcaggcggaagaagaagcagccaagaaagcaaaagaagcaaagaaagaggctgccaaagcacagaaaacgccggatgttatcgttggtaacccgaattcagacgagtttgtggttgcggtgactgcctgccctacaggcattgcgcatacgtttatggctgaagacgctctcattaagaaagcgacagaaatgggtgttaacatccgggtagaaacgaatggctcggaaggtgcgcaaaacgtactgacagcggatgaaattcgccgtgccaaaggtgtaatcgttgccgctgacaaaaaggttgaaatggccagatttgacggtaaacctgtattgcaaagaccggtaagcgacggtatccgtaaatctgaggaactgatccgcaaagcgctgaacggcgatgccccaatttatcgtagtgaaggtagaagcagcgctgaagagtcgaaagcggagaagagcagcgtgggcagtaaaatctacaaggatttaatgaacggtatttctcatatgctgccattcgttgtaggcggggggattttgttagcaatttccttcttgattgagcaagtggcaggagaagacaatgcattgttccaactgttgcagacaattggcggtggaacaggtgcgttccacttcctgattccgatactggccggatttatcgcgatgagcattggagaccgcccggcactgatgccaggtatggttgggggtctgatggctgtaaactctaatgcaggcttccttggcggtctggcagctggtttcatggctggttatgtggtgatcttcctgcgtaaagctttggcaggtctgccgaaagcactggatggtttaaaaccaatcttgttataccctgtatttggacttctaatttcaggcgcgattatgttctacctgttcgatccaattttcggtggtattaatacgtggcttgttaatgttttgaacaatttgggaacaggtaatgcagttattttgggtctgatcctgggcggaatgatgtcgatcgacatgggtggaccttttaacaaagcagcttacgcattttcgatcggtgtctttacttccagcggtaacacgaacggtgctatgatggcggctgttatggcgggtggtatggtacctccgctggcgatcgcattagcttcgacgttcttcaaaaataagtttactgagcaagagcgcaagtctggcttgacgaactatgtacttggattgtccttcattacagaaggagccattccattcgcagctgccgatcctctgcgtgtcctgacctcttgtattgtaggttcagcgattgctggtggtctgacgcagttctggcaaatcaatcttccagctccacatggcggaatttttgtagcagctcttgccaatcatgctttgctgttcttgcttgcagtcgtgatcggctccgtggtttccgcgctcattctgggactgtggaaaaaaccgcttgaagcgaaataacgggtaagagtataaaaataaaaagagggccacattttccttaggccatcaaaatagtaaagccgctaaacatcaggtttctgagtgtttggcggctttttctttatggaaaggtgttggctttgccgatgtagcttattagtagttattgcattggagctatagcctataaagctccttaaccagctgtataaacagctttcgggccgaagacatatactgctggtgatggttgttttgtagcagtccaataggaatattcgggtctgttaactggagggggacggtgaccagttcctccggcaaaggcattgacgatagaaccactccaactgatggaatcgtttttacaaatgtggggatcgacgaaatttgactgacagtataaaaaaacggcatcgacggaaagcgtgaaagctctttctccagtcgtatatggtacaagcagttcttacctccgacgataagcggatactcgtacagattttcgagatgaagcccactttttgccgcgaagggatgattacgggacacaataaaggcgatgtgttcgtgatatatgggttcaaagtgtaaggaaggaatcgagtgaggttccccggagattgcaaaatccagcttaccgtccaccaaagcatttgcgagtgcatccgtgtttccaactgtaaaatggcacgtaatattcggtttatgctctcgaaactgctgtagaaccaagggcagtacggtagccgccaccgtttcaatcacaccgatatggagcgtgccaatctcctcctttttcagagacttcgcctggtccattacaaaattccaatgctgaataagcccgtttatctcctcggcatatagtttgcctggggacgttaactctgcatcccaaccccttttaaaaagctgaaatcccagctctttctctagcctctggatttggttcgtgactgtagactgagcgtagtttaatttggcagcagcttttgaaaacgttccttcttcgattatggtacgaaatgtagttaattctttcagatccacgcatgttcatctccatcggtaaaattgaatatatttatgattattttcaattatacagatgaaaataagaggagtacaatcatcttatcccagcgaataggagagatgaacatgccatttgtacgaattggctacatggagcagcaatacacagagcaagagttgccttggattagtcgctgtatcataaatgctttgatcgaacattttcaggttccggaaaaagattactttcaggtttttcatgctcataagcaaagcgagttttattatagtcccgattatttgaatgtatccagaacagacaagctgctgtacatccaaattacaatgggatcgggtagaactacggaactaaaaaagagtttctaccaaaggttagcggaactcttatctattgaatgtaaggttagaccggaggatgtatttgtgactctggtagagactgaattagaggattggtcctttggcaacggacttgcccagatgattgtatgaagcataaattgatcagatcgagtgttcgagaaaccatcggtgattttgctcccgcttttgtaggttatacggaggatgttctttttggagatgtatggagaagaagtgagctatctctaagggaacggagtctcattaccgttgccgctctggtagcgtgtgagcatgtaaatcaacttccttatcatctgaaactggccaaggagaacggaatttcggaggaagaactggttgaggtcattacacagcttgccttttatgtaggatggccccgggcagcctcagctattcaggttgccaaagaggtgttttgcagagggaaagagagttaagcatgaacctaaaaactgctaagcacaagggattccgagtgtttggcggttttttggcatgattgtattgttattctgcattgttactgataagcaggcgatacccaaataatgactaattgaatcgagcagattcaactggcaattacagacggtgtagaagtattcggcttctgtccgtggtctgcgattgaccttgttagtactaatcagggcttcagcaaacgttacgggtttatctatgtggatcgtgaggagtttgatctcaaggatctgcgtcgtattcgtaaacaaagcttctattggtatcaaaagctgatttccacaaacggtgaaattcgttaattaaagctgccgtgaaaaagcacctccttgaaatggatgttactattttgagggggtgtttgtatttgtagccttgggggagagtctgacttcattcaagcatccaattactcctttcccagaagtgtgatcgtgtattatataatagaagaaacacaaacggaaaggacatcatgcattgaccttacaacaattaaaatatgtcattgaggttgccaatcgcggttccatgaatgaggcggcaaagcggttgttcatttcccagcccagtctgtcgaacgcgattcgtgatctggaggaacaaattcatatcaccatttttgagcgtaccaataaggggatttctttgtccaaggaaggcgtggaattcctcggttatgcacgtcaggtcgttgagcaggcggagctgctggaaagtcgctatctggatgccaagccttcaccacagcattttgctgtgtccacgcagcattacgcttttgctgtaaatgcattcgtaaatctggtaaatcaatatggtcaagaagagtatgaattggctttgcgagagaccaaaacccatgaaatcatacaggatgtcaaaagcctgcgcagtgagatcggaatcctgtatctgaacgaatttaacgccaaggtcattaacaagctgctaaaagatgcgaatctgcaattcaacagcctgtttacggccaagccacatatttttatcagtgccaataatccgctatcccgacagtccatcgtgaccattgaccagcttcatccgtatccgtatttgtcctttgagcaaggggagtacaattcctttcacttttccgaggagattctcagtacgttatcgcatcccaaaagcattcgtgtccatgaccgggcgaccctttttaatttgctcattggcttgaacggctatacgatttctaccggggtgatcagtgcggatctgaacggtaacgacattatttccgttcctctggaatgtgatgagtctattaatgtgggatggatttgccataaaaacgctgcgctctccaagctggccactgtctatgtagaagcgctgcatgaggcgataggggaataaaaggtttggtatagccttaggctataactagctatagtttattggagttaccttataactgaaaatgtatgttatctttcttacaagaacttcactacaaaagcgaaaaaggagataaccttaatgagcagcatccttgataatgcatcccaacgtaaagtgaccccttttagacacgatatggtcggcagctttctgcgcccgcaagcgattaaagacgccagaattcaatttcaaaataatgaaatctctgcggacgagctgagaaagattgaagataacgaaattatcaagctagtggaaaagcaaaaatccgtaggacttcaagccgtgacagacggtgaattcagacgctcctggtggcatcttgattttatgtggggtctggatggtgtggaaaaggtacagctttcgaacggctaccaattccaaggtgtggaaacaagagcggaaaccgcacgcttgtccggtaaaatcggacattcccgtcatcctttcattgaagatttcaaattcctgaagcaagccgcaggtgaggatgcgatcgcgcgccaaacgatcccggcacctgcacagttcctggccgagctgttgcgcggagagaataaagaaacaaccgatacgtattacagcaatctggatgaactggtgacggatatcgccaaagcctacaagtccgtgattcaagcgttgtacagtgagggctgccgcagcttgcaactggatgattgcacatggggtatgctctgtgataaaaactattgggaagctagacagcatgcgggtgagaatgtggaagataccaaaaagctgtttgcccgcgtgaatcaggaaacggtgaaggatcttccagccgatttggtcgtaacgacccacgtatgccgtggtaactaccattccacctgggcatcttctggcggctatgagcctgtagccgaaaccctgttcggcatcgacaacatcgacggctactatctcgaattcgacaccgaccgtgcaggtgatttcacaccgcttaagcatctgaaagatcaaaagcaggtcgtactgggcctcgtttcctccaaaacgggtgaactggaagacaagcagacggtcattaaccgcattaaggaagcgactcaattcgtggacatcaaccatatctgcctcagcccacaatgtggcttcgcttcgacagaagagggcaatattctgacagaagagcagcagtggaaaaagcttgctttcattaaagagattgcggacgagatttggaagtaagggtctaggggaattgaattgaagagtttcaaaacacgccatttgtgggcgtgtttttttgttataaaacctacctatagcacttttaaagtgatgcactattcactagtattccaaacgtcttattggacgttcactgattatcacaagaattgaaaagggggtttatgacaatgccgaacctatgtgaatgaatgtttaacaagtatataattatattcaacgtatgaaattttcgaatgaagagagatagaatttgcaaggataatattaattttttactaatcttattttaaaggaggcatacaaatatggttttcgttattatctcaatagtatctttcctgctactattttttctgatttatagaatttttaaatataagataaggaaatataaccgtgaaaattttgggttatcattggttatgcttcttattctactaggaagaatatataccaatacagaagaatttaatttaaaacccttgttaatagggtatacattcttgtcctctgttttattattaatttttttatttggtatgattcgtaagaaaaacagtaaacaatgaacggaagaccgttttactggtcgtcgttggatttttatcatggaaaatcaaataaaggaaaacatcgaggcatccatgccctagtgaccaggtcggtcaaatatgccggccttttttcataaacaaggtttgttaaaacattttgttctttttatatatggggttgtgagcagtcaggggagatgattgactttaagttttaagataaatgaaatagaccgattccttttacgagggcggtctatttcttgtgttttctgattaatcaaaatgacggtgatgaccatcgtcgtaatacgataattggcatgagcccacgattaaaaaggtacacgagacttgtaacacggtacatactgcatataggtcatgttttgtgtggtttaaacagcttcaggactttgagaaacctcttatccagtggaacttaaattcaaaatttagtcaaatacctatacagcttactctccactgatttctccaatactagattcatatgcacaacggatattgaattaccatttttatcgagcatggttgcctgataggcgctgttttcgccgggatgtactttacccagataataaaattcaattccatccgcatcgtttctttttacgaataaatgcaagtcgatctttaactggtctgccttaataatggtttgaacttcctcagattcaagggttcgtctactttttgtcgaccatttcagaatctctggactaataaattcttcctgatagtttgtgctcgcttccacctcttcatgtttgtgataagttacaaagattggacaggtctgatgcttcgtcttgtacccgtacatggtggaactttcatcgctgtaccactttaatagtttacatgagtcttttctagaatactttttatataaagttagcggctcactatatacatactgctcatttttaagaaagcactatgaacaatatctacaatcatttgtctaaaatatgcattgttctgcaagaagcgactcatcatcggatgaaaagaaaaatgctggtcctgaacgaattcaacgattgccgagtctccgtattttttcttcgtcggttcagtgaaaaaagacatgtccagaacccgtataacggatttaatcgtttcagaatctgtataacagcctttttctttgagggaatttacatactcctcataggtaacattatctttggcaagcaacagcttcagcagtacaatttcatgcctgcgttttccattcaaaatctcagccgacagcatcgtcaaatatttttgttcctgctcgcatagggggggcacagtctccttgatcttctgtaaaaagtgatagtagcttgagtgcttgtctgcaaaaacaagtggatcaattgaatcatattcaataaaatctatcaattgaggaattcgatttaaccgatttttgagttcgatatatgcttctctcaggattttaagctctgttaaattactgttgctaattgagctgaaaatctgttgcatcgcgatttcttcaaagttgatggtcgagacgcctttaatataactggtgtccttcatatggcgacgtatgttatccttgttttgcgacttgtctccggagagggcaatgggtatcaaatagttgtttttatagttgccaataaagtcgatgattgtgacgaactctttctccgggtgtttgcgtagaccgcgacctaactgctggatgaagacgatactcgattgtgtttgacgcagcattacaacttggttaatacatggaatgtcgattccttcgttaaagatgtccaccgtaaggatgtaatccagttttccagattcaagatcagtgatactgcgaatacgtaattcctgatgatcacttccagttaaagctacggtacgataacctcttacatttagcatgtccgatagatgaaaggcctcttgtttgcgactgcaaaagatcaatccttttaccgattcaccagaatgtccataatattctatcttttcgattaagtaagaaacccgttcgctcgtaacgagttgagagagcattgccgtatcatcaataagctgaccgttgtgttcaaaatcagtgacgccaaaatagtgaaatggacacagcatatcctcttccaaagcttcctgtaggcgaatctcataggcgatattatagtcaaacagttcataaatgttaaagttatcggttcgctctggagtagcggtcatgccgagcagaaatgcgggctcaaaatgatcaataactttaagataagaatctgctccggctttgtgaacttcatcaatcaggatgtagtcaaacgctttaggatcgaaatttgttagaacggagtttttagaaatggtctgtattgttgcaaagagatatttggcatgttcaactctgctggtgccagatagaatgccataatcaccatccttacctccaataattcgttgatagtcggacatggacttttgcaaaatttgttctcggtgtactataaatagtattcgatttggtgcaaagtttcttacgtcaaacgcagaaagataggttttgcctgtcccagtcgccgaaatgaccaaacctttatgcgatccgctgctacggagttcttgcaaattctttaacgcacgctgctgcattttattaggtaagattggactatagatggtctgaggaatcatttcaggaatcagaggtattgcctcttgaactttttggtttgctttttgagtctcttcataaagaatttgatacgcttcgatccatttgtgtgttagcggaacagcattttgccatgccttttcgaattcactttggaattgtcccaaaagccccccatgtttgaaggaggtcaatttcacgttccactcgtagttagattttaacgcctgtgcagttaggttagagcttcccataatgatagtggagtaaccttcatgctggaagacataccctttggcatgaaaaccacttagatctgttaaacgaacttcaacatttgtgattttcaataactctctaaaaattttaggtttattgaagtttaagtaatttgaggttaagatttttccggctattccacgtgcttttagatcagctaaatgagatttaagggttgccaaaccactctctgtaataaaagcaacggaaaaagtgaaagagtgacagtgagataattcttccagcaaaggtgtaaggacataatcgttcgtctccttattgttgaccagaagtttaggcttatattgatccagagaatcctgctgctgattaataaacgcccagtttaaagaatcatttaaatgttggatgggagtgttcattttatttggccaactgctcccgaattttctctactgcaggaatgtcagcaggtgcccaatccagagacatcagctcatgtgcggacatccactggatcgcaacgtgttcagttaatgtaggtttaccacttactaggtgacaatagaaagtagacaggtggacgaaaccaaagtcatattcgtacacggtagtctcgatcttctcgccaatctcaatctcgcagttcatttcttcgtcgatttcacgtttaagtgcagcctgaggtgtttcgccttcctcaatctttccgccggggaattcccacttgtaggccaacgttttagtagctcctcgctgcgcacagaggatattttcattttcaattatgacagctccaacaacgtaaatatgttttttcataagttccctccggttatgcagcttggtatttatgtagcgaattctacatttatatttctattctattatagtgcggggatttcagctacatgttagggatggaaaaggagtgaggcatttgtatgcatattttaaatataacaactaagcattttacgctattcaagctcgataataggtaattatggtgattataaaagttttgtacattaatatcgagtatttatgtttgtgctgggaaaatacatgatcagcttgatctgctttaaatgtcatactcccatcgtagttgaatgctatttcgttcgcttcgatttttataatgatgaatgagacgcacagaaaactaaaaaactgacaccaatggaatattggtgtcagtacacgactatattccattgtcttagatggggattgaccagatcattaaaaggcagttggggttgttaggcttgaaaacaaaaaaatccttttaatttgtaatctcccgtatcacattcctcgccaagcgtactttctctggactcgatttttggagtatttttatgatttcttgtatatcagtttcatgttttgtaaccttaatatcctcatttacataagcaaaaagctgaatcaaattaacatccagtgcattagcaattttagctatatttattaaagatacgtttttttctccacgctcaatctgacctatgtatgaaaaatggaatccgcctttttccccaagcgactcctgagacaatcctttttcttttcgtaaagcacgtattctggcacccactaattttagaacttctttatcttccatcgtctacacctcactattctaaaagtgtagacaagatatccaaatgaaaacattgaataatgaatacaataaataataataatatctataagtattattttagagtataataagactattctttaaattctctggaggaatagatatgaaagaagctccttctacctttattccaagtcccactcaaccgtccagaccctcacaacacctacataattcaataacggattttcacactctatcccaataccacatgaaactagcccaaatcctgtacaagcacaatcaagtccaatgctgcattatcctatgtgactgggcgttgacctccatgttaaaagcactatatatgaaagaaaaaaacagccttttccctcctggattcctgtccatgactgatctgctgcacttattacataccgaaaccaacccgaggttggatgttgtcgtatttataggcaccactcaatttctttcatcccagttagaaaccccgctccttcaaaagatgaagcacaaggatgtgagcaggctactgcgaagaacggacgacattctctgccagttgtcatcccgagtgattagcgatccatccgagacgtatcagtccattttctgagaagcccctccatggcaaataaacttgccgattcgccctgtcgttatccgcttttcttcatacgataagagtaagctttaacgcaaggagggattcagacatgggtgaagtaggttacggtggagcatggacatccacaggagcgattttggtattgttcattttgttggtaattattaccaagtcttttctgatctaacagcaggttagcatcgcttaaatccacaaatcggccttctttcacgacatcgtgagggagggctttttatgcagaataggtgttagcccaacatgttgtctggccctgcaagcattgttatactttacatacagggggattttccctcaaatatatggcaatacggatagcgtaagacgtggaaaaacagaaattcgctgaccaaaatcaggaggatcgcatgatgaatacggcaagcagtccatttcaatttacgacagacacggcgactctttgcttatttgatacgcaagctcttaagcaccgtttggacgatgatccggattggtggtccatcgaagaggacgagctgggcgagttgaacaaaggaaatgtagcttttttgaatctgggagcggacgggacctatgaggttgtgatgacagatcatatcgacaagcctactgtgcggctgtttttgaaggttccctcaggcaacctatttattggagcaggggaggaagccacaagtggtggactggagcctgaatgcgtatggggagggacgttcctttctgtacaaccgggattttatgaatgcttggcgagcagagaagacaatcgtatttatctttctttaaaaaaaggaagcgaaggcagcaatagctttacaggtctgattcgattgtaggttgcaggcaacccgtaacggcccatacaagccgcctgaacaggtggaagcaggaacaaccgaaaccaggaaaatggataaaaggctatccccacggcttacacatccgtgaagacagccctttatctgtctattgatactttacaataatggcattgctgatttggcggccgggtgtggtgaggtaggagccgttgtaatacagcccgctggaagcaccgccgtccagattcatggcctgataagcgccagcctgcttcatcatttgggcgagctgcggtatagtcgctccacttgtggtcaggaggatcagcttatgatcccgactcattccgagtgcgctgcgggcgccgccgcctgttaatattttagggtccttgaagccttcggctttgacatttagggaaacctgaccgttcgtgaccagacgaggcccggcttgaagggcaccttcgacgctaccttggcttaagcgttgttcaaaggcagaacccgacattaactcagataaatggttggcatcgtaggtgaagaccgtccgttggtcgccagagctttttttcaacatctttccgtgactgaccagatagccgtaaggcgttttgtaagagcttttggtataggcatcaaagaatgtaccattgatggctacaaccgcttggttacgtttggcgagactacttaagtcttccactttaccaatggaatcgcctgccagtgccacatccaggcttaccttgggatggagcatagagatggtgaccaccttagcggaaaatgtacgagacccgaccttgaagcttttatgagctgtcgtaatgggtgtagtgtttccgggtagcttgccagtatgtaccggaagcgtgacggacgttgcaccttgcttaatgcgtacagctgaggtttccttttgccatgagacttgcaggtttagatattgactgatgaactgcaaggggacataggtcgaaccgttatcggtaaaaggagcattttgcaaatggaccgtttgatcattcactttggcagtagatttcccggcaaatagggtgatccgagtattgccttgcgcaatttctatttttttgtccgctgccgttaaattgaatgtgatcccttcatagctgttcagaagacgaagcgggatgaaggagtggttactctggtccacatagaccagcataggtgctggggcagcagcgtagatcggggataccagtaatagcaaggacaggataacaagtgcggtggttcttttcatgaatagatcaatctccttatgtagtcttgacactttacgaggtgcttgtaattatatcgggttttataagttgtaaatgtatgttatgcgaattttgagtgtttagctgatataggaagcgggaggttggagatgagcaggtatgagacaagacttgaggattaccgtcgcagagagagcccgtcttatcgtgtatttgaaggattgcaggaattggtgcgtagcgtggggcaactgcataataactggttatatgtgaatgtggatcaatgggatcaagatcctgttcacacaccgatttattattgggatgagcattggctagaggaatgtgcagaggagggtgcagtcgtaaccaacgaacaggacgagtatattcccaagtgggtgctggatcgtcaggttcaaacctggtttgagttggcgaccttcgaaagtattgtggaagtccttaaggctgctggacagccagtgacgcttcagatggtgactatagcggtaaaatactatgacaaacgagatgcctttctggactatgaagaggtgaaggcagtgacagacctgtggtctgtgctgacaaaggtgagaaaccacctaacagaatgaacaaagcctgtagaacaaacagggcatacatacactggatgggagaagcaaatgagttggttgaatcatgaaatggcagcaaagtggcgacaggaaggaaaaaggtatgccgcagatgtgaatgaatttgtcagagtcggcaggaaagtgaatggcagcaggagcaatcagagccaaaccaggacgaacgccccaagatggccaaagatatttttcgtatgattcaggaggcgaatcaggctggtgaaatggagcagttacgtcgagagattccagccgcgtcttggccgcttacaccagcgttcgaggaggctttgcaagccgttaggccgatagcttttgtgaatggaggcaatgaagtcattctacatgcgggcaatcctcgggaacgtgggacgatctatgtgacgggaaaagatagaatcttgcaaatccccggactgcatcgagtaggctgttcgccggacgggacttaatttgcgttggtggaaggacaggggattcggattgttcgtcaaccggacttaaatctgcaaggagaagcgacagcacattttcagtggaaggatatacaaggccgcttaaaagcatccattcctgatctggagtgcttgggagatgaggagcatcctgaagatatattagatgaagtgattccgtttggcgatggacagcgacttctgctggtttgcggttacggcgtttatttgctggctggtgatcaggtggatttgatccatcccaaggcgtctgaacgaagaaaactagagttggaagacacgattgtggatatggcccatggagctgtgtcgagggatggacgttggattgcttacggtagccagatgagtgagcatatgcttatggatctgtctgataagacggtgcatacattggagccaagttctagttatccgcattatgctctatttgccaaagatgatctggacgtctggtacaatgcctgtcatttctacaacggtgccaccattcaagtgtcgattgctgaggtggagcagggtcttgctcagaataaggaagaatggccgatgatgaatgaagaaatgcgagtatacgctgcaacagcgctgacacaaggatctattttgggtgatgcctacggttatctccgtctgattgacagggagggccgtgaactttggcgctattttgtcggcagtacgatatccgggctggcagttacacctgatgaaagtatgttggcggttggaacgtatggcggtatgcttcatttgattgatttgcagagcggcacgaaggacgaatatagcattggcaccgcgccaattcacgagacagcgcgttgggtgatctggcggaactatgagcccttgcgctggtaatactaatattccgcaaatggtgataaaagcaagttctgataagctgaacttaaaaagtgtagcagcacatgattacaatgctattttcagatagagggcatttggcattaacccatgatgcaaaatgtgaatagaaaggaaagaggtgtgaagacatggacaagaaagcggatattcgtacatccatgaaggaactatttgctcagatggatgaagccttttttatggatgtggaagaaaatgtaccgatggaaatgcgtgatgggaatgtcgacgaggagggatggatcaagtggaagcctctcctttcacagattactgaacaggaagttcgggagatggaggaaaaataccattttgagctgccgcccctgctgaggagttttatcatgtcctaccattatgtatctttacaattcgataatgagtccatcccgggagtatactggagcgattgtacgtttgttgagttcccacgtctgcctgtaggtcaaggcttaaaggcattttatgatttgctcgatcaatggtcacctcttctgtcagcaggctacattccttttgcaatagcagaggacgaccagggtcccgtttgtttaaatgcaggcagcagacataaggacggggattatcctattgtttggttctttcatgaggacctacagcatttgaatgaggatgagctgcggatcaggagtagtctgcttccccatgtacaggggctgtttccatcttctgtcgaaatgtttaacgtgatgtttaagcacattagacactagctatttcctgaaatgtaattttaatgtttatccgaccgagatattgacataaaaaatgaggaatgatataaaaaaggtaggctagcactcgaatgatgggagtgctaacaaagttgaatcgtttgcatagctcatatcggctggccttacataggttcatatttgaaaggagatatccgaatggagaaaaaacagtttcaggctgagtccaagcgtctgctcgaaatgatgattaactcgatttacacgcaaaaggaaattttcctaagagagctgatctccaatgcaagtgatgcgattgacaaaatttattacaaagcattgacggatgatcaactggtctttgacaaagaaaattattatatcaaagtaactgccgataaggataacagaacgctaaccctgcgtgataccgggattggtatgaccaaggaagagctagaaaataacctgggtgttattgctaaaagtggttcactggcattcaaaaatgaaaatgaatccaaggatggtcatgacatcatcggtcaattcggcgttggcttctattcagctttcatggtagcagatgtggttacagtgactaccaaggctttgggaagcgatactgcatataaatgggaatccacaggtgcagacgggtataccattgaggcagctgagaaggacgaggtcggaaccgagatagttctgaaaatcaaggcaaacaccgaagatgagtcctacgatgaatatttggacgagtaccgtttaaaagcactgattaaaaaatactccgactttatccgctatccgattaaaatggatgttacaggcaagcgtctgaaagagggaagcgacaacgagttcgaggattacgaagaagaacagcgtattaacagcatggttcctatctggagaaaaaacaaaagcgagctgaccgacgaggattatcaaaatttctacgcggaaaaacgctatggctacgacaagccgctccagcatatccacgtcagtgcggatggcgcggtagtgtaccaagctattctgtttattcctgaaaatattccgtttgatttctactccaaggaatatgaaaaagggctggagttgtatgccaacggtgtgctgattatggaaaaatctcctgatctgctgccggattattttagctttgtcaaaggtatggtcgactccgaaagcctgtcgctcaacatttccagagaaatgctgcagcatgaccgtcagctgaagctgattgctaaaaatatcgaaagcaaaatcaaaggtcaattgctgaccttgctcaaaaatgaccgggagaaatatgatcaattctacaaatcatttggcagacaattgaaatttggtgtctacaacgattacggcagacataaagaaactctccaggatctgctcatgttctactcttctacagagaaaaagcaggttactttggacgaatacgtatcgcgtatgccagaggatcagaagtatatttattatgcttccggggagtccaatgagcgtattgaaaaactgccgcaaaccgaaatggtggctgacaaaggctacgaaattctgtatttcaccgatgatattgatgagttcgctattaaaatgctcttaagctacaaagagaaagaattcaaatctgtatcgagcggcgatctgggcattgagcctgacgaaaacgagaaagaaacagaagcagaacaaaacgacaacaaagagctgttcgagtatatgaagggcttgctggaaggcaaggtatccagtgttaaagcctccaagcgcttgaagacacatccggtatgtctgtccgcagacggcgaagtgacgattgagatggaaaaaatcttgaacgccatgcctaataacgccgatgtcaaagcgaataaagtgctggaaatcaacgtaaaccatgcggtgttcaactctttgaaagaagcttttgacaaggataaggagaaggtaaacctctatacggcattactgtataatcaggctttgctgatcgaaggcttgccactgcaagatccggttgaattcacgaacgatatttgcaaaatcatggtttaacaagctttattactgtatagagccgttcccatactgggggcggctttatttatcataaacacttcttaaatctccataataggccatatagcgcttacagaagaagggatgggcccacacaatgccgatcatactcaatacaaaggagggcaattatatgagtctggatagagatagaaaggaactccaaaatttggaccgaagtgagcttatagagttagtgggaaaaatcatcagaggtgagggaacagaagaggaaatcgacagcatgctgaccatagtgaagcaaaatacgctccatccggggatcagtaatttgatctactgggatgatcgtgatttgagtgcagctgagatcgtagatgaggcattacgctatcagcccattattttaccaccccatgaatcttctgcataggatgcggaggggtggtcttttgtttagaaataagatagtattaactctttagaactatgagcattagattcaaaaaaacttccgttaaatgcgtgctgacttccctggagtgtatggggtaatgtttgttttctgcacactttacggagtttttatgcctaattttggggtttgtaaagtttttgtgacatgctcctgtgaattttgacacagcaaattgtcgtttttcttgattatttggtgggatgtctttataatcattttgtttgcaagaatgattagcgattagcgtatggaataaggaggttatttattttgggaaaagcattgattattggcgccggtggcgtggccagcgttgtggtgcataaatgttgccaaaacccagatgtatttgaagaaatttgtatcgcaagcagaactgttgagaaatgcgatgcgcttaaagagaagctgggtggaggtcgtacgaagatccaaacggctcagcttgatgctgacaacaccgacatggtcattgacttgattcgaagctttcaaccggatgtagttatcaatgtggctctcccttatcaggatttgacgataatggatgcttgccttgagacaggtgttcattacgttgatacggcgaactatgaaccgccggatacgccgaagtttgaatacagctggcaatgggcctacaaagaaagattcgaaaaagcaggaattacagctctgctgggcagcggttttgatccaggcgtaactggagtatttacggcttatgctcaaaagcactactttgatgaaattcatacgattgatattgtggatgcgaatgcaggggatcacggatatccttttgcaactaattttaatccggaaatcaatattcgtgaaattacggcgaagggccgttactttgaaaacggagaatggattgaaactgagccactatctgagaaaaaggtatacgaccttcctgaaattggaccgaaaaatatatatcttttgtaccatgaagaactggaatctcttgcagtgaatattaaaggcgtgaaaaaaatccgcttctggatgacgttctcggacaattatctgaatcatttgaatgtacttcaaaacgtaggcatgacttcgatcgagcctattgattacgaaggacaacaaatcattccactgcaattcctaaaagctattttgccagacccggcttctctgggaccaagaacaaaaggcaaaacgaacattggttgcatcatccaaggcgtgaaagatggaaaaccaaaaacgtattatgtttacaatgtttgtgatcatgaggaatgttttgcagaggttggctcccaagccatttcttacacaactggtgttcctgccatgatcggcgcaatgcttatcatcaaaggtatctggaaaaaatcaggcgtttacaacgttgaggaatttgatccagatccatttatggaagcactaaataaacacggattgccatggcaagagaactttacgccaacgttgcttgattgaggtctgcgatgaatattgatattacaggacttccatcaccttgttatcttgttgacgaaagacttcttgtcaaaaaccttgaggttttaaattccgttcaagagcggacaggctgcagtattttgctcgctcttaagggattttcgatgttttcgacctttcctctggttggcaaatacttaaaaggcgtaacctccagttcgttgttcgaagcacgacttggtcgcgaaaaaatggacaaagaggttcacgtatacgcacctgcttatgttgacagtgaatttgatgagttattggagtatgttgaccatattgtttttaactcctttgatcaactgaaacgctacaaaagcagagtgcaaggcgtaacttccaaaaaaatcgacatcggcattcgggttaatccagaatattcggaaatcgaaacgccgctgtatgatccttgctacaacaactccagaatgggtgtgaccctggctaactttagacctgaggatctggatggcgtggacggtattcattttcatacaatgtgtgaacagaattcagatacgctagagcgtaccattaaagtcgtggatgagaaattcggaccatacattaagaacatgaaatggctcaatttcggcggcggtcaccatattaccagagaagactatgatctggacacgctggtacgctgtattcaatattttcaggataaatatggtgtgcaggtttatctggagccaggcgaagctattgctttgaatactggatatctggtggcaaccgtattggatacgatgaaaaacggaatggatattgccattctggatacttcggctgaatgtcatatgcctgacgtgctggctatgccatatcgcccaaatatcattgatgcaggcaagcctggcgagtatgcttacacctacagacttggtggacttacgtgcttggctggagatgtgattggagactattcctttaaagagccattgaagccgggagacaagcttgtattctgcgacatggcccattatacgatggtcaaaaaccatatgttcaacggagtcaacctgccagccatcgccagctacaacgacgaagaaggcattaaggtaatccgtcagttttcctacgaggactttagctcacgtttgtcgtaagacttccacaggggtaaaagaactgagtgcaccgaatagaatgactgaactacaaaagcctcgccccttgagaaaggggtgaggctttttggcgtagttatgttttatttgccttctgtatgtttatactagtacgacagtaggcaggcatgaagaaggttgatcagtaggtttttgtttaatctacaattctagaagaaagtttataccagaatacatgtcctcctggttgaatgcccggtgattcaacaacaaggtagtattcttgatcgccatcaagcgcttttgttaaaaagtattggccgtcttttgaacgtttaattctttttccattgttatcgtaaagagttagttgcaaccatccatcggaatacttttcaccctcaattacaaattcaactgtacctgcttcaaaagacttgaatttataaacatcgtaggcttcccaggtcccgtttatgctttctcctaaggacccaataacagaatctcctattagctgtaagttagcttcttcaaaactgtcatttggttcctgttcatgtccagtaagggaagaggcagtatttagttgcttgtttgatgtagaatctgcttctgcagcaaaagcagcacctgcagtagtactcagcataagtgtaagacctaatgaagctaacaacgtttttttcatgaataagagccctctcttttttgggatttatattcatttatatgaatatattagtaaacaacatggactattgtatattatttaccagcaaattggaatgataaaaagggatatttatcaataaaataaatataatagaacattttgttacaaaattgcattttgtgtgttcacaagtttgtcctaggggttctgttcaaaggttagatttcttggaggaaaatatatatggtatacttcattggattaggaacaaacttcgacatgagttggggaaataaattgtaacgataggcagaggtgaattgcacatgttcgatccgaccatttttgacaatttaaaagtcgccatggaaaatacagtatacgatctggataatctggattcacgtattgacattacgcagcgaatcgacagattggaaatgtctgtgatgtcgcgtgaatttggcgtacagttcagactgagggaacagccgagtgtgacagcagaacttcaactaaagatggatttaaacaacttggctgcggaaattttggaaattaaagatcaaattccgggatgtgtcttgttgctgagttttcacatggaaattcgtgagattgagtcacaatgcagccggattgaaaatgtactgaccgaaatttggaagcccgatcttcaaccggtacaaacgcttagtcagatttacggagaaaagatgtctacataccaaaacaggattgaactccgattttccagacaaattaacgaagatcagatggaagacattccagagctgttggaacacatattgctgacgcttatggaattaaacaaggtctaaagggttagggccctaatgtaaatgacattagtagaccaacaagttaacgttagaggagttgaaagtataaatgaatgaacttgaattctctcaagtatatgcgattatggaggcttcttttcctgaaacggaatgcaggacattcgagtcacagagggctcttcttcatcatccatgttatcgtttacttaccgaaaagaacgaacaagggcaaacaattgcctttttggcgggctgggaatttgcgcattttcggtttgtagagcatattgccgtagattcccgtatacgaggtggagggttaggtaaagagcttatgagcaagtttatttcacagtccggtaaaccggtagtactggaggttgagccgccagtggatgaatggactcggagaagaattggtttttatgaacgcctggggtttcatctgaaccattttgactatgtacaacccccattaagagaaggacaggctgatctgcggcttcaaattatgagctatccaggtgcgctggctgaacaggattttgctccgtttaaaaagattttatataccgaggtctatgggttaaataaaaagattgtatagctaatggtgcttcattatcgttcatgttttgtccataccattacaaattctttctcgtcagtttcggtatcaatagattccgcttgaatggtaaatccatttttagtatagaagttgaatgcttttgtgttcgactggtatacctttaattgaatctcattatgttgcttcttgatccaatctagtagtaactggccgtagccttttctttgagaatcaacacgtataaatagagctgccaagtatccatccaacatggaaacgaagccgccaatgctatgatcatcttgtatgataacgtagttttgagcgaggggaaggtacctgttctccatctcagtagcttgtgatgcccaatactgcggagcaataaaatggtgggcttctacggaagcatccagccagatggctgccagttccttgaactcttctacattcgcgggtctaatcgacatcttaacgcctcttttcacagtatgtaatcctattccgatagtcaagtatgagaaagatgatgttgaaataaaaaagaccgtccgtagacggtctttctacccgtggcgcttaattaaagctttgatccgtatcccgcgcctccgtcaactctgtaaattagagaataacggaccgggtaagggatacgctcaacatgtgattattgatgttgacgcacctcctttcctgatggacccattttaccatatctggtttgtgatatccagtgattttcttatatttacggaaatgattcatagaaaatataatataaaaatagcttgattttatgttctatggaagatataatctaaattaccgtgattgaaaaacatcggtgtgaatacataatatgcggtcgtggcggaattggcagacgcgcacggttcaggtccgtgtgggctaaccccccgtggaggttcgagtcctctcgaccgcatcatagcctaacatttacaggttcttggattggctggatgccaccaagagcctgtttttatatggttaagatgcgcctaccattataacttttttatttatactgaaatatatatttaatatagtcttttgcactctgatcaatgtcttcgtcgcttgcttgaaacgaggctccgaagacagcgaaatagggtaatgttatggcgccaacatgcactgcgcttgccttaaaaggtgctataacttcatctacagtaaaagaaacggaaccagtaggtaagtaattttcttttttatcgccaatggacatggctatccctagcttctttccttttaacttatcaccctttgaaccataagcccatccatgggtaaaaacatcatcgaaccacttttttaataaaggagggtaactataccaatacaaagggaattgaaatatgacattatcgtatgcttcaagtagctgttgttctttcaaaacatcaatgctccagtttggatactctttataaatctcatgaattgtaatttcattggtatattgaagtaattctcgtttccatctgttatttactctagaatcttcgatattgggatgagctaaaatcacaagagttttcatcataaatcacctttcttacgtaacatatttgcctttatagatgctctattattattctgtatgcttcaaaaaaagtaaatacacacaataaagtaagatagttacttgaaagtatgcattggacttaaagtgaagatatgcgattatagaattaattagataaacgttgttatttttagcgttgaagaggtggtactatgaaacaatataatttaggcatagaagcaacacttgagatcatcggaggtaaatggaaatcattaatcatatgtttattaatgtctggtagaaaaaggacaagtgaattacagcgtagtatttcaggcatttctcaaaaggttcttatacagcaacttcgcgaacttgaaaaggatggtatcataggtagacatgtgtataatcaaatgcctccaaaagtggagtattatataacggaatatggaattacagcaaatgaaattattgacttaatgtgttcttggggaagggctaatatccaaataagacaacagcaaggagaagatgtgatgttgttagaaaataattcaaaatgaatagtggagtaaaaaagcgttgcagactatgatgtttacggtagttttcttcggctgtcttcaagtgttatgttatgtgttgagccgcaagctgatttgctatatagttatgactggacaaccattccatccatattaaatgaatgccaaagtagggggacccttgcaatgattattaaaccgaaaatccgtggtttcatatgtacgactgcacatcctgcaggatgcgcggctcatgttaaccgtcagatcaactacatcaaagacagcacatcaatacaaggagctaaaaaggtacttgtgatcggagcatctactggatacgggctggcttctcgtattgctgcgagcttcggtctgggagcggacaccataggggtatcctatgaacgtcccgcatcagaggggcggacggcttcagcaggctggtataatacagtagcctttgaaagagcggccagagcagctggctacatagcagaaagcattaatggagatgctttttctcatgaaattaagcaggagacgttgaagctggtaaaggaaaagctgggcaaggtagacctgattgtatatagtgtcgcttcaccgcgacggacacatcccgatacgggtgaaacctttaattccgttctcaagcctatcggacagtctttttctaataaaacagtgaatacgaatacaggtgtcgtatcagaaattacgctggaaccggctacgcaggaggaaattgagaacaccatcacggtaatgggtggcgaagattggtccttgtggctaaaagcgttggaagaagctgatctgctggctgaaggggtaaccacactggcttactcgtatattggtcccgaaattacggaggctatctatcgtaaaggaaccattggccaagctaaaaatgatttggaagctacagcacatactttaacaaagcaactggagcgttatcatggaaaagcttacgtttctgtgaataaagctttggttacacaatccagttcggctattccagtcgtacctttgtatatttctttgctgtttaaggtcatgaaggaaaagggactgcacgagggatgtattgagcaggcacaacgtctgttcgagacgctatacagtgggtccactgtggaaacggatgaagaaggacgcatccgtctggataactgggaaatgagagacgatgtgcagcaggctgtcaaagcagcttggtccgaaatcactacagaaaacgtatctgaattgggtgatctcgaacaataccgtctggatttcctccaattatttggattcgggtttgatgaaattgattatgaattagacgttaatccataggttgatacactttcataagtgatatttgtaaaacaaaaatgggtactctcaagcgatgcaattgcttaagagacccgttttttatgtatattggcaaaaaaacaagttgcactcgtttcactaacggcatttatcgagaattagatgtggaaagtgacttacggtgcagcaagcgaaaaacggcaatggtaatgacaatccccacaacgccaaagactgcaacagaagtcagggcccgataagcttgccagccgaacaaaaaagcaataccactgccaaacgttgtacctgccaataacccaagtgcgcaggcaatatccgttccaaatttcataaacatgttcctttcgaatgtgtaaattaaaaagcaacttgtactttttcgctggacttggacacatacttgtgcgtacaattaaatagtaatcgttttcaaacggaatctattaatcattatggagcattcttgtgcaaattattcctttttcaggaggctgatgaaatgaatatgaatgaacagatcaagctgtggaacgaagaggcgcaggctagtaacgctgatcatcctcaccgaaaggttgaattgtttattgaggtacgggatggagcactggactctgttgccccttatctgaatcaacaggtttatcgtcatgtaactctggtagaagatgagtatacttcggtggcggctggaacaaaagtggctgagctgattcgtgaggcaggtttgacagttgatgtagttctcttacctccgaatgctgtaggggatgtgattgctgatgaaacctacattatgaaagtgctgctgggtgtggcggataagagtcaggctgtacttgctgtaggctctggcacgattcatgatctggttcgcttcgtatgttataaaatgaatcgtccgttcttgtcagtaccgacggctgcttcggtggatggttttacctccgcaggcgcaccactaattgtggatggcagcaagcagacattccaagcagttccgccagaggcgatctttgctgatttgtccgtgctggcaaatgcgccacaaacgatgactgcggccggttttggcgatatgctcggtaagttcacctcactagcggactggcatgtttccagagatttgggaaacgagccgtattcacctgtggctaatcgcattaccgaggaggctttgcgtgcctgtatagaacatgtcgatgagattgcggcaggtagcaaggctggggtcgaggtattgatgaatgcgctgattgcatccggtatttcgatgctgatgatagatcattctcgtccagcgtcagggggagagcaccatatttcccaccgaattgaaatggattttattgcagagggacgcaagcaagttttgcatggtgccaaagtaggcgtagcatccgcattgctgtctgacctgtacagggatttagcagccagtcaggatgtagaggcatttaaggtgtatctggaattgcctacgtcggagcagatgcgtgcatggctggctcaggtcggaggcccatctaccattgccgagctgggggttacggaggaacagctcgctcgtgcattgcgcacggctcataccttgcgtgatcgctatactggacttaagtatatgaatgaacatcaattgcttcgttcgtaatgtgcaacctctacacaaattgtcctttagatattcagccactcatgtgtggcaaggaagggataagcgaatgggtttacacctccggcagcaatacgacgatatcctgttcctgtaacatttgtatgtacaaatgaacggtatgctataatcgtggaatatgaacaggtacacgatattgcaagtacggaggaaattatggcgcctaaatatatacaagttaaacaggaaattttgtcctggattcattcatccaaactggaaccacaaagccagcttccatctgagcatgaaatgtctgaacaatttgccgttagtcggcaaacggtgcgtcaggcgctgggtgagctggtgcaggaaggctggctgtttcggatgcagggcaagggaacctttgtcgcgacacgggacagcaagcagcccgaagatccaaagacgattggagtcattacaacctatatatcggattatattttcccatccattgtacagggaatcgaatccaaattgagtcgtcagggctataagatgctgctgtcaagcacaggtaatgaccctgagcaagaaagtcagtgcctggaaatgctgttgagtcaaccgctgagcggaattattatcgaaccgaccaaaagtggagagcgtaatcccaatctgaactattatttaaccgtggaaaatcgccaaatcccttatttgatgatcaatgcgcgttatgaggaaatggatgcgccatgtctgcgagtagatgatgaaaagggtggttttttggcggcagagcatctgattaagctggggcaccgacgcttggccggatttttcaaaaccgatgatatgcaggggattcttcgtatgaagggatttgtggccgctcaccgcaaatatggtgtgacactacacccgaacgcagtaacgacttaccgggcagaagaaaaaaatgagattccgctacaacgtgcgtcgaggctattggcgatggaggcgggagagcgtcctactggatgggtgacctacaatgatgagctggctgttcgactcctagatattgtacgttcggtgggcctgaacattcccaatgatctatcgttggttgggtttgatgattcatttttggcgacagcaacggaaatcaagctaacgacaattcggcatccaaaggaagagttggggttacgtgctgccgataccatgctgtcgatgattgaagagaaggggtaccatgaagaagatcgtcagttaattctacctcctgagctcatcgttcgtgaatctactgggcctgtccaggtcatgcctggagaacactaggctggaagatcagtcggttttatttcttaatatgtaaggacaagttagtaagtatacagctttaacgcttaatatttgatggcatgtttctcgtcataccgaacagtctgttttctggattgcagaaataggctgtttttgttatattttttctgaaaatgagtacataaatctatcgagaaaatacataaaaaaagactagctaagttgtacgtacaatcatataatgaaagcgtaaacaaggttaaagggtcgttaagaccttcctgtaattttccatttgaagttagtttcagtcacctcctccattgcagatttcagaaatgatagtaaaaggtgtgtcttatacatattagaacaattgaaaaaggacgtatgggaggctaatttggctcttccaaggcgtggcctatgaagaactgaaagcggagcaactggttgtactgattctacaaggcgatattgtcgaggttgaccttcggccttcgtcagatacgcccacacttcatctggcactatactgttctttcgttcggaatccagaattcaccttagtggatctggcgctgctgggtaagcattttctgcacaagcatgggcgaatgcttattatggtcaacgataaaggaggaggcacacaaatgagcaagtatactattggtatcgattatggaacggagtccggccgtgcggttattgttgatctgtctgacggagctgaaattgctacacatgtaacaccttaccgtcatggagttatggatgaagtgctgcctggtagcggacgcaaattggaaatggattgggcgctggaacatccggctgattatattgaagtgctgactatttctatacctgccgttatgaaggagactggcatttctccagacgatatcatcgggatcggaattgattttacagcatgcacgatgctgccgatcgacgcgcaaggacaaccgttgtgctttgacgagaacctgaaagataacccgcatagttgggtgaaactgtggaagcatcatgcagcacaggatgaagcggaccgtttaaatgccattgcctcgcagcgaggagaggcctttctgccccgctatggagggaaaatttcttccgaatggatgatcgcaaaaatttggcaaattctgaacgaggcaccggacatttataatcaaacagacctctttgtagaagcgaccgactgggtaatttcccagctcagtggggaactgaaacggaatcagtgtacagctggctacaagtctatttaccatcatcgcgagggttatccggatcgtgaatttttcaaagcgctcgatccgcgtttagaaaatttgacggatacaaagctgcgcggtgagatttatgatttgggtgcccgtgcgggtggattaacagaggatatggctgcaaaactcggactgaatccgggaacggcagtagcggtaggcaatgtggatgcacatgcggctgttccggcagtaggcgtcgtcacaccaggcaagctggtgatggcgatgggaacttccatttgccatatgctcctcggtgaggaagaaaaagaagtagaggggatgtgtggcgttgtagagaacggaattattccgggctattacgggtatgaggctggacaatcggcggtaggaggcagtggctgcgggagctgaagctggaggatacgacgatatcgtcgaagcagcgcttcatatggctcgtgtacgggacgagagcttcaagccgatctctgagaacgcggccgtgtatgataagctgtacgagggatacagccgtcttcacgactactttggacgtggagacaacccggtgatgaaaaagctaaagaccatcaaggaagaagccagacgttcaactgaaacggcaagcattcatttttaagaaactgacaaaatataagcaagaagtatttaaaactctgttatctaaaaagcacagtacaccgaggaatcggcagactgtgcttttttttgcattttatattctgtgaattacatgatgtgaaagtctcagtggatgaaagatggtaatgcgttcctttcaaagactttcatgaaattacaatcgtttcgtttttacggacatttttactttttcagcatggcatcagcaaacaaaatggattttggaatacggaaaaactgttccgcctgatcctggaaggtttgcgaaggaacggtaccctgatgcaaccatttccgaaatgtaccggggtgaacgccaatccaatgactcacatcggtcaccgaaatatcatgtaccatgcacagacccgccaagatccgatttttaaccggagaacgagtcacagtccgtttcataaaacgggacggcgatggttgacagatgagtggtgaacgccggacaacctcttcattaaatagaatatggtgcggataaccaagtgtattacacgtcttttccagattagtgttgccgggaatgcgaccttcatatacccacgcactgacactacgggaggaaatggaaagctcctcggcaagttgggacagtttaatgtcattagccatcaaaacggcaagcaaaacgcgattgcgcacttgacagcgtgttggtttacgaaaacgtttgacacgcacgccttttcccaaatatttgcgattgatcagagaccacgcctgaatggaatgtttatcttgttgtttaggcatataccctccgattttttttaaccacatactactatacccgaagggggctttgcaagtgactcctctcctgattttcttttaatcccatgggcttaaccggtttatggaaaataaggtccatttggcctataaaaatggaagtttaaggtgccgatatattaaattgtaacattttttatggaaatggaggtaatatgttcttctcttatgattgtaaggattatagtgactaataaaaatgtcattacaattaatcctgcagtaccttcactaggtaaatatggtttaagtgataggaactatactgcaagtgcaacgaattatgtagttacggacgaaattttgaacaagactttgggtgaagtaggcactggaaaaacggtttacttacctacgcagtataaaattaagtggtggcactctaaagcatataaggcttggcaaatggtcagaaaccataaaatggactccgtaataaatgctttgaaggagaagaggtataaatgaaagtgaaaaaaacattgttatatctaagcattccgttgttgttgatatttgcaatcatattgttcattgctttaccttggcttctaatattcatagggaatcaattagaacctaatccttcacaccctgaaatcacatatgggaaatttccatttcgtttggaatatgaaattaacgggcaacgaaaggttattcaagatactttaatatgcgaatatgatggcattggttcaaatgaagctcgcggcaaatatcgtaagtggaaggaaatgctatccagcggggatagattactacctttactagaagtcaacggcagaatagaaatatcctatcatccagggattgcagagtactatatgggtgatttggatagtactgacgagtataagcaaactgttgctgactctatatttattgaacaagaaggctttatcattaaaaaagatggaagggtttttgaaaatgatggaaggactattaatactcaattttccaattcaaatgaattacttgataagtaccatattaaactgataagctgggactctactccaccaatcaaggataattttcctgaaaccaaataataaagaagatgaaatattccttttttcgagaaggggctttattaaaccaaaaacgagattaattctcgcttgttctagcaataactagttgtcaacgagtgtgctttgtgtcacaatcaaagccacaatggacaactgtctgagtaacttaaaataaatttataaagcacttgaaaccctttggtgatttcaggtgcttttttacgtccacgtataattctataagtctagtaacataactatgacatttggcgagataaaacatcttagctggagaaggtatccaatccatatcattactcggttgagctatggggcagcaccacagaacttcaatatttgcgagccatgtactaaaatcaataaatttattatatttttttattgaaacattactggtaaaatctattcgattaatttggtgatactaatacaagactcaaatcaactgactaatggagattattctactatatggtttcctattgtaatttttattctttttataaataatttttgaataggttgttggcatagtagttgttttacattgttaatagcagaattgaattgtacagtttgattttattcagggagaaagagtggatatgaatatcgtattgacttaatcaatccttttcggaggaacagtcgggaacaattgcatttgaaaaatgtgtcaaccggtggaggtagcgatggctgggattggagattttaaaaccgacaaaagtaccgaattaatatgagttgtctacattggatgaaaataacaacagtaagtatggtatgattcctagagtttttttaatagatgtagaggctggaagtgcacaagtattgaagtagaattttggattatttaaccacatggggagtctttataaacttaactttggaagtagtgaccaaaatgctggttacaattatttcatggggattacaacagcaaaaggagtataaggatgtcattatgagtaaatttatttgtgcagtctgtggttataatgagttgaattatcctcaatgggataaacatggttttccaactcacgaaatatgtaattgttgtggatttgagtctggatttgatgatgatacaaaggacattccagagtcaatcgaagaatataggattaggtggctaagtgagggggctaactggtttagctcatcaaagaccaagcctttggattggaacttggcgatacagctaaaaagaatcaatgtggatatttctaatagtataatttgacctagaacccactgtagtttacggccttgagaggagtaaatccactcaaggtatttcttttaccgccacccggtgccaaataaatgaggcggctaagtccaaacgaacttaaccctctttgctcccgtataatattcctctagtatgcctgtacacaataccagatagtttcgtgttgtggctttgttattaaaacttcttgactgataataaatctatgatcctgaccaatatgttccaatgcatttttaatacatttaccctaagacaggtagaaccacattggattactattatttcgaatgataggatgatgaatttggaaataaattttaaacgtccttatggtgttattaagcataatatgtcaatagagaacattgctgacttgataagcttatttattgaaaaggattcaatcatattattttccttttacaaaaggaatatggattcatttgatgtaaatatacaggaattcatcttagagaggtgtgtttttgtgaattctgagtgggtattgccatggagggaatctatacctcattgggatgaaccgaatcagacaccgccgaaaataatgtggttttcggcggtgaaaaaagaagaaattattaaagcaattgaaattgataatttatttagatgtattgtcattaagaagggttcagattttaaacaacatttcaatgttttattccatcaggaatattattcgtctattgatgagcaagactacgaatattatttaggatttacaaataaggatttgtttcttgctaattatctggatgaagttaaaaagaggttcgaggtatcattaatagaataggcaaatggaaagatcttgggggcggcaatcctcaaggtctttctttatatgaacacctaataccaagtaaatgggttgaatgatactcctttatgacaatcccatagtctattagaaaccccgaatcttcagataccactgtatcttgctccaaataccttctcttcattttatttcggtaggttctagtccaccagaagaatctactaatcgcttgtactcttcgtaactccggccaatttattcacaaatttgtaacctcctctggcagggggttgcgagattgttttcaaattgttttactatatttacctactatagtctggtaatctattaatatatataaggggaacgaaaagacgtcaggttcagtcggttcatacgcgtttatgttctatatgttgagtgaatgtctatattgccatgtctatatcgtcatgtctgtataacttcatagacaagctagagatagctcccgcacattataaaatacagcacaggatggtgtaatgaatgaagcttttaaatgcaaaatggatggctgtatgcttgatggcaatctgttgtttgggtttgctaggtatacatacgaatacggcgagtgcacaagcgaaggctcctttgctgggggtcaatgatgtgttgctagattcgaataccattcagcccgtaatgaaaaatgataagttgtatgttcctatcgttacattagggcaaaagatggggatttctacttcggccagcggcaacacattggtactgactgggcataatcgcagctttacgctggatttgaacaagggggatgtgttcgagcgtggagatcgtacaatggtgcccattcgcactttgaccgatgcgtttggcttcactattacgcttccaacaagtaatctgtatcgaattcagaacgcaaatgctagtttgtctgatgctcagtttttgaatacattcgcggcagaaattaaacagtacgcagctgtcaagccaggcaaaactagcaatacaggtagcacagaaaatgctaagccttccagtcgtacgatttatttgagcttcgatgatggtcctacggcgcatacgtcgcagctgctggatattttggataaatataatgcgaaggctactttcttcatgctgggacctgaaattcgtcaacatagcgcagtgatgaaaagaatggtagaggcgggtcacggtttgggcttgcatgggatgacgcatcaggtgaagaaaatctatgcatcccctgcaacagcaatggcagagatgaatcaggataacgaaattttatttaaggctacaggaaaacgcacttctttgattcgtacaccttatggcagcaaaccatatttgaagaaagcataccgcgatcaactgacgggtgcaggctatcatatttgggactggaacattgattccaatgattggcgttatactaaaaatccagagcattttgtacagactgtcctaagtgatattaagagattgaaaaagcaaggcagaacaccagtcgttcttatgcatgataagccatctacgatcaaggtgcttccacaaatcatggccgctttgcagaaagaaggctattcgttcgagccgttgaatgataacctgaccccgcttaatttttggaatgatcatcgttaattgaatagcatgaaagaaaagacaccttttcaaccatttatatagtggtggtcaagaccccattttatagacactaaaaaaagaccctaggctataagctgcttccgatactctttcggaggcagcttatttaactttcgttgtggtcgacactggttgtaaaattggatatattcttttattctcctttgtgcctcgtccatatttcggatatcataggggtagagcccttccgttttgagatgcgagaagaagctctccatcgaggcattatcataacaattgcctcggcgagacatgctgattcgggcgccaacctttggtagcatgtcatggtacgcatgggacgtgtactggaatccctggtcgctgtgaacgatgaggccagtcacgtctttttgctgttt

SEQ ID NO: 2644 - DNA, 27377 bp, Unknown
  Kingdom: Bacteria, Phylum: Firmicutes, Class: Bacilli, Order: Bacillales, Family: Paenibacillaceae, Genus: Paenibacillus
gaaattatgaaagaatcaacaagtcttctattgggtgtcgaaaaagcatatcagttattgcgtaaatacctaatgaatactataggtaaggctccagctatttatgaactggacaagtatgtgataagcggtatatacgaaggacgaaatataaaaccattaatagcaaaagcatttaaatcactagcgatccaaattcaaaatgaggttgacggactaaatataaattttgattattatctaattggtggaggtgcagcacatcagatttataacacacttaacttcaagaataaagcacttttcgatcagctttcacaaataagagggtatgaaaaaattggagttagagcatggggaagaaactagttagcgcaagactcagaagcggaaaggatgatgacctcaaaaaagcactgagtaaacttcctatatattatgatgagagcgacatcgtaagagaagcgctgagacagttcttatttggacacaagggaagaaagcctgaaatattggggagtaaagttgcaattgatgatgaactcgttgtgaatagagaagaattagaagaagttgattttatatcgcaatcagatcttgataaaagcttagatgattttatagggacttgagtaggcttcggcctacaatacataaaataagggaagctataaggattaaagtaaaattaaaagttgaatatctgaagttcttagtgaataagtgttatgttaatggcgttaaatatctgatcaaacatacctgcatgttgtagaccatattaggcatatactgtcacaacgagaggtgatcactgtggatgaaagctctagaaggattactgttaatgaatcaaggatcaatgttgtttttaaaagtcaggaggcttatgaagcaatatctgagcaaaacgaagaagttccattaaccagtaatcattacgaatccgcagcagacatatttaaggatttagacgaaatgattggacttgaaaaggtaaaagatcttgtgtatgaaatttatgcattgatacaggtacaaaaacttagaagtgaagaaggtctgaaaagtagtagtcaggtataccatatgatttttaaaggaaatcccggtacggggaagacgacagtggcaagaatagcttctaaattgctaaacagaatgggtatccttagtaaaggtcatctgattgaagtggaacgtgcagacttagttggagaatacatcggtcacaccgcacaaaaaacacgagatcttgttaagaaggctatgggaggtattctttttattgatgaggcctatagtttggctagaggaggagacaaggattttggaaaggaagcaattgattgccttgtaaaagtcatggaggatagaagcgatgatttaatcatcatcctagcaggctatccagacgaaatgggaatgttccttagaacaaatactggtcttccatcacggtttccaatacagattgattttcaagactacaccacggacgagttaatgttaattgcagtaaagatggcgtatgaaaaagattacaacattacttctgatgcattgataaaactcagagaaataattcagattgagaaagactcaagaaataattttagtaatgcacgatatgttcgtaacgtgattgaaaaagcgattcggcaccaagctgtcagaataatgagtagacgtataaaaatatctaagcaaaatttaatggatatattgccgcgagatatatcaaattcaaatattgaaatgaataaaaaccaatttagtatatcacattaatttagtatgtattaatccataaagaacaatcaatggattgctgccacgttatagaagaatgattgttgattgttctttatggggttcatagaaattaaagggggtgaggggtaaaaagtgttcatgctggatctaattaaaatcaatattttataaaggaggggtgagttcaatttgaagtttaacgttatttcacccgatgaaattccatttgataaattagacatagaaatgcgagaaatcattagtttgctaaattgtgaatatggaattaaaacagaaagttgctgcttcggacacagagaaaaggatagtctttacatagcatttcatgaggatatgaatgatttcattgaggagttagcgattgaagtagctacgtatatgaaaggatctgatttcacttttgaatactgggttagaaaaggttcgaaaaagattaaaagaaattggttttgcagaacaaacggaactaagtataaatctgatcgttaccgcattttagaggagtttatgagtatactgaataacttttataactaatttacgaaaggagtagacagttatagataactatgtgatatatcatcttcacagcgacaacagtaatccctctacgtcgatggcagttgattcggtaactaagtttcaacaatacatagatgcagcagagcaggcagaaatgaaaactatatgtttttcggaacatggaaatgtttttaactgggtcaagaaaaagaagtcaatagaagaaaagggaatgaagtacatacatgcaaacgaagtatatctaactgaacataacgatagagaacggggattaattcgagacaacttccactatatgcttatagctaaaaattgggaaggggtaaaagagctaaatcggctaacctctatatccaacaacaaagaagatgggcattattactacaatccaagattgacatttgatgagctattcaatacttctgataacattataatgacatctgcatgtttggcatctccactttggagagcaattaagaacgataacaaacagatgtacaaccgactaatggaatttttcgtgaaaaacaaacaccgaatgttctttgaaattcagtatcatacgcatcccgaacaaaaactgtttaatcagcacctgtataacatttctaaggagactggaattccgctcattgctggaacagatacacatgcattaaatcaggctcatgcatctgctagaacaatccttatgaaagcaaagggtgccacctatggagatgaagatgcgtttgacttaacgtttaaaacatatcccgaattagtcaaaatgtttgaggaacaaaattcaataccaagaagtgcttatctcgaagcaattcataacacaaatgttatggctgatatgattgaagagttcatggttgatacgtctccgaaatacccaaagctatatgatgatccagaaaaagtttttaaagaaaagataaatgttggtgtagttgaaagaggagtaaataagttcgaagcagaaaagaaacgtcattattttgaaagaattatagaagaatttgatacatataagaaagttggagcaattgattatatgctgcttcaaaaagatgtggtggactgggcgcataaaaatgagatttatcaaggatatggacgcggctctgtaaacggaagtttgattgcttatcttttgaagatcacagagatggatagtattaagcataaactaaatttctttcgcttcctgaatccagaacgcatttcactagctgatatagatttggactggcctccttctaaaaggcaagatgtgattgactatgtagcaactattccgggtatttacttctctgaaatcataacctttaatacagtggctttaaaaggagcaataagagaagttggtagggcgcttaatatggatttgtcagttgtagatgaaattgcaaaggctgtttttaaaaatgatgataggaaagatgaaatcgataagcaataccgtgaaagatatcctgaattatttaaatatgtagacttggttcaaggcgttattgtaagtataggatcacatccttcaggatatgtagtttcaccaataagtctacaagataatataggactgtgttacacaaaagaaagtaagtatcctgtgagtcagatcaatatgaaagaattagatagccttaactacgtaaagcttgatattttaggtttagataatattgaaatcatcaatgaagcttgtaagttggcgaatattcctcgtttagttcctgacaacatgaacgtagatgacgaagaggtttggagttctatcagggagtcaggcttaggagtctttcaatgggaatcaacaagtgctggagcctatctaaaagacttgttgagtcctgaaacaataaaaagaataaaaaaacaatacccaaacttcagctatattcaattgttctcaattggaaatgcagccattcgtccttctggagcttcatataggaatgatttatcgcaggggatatttaaagatcatggatatgatgcattaaatgctcacttgaagagtacacttggatatcttatatttcaagaatcaataatgcagttcttggtggacttttgtgactttacgatgcctgaaagcgattctgttcgacgagggatgagtaaaaaagagggtacgaaaaaagagcttccgaagataagaaaaaggtttattgagaagctgatgcgtgattacaatgagactgaagaaacagctacagccgtacttgaaccatttattcaagttatcatagatgctaaagattatggcttctctgacaatcactcaaacccatactctcatatcggttatggcaacggttatttgaggtattattatcccttggcatttctaactgttatgttgaatataaatagcgacaatattgacaaaactggacaaatcatcgcatatgcaaaatcaagaggtatagaagtatcatcaattaagtttggtaagtctaatgcagactattcttacaatgaaaaagataaaacaatatataaaggattggaatcgatcaagtttttgaacgcaaaaattgcttctgaattattggagttaagccaaaatacatatagcagctttatagatttgttggtagatgtaactgaaaaaacttcggttaacacaagacagttggatatattgcttaaattaaacttcttttcagagtatggcaacaacggtttattgatggctatctacaatgaattttctagcggtaaaaatcaatacaaaaagacatatgttgaaaaaacaaaaaataaaagactggaagaattaaggctaatagagtcagatctaagatttgataatgaaatcaaagagttgttaccaaatgagatcgtcatgttccaaaaagaaatgttaggttattctgacgctaaatatcccaatgtaaacgcaagttggtgcgttgtaaccgacttagacactaaatattctcctaagcttactctatataacctaagacgtggggaagaaagaatatttaaaatggacaaaaaaacttttaattctagagattcattgctaagaatcaacaaaggcgatttgatcgaaataactggttttaaaaagaaggcaagacaagtccccgatggaaatggtggctttaagccaactgaccagacggatatttggattactggttattcaaaatacacagacaaggagaaattacatggatagtaaaatgaataagcaaaaaattgaagaaatattaaatcgaaagcttagcgagaaagagtataaagagattgtatcaatcgttctatacaagctactagaggaaaacaataatgaacaataaccttgataggtttgaaactccataccacgagtatagatttcctgacgcacaagataaggaggtgaggaggttttcaacttgtgcagggtgcaatgaagatatcttaattggagatgaaatattgatcttgttcgacggtctgaacgtccacgacgactatgcatgcctaaagaaagctaatggagcaaagaatattattgcaggagaggaatggtaatttgaatttagttggtcataatattacgctagttaatgaattgaagaaatatatgttaaaaagcattgaggaatataataaattgggatacataactgaaggcaagtatgaagaactaattgaacttgaaacaaataaacttgatgatcgtttgaagatgatggagagttttatatgaggttgaatctaatattacctcttcctgtttcaattaatgacttatacataaaccaatatgtgtgggatgcaaggattagaaaaagagttccgactggaaaaagaatattaagtaaggagggagagaaagtaaaaaaacaaatcatcggcgcagcctcaaaccaaatcaaaactcaagagtgggactacgagtatacaaagacacattatctctatatggacacactaatatattttaacagaaagggtagagatgataataatatttataaattgaacaatgatgccttagagaagattgtttatgataatgacagtagaatattaacccgaacacagcgtatcctttatgacaaaaagaaccctagagttgagcttacgttcacacccgttgagtatataggaatatttgataacgaggaagtatacatagaatttttagaaaactgtaaaacatgtagtaggtataaacggaattgttccattttgaaggctgcaaccgagggatacgttcaagatgaaattgatgagggaaactgctttaaatacaagcagacaaagattaacgagtgagtaaaagtagtattttatagggttaaggcaactatgcatatgccttctttcaacacaaatagaaaggagggagcaaattgaaaagaagtaacataaatagttttgaacttgtagttcaaattgtcaatgaagaagatgctaaaccaatagaagaaataaagaacgaattttcattatggttggaaaataccatgaaaaagtattctcatttagtaccaaaagatatataattaatacataaaaataattaaaataaataacaggaggaactttatgctcaggactttaactggttcagaaaaattcaccaaaactgagcttgaagccttggtcactaagatcaaggctcttatttatgctcgtgtttcaactgacggacaagttgacaactattcaatcgagtcacagattgaaagatgtatggatttagccaaacaaaaagggattaaagaagatgaagtagtggttctagttgaagatggtgaaagtggagataatcctaatcgcccaatgattaattacgctttatttttgctcgaatatggtattggagatcacgtgatattccttcacccaaacagaatgagtcgttttctgcatttacaaacacaactatctaatcgtatatggagtatggggaaagacttttggttcgtggagtttgaatttgataaatcaagtccagagtcaatgttgaactttaatattcaaggctctattgctgagtacaataaagctaaaattttagcagataccaaacggggaagaatcacaaaagttaaaaatgggcttataccgggtttaaatagaatttatggatatacttttgatacagaattagacacactagtcgagaatcccgtagaaaaagaaatttatctaaaaatggttgataagctcctacataatgattatagctgttctaggattgctgaggaattatctctacataacgtagcagcccctaaaaaagatagatggtatcaagttacgattagtagaatatttaaaaatgaaacgtatacaggaaactattattttggcaaatctaaagtaattcgtaatgccgatggaacaaagaagcaagttccacaaccaagggaagaatggagacgtatacctgtacctgcatacattacaatggagacatatcataaaattcaaaagagacttgatgaactaaacaaaaacaaatctggtagaccaacagaagattatcttttgcaaggtatttgtcgttgtggaagatgtggcgcggcagtatcgtcgggtgtgactacgaagactaaaagtgggttgttgaaatattacgtttgtcaacataaaacgaaaaaatcatgggaagttggaacaggagagtccaatccgatctgtgagggacgtaattggagagttgattacgtagataagattgtttgggagtacattaaaaatattatatctgaaccaacagaattttttgaacgtataattaaacagcaatcagaaaactcaaacactgatgaattgcttaaacaaaaaaagaaattagaaaagtccctacaggaaaaagaagcgtctcgcgaacgttatacagagatgtatgcggctggaataatcaaatcaatgaaggatttagaggacaaggtatcagcggtggatttgcaggtacaagacataaaagaggaattacaagtaatagaaaaaagcttatcaactgtgtttaataagcaaaaccatattgaaatggtacaaaaatcactacgatcttttaaatatttgctcgataatgaccatatagatatggagaccaagagaaaagtgacgcgactgtttgtgaaaaaagttatacttactgaagacaataaaataaatgtttatttacatctgggctttgttgattatgagaagaaagaatccgataataaacatataaatgcaaacagtcgccaagtccatggaagaccaaaaaaatcaatttattttgattctcgctggatactcgggggaaatggacttttttctacgaacaaatcctggccttccttctcgctttccaatccagttggattttcctgattatactgtggatcaacttatccaaatttccgagatgatggccaaggagcgggattatattctcatgcctcagtccataattaaaatgaaggagcatttgctaaacgagcgtaatgacagtcttcatgcatttagtaatgcacgatatgttcgtaacgtgattgaaaaagcgattcggcaccaagctgtcaggttgctcaatcagtaccggagcgggcaacctggcaaacaggaattgatgacgctgcgtccagaagatttgaaaatggacaaaagataggcgataataggaatctgaatcacatcgaatggtatgacatcgagcgggggccggcctgaacatcaggtcggtctctgttcgagagttgacatgaaaataaaggagcaaacaatatggcgaactccactcatgatacacaaaccgaaatgcaggacaaggcggtactggttagtctaattacggatgaagttaaacgatctggcatcaatacggaatactcgttggatgagctggtgaaactggctgagacagcgggagttgaagtgttgagcgtcctgacacagaataaggaagctaaggattcaaaatggtttattggcaaaggaaaagtagaggaactgcgcgcagttgctgaagaattgggagcgaatacagctatttttgatcaggagctctcgggggcccaagtacggaatctggaagaaagtctggatctcaaaattattgaccggacacaattgattctggacatttttgcacaacgtgcaaaaacacgggaaggtattattcaggttgaactggcgcagttgtcatatttactcccacgtttgtctggacatggaaaaaatctctcgcgtctcggtggtggaatcgggacacgtggtcctggtgaaagcaagctggagacagaccgccgtcatattcgtgatcgaatcagtgatctgaaacgccaactggaggaagtgacccgccaccggtatttgcacagggagcgcagacaaaagagcggcattgttcaggttgcacttgttggctataccaatgcgggcaaatcgacgctgttgaagcaactgacagcagccgatgtatatattgagaatcaactgtttgcgacgctggatcctacctccagaacaatggagctaccgagtggaaaagaagttattcttacggatacggtcggttttatccaaaatctccctcatgatttggtcgcttccttccgtgctactttggaggaggcgaatgaggctcatctcattttgcatgtcgtagacgcgtcttcggatatgcgagacgaacagatgaaagttgtagagacgatcttacaacagctaggggctgcggacaagcctcagatcgtattatttaacaaaaaagatgcctgtacccctgagcaactggaaatgcttccttctggggagggctatttgaaaattagcgcttttgatgaaggcgatttgctgcgcattcgtgaactgattcaagagcatctgagcggtgatacgctgagattccgcattcctgcggaacgtggggatttaacctcggtgctttatcgaatcggagatgtactgctgacagagtatgatggaaatgatgtcatttatgaggttgaaattcaaagaggcgagtacgaaaagtatggtcatgcactcagcgagttcacagaaggttaacatgtaatgatgtttttgggtcaataaaatgataatgctcatcgttaaaactgaacaataatataacatgaatagcctaaggctgcgtaagagagagggtcaagcaggtaaatggtagtttttagtccagaaattcagcaaattcaggaaacggcagaacataaaatacaagaacgtatacagcacatagatcatattgtagattcaaatcagtggaaggtaattcaggcattccagcggaagcaagtgagtgattttcattttgcaggttctacgggatatgcttacaatgaccggggacgtgaggtgctggaagaagtctatgcggatgtgttcggtgcggaggcagcgttggtgcgtccgcattttgcctcgggtactcatacaattgccactgctttatttggtgtgctgcgtccaggggatgaactgttatacattaccgggaggccttatgataccctgcacaaagtgattggtaagcccggcgacgggacaggatcattgcaagattttggagttacttatggagaaaccgcactgacagcggaaggtaaagtggactgggaagcggtggaggctgctatccatgccaataccaaagtgatcggtattcagcgttcacgcggttatgattggagagcttcgtttagtgtagcagatattgaaggaatgacagcacgtgtgaaagaaataaaacctgacgtcattgtctttgttgacaattgctacggtgaatttaccgagaagctggaacctactcaggtcggtgtcgatttgatggcaggttcgttgattaaaaatcccggtggtggcattgcagaaacgggtggatatatctgcggcaaacaaaagtatgtagagctggcatcctaccgattaactgcacctggaatcggtggagaagtaggtgccatgttaggaactacacgaggcatatttcagggactattccttgccccaacactggttgggcaagcggttaaagggagtgtattcgcagctgcggtctttgaggagatgggatttgagaccaaacctgcctggcatgaagagcgtacggatttaattcaggctatttcttttagcggaccagagcatctaattgcttttgtacagggaattcagcgtgcggctgccgtggatagccatgtggtgcctgagccgtgggatatgcctggttatgagcatccagttatcatggcagcaggtacgtttatacaagggggaagtttggaactatctgcagatgctccgattcgtgagccttatattggttacatgcaagggggcttaacctactctcatgttaaatttggagtgcttatggctctgcaaacgatgaaagaacgtaaattattgtgagtttttctaacatgtcattgacactttgcatcagctaaatgtacaataaggtgaataatagatcactggaaggttgatgacaaatgggcgacgaaattcgcagaaatatggccttatttccaataggtattgtcatgaagctaacggacttgtcagcacgtcagattcgttattatgaacagcataacttgatagttcctgcccgtacatcgggaaaccaacgtcttttttcttttaatgacgtagagcgtctgcttgaaattaaggcgttgatcgagaagggtgttaacattgcgggaattaaacaagtcatgaatccggttaccaaggaatcggaggaagctacggttattactgcagatacggaagtcaaacgccgtgaaatgtccgatactcagcttcaccgcttactgaaacaacaacttgttgcaggcaaaagaccaggacaggtatccctaatccaaggcgaattatcacggttcttcaataagagataatgctttgacctacctcttggtacaaggtcgccttacattaaaatcaggtctcatcatttaagtatttatagaacaacagattcgtatatagtcgttacagaaagggagaggttagagtgagttatagcagagaagatatccttcggattgcgaaagaagaaaatgttcgttttattcgtttgcaatttacagatttgctgggcactattaagaacgttgaaattccggttagtcaactggaaaaggcattggataataaaatgatgtttgacggttcttccatagaaggttatgtgcgtattgaagaatctgatatgtatttatatcctgatttggacacttgggtggtattcccttgggtaacctcggatcgtgtagctcgtttgatctgcgatatttacaagccggatggagttccgtttgcaggtgacccgcggggcatcttgaaacgtgtacttaaggaagcagaagagttgggatacacttcgatgaatgtcggaccagagcctgaattcttcttgttcaaaacggatgaaaaaggcgagccaactacagaactgaatgaccaaggcgggtattttgacctggctccgatggatctgggtgaaaactgccgtcgtgaaattgtactcaagcttgaagagatgggcttcgaaattgaagcatctcatcatgaagttgcacctggtcagcatgaaattgactttaaatatgcagatgcgattaaagctgccgaccagattcaaacgttcaagctcgttgttaagacgattgctcgtcagcatggtttgcatgctacctttatgccaaaacctttgtttggtgtaaatggttccggtatgcactgcaatcaatcgttgtttaaggacaatgaaaacgtattttatgatgaaacggacgaactcggattaagccagacggcccgccattatatggctggtattcttaaacatgcacgtgcaatggcagcgatcacgaatccaacggtaaattcctacaaacgtctcgtaccaggttatgaagcgccttgttatgtggcttggtctgcaagcaatcgcagtccaatgattcggattcctgcgtcccgtggtctgagcactcgcgttgaagttcgtaaccctgacccggcagcgaatccttatttggccttggcagtgatgctgagagcaggtttggatggtatcaaacgtcagttggctctgccagctccgattgatcgtaacatttacgtgatgtctgaggaagagcggattgaagaaggcattccaagtctgccagcagacttgaaagaagctttgtctgagcttattcggagcgaagttatctctgacgcactgggcgaccatgctctggcctacttctatgagcttaaggaaattgaatgggatatgtatcgcacccaagtacatcaatgggaacgcgatcaatatctgactctttactaaaatgggaaatcccttggcgctctaagcgttgagggatttttttatttgtggtaggtaaaaaaattattaagtttatttataattgccccctaattgcccccaaaaattttattatcagaataaattttcagtaacagactcatagttctccatgctattcatctctattttttggagatgtgtgcataaacgttggctgttatttggatgctactatgtccaagtctctcctgtacatacttcattgtagccctagcttcaagtagcaatagcgcatgatgctatatatgcgtttgcccgaacagaaaacataacgccaatcgctttcaaggggaaaatttttaaactaatgttgaatgcaaaatatgtgttggatgtcttgaaagtcttagaaaacgaagtaactacactcgggtatactggctcttctaaaccattcactctcgagagtgacgagtcgagtttctgcattgttcttccttatagggtgactggttagatgagtaaatacaatgggagaaaatgatctttactacttattacaacggcaggccggtctaagattaaggaagttcgattgctggaagctatggataagagacagatttctgtttttgaaaatatgctaaataatattttaggagcttcagctaaacagcaagtgtcttttggataagggtattttgaggattgaaaacagatagtagaatttacaggaatataactaaaagtccacatgttaaaaagaagaacccaaagagtatcgaaacagagcctctaaatttcatgtcatcaatgtaagcatcactcggttcagagtcacctttgatcttccaggcttcgtttgcacgccatccccaagtgggatttcgtttacttaaaataccaagcgagaaaaaaataatcgcaataaaaataagcatgaatcccatttgatcagcccctttaagtaaactataccaaaaaagaacgacagatggaaagtatcgtctctcaaggacagatagaagaagaataagagggctttgccctccatgtgatggttcaattttaatctgagtaggcaacagcattaaaactttctattcctattcgggtagcatctgctgtgcaaaatagatataaggtatacaccaattcatttgaaggtggtagagggatattgtaatcggaagcatttatggtgacgacctgtacagcgtttgggtttgcttcggagacacttacagagtaaagggcgtaagcaacaagcgaatcgaaattgcctctaacaatggaaaaagaaataacggagtcaaatggtggaggggtaggaaatgcaagctcagctatcccggataattgtacacgcatgttttcccctgcgcccgttacatctaagccaagctcagcaatggcaacgggtgtattggctggcaagggaatagagattgtattaccgtaacttgcgttttgtgatgttcgagcatctaacaatctagtcattatctcatctccctttttgggtaaaggatttgcaagctggaaatataaaaatacagacagtgtaggatttggaccggttgattgaactagatattaagcttcagaagaatgagctgtaataatgctaacacgatagggtcagacctatgcctattttcccgaaatgaagtcaacagcccaatctttttggttaattgcacaatatgctactttgactagactttggaggtgaccattaattatgtttcgacattattgttggcagaagaatatgcatcggagaaaatttagaagatgtgtagttaaaaaagtcaaagtgttaccgaaagttattgttaaagggatccgaggacctcaaggacctcaaggacctcaaggacctcaaggacctcaaggacctcagggaccgcagggactgccgggtccacagggagttccaggcgctcaaggccagcaagggctacaaggttttcaaggaattctcggaccaacaggaccaacaggaccagcaggagcagtagggccagcaggaccagtggggccggcaggagcggtaggcccagcaggtccagcgggggcggtaggaccagcaggagcaacgggggcagcagggcctgcaggcgccgggataacagacttcttaagtgttttccgagcagatcctggcacgggaactgacacagttccgggtaactcaccaattacctttacaggagttttagctaatgttggtggtgcatttactttcactcctccatctacaacgataacaatcaacgaaacggggagctatctaatagattttacaattcataaccaaggtaatgctgactttaaccttaccgtaaatggaatccctgttacccctgttcccttcacgggtaacggtggcggaccaatttcggcagaagtcattattactgtaggggtcgttcctacaactattcaattggtaaatgcaaatgcaaccccggcccaacttcataactttaccaataccactcttactatattaaagttgactgtttaagccattcttaatgatatatagaacattatatgtagccgccttagaaaagactgtacgatttccatcgtcagtttgtctaattacactcatagtaagcagacgtatttatgaggggattgtgtagcatggcaagagaacgtagtggcagtaataagatccattaaacactaccactactccaaagcctatcttcaaagttgaaatgggtaactttgtaaaaagatgataatattcagacatagaaatatgaatgctaagaaggtcgggaaacttctcccaccttctttttgttgtgacaaatcggaactattgctttgatccgtcaggtacgacaactcatgagcggcaatcaatataaattttctttttttgattagtcgcgaaaaatggaagctacagaagaacgggccgaggtcgattggcctaaagttaagcattgcataaggaagcctttaaccttgtgttggtagaaggactgacggaggaagaatacaagaatgtagacgaagagggcatttaggagttggatggcctcttagaacgatttctataaggagttgtttccacctgatgaagtttatgagcctacgacgaagaagaccaagaggttcctgaggatgatcggaaaataaactggatagaactttggctctatgcgtgagtaatggtatttctgattcagaatggactaatacgaccattccaaagattagagcgctcatgaaggccaagaacagaaaccgggaattcgaaatcattctccacgctggtaaggtggaaaataaaaagccgaagaaggtcaagtcgctatctgatcttggtttcttcgcaaagtaaattaagaagcatccgcaaacatgaagtgacccctgcaaagtaaacagctatcaaaaagcaataattaagtagcctgagaaggagtcaggttgtttagtttctcttgaaagcgttcatggttgtagaaatggatatacttttgaacggcatgctccacctgacccatcggcgaaccagcgaagcgtcaatctccatttctcgtgccacggttttatatccgattctctttttgaggtacagatccactgtcttattcttgaagctcacatcgtaagtttttcttatttctcccatagaaaaatcccctccataatagacagattagatggcttgctcttttctgtctactatgaggggaacttatcacacttgatgagtcttttgtatgaattgtattagtacttgtttttatgatggaaaaagagtttcggaatctggttctccgccggcaccaagccaacggtcagggcctgcaaatgagaaagtctttccgttcccggttactttgatattagcgagtctccaacctgatttatttccagatccatcagtcctaatggtaacttttctgatgtcaccaaggttgctggtactgattcttgtagtatcagaatctcctttttcaaagctgccagtgagtgcggcggtaacatagtcgccattagaaccatacagagttatagaaatatttgagtctgtacctgaatccgcaatactgcctgtgtttacggtaacaacatattcaacattagcaaaaggtgtaacagactctatgcttctattagagtcttgtaatgaactataagtgtcgcttgtgacctgatccgcgaaagaaggtgctgcgaaagctacagatgatatgagcattgctgatgctaataaagatacttttttcattaatttgttaccacctttctagtatttgtatttaatgttatacatgtgtaatatgtttgtacatagttctttggttgtgaagaaaactttttcccttgtctttgtttgttgtatttcatatttatgtgtcgaatattcttatttttaatgaatcacggaatggtatgaatatttatttatagaaggtttttttgcgatttagccagtatagcttaattcgaagcgatcagcatgaaccacgctaatcaaatgtgtatttttcatgtcagacaaagctccccttactttgacagtcattaagctgtatgtttattgacgaagattaaaagaaggagaggagttattgctccattgtcagcttctgcagatgcagcaactgtaacgtttgacacttacaaaaatttttcaaatcaagaaatagttttatcacaatcagtaatatttaaagatgacacggcatatacagatgtatctgatacagtgaaaagagtgaaattttcaattaatggtttggaaaatccttttaatgctaattattataatcggttggtctggacaagtgatgaaaatacaccgagtatagaaaatacgttatcagtaaaaattgctccaaaaacagggagtctttacggttccagtagttatgaaaacctttctctgataaaacaaaagatcaactccgattcaaaagtatatggatggattcaattagaatcaaaagagtggactaaagcaggatcagctaaaagctctactaaccttaattggtcggcagagcttttaactgttcacggcttttagaatatatccaggtattctttctggaatttgatgaaatcttgcacactgtcgtgataggtaaatctaccgccatttttatcaataatccagttgatcttctcgtcatttaacaagattccatacatacagtgatgaagcagctcaatttgcttttcatctctaattcggatcaaatgtttttcttcttcgacaatgaggtaccatttcgtttctgtttcatctacatctacgtctacatcagcatctacatacagtattgataccgacaaggggaatggccagtcaaaccaatgtcctcgtttgtcttctctataaccttcaaatgccatggttatttccccctacttggataatttcctgattagtttaaatgtatctaacatgctgcgattgtacgcttaattggaaactgttttacggaagtggcagctatcctcagcctttggcatcttggcaccaatctggtgaatgacctgctgtttgaggctggtactagctgggatacgtctgtttaggctgggctaacggagtgtgaactccggattttattgtaaatttctcatttgctcaagtttttaaagacaatgctggttcaaggaaacatttgcggcagccctttttgacattggacgacacaggcttttaggaatacacacattaagtttactgctagttcttgtcttatcctactggctcaggaatatcgcccccatattctttccatggcttcacgtacaccatcgtaagcttctgaaaaagttcagtatcacttgggcgaccgtctaatccgctattgttgcgcaatagctgtatcctcttttatcgttccttgttctgatctgtatagtatacggaaaacgacaggtaacaaagaagttgagcgctttgttacccgatatcaaaacgctactaccaatactctacagttattctactgagcaatgacgtgggcccaacatgaaggaactggagttgaaaacaggtagcagtgtagtggacataaaggcgcgtctgctggctttggaagagggggacaacaagagcgatatacgctctatattgtaatcatagagggctggaatggtgacccaaagatcattacattttctcgtatggaaatacgcgctgtattaaacctccaatgatatggagcttattttttgtactcggaatataatttgcttataacacatcaggaggctgcactcatgtcttgaatgtattttatttctggagtggtttgtttcttatatttaaaataaatggatggaaaagatcggatgtatattgctacattgttacttacttcattaactttaaaggggatctgaaaaaagtttaaaattgtaattcatggattgttgcatttgtatatataattacatcttttcccattctagataaggtggtagaatgaaaaaaataggtatgggaggcgttttatttgaagtgtgataaatataattgggggcaatttaaagagggagcgtatcattgaccctataaactacgttaaccctcatttctggagggtcaaaattgaaaaccccttattcacagtctgttttacaccataaccaaattttaatatggctttgtgttctttcgttttttagtgtgttaaatgaaatggttcttaatatctctttacctgatattgctgatgaattcaataaaacaccagccgttacaagttgggtaaatactgcctttatgctaagtttttctataggaaccgctgtatacggaaagctatctgatcagctaggtattaaaaggttgcttctgtttggaatcatagtgaattgcataggatcattaattggatttatgggacatactttttatccaacacttatcttggggcgatttatacaagggattggtgcagctgcatttccttcacttgtgatggtcgtagttgctcgctatatcccaaaagaaaacaggggcaaggcatatggcctcatcgggtctatcgtagcaatgggtgaagggataggaccggcttttggtgggatgattgctcattatattcattggtctcatttactgcttcttcctgttctaacgtttgtcactgttcccttcctgataaaattattgaaaaaggaagtcatatcaaagggttcacttgacattgcaggaatcgtgcttatatctctaggcattgtaatgtttatgttgtatacaacgtcttacagaatttcttttctggtgataagtattctttttttcttgatctttttaaaacatatcagacaagtaaccaatccttttgttgatccttcattggggaaaaatactgcatttatgataggaatcctttgtggcggacttatgtttggtaccgtagctggatttgtttctatggtcccttatatgatgaaagacgttcatcacttaagtaccgcaatgattggcagtggaattatttttcctggaacgatgagtgttattttctttggtttccttggaggagcacttgttgataagaaaggttccttacatgtgctagcagtcggcgttgcatttcttgccgtcagctttttgatagctgctttctttattgaaatgacaccttggctgatgtctattattctagtctttgttttcggtggtctttcttttattaaaacagtaatatccactattgtttcaagtagtttaagacaagaagaagctggcgcaggaatgagcttgcttaattttataagctttttatcagaaggaacagggatttcagttgtaggaggcttattatcaatacgttttattcatcaaaaatttataccaatcattaattttccatctgcttatttatatagcaatatgttattgatttttacagttgtcattataattagcggcattttaactgttattgtatatagacgttcagtttcagattcctgataagagcagaaaaggattacatgctgaaaatgatcgcatcctcacgtttgaagtaagtggatactctaaataaatcaaaagctctactaaccttaattggttggcagagctttgtttgctgatcagtttgattttaggctaatttgaatgcttaaacttataataccaaaaaatcgctttttcatgggctgtggaaaagttagaatatagcatagtatcaactccgccgattacaaagttatttttagtatagaatcgacaagctaaaacattcacatcctgtgtttcaagcataagaccaacaaggttattctgcttagcccactcggttgctttactcaataaggctgctccgattcccttgtgtctccagtctttagcgacggcaatatcctcaattagagcatagccattccaattagtacaaagtttaatttgcccaacacagtcgttctcatcataatataaaaaaatagattttccttgttcatcaatataactgatgtcaacgtcatcatcctcatactgtttaaaatatggttcggggaaactttcttctatatatgtccaattatcgttctcgtatttaggtataatccttcctgacacaataaagccgttattctcatttgacttcttaaaatctcccatattcgaaagtgacattttaattatcatggcttgtctcctcctggtttaatttctctacgcacactattctaaaagagagccaccatttcctgtctgttagatttataaaaagagcaaaattgtagcgactgttcaactatgtctgatattctacgatctcgtccgcttgcttcaacgattcaaagcagtagttaggtgtaccgtttaacacaaaaaaagcaggaagaatccttcctgcttttgcttgaaaatgattattaacgtctgcgttgtctatcattcacgctaaacagattaacagccagtgcgttacctcttgcacgcgcaacggctctttgattcgaacggatgtttgatcttcttcttctcaaatcacgtctgcaatgtcttctgctcatatgatcacctcccttcaaggaaatgaaggtacggatgaatcttagtggtgtttatgcttacgcttggaaattttgatattcaaggcattggttgctagtgcatttccgcttcctgttttagcagctgcggcttgaaagactttaacgaccagatatctgtttttcccgatgcgatgcttatacgttttaactctatttctgatcatctgcatatctcctttgcttaggtctgctatatactatgtcaattgtgatagtaatgtatcagcataaatctattaaaagcaaaaagaagctggtacctatattcctaatggttaacaaaaaactcatgcgaacctgtcttcgccatttcaactttacgttgcaggagaatgttacaggcagatcggcatgagtctaatagtgtagataaataatatgcagtttagtataaaattatttactattaagagtgttaagttttttctcgtagtacgcctcttgagcaagaatatgattcagttgttcagagagctgtttatattcttggctgtcttctgggtaattgtttctttcggaaattacagcttcgagttgcttttctaaatacctgaaatggataagtatttgtatgtactgaatacgatcgtaggttgttatgtgtgatttctcttctgcatacaaatgatccatttttggtactacacagcttatggcaataaatatcacaacaaacgctgaaattataatttttttcatttaattcctcctacagagctatgagtaattaatataccatatttatctaaaacaaagaaagatctattagttttgcccataacagtatagctgctcaagatcagtgggtgattatttgagatgaggaggctgattttatagtagaaacaataggaatagattgctgaaatgaaaaaatagttgtgagatacataataacaatacaaaaccggcttgccctaggcagccggttttgtattagtgggtagaataacggggaagaaagaacgagaaatcagtggaagtcccggaagagtcctacaaccttgcccaaaatgctgacgtgtgtcaggcgaagcggttcaaaggctggattttcaggttgaagtcggatatgatctttttctttgtagaaggttttaactgtagcttcgtcttcatctgtcatagctacaacaatatcgccattatcagcggtctgctgctgacgtacgattacatagtctccgttagcaatcccagcctcaatcatgctttcgcctacaacagataacatgaatattttatcctcaccaacaaagtgttggggaagaggaaagtaatcttcaatattttctgtcgccgtaataggaaggccagcagttactttgccgacgacggggacacgactaatggagtaattaatcaagttgctgttatccgattcgtcttgaccgagtaactcaatagcccgtggttttgtaggatcgcgtcgaatgagtccttttttctctaaacgatccaaatgaccgtgaaccgtagaactggaggccaatccgacagcctcgcctatttcgcgtacagaaggggggtatccctttagacgcacttcattgcggataaattcaagaatggcctgctggcggctcgaaatcttagacataccgtatcaaccccatttagtaacgtttgggaaaattatagcatagaacctccgttcgtacaaacataagttctaaataatccctaaaaataatcgcgaacttttgttctcttttctattgaacaaaacaaatgttcgtgttatattgtgaaaacataagaacaaacgtttggaggtcgcagccaatgatgaaatatagcacttatcaaagtatttttccgatgaattcagaaaatttgcaggagacccgaaaagagggtggagcgcattttatgcaaattattactaatactcttttacttaagcttcttattttagtgattgttgcttggattgcaggggcaggtgtacttacggttttcgcggcaccctcagcttccaagggagaagtgactaaactgaccgtacaacctggagatacgttgtgggagattgccgcaaatcataaaccggaacgaatggatacacgggtatatatagaaggaattgtgcggattaacggtttggaggaccggggagtgcaggcaggtcaggtactcaagcttccgcacttctgatctatagacaattagagcttgtcagggagcgtaatgcgggagccttgacaagctcttttctacatgtcaaagtgtattatatctttgcttttatggaggggacacaatttggatatagacagcttggtacagcgcatcaatgaattagcgcgcaaagcaaaatccgagggtttgacggaagaggaagccacagagcgcgccaatcttcgggaaatttatttaggtaacattcgccgtaattttcggcagcagcttgaaacgattgaatttgtggacgatgatacatcgaagggaaatgacgggctgaagcattaatgttgttaaagcgcccaagcctgcaatttgccttttgttttaggtaccgttctcggtatctatatagattagctttgaggcaattgttttattgtaatatatctgggaaggaattgagagatggcccgatcatttgaaagaaaagtacgcaaaaacacagcgcatttaaataaatcgcgtaaaaagcaaggcattcaaaccattaacggcgcaggttctgcaatggatattttccgtggccgtaacattactgtgccaattatgctggctggtctctctgtattgtacatgcttatgagttactttttgactaagactggcatgcgagggatggattggcttgtattcggcctgtacttgatgctggctgttatctttttcatccgtcgtccttatctgaaagtgggaaaggatactctctatatgctgaaaggtggtagagaacgtccaatgacggcaggggacatgaaagccatcaagattgaaaagggttacgtaaccgttgaaagaaaaggtaagggcggtaatttcatattcacaaaatcattaggtcgctatgacacggatgccattgcagagcgacttgagaagtttgcgctatccaatcagatacaggtggacaagaaataactgatttagcctgtagctctttaacaaaggccgtatgatgttatttcatataacatgctgcggccgcttgcttaatatgggcacacataacgattcaaatacttaatcgagcaaataggtgtacatatactgtggaaagagagtggataattcagatgacgattcaggcggtaatgtttgatcttgatgatacccttttatgggatgaacgtagtgtagaagaggcatttgatgcagcgtgccaaacaggcttccgtgaagcaggcgttgatccgaaaactctggaggaagcggtacgtaaggaagcacgcgctttgtatgaatcctatgaaacctttagttttactcaaatgatcggcattaacccgtttgaaggattatgggcgaattttacagcaggtgagcaacctgaattccgccaattggaacagttggcccctatttatcgaaaggaatcatggcgcagaggactccagcaactagggatagataatgagaagttggcggaaaagctggctacccaatttgcttcggaaagacgcgcgcgtccacatgtatatgaagaaacgtttgagattctagaacaattgaagggacattacaaactgttattgctgacaaatggctctcctgatctacaacaggagaaactggatggagttcctcaattagctcctttttttgatcatgttgtcatttcaggttcatttggtcgaggcaagcctgatccgtctatattccagcatgctttggggcttcttggtattgagcctgaacatgctttaatggtaggagataagctgacgactgatattcaaggagcgttggcagcaggtgtacactcggtgtgggtgaaccggaacgctaaaaccaataccacagagatcaagccgaagttcgaaatcaagcatctgtctgaattggacggaattattcaaacgttaaagtaagaaatccatagtctttagaaacgagtattaaaaaaactcccttcgctcgattattacagtggtcaagaccccattttatagacactaaaaaaagaccctaggctataagctgcttccgatactctttcggaggcagcttatttaactttcgttgtggtcgacattggttgtaaaattggatatattcttttattctcctttgtgcctcgtccatatttcggatatcataggggtagagcccttccgttttgagatgcgagaagaagctctccatcgaggcattatcataacaattgcctcggcgagacatgctgattcgggcgccaacctttggcagcatgtcatggtacgcatgggacgtgtactggaatccctggtcgctgtgaacgatgaggccagtcacgtctttttgctgtttaaaggcttgtcgaaacgtctgtaaaaccagttcgttatcatttctatggctcatctggtacgcgataatttcgttattgaacaagtctttaatcgcagacagatatagccagcaatcacccacacgatattgcgtgatatctgtgacccatttttggttaggtttggccgccttgaaatcctgtttt

SEQ ID NO: 2645 - DNA, 184659 bp, Unknown
  Kingdom: Bacteria, Phylum: Firmicutes, Class: Bacilli, Order: Bacillales, Family: Paenibacillaceae, Genus: Paenibacillus
ctattctaaggggtgcactttagtggttttgaaggtgtctttttgttgtatttgctcggagttgtgaagtttgcagcactttatatgaatctatgaattcatgtctatgcacaggtcatatgactttacgggttaccatgtcgctgcatatattacagtaaccgccctgagaggaggagaggtatgaatattaatccgaatatgtttagtatgatttgcgctaccgcaggagcccttattacgtttgcctttggcggctggaatcagctaatggtgctattcacggttgcaatggctgttgattatgtgactggagtcgccgcagcaattaagactgggcaaggtttgagcagtaaagccggcttttgggggctggcgagaaaggctttaatgctaatggtgatttctttggcgcatcacgtggatctcctgatgggtaccgaaatcatgaaaggggcggcgacgtatttttatttatccaatgaattaatctctattacggaaaactgttcacgaatgggtctgccgctcccaccgaagctcaagaatttttttgccctattaaaggacaaggagtctgatggtaaaaatggcggaaaagattgctagaattacaaagtttctttccgtatgtggggcgttatgataaaattttcaagagaacatttttaagataaggagcctatacgcatgattaaacatattgttttgttcaaattgaaagaccgctcccctgaaagcattgagcacacggcatccattttgcgcagtatgaacggcaaaattaaagagctgctgtcactcgaagtaggtacggatgtgattcgttcggaacgttcttatgatatttcccttaccgctgttgtcgaaacactggaggatttgcaaacgtatcaggtacaccctgtgcatcaggaaattattgtacacatgaatgaagtgaaggatgtatctatcgcagttgattatgaaatctaaagcgattactggaggtgcaggaccttgtattatgtcaaccgggaacaaattgagcttcgactaggggctgttcccgacattgtcgccggacttcgccagacttcttctgcctggaacggcgatctgttgcagggactagtgcaggagcgctgccttcatctggcgattgagacggtaacggacgtaggaagctatatcatcgacggatttattatgcgtgacgctagtagctacgaggatattataggtatcattcatgaggaaggtgtactggatgataccgtatttcattcgctagtagagctggtaggcttacgtaaacccctagtacaggagtactttcattgggaccggacaagccttcacccgcttacaccaaagctgcctgggttgctggagctttttgcatctaacgtgcatgattatttaaataaggaattgggtccccagcccgagggagtgtaaaggcaaaagtgacggataagtatatcgtacccgaaatgcccactaggcgcatgatcatgacattattgaaaacccagggacctgtgggcgtcggaagcttggcagctcaattgggcattaccgaaatgggagtgcgcaggcatctcaaattgatggagcaggatggtctgatcgtggctacgatcgtgagacaggcgatgggacgcccgacgtttttatacagtctgagcgagcagggaagcgagcagtttcctcgtaattatgatcatctgttactggaactgttagaggagctggatgaagaacagggaatggaagctgtttactcgctgtttgatggtagaaaacgtaaaatgatgaagcgctacgcccctcacatggagggggagactacactggcttcacgtgtggaaaagctttcgggtatccaaaatgcttccggatatatggcagagtggcgcgaggaagaggatggtagctactcaattgtggaatacaattgtcctatctctcaaattgcaggccgttaccgcaaggcttgtgaatgcgagcagcaaatgtttgaggagctgcttgatgccgaggttgttcgtgaggattgtttagcggatgggggtcgctgttgcctgtatcgtatccgctctaaaaaaaagtaaaacttttcaggcttgttttctgtatcatgacaagctccccatgcttataatgcactaacagatgggcattcgcccgggcacaagggagagatgatgatgaaggagaactgcaaaagttttatccgaggcgcgttggcaggcagcattgttggttcggttgctgctttactatttgcccctaagtcaggtcgtgagctgcgtcagaatattacagatcaggcgcgcaacgtaagtgataagggacaggagctagcggggaaaatttcagacacctcaattgagtatactgacaaaattaaggagacagcctcagccgtcattcatgaaatcgggcaatggcgtaaaaagggtgaaattgttcctgaggttagtatttcatcagcgactgttcaagaagatacggaaaaagatgctctgtaacggtctgtaaaacgtaagtgaaacactcaatacagtttgaattcgtggcttctcccgttggggtggagccttttattgatcacttcctcgttttagggtaatcttttggggtaccttttacacgaatacgacataaggtatgtagcaacggatagctttccgagatgaaacaactcatatttgaacaaaaaaggaagcggtgtgcacgtgcagcaagcgattgcaatattggattccggtgtaggaggtttgacggttgtaaaagaagtcatgcgtcagcttccgcgggaaaaaatcatttattttggagacactgcgcgcactccgtatggcccccgaccatcggaagaggttaaaaaatttacagagcaaatggttgattttctgatccaatttgatccgaaagtcattattattgcttgtaacacggctactgccgcggcattggactatataagccaaaaggtatccattccggtgatcggagtcattcaccccggggctcgtgctgcgatcagcgcgactgctaccgggcatgtcggggtgattgggactgtcggtacgattcgaagcggagcgtatacagctgcgctcaagcaattgtctccttatgtagacgtggtgagccatgcttgtcctgcgcttgttccattggtggaacaagggttattccgctccaagacgacatcgcaggttgtggaggagacattgagacctattcaaacgtatccgattgattgtctgattcttggttgtacgcattatccttttttgaaggaaacgattcaagaagtcatgggacctgcagtaaagctcattagctcggcagatgaaacggcgcgtgagacgagcaccattttgtataacaaaggcaagttagaagctggggacgaaacgccggtacatcagcttttttgttccggcgatcctgaattgttccagcgcattgccgcacagtggctcggggagcaaattcgccaaacgcctgtcgtctggcaagtcaccaatttggattaacgagacaaccgacttttttgtcattggacaaatgaagtcggttgttttgcttttcgctacatcaagacacgccgcgtctgcataacatgcagtaaggcagatggaaggggcgtagtaagatgagggaatatatcgttcaaaaaggagatacattgcaccgggtcgcctcggcttttaaactatcggcggatactttaatcgtagataatccgtgggccgccacgcaaccctatctgattaatggtcaagtgttatatattcgtccgtctacggatcgtaaatacgttattcagcctggtgagtatgcaagacagattgccaagcagtttggtgtggagcttgatgagttacggctagccaattcaggacttgcggagcatgattttacggaaggaaaaacaattgttattcctgaagaccatcaggatcagattgtacgattacgtggagagtatggatatgaagatttaaaggaagacctagcggccttggcccacagatatccatttattgaagttggcagcattggtaccagtgtcatggggaaggatattccttatgtacgtattgggcagggaacgcgtaaaattcatgccaatgcttctgttcatgctaatgaatggctgacgacgccttgtttgctgcgttttatagagcaatatgcacaagggatcgatgggactgaagaacatgtagggacctctcaatgggtgtatggaggttctccgcgggatttgctggagcatacatccttatgggtggtcccgatggtcaacccggatggggtagagctggtgcaacaaggtgtactcccaactcatccgttgtatcatgacctcaaaaagtggaatgaaggacgtgctgattatcgcggttggaaggccaatattcgtggtgttgacctcaacgatcaatttccggcatattgggaagaagaggtacgcagacgcggtaaaacaggtccgtctcgacgagactatgcaggacctgcacctttgtctgaaccagagtccaaggcgcttgccgatctgacggagcgcgaacagttcgacatggtgttatccatacacagtcagggacaggagatctattggaattatcgggatctagagcctaaggagagccgagattgggccttacggctagctgccgcaacagggtaccgggcagtaaaactgggtggtagcgatgcagggtacaaggattggtttatacagcgatttggtaaaccagggtttaccgttgaagtcggtctaggtgtaaatccgctgcccatgcgtgattacgatgatattgcagcagaagtgggtatgttaatggcaacagtgctgtcatggtaaaaaattcggcttactgaaacgtatcgaatcatttgcacgtattaggaggaacacgttttttataagtgttcctctttacatgtcccttcaatggggtatatatacttaggagcattggaaatggagtgaacaacctatgaagtggaaaagactactatctctccgtcaatggtcacatgtatttcgtcgtatgccccgattgattacttcatcaaggattccgctgggagaaaaattactctttgcggtgcctgtgttgctctattgggtattacctgatgtcatgccgtttatgcccatcgacgatattggtgtgacgctattgcttatgaattggtttgtcacccgtgccgaacgaaaatatccagatgtgcttgaaaaacagcatgtacgtgttcggtagataagcttatgaatttcgtgattgcgatttttcacgattttctttacaataggaatattgccttttgctatgctgaacataattgtgatctattggctcatgatgatgcttcaggcgcagctgtgccgccgtagtacctctttccctctgggatagaggctaattatttgagttgttgattttacccgctaggttgtgtggtgtggatatgtatccaatgaaccacatttcatttaatgaatatgaaggagatgaagtttgatgaactgcaaaattactcgtaacgcagctaaagtattgaaacttgaactggataaggaagagaaccaagggaagagcctgcgcgttgttattactcatgctcatggagatcatgctcattacgggctggatttggacacgcctaaagaaacagatactgtcgtatctacagataaaggcattgacgtcattttggaaaacggccagccgctgctggatggtataaaaattgattacttgtacttccccgaagaaggatttgtcattactaacccttcccaaggtaatcacggcgaccactaagccggagctcggagggatgacagatggccaatgatattcgcgtatgtgatgaatgcaatcatatccgcttgaaaacgatcttgcccaagttgcaaaagatggcaccagatgccgagatcaaaatcggctgcaaatcgtattgcggtccttgtgggaaacgggcgtttgtgtatgtgaacggacgttatgtgagtgcggccacagaggatgaagtattggagaaagctgcgcgctttatcaaatagttccagtacgcagcatttgcaattttgaatagttccccttcttctgatccatgctaatggatgtagaacactgcccagaaggaggtgtgactcatggcccaatatgattccaatctcgacaatcacagcgttgaggctcaaacacaaaactcggtggacaggctgcacaatgccgtctctcaagcattgtcacatccggctgagcaactgattgaacaggcggagcaatctcgtactcatgcggaacatgccatacagcaggcgaaggatagccttggtgacgatgcagtagaagttgcggaggacatgcttggtgaagaggtacaacggcttgaagaggctaaaaaaacgttgcgttcctaagcatttgtgaatggtaacgagcgcagtcgagtgaaaatccatataaaaaagcacgatccacagcacttacaagctgatggatcgtgcttttttgttatatgcatggtagttaagcgatcgacatccttaaaggagtccggggaggatgctatgtcagcaacctcccacagaaagtctattagatacagaaggagttatttctttgtttgtggttcccattcgcgaataagatcgtatgtgataacctgatcggatatgttcaatcgattgagggcttcggtatatcccggtccgcaggcgttaacatctgtaggctggcctgtactcaggttgtaacaggtccctttggagaatgtaccgtcctccgatggaatgtagtacactcgtccatcggtgaaagcaccagtacgcagcacaaccatacgaggcttcccgctaaacagatcgtttcccataaaatgatatggttttgttgaaatcccaagtaggtgcattacggaaggagtcagatccaactgacctgccggttccgtatacgtgcctgcctggcttccatccggaagatgcacaagcaatggtacctgattcatgattttctgcatgtcgagatccgtaagtggcttgtctaaaaacttctcatacagtgctttgtctttaatagaattgtcatgatccccataaaacatcaggatcgtatcatcccacaatccgtctttcttcatctgatctaccaattcacccagtgcttcatctacataatggacagatttcagatagtctccgaacatggtaccttcaaactcgccaacatctaaatctaccgcgtcaggtgacaggttgtacggatgatggctcgagataccgaccatataggcgtagaacggctgcttaacttcggtggtgagatcattgagcgtttgatggaaaaaggatttatcccccagggaccaacccagtggctcatctattttaaaatcttttttactgtagaacttgtcatagttcattgccttatacatggtgtaacggttccagaagctgctgtcgtacacgtgaaacgcattgggactatacccagtatccttcaaaatggaaggtaacgtatcgaatttatggtccgcataacggataaatacggagcctgtagggagcggatgcagcgaagcatgtgtagagaagtccgcgtccgaagtacggccctgcgcagtctggtgaaaataattgttgaaatacatgctttccttcgtcagtttgtcaaaattaggcgtaatcgcttgaccgttgatctgtttgccgataaaaaagttcatgaacgcttcagcttgaatgaccatcacgtttttgcccttatacttgccagatagatcatttttaacctgaagcaacttctggtgctgattaaaccattccttatctttatcggattctgcttgagccaatgtaggctggggaccaaggtgatcctgaccatagcggtagatgtcatatccatgaaatccgaccaatccggttacgttgtacaaggccatcgaccaccagttgccgacaaatatgccagttgcccatgtggaggtataatatttgatcggcccaaatgttaatacatagccaatcaggaaggccaatgctcctttggagaagcgaagcagaaatctctttgtgaacgagcttcgggatgcttctaaataagtatcattcgttgtaagtcgacgtcgtaaggaagccacaaatatgacatacggaatgaatagaatccagtctgcaaaaaagaaaatgtcccaccagtacataagggatgcgatacttccgcctagagaatcaacttgtccggcttgaagtaagacgggaatcgtaatgaaatcctggaaataacgataataaaccatgtcggaataaatgagcgcggtgagcaacatatcgagcaccacaagagcaatcaaacgtccgcgacgtggcagccataaggtccagaagctcacaagtaaaagcgaaccaatagcgatgacataatccagcagattcatgtcaatattttgggcatgcaagttatagtgaatcagtacgagcttgccgatcataagtacaaaaaacagacctaatccaaaatattgagacagcagcattctgctgaacgtgttaccagtgcgacttgcactggacgtgcgaataagcaacactttaccccctctggcagaaatgttcggctagtataaactacatattaacgtaatgttaaaaccgaaatgcctttaattattatagcgctcatctcgcgcatttcaatgattaagtaaagaaaatacagcacaaatcaggccagaacaacgaacagagagttcgtttcctggcctaggcttcatcatatttaaggctacaacggcgaagtatctttgcggcgcggaggcagagggcctagatactgatagtattggcattcgatccggccgttaaacaacttccggcgtttgtctgctttacgaccccaataatgctcaaattgcttggtggagctgatggcaaagaaggaccaagtcttcatttcggctgccgtgcgtgcgagtgaacggatcagcttttccacctcggattgctcgctcagtctctcgccataaggtgggtttgtaatcatcacaccatattgtccttcgagtctgactttagttacaggcatcaccttaagagggatgtctttagcaaagcctgctgcttttacagctgcctcagcaacttgtatggcatttgggtcgatatcgctacctgcaatttcaaaaggaatgtcatcgcgggtcaaatccatcgcctcgtcgcgagcctgatcccataattctctgccaatgacaggccagtcttccgagttaaaggtacgtctcaggcctggcgcaatgttccaggcttgcatggcagcttcgaccaacaaagtaccggaaccgcagcatgggtcatagaatggtcggtcagggctccagcgactaagctgaataagagcagaagccatcgtttctttgagaggcgcctctgtaacgagcttacggtagccgcgtttgtgcagtcctggaccggtcgtatcaagtgtcagcaacgcacgatcattcaatagaatgacctcaatgacgtaacgagggccatcttcagcaaaccaatctgtgtggtaggtttccttgagcttctctacaatcgccttcttgacgattccctgactggctggtacgctactaagctgtgatttgtgcgaacgtccctctacgggaaattcaccatctacaggaatccaatcctgccaaggcaatgctttggtaccctcgaacagctcgtcgaaggtagttgcagcaaattcacccatttttataagcacgcggtctgatgtgcgaagccacaggttacaccggcatatatccatataatctccggtaaaaacgacgcggccattttcaacggtcagatcttcgtacccgagttctctgagttcccgggccacgacggcttcaagtcccattggcgcagttgcgattagttgcagttgagtcattaaacgtattcactccgtccccataatcatgtaagcttggttcaatccctatagtataggtcattgtactcgaagagacaaatcattaaggtgaaaaatttacgaaggacaccacgtccaacctacgttatgattaagcaagaaggagagatgaaccgtggaaattacaccaaatatgacgcctgaacaatatgtagaccagctggtacaagaggatgaagcactgcgcagtatcagggaggctatcgttaaagaaggtatgccggaagtatccgttgcccacccttacggaaaactgttgacctttctaattgaagtatctggcgcacagcatgtactggaaatcggcgcattaggcggctacagcggattatgtctggcccgtgggctgggagaaaagggtcgcattgtgtcactggagctgaaagaagcgtacgcagcgctggcacatcgacatatggaaaacaacggctacggtgaccgtgtcgaataccgtatcggacccgcagcggacagcttgaaggaacttcaggaagagggaagaactttcgattttttcttcatagatgcagataaggaaaattacccggtgtatctggaatatgcgattgctctggcgaatccgggtgccattattgcgggagacaactgtttccttcgcggacgaacgctgaatacggataagaacggccctgccgtccaagccgtgagacggtttaacgaaacgatagcaacagatccgcggctggtcagcacgcttttgccagcttacgatggattggcactagctcgagttaaatagcatgcattccatatgtatagctatgtaaaaaagaacctccttgtccacagcagcgtgaacaaggaggttcttgtctgttaaggcaggcttgtcttaccctaagattatcttacctgaaatcaggtgtaaccttacgatcaaagagcttcatgcgtacccagaatatgttaacgattaacaggacacctgacatgataaacagtccttcgatgccgataaacccggatagcaccccgccaatgacagcacccagcatattccccagcgccagtgaactcgtattaaagccgaaagaacggctttccattccttccggtgtatacgtacgaatcagcgcatttacgcttggtagcagaccgcccataaatacacccatgaaaaaacggataatgacaagttgccatacttcattgacaaaagcctgcggaataagcataaccgccgttccaagcagtgcaatggtcaagatcttgtgtgcgcctatcttatcactcagtcttccaaggagcggtgcagcaaccatattggatacacctgtaatagccgtaacaaacccggcaatcaatgcaattccttctgccgatccatacagcttttgcacatacaacggcagaagagacaccgtactgatcatggcaaactggagcagaaacgttacggtgaacaaagccggaagctggggcgtatggcttaactcctttaatccggcaagaaccgaaatttgtggtatgcgtgcagcttccgttttgctgaaattttctttaaccagaaacattgcgataagcgaggctataaaaattagagtgcctgtaatataaaaaatcggtctgaatccgacccagtcagccaaaaatccgcctagcagagggccgagaatcgtgccagccatctgaccggattgcataattcccatagcgaatccggttcgctctttgggagtggtacccgacactaaggaaatcgatgccggattgaaaccggaaatcgtaccgttcagcaggcgaagcgccagcagttgccacgggtgggtgaccaaacccatacatccgatgaccaaagccataccaaagcctgagcgaagcagcatgactttacgtccatatcggtcagccagcttcccccacaaaggctggaacataaatgaggtcaaaaagttagcggcaaaaataactccggcccatagaccaatatcgtgctctcccttcacatgaaggtcctgagccagatacagggcgaggaacggagtaatcatcgtaatacccgcattgaccagaaactgaccgaaccaaagcacaatgagattgattttccatgtctcccacgttttcaatgtgctttcacttcctttctgcccattctcatcctgttgtaaatcctactcatcaaagcataacttctcccgagctttaaaaagccatttctctagtatagcacacttcattgaaactttatccaaatgtcatgggtttgtcatggtttgttcgagagctgcggttgttacgactcttgaaaaagggcataataaaatatagtatttatgattcgaactggaggctgaagtcatgacctacaatgatacttttatccgcgcttgccgcaagcaagctgtggatcatattcccgtatggtacatgcggcaggccggaaggtatgaccctgagtatcgcaaaattaaagaaaaatacacgttgcttgaaatatgccgccagcccgagctggccgcagaagtgactttaatgcccgtgcgcaagcttggggtagacgctgcaattttatattctgatattatgaatccggtagcctcgctaggggttgattttgatattgtcaaaaatattggtccggttattgataatccgatccggtcagctgcagacgtagacaagttgcgtccgattgatgtggaacgcgatttgggtcatattttggaaacgattcgtattttggaccgtgaactgaacgtgccattgattacgttcgctggagcgccttttaccattgcaagctatttaatagaaggaagaccctccaaaggatatattcgcaccaaagcgatgatgtatggagagcctgagttgtggcatcgcctgatggataagctaggggacatggttattacatacgtgcgagctcatatcgctaatggcggtaaggcttttcaattgtttgatagctgggtaggtgcgctctcgccttatgattttcaaacttttgtgctgccgactatcacacgtattttccatgaattatctgatctggatgtacctaaaatttatttcccgggcgtaagctctggtgaattgcttccacacttgaatgggttaaaagccgatgtgattggactggactggcgggtaagtatacctgaaggacgtcgtcgcttgggcaacggttttggtgtacagggaaatctggatccttatgtgcttactgcgccaatcgatgtgatcaagcagtatgcgaaaaccattgtagatgaaggcatcttggagccaggttacattttcaatctcggtcacggtttatttcctgaagcctcgctagataagctaagagagcttacgaattatgtgcatgagtattcccgttcggttttgtcaaaaaattaatacattagaaatgttaagaggtggtctactaatgaaaaccaaagtgggtgtactggtcatgtcctacgggacgccggagagtctggatcaggtggaagcctattatacacatattcgtcgtggtaatgctccttcgccggagcaattaaaggaattaaaggatcgttatgaagctattgtgggcggtgtgtttccgctgcgtcagaatacggatcggcaggttcaaaacttgcaggaaaccttaaatcgtgaaaatcgcaacccggacattgaatttgtctgttatcagggactcaaacatgccaaaccgtttattgaggacggggtggaagccatggtgcaagatggcatccgtgcagcggtaggtgtcgtgctggctccgcattattctgttatgagtgtaggcacttatattaagcgcgcgcaggctaaggcacaggaactggatctggccatatcatttgtggagagctattatcttcatcctaagttgattaagacgctgactgagcgtgtgaacgccaaactggcgctttttgaagaagctggagccaagcgggatgaggttcgtgttctgtttagtgcgcacagcttgcctgaacggattttggctatgggtgatccttatgtggagcaattaatggcgacttcgcaggctgttgcggacaaagcgggaattaccaactggcagtttacgtggcaaagcgctggtcgtacagccgagccatggttggggccagacattttggataccatgcacagccttaaagaggagcaagtggagtatgtgctggctgcgccagttggctttgtttctgatcacttagaggtgttatacgacctggatattgaagcacaggcgttggcgaaggaattggatatgcgttttcagcgtattgattcactcaatagtgatccactgtatatggagacgcttagtgatgtcatcatagaccaatggaaaaagggatgaggacataatggagcaaaagttacgtaatattgtgattgtaggcggaggcttgaccgggcttagcactgctttttatacacgaaaaatgtacaaagaagctggctacacacctcaaatcacgctggtggagaaagcttccgtgctgggcgggaaaattgaaacgctgcataaagatggttttgtaattgaaaaggggccagattcctttctggcccgtaaaacggccatgatagacctagcaaaagagctggagctggatcatgagctagtgagcacaaatcctgaggctaaaaagacatacattttgcatgaaggacagcttcatccgatgcctcctggcctggtgctggggattccaacggagctgaaaccctttttgcgcagcggattgatctctttaggcgggaaaatgcgggctatgatggattttgtcattccgcctcgccgtgtaccgggagatgaggcgttgggtgattttattgaacgccgactgggcaaagaagtgctagagaatgtaaccgagccactgctggcagggatttatgctgccaacatgaagacgctaagtttgcaagcgaccttcccacaatttgctgaggtagagcagcaatacggaagcctcattcacgggatgatgacaggtcgaaaaccagctgaaacacatacggggacgaaaaaaagcgcctttttgaccttccgtcaaggcttgcaaagtttggtgcatgcgttgctgaatgatttgtatgactgtgatttacgcaccggaattgctgttactgaattcacaaagacaacggaaagtaaaggcagcccatatcgcgttatgctggacaatggagagacgctggaggcggatgatatttttgtaacgactcccaactttgctgctgcgccgctattgcgagatcatgtcaatgtggctgcactggaagccgttaattacgtctccgtagcaaacgtggtcatggcctttgataaaacagatattgagaacgtctttgacggttctggttttctggttcctcgcaaagaaggacgcagtgtgaccgcttgtacatggacgtctgccaagtggctacatactagcccggacgataaggtgctgttgcgctgttatgtagggcgagcaggagctgaagaaactgtagagttaccggatgatgagctgactgcactggtacgtaaggatttgaaagagatgatgggagttacagcaactccgctgttcacggaaattacacgtcttcgcaattccatgccgcaatatccggtagggcacccgcaggctatagctgatttgcgggaagagttacgcactgccatgccgggagtatatgttttgggcgctggctatgatgcgattggtttaccggattgcatccgtcaggctaaggaatgggcctctaatgccgttcaaacgacacagcaggaagcggttaagatacaggtgtaaatgttcgatgatgaacccttcgagatccaggcgaggggttctatttatattgaaatttgatatataatggagaaggtgtaaaattcgccagctaataaagaagttatgcaaatgcaatagcatagaaggagtgaagaatgtaccctcccagatcacagcgaaatgaaggtcgcaagaaagcaagaaaaccaaaaataggcaaggcttggatctttacgaatctggtcctactgcttatgatcgtaggtcttttcggttattattacatatttgaacacgacaacagtggctctcttggggaaaatgccgagtattcgcaaacggagaagaaaatccaaacgggatctgctagtgaagagaggtctactccctcggtcagtgaaaatgatacagccttgtcaaataaacagctggacgaaggcccccatgcagataagcaatttgctgacaatgaaacgaagcaatctgctgcttcagacacaagccatcgtcccgcgacaatgtctgacacaaatgctcccgaaggcagctcttcaggagcaaaattatcctcggggaaagacgggcaggcagggaacgatatgtccaaggatgtatacgacggtaataatccatccgccgataagggaggaacggaggatgtaaaaaaatcaaaaacagacgatgcagattctccgacagtcacgcttcactttgtaggggatgtgcaattttccggtaaagttgagcagcgattggagcagaatgggtttgattttccatatcaatatctcggaaacttgtttcataaagacgatctgacgatggccaatctggaaacgcccgtgacaacgaatggtgtgggtgcgttaaataaaacgtatgtgtataaatcttcgcccaaggcgttaactgcgttggctgaggcagggatagacgctgtcaatttggccaacaatcacattttggatcagggcacaggcggattactggatacactgaaatatctggatgaaaaaggtattgcccatgctggagccggacgtaatgccaaagaagcgtatgcgccgcattattttgaacgtaaagggatcaaaattgcgttgttggggactacacgtgtcatgcctgaagccaactggaatgcgggcgccaaactgcccggtgtagcaggagcctatgattcgaccgctatcgtaaagtccatccgtgaggcacgaatgcaggcggatctggtgattgtcattgcccattgggggaaggagcgcgctattgcacttgagccccatcaaaccgagttatcgcacgcttttattgatgctggggctgatcttgtcattggcggtcatccacatgtgcttcaagggatggagcaatataaaggtaaatggatcgcatacagcacaggcaattttattttttctaaatcaacggtgccggccacttgggatacagcgatatttcaggcaacctgtacccgaaaaggggcttgcgaaatgaagctgaccccttaccgggcggagctaggtcaaccaatcccattgaaggatacggaggccagcaaaattttgcaaagagtggcggcactgtcaccgggaaatgtctcgatagggacggatggtacagtaagcgctcaatagaaattcgaaaagaaattttttatatgggaattgacggaacgatcgtatgagggactcctttgtggatggaggtcataacaagatgaatcatttgtgcgtggctcaccgcggtttttcggggattgctcccgagaacacgatggcagcctttcggcttgcgttgaagcaaccatttgtacactggattgagctggatgtacagctgtcaaaggacggtgttccggtggtaattcatgattttacgctggagcgaacgacgaatggtacagggcgagtaaaggattcggactggaaagcattgcaacaacttgatgctggtagctggaaaagtgcagaataccgtggagaaaagatcccctccctcgcacaggtactggatttatgtcgtggccgcgtatcgctcaatattgagcttaaaaccgctggtgacatgtatccaggattggagaaagccgtactccgtgaaattgtgatgagagggatggagggagaggtggtattaacctcttttgagcgtgccgcattacgccgggctaaggaactgtctcctgagatccgtaccggattgattatcgatgcgcgcccagatgatttggcaatgcaactggagcagctacaatgcacttttttatccatgggctatccgcgtttggatcgaaacctgatgaaagatctcaccggacgcggtattactgttatggcgtggacggtggatgaccgccgtataatgcggagattgtcctcattgcatcctgaattgatgatttgcaccaattggccggatcgctgggagcaggtttttttgctttccaagcaccggatgtggcactatatacgtaaacttattcgttaatcaattgaactacatacgcgggaagggtgacggatcgtgatgaacgtggatattcgtaatgtttactgtgtcggacgcaattataagctgcatgcggaggagctgggtaatgaggttcctgcagaaccgatgatttttttgaagccgtctcatgcagtcgtgccgctggatggcgccacgctggagcttcctcaggggcaaggagatattcattttgagactgagctggttgtggctgtaggacgtaaatacgaaccaggcatgtccgcagatacatgtctgaacgcatttgcattcggcattgattttacattacgtgatgtacaaagtgttctcaagaaaaaaggccacccatggaccgccgccaaaggctttaaatcgtctgcacccgtgacaccattcctgcctttagaaaaattggacatgctggagcagcaggatttttccttgctcaaaaatggacaggaagtgcagcgtggacatgttaaggatatgattttttctatccagcatatcgttgaatatatagcgactcattatggactgggcgagggagatattattttcacaggtactccagcaggagtagggcctacagcaagtggggatcgctttgagcttttctggggaagtgatcgtcagggaagcttcactatcgcataaatttgtgaatggcatccatgaagaggattaaaaaagggaagttcttggtggttggggagcaaagagagattcccgtagataagcattgtgaaggccgtgtcctgtgccaaagcatgggacacggcttttatataagcgtagagcgttgtacaataatatacagaacgaaaaaaaaaacggagattcatttcaaaagcgggggtatatcatggactggatcatcggattgctttgtgctgctgtggtggccggagctgcattttataaaaaatccttaaccttatctggctttgccgcggctgtactgatgggaactgtatattatggggcgggtaacctgttctggttcggcacattgctcttgttctttatcacgtcgacccttctgtcgaggttcaaaaaggagcgcaaggctgaactggaaaaatcgtatgccaaaaccggaaaccgggatgcaggccaagtatgggccaatggtggattaggtatgctgttatgcctgggttatgcgatatggcctcatgttacgtggcagctggcttttgtcggtgtcatggctacggtcacatccgatacgtgggcaacggaatttggcagcctgagtcgtaggccacctcgttcggtgcttaacgggaaggtgctggcacccggaacctcaggtggagtctctgtattgggaacggctgcggccttggctgggggtgtactgatcggcataggtgcatggggctttggacacgtcataggaacgccgagcttgccgttatggctgtgggcactggttggaggtatatccggtagcgccggggcctttgctgattcctatctaggtgctacagtgcaaatgatgcgttcctgcacggtttgcggacgagaagtagaagtagactcacattgtggacaaacgacggtctatgtacgaggctggcgttggatgagcaatgatcgggtgaatagcattagttctattttcggaggattggtggctcttgcaggtattttttttatactctgaacacagggctggagatcatttacaaggaattaactgttataagaattgaccgtgttcaatccttgtataaggaggtgctaagatgggcgatatacacggagataaatatgaagctattttggacgcagcttacgccgtctttggcaccaaaggcttttatgaaagcaaaatttcagagattgcagaacaagcgggggttgccaaaggcacagtatacttgtactttaaaagcaaagagcagctatttacagcagtcacacgtagagattgcgagcaatacctagccgaaatgcatggtgcattaatcaatcgtactttgggagaaggactgctgcggatggcaaatttgcatctgcactactatttcaagcgtaagcagcatactaaattattttttatgacccccaacagtgaccccgatctaatggagtttatgcggggatttattcaggactatactgatttggtcaacaataaactggcgtcagagggtgtacagcagtccgagtttcatgcgaaggcattcattggtatattggaacgcctaaaaatggatattttattgaatcaagatttccgcgaatgtgacgtggatcagacggctgaattagcggcgaacttatttatgcatggctgtaaagccggaatacaaaaatcctgacatcttgtgctaaaaaaccgtactgacttcgttcaggtaacggtttttttaatcattggctgtgtctgtgttaaaataaacaggatgcatcacaaaattggggaagagtagggaatccgtatgaatattatgaccgttgaacatataacgaaaagctatggcgagaaaatgttgtttgaggatgcttcctttggtatggatgaacgtgacaaaataggagtcgtcggtgtaaatggcaccggtaaatcaacgtttttgcgggtaatttccggattagagccgccagatgatggcaatattgcagtgaacaacgatgtgcgaattcagtatctagcacaaaatccggactttgatcccgaaatgaaggtactccagcatatttttcacggcaatcagcctgagatgaaagcggtccgtgagtatacggaaatcatggagttgttggagttaaatccgggtagcgaagagcttcaaaaccgtctattgcgagcaagtcagcaaatggatacgttccaggcatggcagctggagagtgaggccaaaaatatacttacccgactggggatcacccagtttgagtctcgtatgggcgttctatccggcggacagcgcaagcgggtggctttggcagcggctttgatccaaccctgcgagttgctcattctagacgagcctacaaaccatattgataatgagtcggttgaatggttggagcaatatttgcaaaaaagacgtggtgcgttgttaatgatcacgcatgatcgctattttctggatagagttgcaaatgtcatgttggagctggatcatggccgccttttccgttatgaggctaactatacccgttttctggagctgaaggcagaacgtgaggagcgggaagcgtctacggaacaaaaaaggaagaacctgctgcgtaatgaactggcatggattcgccgtggagcaaaggctcgttccaccaagcagaaagcgcgtattgaccgatatgagcagcttagggatcagcaaccggaagctcgttctggatctgtagatatgtccgtcgcctccacacgtctgggtaaaaagatcttggagatcgagcatctgtccaaatcggtagattctcgtaagctgatacaggatttgagctacattgcggttcctggtgatcgtgttggtatcctaggtcctaacggtagtgggaaatccactctgctccaaatgattgcgcagcatatagaaccggattccggcaacgttgtgctgggaccgacggtgaagcttggctattttactcaggaacatcaggaaatgaacgaatcattacgtgtcattgaatatattaaggaagaagccgaagtgattcgtacagcagacggttcgacgattacagctgcacaaatgctggaacgtttcctgttcgcaccaagcgcgcaatggacggttatttccagactgtctggaggcgaaaaacggcgcttgtatctgcttcgtgttctgatgtcggcaccgaatgtgctattgctggatgaaccaacaaatgatctggatattcagaccctttccgttttggaagattatctggatgaattcccaggcgtggtttttattgtttctcatgatcgctatttcctggatcggacagtggacaaaatactggcgtttgaaggggatggacaggtacgagtacatgtaggggactatagcgagtatgcagaatggatcagtaaaaatgctcaatcttctgtgaatacgtctgtctcgacgagtacggcttcctcgaatcgctcttccgcgcctaagtctgcgggtccttctgattcagtcaaggagacaagtaaaaccaagctcaaattcaccttcaaggaacagcgggaatatgagcaaattgatgagctgattgaacaagccgaacagaagttggccgacattcagcgacagatggaagagtctttcagtgattcagcacgactacaggagctcatggctgagcaagtgaaggccgaacagcatctggagcaccaaatggaacgctggacctacctgaatgagctggccgagcagattgaacaaagtaaatcttaataatacagaagcaagtcaccattcagagtggaggcttgctttttttatcgaattattaatatgtttttcatattaaaagtgcgtgaattatatatttctaatattaaattacggtgggtataatggattgcatatgggagggaggaattgaaaatggaatatcgtaaacttggaaaaagtggattaatggtaagtgagatcgcattgggaaactggattacccacggtgctcaagtggatgatactatagcgcaagcctgtgtaaacgctgcactagactcagggattaccacgtttgatactgctgatgtgtattcggataccatggcggaaacggttttaggtcattctttaaagggaatacgccgtgaaagtattgaattatgtactaaggtttttcatcccacaggtgccggacagaatgataaagggctgtctcgcaaacatatcatggaggcctgtcatgcttctcttcgacgcctgcaaacggattatattgatgtatattatgcacaccgttttgatccaaccgtatcgcttgaagaaacttttttggccttatccgacttggtgcggcaagggaagggaaggttttgtatgtaggagtaagcgagtggacagcagagcagataaagcaaggagccgttctggctaaggaattaaaggtccctttcgtggcaagtcagccccaatattccatgctgtggcgtgtcattgaatctgaagtgattcccgcttgtgagcaggaagggattgggcaggtggtttggtcacctctggcacaaggtattctttctggtaaatatgcagcagacaagccgttacccgagggatcaagagcttctacgacagcagggtcatcatttttcgaacgtttggctggacaatggttaggtaaagaagtccttttggcagtaaagaaaattcagccgattgcagaagaatgcggactgacgctaccccagcttgcagtcgcatgggttttacaaaacccgcaagtgtcctcagctattatcggtgcttccaagcccgagcaggttaaagagaacgtaaaagcggcgggtgtccgtctagatgagcaggtcatgagacaattggatagcattttaaatggtattgttgaacatgatccgagaaaaacaggttaagatatacgatcaaggagatttacatgtctaactcctcgttacaagctgtttcttcaaccacttccagaaaatgagtcagaacagtttcgtgtgtacctgttttccatgcagcataaagtgggatggacggagactcttcttgaaaggaacgaaatacgacatcactgcgttgaaagacagaaacggaagaggggacaatggagatacctatacctgccgctaccaagttaacgatcgtatacatttgaacggcttcctgtacgatttgaggctgaaatccgtgttgtccgcaaaagtccagtatgaggttatgaaaagaagctcccatatgaggcggggacaggataaaaaattcgtccgctaaagaacgtaaagacaaggttgaatggtgggctaacggatgtgtttgaggaagaacggccatgagtgattcattggtgtaaagacgagaattgatatgtatagatggatctgcacagcgcaggaagcctacatgaactttgccatcgtgtatagctttcagttgttggacagatgtcatttcaaataacgtaagcttcacatctggaaaacgctctcggaatttcttcaaggcattaaccatcagactaccagaggctgaatctacaaaagcgatggataattgtccgaatttcccctgacttgcaagctgtgtgatcttgatggatctttccaattgtgcaaccacgtttctggattcttctaaaaatatcgctcctgctgacgtaagtcgaacttgcctcttggttcgttccaaaagcttcacgccaagttcttcttcaaggctttgaatttgttggctcaagggaggttgggtaatattcagttttttcgcagcacggttaaaatgcagttcttccgctactgcgataaagtaacgtagttttttcagatccatagctgtgatttcctttcgctaagccttcaccgacctattctccaagggaacaggtcggtttttatcgttcgaattaaacggtcacgtaagctgcaagcagacgtgcagtgttcaccacggcctgcttgtgcgtgcgctccatggcatgggaggcgtgtacgccagggccgatcaacgcagcacggatgttattaccggctctaagtgcagctgaagcgtctgaaccgtagtgcggataaatatctaccgcatacggaatattcagctctttggccagctcaatcagacgggtcgtcatagtatagtcataaggtccggaggaatccttggcacagatagaaacatccgtttccttgcagctcagatcttcacccatacagcccatgtcgacagctatcatctcactgattccttcgggtatgtaagccgctccgtgccccacttcctcatagttagaaatgagcaatttaacggtatgtcgaggcttccagtttccatgtacagcagattccagtaaaccaaacagtgcagctacactagctttatcatccagatggcgtgacttgataaatccactgggtgttacgactggacgcgcatcgaacgaaataaaatcgcccaccgtaataccgagctgaagtacgtcttcttttgacccgactagctcgtcaatccgtacctccatatggctctctttgcgctcaaagctccgtgcatcatcatagacgtgcacggatggatggctggacagaatagtgcctgtatacgtttgtccgcttcgggtatgaataaggcagtattcgttctcaatgctgttcatcatgaagccgccgacggatgtcagacgtagggtgccttgtgctgtaatggaacgcaccattgcgcccaatgtatccacatgtgcgctcagcgccaccgtatggtccgtttcctgacctttcagagtcaagatggcaccgccttttgcattccattcgatttgcaccccgaggctttccgcttctttacgaataagctccatcacatggtgtgtatacccactgggactgggtgtgttcagtagctgatttaaaaagttcatcatataatcttcatttaattgaatcgtcatttgttgctcctcctcatttggacaaccgatcagggttagaggacggttgctctatatcttggtcgaatgtagaccctgtgctggaagaaccagtcgtgtcataggtcacatccgcgtttgctttcaacgtggatgtgtgctcttcttgtagtgtatgaagctgagtagtcagacgtttaatctctctctgaagcctatattggcggaaaataccgaaagaaccgacaataagtccacctagaagagtgcaaccaagaataagcaaaatcaaaggaatgctaaccatactgaatagaaggttcacttgaaccgaattcacattaataacagcaaatacagctgttaacaaagcaataacaagagctgcgatcaaagaccattgtgttttcaaaatgccacctcctcccgttacattataaaatcccttgcccgccatggacaagggatttatccgtgcatcatttcaatgctggattttaagtgcgcacggtttactttccttcagttagcttttccatttctgtaatgacttcttcgaatacgctcatcgcttcccggatcggctgcggagaggacatgtcaacgccagcttttttcaaaatattgattgaataatcactgccaccgctcttcaagaagcctaagtaacggtcaacggctggctggccttcttccagaatctgtttcgagaaactggttgctgccgagaagccagtagcatacttgtagacgtaaaaactgttataaaaatgagggatccgtgcccattccatttcaatgtctttgtctaccttcataccaggcccgtgatatttcacattcagatcatagtaaatctctgataaaagctgcggtgtaagcgattctccctgttcagcgcgttcatgtacaattttctcaaattccgcaaacatggtttgacggaataccgttgtgcggaattgatctgcatagtaggtgagaaggtacattttctctttcggatcggttgatttgttcagcaggtagtccattagcaacgcttcattggttgtggatgccacttcagcgaggaaaattgtgtactgtgcatctctatacttcaatgcgttgtctgaatagtacgaatgcaatgcatgccccatttcatgagcaagtgtgaacatgctgttcaggttatctttatggttcagcagcacatatgggtgagtaccataagctccccaactgtatgcaccagtacgtttgttttcgttttcgtatacatcaatccagcgctcatcatagcctttttgcaacgaagccagatagtccgcgcccagtggcttaagaccttcctttgtttgctttttggcgtcttcatacgtaatgtccatcttgtattcgtccacaagtggagcgaacaaatcatacatatggagctcatccacacctaacaactttttacgcagcttgatgtagcgatggagcaggggcaagctttcatgaatggtatcaatgagattcgtatacacttccttcggaatattgtcaccgtacagtgacatttccagtacagaagggtatttgcgaacacgagaataaaaaatatttttgtttacattggcacttagtgtagaagcaattgtatttttatttttggcatatgtgtcatataccgctttaaaagcacgttcgcgaacttcgcggtgcggactttcgaggaattgaatatagctgccatgagtcagctcaacctctttgccgttttcatccttaatttttggaaacttcagatcggcattgttgagcatgccaaaaatcgtttgcggggcttgagccagattgccaacctgagcgagcaacgcttcttctgtcttgcccagaatatgtgccttttcccgcttcatttcttgaagtgtaaaccgataatctgcaagctttggatcttcaatgaaggcatcgagctgatgatccggcaatgccaaaatttcaggcgtcacgaaagaaagagactcgctaacctcaacgcctaattttttggctttttgcgaaagaccctggtatgtaggttcagctgtatcctcatcatgatgcagatgtgcgtacacatatacacgctcggttttaagcgacaattcatcttccaatttaaagcagctgccaatcgactctgctgaattgagcttgccttggaattgttcagcctttttggctagttgtttgacttcttcgtattcttgatcccatgctttgcggttgggaaacaaatcttccagtttccatgtattttccactggcgcatcagcgcgttttacaatttcactcatggagagcctcctctgatcgaacgtaatgtggggtagagctgcggcagtaagggacggatgccaaaacgaagaaaccgccacgcttaccgtaagcagcagggcaagaggttttacaggatgcatgtaacggcagatcctccttataccatggcttgttatgccatagtatgacctcttacgcccgaaagtataattttccttactgtgggttggaacctatatttaatgagctgtatacaatgagataaaaggcaaggcaaaccatgattacagcagtgagggccatccactttttgagaggagtcggtatcgtatcacgcttcatgatcagcactccgcccagcgtgaaggccagaataatgaagatgagatagctgttggacaccatgaataggctagacctgtttgaaagcgttcatgatccgctgccactcttcctcattatcttgaaaggactgcttgggaaaccgattttgagcccaatgcattagtgccggacggcttaaaaacgtgtgggcttcctcgccccaatcatcggatatttcccgtagaacgatgtaacggccctgcacctcgactgtcatcatgttccaattgtcttttttgtatatttcgtgttttttcatcatatgcatgtctccgattttatagatgttttggttcatgataccgcagtttccgccgcaaaagcaaatcattccagcccgaaaaacccggaaaaacatcaattgcattgtgaaaaagcatgaagtataatatggatattcgccatagatggcggtatttttaggaggttgttcacttgaaaggtacagttaaatggtttaacgcagaaaaaggttatggcttcattcaaatggatggtggcgaggacgtattcgtacatttctccgcaatccaaggcgacggctttaaaactttggaagaaggtcaagcggttgaattcgaaattactgaaggtaaccgtggaccccaagcagctaacgtaatcaaactgtaagtgtaactgaattgtaagaatggttccgtttctacggatgtcttatatattacggttaaactatgaattgagagcgcagttcctttaatttaagggactgcgcttttttgcgtaaatacgtttatgatacgagaagattgagcaggaatagggtattatacgtaataaaactaggcagaatacatttcaaattgaaggagttgagaaaatgagtgcagcagaggctagtcgtaagccttccctgattgaaggtcctattgccaaaacgctgtttatgttctctttgccgatgctgttcggaaacattctgcaatccctgaatggaacgatcaattcgatctgggtagggaagtttctgggagaagccgcattgactgccgcttccaacggaaatattataaacggctacgggacagtggcagcagcagcttatacagcagccaataatttgtcgagctatgtgcagatgccagcaatggcgttaggtgcagctgtatcttcctttgccgctcaaaatatcggagccggacgttgggatcgagtgcgcatgacaacctggattgggattgtgtataattttgtgttgactggtggagctgtggtattaatttacgtgtttaaccgtcaggccttactcatgttccttccatctacggggggcgcattggaattgggcatgcggattaatatgatcaccttgtggtcttttgttatattcggtgttaccaatgtcattacaggtgttgttcgatcaacgggttccgtcatgataccgcttttaattaccattatttcattatggggcattcgtatacctttggcctatgtatttgtcgatgagtatggtctagatgctgtatggtggagcttcctgttggttttgctatttctgccgtagcagtcatttactattatgctttcgggaaatggaagcaggcaagcatgggagagggaatccaagccatgaagcccgcagaggacaagggataggtaggccatttatactatttgcgattaaagtcttataaggatagattttgtgtaactcctatttttgactaataaaacattccaggtataaaattctttttgtaagaatagctcattttcttgaattttaaagaaaaaagtgaggttgttcatttgtgctaaaaggacgatcatattataatggatatggtttggataggtataattacgtagacaacaatgtggaggcaccgtcatttgagttatgttgagcaaggacgttatcaagtaccgagaggccccataggtctaatgagccgaatgtacaagcacattctccctgaaacgaaactagaattgagtaactggaagagcagggccgaacaaattccggaccctgagctgcgaagccaggcgcttgcgagcatagcggataagacatttcactgcgtgggtggagcggtttatgccgctgccaatatgtctgcccggcagacgctaattccgctgatcgtagcgtatcagaccattagtgattatctggacaacctgtgtgatcgcagtacgtccatggacccggatgatttcaggctactgcatcaggctatgctggatgcggttaatccgacggctaggccagtgaattattatgagttgcgtcgtgagcaggaggatggcggttatttgaccaggctggtgacaacctgtcagtcttgtgtaagcaggcttccgggctatgaggcggccatgccttacgttcaggatttggctcgattatacacggatttgcaagtatacaagcatattaaacccgagctgcgggaacaagcgcttttggattggtggtcgcttcataaagaccgtacaccagagttgcgctggaatgagtttgctgcggctaccggttcaactctgggggtctttatgctgtttcttgctgccagcgaccagcatctgacagatgcaggggctgcctcaatacatgcatcgtattttccacatgtgtgcagtcttcatattttgctggattatctaatcgatcaagacgaagaccggaagggcggagatcttaacttttgcaattattatgaagataccgacatgatgctagaccggatcgcctacgttgtgaatcgggcgcgggctgatattgcagatgtccctgccagctcctttcaccggatgattatcgagggattgctggctttatatttatccgaccctaaagttagcgagcagcaggacgttcgcgctgtttcgagacgtttaatgaaaaatagtccgctcatgcgtttgtttttcttattaaacagtcgatggataagaaggcttatatgattattttgaggaggtcataaatcatgacagcagttaagaaaattgcagtattaacaagtggtggagattcacaagggatgaacgcggcagttcgcgccgtcgtacgtagcggattgtattttggactggaagtattcgggattcaacgtggttatcaaggccttttgaacgacgatatttttccaatggatctgagaagcgtcggagatatcatccaacgtgggggaactgtacttcaatctgcaagatgcctggaatttacgactgaagaagggcagaaaaaaggcgctcaaattttgcgtaaccgtggaattgacggcgtagtcgtgattggtggcgatggttcctaccaaggagctaacaaactgaccaagcaaggcattaaaacgatgtgtcttccgggtacgattgacaacgacatttccttcacggactatactattggttttgatacggcggttagtatcgtagtggacgcaatcaacaagctgcgtgatacgatgtcatcccatgaacgttcttctatcgtggaagttatgggacgtcattgtggtgatattgctctgcatgcgggtctggcttctggcgcagaaacgattttggtgcctgaggtagaatttgacctgaacgaagtatccgaccggatgaaacaaaactttaagcatggtaaacgccacagtatcattatcgttgctgagggtgtaggcaaaggcgaaacagtagcacaagttatccaagaaaactgtccggattatgagcctcgtgttacagtgcttggacacatccaacgtggaggcacaccaacagcgtttgaccgcaacctggcgagccgtttgggtgactttgctgttcgccaattgattgagggcatatctgacaaggcttgcggaatgatcgacggtaagttggtagctacagatattgacaaggttgtaaataccaaaaaagatttcaatatggagctttatgagctggccttgcgtttgtcccaataataagagcattatgtaaaatagatcggctctgatattggaaatgatcaaaattaattatgcggatgacccgagtcatccgctatttttttagctttgagtcctatcaggaggtagtcatatatgtacctattcaaaatcgaagtggacagttcggaaggagcgctgaccgtcattctcgctgctgaaaatgaagaacaggcatttgaagagattgaacaacatgtggagagacactttctatatcctcccaagctgaatgaagtggctattgtggagaaaaaacgaataactttaggcgcagcatatgtaatcgagacacgcaaaggctaaatagcctctgcgtgttgttttttttggccgaaacgacgttgtactctcaccagacgccaaagaagtaaaatagcgcctactgccaaccctgttatcaaaccgatccagtagccgtagggtcccaatgaagtccagcgtgccagtatatatcctacaggaagcccaatgacccaataggagaggaatgtgagcaaaaaggctggattgacgtctttatacccgcgtagcgctccttgtgtaggtgtagcgacagcatcagatatctgaaagaaaatcgcatagattagaaaatgctgtgccaattgaatgacctgcggatcggtggagtaaagtcgagcgacctgttcaccccagataagcagtacaatagctgtaatcagtgatagacctactgcgctgctaatccccattacactataagctttggcatcccgcggacgagcagcccctgtttcatagccaactagaatcgtgagtgccatgcaaatgctgagtggaatcatatacagcgtagatgcaaagttcatggcggcctgatgtgcggctatggtagctgtattatagctactcatgaagagagtgacggctgaaaagacggcagtctcaaaaaatatagcaaatccaatcggtacgccaatcttgatgagctctttcaaagcaccagcagcaatcctgtatattttgctgaagattcggtattcggcaaatatttttcctcgatgcgtagtgataccggcgaccagcatgataatccagtaggtggtcgccgttgccaccccggagcctacacctcccagacgcggaaaaccccagtttccataaataagaagatagttcaacaatacattgatgggtaacgatatgagcgtgatgaacatcgtaaagcgggtttgtcccaatgcatccataaagcttcggagcacagtgtaggcaaatagaggaacaatcccgaaagccatcgcacaaagatagtacagggccacattatgaactctcaattccaaatccataccgttcaaaataggcttgaccaaaatgatgccagcaatcaaaacgaccatagacagggcgagagagagccaaagtgcttgaatgacatagtaggagactttatctttgcgctctgctcctaccaattgagatacaatgggcgtgatagccataagtattccgttaaggcctgtttgtacaggaacccataggcttactccaatggctactcctgccagatcggcaggggaaaagtgtcccgacatattcgtatcaaaaaaagtcatggcagatagtgcaagctgggtaatcaggatagggagtaaaatgtagaaaagctgcttccatttctgtcccgttgttagagtcaattgcatttttgttttcctcatttactagggattgattattcgtatgtatcataacatgtaagtatttattgtaagggataccgctacatttgaacagtaataaaaagactgcacccgttcgccaaacaacgggacagccttcgaaatgattatataatttctagattttatataaaataataaaaagtccggagagataaattatttgtatgttactccgctagtatagcggtttgtggcattccaaagtagatattcatccactttcatatccttaagcgctcgaatttggtcctctacttgagtttttccatacttagcataatgtccgctccccaaccaacttgcggtaaaatcctggatccaaggacgaataattggctttagcttgcccgtcggatcgagctttttgtgtgtatcggccatggagcctttaatcgtctggtatggattcttatcggggtcttttacaccgaaccagcctgtggtgtagtgacttggataaaccatgggcgaaatgacatccacattttcggagattttagtgaaatcctgtccgatcccctccgcagcaggaacggatgcggcatatccgaaaatatctaccgatactcgtacacctaatggagcaagctctttacgggcatattgtacgaattcagtgactgcatccgagcgggattgatctgatttggtatatttcagcttgtctgctcttttctcaaagccttcggggaaacgtacatagtcaaattgaatttccttaaaaccaagtttggctgcttccttagcgatggcgatattataatcccatacttctttattatagggattgacgaacccgtctcctttgccgtttttccagacagagccgtcagggttacggaaagacatctcgggatttttgttagccagtaccgtatctttaaatacgacaatacgagcaatcgggtaaacattatgctttttcaatcggtccatcaaaccggaaatatcccgaatgaatttttgcggcttgcccaatttgagcagctcgggattggtcgttggataagtgatgtaacctgcatcgtctttaatatcaataaccatggaattgagctctgtcttgtcaagcagttcaagcagctgagtcatacgcgaaccgcctgcgctataagccgtgacatagatgcccttgatagcaggagtcgtcggttgtgggtcaattttaactgggggattggaggcatccaccttcatattattgtgctgagcctggatcatggcgctactaattgttgttgccaccctatcttttacatttggagcattggctgactgatcgccgtttccgcctatccccatcgccaatagcataattgcccaaatcatattcatttcctaactctctcccttatgtatgtcgcttacctgattatacgtaaagttatgtatcgaaaaacaacacgcttgtaaccaatactggaatcatcaggcacagtcttacatgattaacccaacctatgctcattgaatccataaaaatgcataaataatgccgctctcttcgcggttgtagatgtaaccggaagaagcggcacttggtaaagaaatttattgaagataattattgtcttgatgctcgcaaatactgtactgaataatttctagcgcatccgttggcttgagtatggccatcccgtcccgaagcacaatcatcgagttcagctcatcctttttgagagaagggagcatttccgggtaccatcttaagacaatgtcggacagttttaccgtttccatttccacaaaaatcaccctttcctgctcggaatcattccaaaagaatcattcaatacgattcggaaaagcaaagtgcctgtgaaatagcaggtaaagctggtctttatatactatgggaacagcgcacatatagtgtaccacagaaactgtattttgacacttgggtttgtgcttatcttcggcgaaatgaacccatcaccccaaccgtttccacaatattgacaaaagctgaagggtccacttctttaatgatccgttttaattcaactagctcgtagcgtgtcgtgacagtcatcagcatgtccttttcggtatgtgaaaatgcgccttcaatttttattttgctaacaccgcgtggtgtggttaacatccgctccagtagcttgtcggtgtgttctgtaataatgtagacggtaatcttcgtgtgactgacatagatttgatccaataccttgccagtcacaaaaatagatagcatcgacgcaagtgcaatattccaatcattgttcaaatatcctgctgcaagaataaccagtccattcatgccaacaagtacagttcctacggggaagtcacgataacgagtgacgatggaaccgataatgtcaaaaccgcccgtagaaccccctacccgaaaggaaattcctgctccaacgccgatcatcaccccaccaaaaacggaggctagcagggggtccgacacgacagattgcaccggcacccaagccaaaatccacgttgtaacgacaacggataaaatgctcaggctaataaaacgcttgcctaaaataaaccagcctgcaataagcatcggaatattgataataaaatacatcgcgctgatatcaaattttgtgaagtagccgattaacatggaaagaccggctactcccccgctcagcaagtggtgtggcacgagaaacagattaaaaccgcatgcaatggcagcggctccaagaatgacagttaagcagtttaacactatttttaacaacttattttcacctcatttaaattatacgggaagcaacttgctggtattcatgaattgttctgtgctataatgcgatgtggatattcttgagtagggacctatgtccagagaaacacttaaaatttaaactgttttaaaaaggataaattcgtttaagatgtgtcggataggttccccaaattcattacagaaagatacagttataggtctaaataaactgtcactgtattggggaaaacttatacaataatatcgctacttaagaatacagacaacattgtggattgtccaccacatccaccattatgaaggagtttgaataaatttgacgacatttgcagaatttgatcttgaaccgaaagtaattcaggcgattacagaactgggctttgaagaagcaacaccaattcaatcccaatccatcccgattgcactgcaaggcagagacatgattggccaagcccaaacaggtactggtaaaaccgctgcgtttggtattccgctgattaacaaaatttctagaagcgacgaaaaaatcagagccctgatcatggcaccaacacgtgagcttgctatccaggtagctgaagaaatcgaaaaactttcccgtttcaaaggtcttcgtactttgccaatctatggtggacaagatatcgtacgccagattcgtgctttgaaaaagaaacctcaaattattattggtacgccaggacgcttgcttgaccatattaatcgcaaaaccatcaagctggaagatgtaaacacagttgttttggatgaagcagatgaaatgttggatatgggcttcatggaagatattcaatccattctgaagcaagttccagacgagcgtcaaacgatgcttttctcggctacaatgcctcctaatattaaaagattggctgagcaattcctcaaaaatcctgagcatgtttcagttattcctaaacaagttagtgctccactgattgatcaggcctatatcgaagttcctgagcgtcaaaaattcgaagcattgagccgtttgattgacatggaatccccagaacttgctatcgtatttggtcgtaccaagcgtcgggtagacgagctggctgaagctctgcaaaaacgcggatattccgcagacggtttacacggtgatttgtctcaaaaccaacgtgatgctgtaatgcgtaaattccgtgacggaagcatcgacgtgctcgtagcgactgacgtagctgcccgtggtttggacgtttccggcgtaactcacgttgtgaactttgaccttccgcaagatccagaaagttatgttcaccgtattggacgtactggacgtgcaggtaaagaaggggaagcttggtctttcgtaacgcctcgtgaaattgaccatttgcactttatcgaacgtgtaactcgtcaccgcattccacgcaagccgcttccaacgttggctgaagctctggaaggtaaacaacgtatcattgctgaacgtctcctagaggctgtagaaagcggtgagctgaacgagtataaaggtttggctattcaaatgctggagcaatatgattctgtacaacttctctctgcagctctgaagctgatgactggtgagaagagagaagcatcgattgaactgactccagaagatccaatccgtgcaaaacgtcgtaaaccagacgtgcgttctggcggtcgcaagccttctaactatagcggtcgcagcaacggtggttacaattccaaccgttctggcggtagcggcggtagtggaagcaaaggtggatatggcggttacaaccgtggtaaagaaggcggtggctacaaccgtgattccggaagccgctatagtggagatcgcaaaccacgcccgagtagcaatggagaaactcgtcgccctgcaagacgtgaagattcctcttccgaataagaaatgaaataatgaaaagtcgaagcagatgaagcttcggcttttttgttatgattaatcagtaggtatgaaccttttagagatctgctttaatggatcacgtattgatttcactggcgtattagggctgaaatacggtatgatatagtcaagagccggaatttataggcatagcaacatgagtcttggaactgccaaggcttgcggagggagagactgacattggagtttaaaggagctatgggtggtatttaccgcctgaccgagtggattacccgactggcggctacaaatttgttatgggtgttatgttcgtcgccttttgtgttctgcctcatactgaaactacttgtaatgaatcagaatttggctaatgagtctttacaaatgaattgggcgatggctattttggcaccgcttactttatttccagccacatcggctatgttcacagtggttcgcaaatgggtaatgggagataccgatacaggcgtgtttcgtaccttttttaaagggtataaagagaattataagcaaagtttgatcgggggtattttttatacgttgctatttgttatcatgtatgtggattataccgtatatatgacacaactcagcaacttgcaaatcgtcggcgtaattatgcttattcttatcattattttgcttgtgtctatgtttaacttcttttcgatggtggctcattatcatatgtctaccggacaaattattaaaaatgcggtgttgctgacactgattcgaccattccgagtattttccaccctgctcggcagcgctgttgttatatttatcggagtcaaatatcctgtgcttttcctattcttcattggcagcgtggttgcctggttcgctttctttaatttttacggaacgttcctcaaaatgcaggatcaaatggaaaagatgaagcagaaagatgaagatacggcaagcattgaagacaaaaaaagtgataacccctaaaaataaaacatatttctcctagcatttactttctgagtgagaagcgctataataaggtcacatcctgcgatgcacgttacgatcatttgttgttttgaaccaatgacaatgtctagggagatctatacggatgaatagctgaaaagccctgtcaatacctgacaaggggacttcaaaagtttattctgcggtcacccacctgctaaagcaggttcagaagacgctatggtcggacggcatcggcgggtactccaaagataacgaatacactctgttcatgcttcgtgcagaaacagggtgttttttgtatgcaacaatgttaaactaagacatgaggtactaaggtcgcataccacaggtatggtcggttaactttttgttgtttaacgtttttataaagcgcttgcagcaaaaaaaccgatgtgctgcatttcggcaacgattatcgtgaaggaggaaatgtcttgtcgttgaagaggactctggtagggattgtgcgcagccaagaaggtacaagcgaccgggtcaaggacccccaaatgaagacacgctattataacttatcgagagacaaggcttgggaagaagtatcatctattttgaaaaaaattcctggctacaaggtactccatgaggtagcatccgtaggtgagattacgttagagaagcgaacggcgttcggtagaaccatcgacattaccgtttccatattgtccgtctcgccagttcggagtgcggtagatatttattctgcttcacggggatcgctaggggacttgggcgcgaattaccgcatcattttgcaactgttcgctgtgattgacaagaagctgtccgctcataaggtcgtgcagtaattgtagatgtgtgagcagtgatgtggcagataaacgtcaaaaaaagcgaggaaggcaacccttcactcgcttttttaatattcagtctgatttagacgagttttttcactgctgcaatcgcttggtcatagtcaggatgttcggacatttcgctcaagtattctacgtaagcgattttatcattttgatcaattacaaaaatagctctatgatccaaatggaattccttgatgaacacaccataagcttcgccgaaggaatgatccttatagtcggacagtgtcaatacgcggtcgataccggcagcaccgcaccaacgagcttgagcgaaaggcagatcgacgctgacagttagcaccacgacttgatccccaagggaatcagcttcttggttaaaacgtcgagtctgtgcgtcacacacgcctgtatccaaagaaggaacaacactgatcaatttgactttgcccgcaaagtcttggagcgtagctgcttctagcaggtttttctgtaatttgaaatcaggtgcctggtctccaaccttcagttcaggacctaagagtgtcaaaggattgcctttaaaagtagcagctcctgtacgttcttgtgccatatgtaatagcctccttggtttttagcattggttatcgttgccgaaatctattataatcttttataaaagacattgtccaatttgaataaggtggagacacccatgaaggaaggattgccttgatttttttacgttatgagaactggaaaagttatttgcggttttacccagtgacctgtctgattttgctcattaatattgtgatgtttattgtactcaccgtacagggtggatcggaaaatagtttgacgctgatccgatatggagctttgattaatgaagcgccattcactgatcagctgtggcgatatgtatcagccatgtttttacatgcagggtttgatcatcttctgttcaattccttcgccatactcgtattcgctcctccgctggagcgtttgctggggtccttccgctatgtgttattgtatctggtcacgggcattgtagggaacatactgtccatcgcgcattacaacatgatggcggaaacgacagtctctgtaggagcctcaggagcgatttatggcatctatggagcattcctatacgttgccctgttccagcggtcactgatggatgacgcctcgcgcaaaacgctgtacacgctgcttggatttggcatcctgttttctttcgctgtagcgaacattaactggacggctcacttcgggggattactcagtgggtttttcctttatggattaatgatcagattgactggccaacgcaaacgtcactaaagacagttttaccgtaagttagcagggtaagaaagaggatgatgttcgattgacgtcttcttccggatgttgaaaaacagattggagcgaatatcggagtggaattacgacagttgcagtacttcatgaaggtagcgcaaaaagaacatgtcactcaggcagccgaggagctacatgtggcgcaatctgcggtaagtcggcaaattcatcagcttgaagaggagctgggagttaatctttttatgcaaaagggtcgcaatttgcagctaacgccagtgggacagttattttgcaaacgggttgagacgattataaaagatctagagcgagctgttttggaggttcatgagtttttggaccctgaggggggcgaaatccgcatcggttttccgcacagtttggggattcatcttattcctacggtggtggctgaattccgaaagcggtatcccaatgttaaattcagatttaaacaggggatgtacccgagtttaattcgtgatgtgttagcgggtgaggtggatttggcttttgtatctccttttccggatcgtcatgatcatgtagagggggatgtggtgttgaccgaggagttgtttgctgttctcccgcccaatcatcctttagccacggccaaacacatcacgctgagtcagcttaaaggagaaaaattcattctgttcagagatggatattcgttacgcccgattgtctggcaggcttgtctggaggcaggatttacgccagatattgcttttgaaggtgaagagacagatacgattcgcggattagttgcggctggtatgggagtcagtcttttgcctgaaatggcgttgtttcagaccaacccgcttcaacctgcaagagtgtcaattgttgatccagaggtcacgcgaactataggcttgattcatcgcaaagatgacaagctaccattagttgcaaagtcattccggacttttttgttgcaatattttggtcttaaaggtagtgttgctactccgaatggaagtgcaaaagcggatttagggcagtgagtatagctggttggttttagataaagaaaaaaaggttgttcctctaccgttaacttggtggaggaacaaccttttttgcaacacaagcaattaatcccggctgttaaagataccgattaagcgaattagttccagcaaggaaacgagagctgcagccacataagttaatgcagcagcatttaatactttggcgataccccgttcttcatcactacggataaacccttcggaaaccataatttcccgggcgcggttggaagcattaaattcaaccggtaatgtaattaattgaaaagcgacagtagccgagaaaaagataatacccaagccaatcaggttcgtgtagctgaataagaaaccggcaatcagcagaaatggtgcaatcccggaagcgaagtttacgatcggaaagatccgatgacggagtgctagcatgggataatgctctttatgttgaatggcatggccgacctcgtgacaagctacggcaactgcagaaatcgatttttcataataaacgggctcggacagccgtacgactctttgcatcggatcataatggtcagataacgcaccaggtactggttcaataggtacatcatgcaaaccattgcgatccagcatatgccgagctgcatcataaccggtcaacccattttcatttgggacatcagaccatttattaaaagtaccttttacacggaattgcgcccataaggataatccgaacgcaagaataatcaatatatacatacccatcataaagcaaccctccattattgttcgtcatagcccgggcatctacatcatagaactatgctccagcagatacttcagagcttcgatacaagcggcgctttgtggtagtagaccagtaagcaacttgcgcgcttgaacgggcttgagctgccccaaaagaggctgtagttcattgacttcacgttctagacgctgcatgtgcatctctagactcgttagtctgtcagtgacgtgctcttcccccgcgaccgagttccatttaatcagtgtctgtctgatttcctcaaggctatacttctcttgtttcatttggttaatacgttcaagcctgtttaaggtttcatcattataaagccgataatttttcaatgatcgttcttcaggtgtgatcaaaccaagctttgtgtaataatcaatagttcgttcgctgacaccagccgccttggctagctcaccaattcgatacagcttcatatccccatctgtcttcacctcgcgctcttcgttcagccttcaatattagcatttgcaaacggagtgtatataaagaatattttacatgattcccaaccatacagtcaaacgtcatgcttttttctggacagaaacaagctacttttatagttagtaaatgtgacatgaagtgtttgggaccatatttttttaacataataaaaaaaatcttgtcaactttcatgtattctgattataatgacaataagaatttcacgaaatgtaaagaaacttaacattcgagggagtgggcttcatgagaaaaaagtggttagttgtattattggccatgctgacagtattagcttttccggtaggtgcgtttgctgctgacggtccgacaaatattcaacttcaagccgggctaaacacggcctttacgttcttggcatttatacttgtattttttatgcaagcgggatttgcattgctggaggcaggctcgacacgaatgaagaatgcaggccatgtcgctggtaaaacgattctcaccacaggtgttgcggctttgtccttctgggcacttggatttggattcggatttggtaatgatggcggcaacggatttatgggactgacgggtttcttcatgagtggtacgaatgctgctgcatcgtttgatgctctttcaggtctggatgttccgattacaattatgtttttgttccactttgctttcgctgcggtatcactttctatcgcatgtgggggaatggcagagcgtgcaaaattaagtgtatacattatcttcggtattttgttctctatcgtgatctatccggttgtagctcactgggtgtggggcggcggatggcttggtaagttaggcatgcaggattatgccggttcgacggtagtccatttgacaggcgctacggcggcactcgtcgctacactgctgctcaaaccgcgtctgggcaagttcaataaagatggcaagccgaacattatccctggtcataatcaggtgtactctatcttgggtgttattattctctggtttggttggtttgggtttaacccaggtagtgctgtatcggctatgaacgacggattctttggatatgtggccttgactaccaatattgctgctgcggcaggtggggttttcgctttgctcgtatcctggatggtatatggaaaagcagatattcctgctatgctaaacggtgtgctggcggctttggttgctattactggttcttgtgcctttgtagccccttgggcggcactggtcattggtgcagttgcagggatcgtcactttcttcacagcgcaatggttcgagcgtgcaagagtggatgacccggtatatgctttctccgtgcatggtgttgcagggatgtggggcgcagtgtccacagggttcttcgctactcctgagcttgtaaaaataacaggtgtaggtcaagcgggtctgttctatggtggtggatttacccaattaggagtacagctgcttggactgattggcaccttggctttcgtgttcgtcatttccttcattattctgggtgcgatgaaagcgattatgggtatccgcgttacggaagaggaagaaacgatgggactggatatcagtgaacacggtacgtacggctatcctgagcaaatgaagttggttgccgaggctgaaaagcgttctggaattgtgaactaatatgtaaaatttaaagaaccagtatggatgagcggaggagatggaagtatggaactgcaaaatatggcctcttgggtgagttccgctgaagcgatggatcaagcagatacgcctgaatcgctaaggcaggccagggtcgactctcaaaaatggctgctggcttcccaagcctccgctccgttatcagactggttacgaacggcgaatgaaatgcatgaccgcatcgcggccagagctgtacaaatgtgtgaaaaagggatggttgaggatggcttcggccctcctcccgtcccttatgcatttatagccttcggaagcatggggcgctcggaatcgacgctgtggagtgaccaggataacggtatgattatcagtaacacaatatctgttaataaagaattgtattttagtgagtttggtcgcagattgtctgcgatgttagagtatttgggatatcccaaatgtgaggggaaagtaatgtgctcggagccgttgtggcgccaaacattgtctggatggcaagaacagctaacgaaatggtcggacgattttgcttgggagccgattcgttatctgattatctcgtctgatatgaggcatatcgctggagatgagcaattatctgtaaactggaaacgaagtttttatgagttgttccgaaaacatcctgatttaccctcagcggtacttcggaacacggtgaggcataaagcgacacttaatattttaggtcagattgttaccgagcgcttcggtgagcatgcgggcgattttgatgtgaaatacgggttgtacattccgctggtgaacgcagtccgttttttggcgttgcaacatggtgtagaggaaacctccaccctcaaaaggctcagtcgtctcgcatcattggaagcggcgccgttgcctttactcgatgcttgcgagcgagcctttcggatcgcgcttcagcttcgaatggctactccggtgaagaagaatgatggattgctggtcagcaatggctacctggctgtaaagccgctgaaacaaagtaaaggctggcatgagttgcgcgaggcgctttcgacagtacgacggctgcatcgtgcgttgcaaaggcagttgcgatttatggaagggagaaggtcatgaaggaaccagcgcagggaagtggcttctggagcgctctccgcagaggaggagtgccgtctgcgatcgcatctgtaatgggggctcctacggctcagcagatggcgtttattcgctccttaacccgggagcaacggcgctctgaagtattgcggaccccgctggatcgtttggagacggtagtttttgatctggagacaacgggattttcagcacagcatggagatgagattttatcgttcggggcgattcgggttgtcggggacatgattatggaaaaagagcagttttatacgcttgttaatccacggactgtgattcctgagcatattaccgagctaactgggattacccgggaaatgacggatgaagctccaccgcttatgaacggactgcacgactttatgtcctttgtaggtgggcgagtacttgtggcacatgctagcgcccatgacaaggcctttttgaatgctgcgttatggaaaacatctaaagttcaattgactcaccgtgttctggatacgatgatgcttgccaaatggcttgagccacagcaacatcaaacctacagtttggatgaattgttgacctatcaatccattccgattgaaggacggcaccatgcgttagaggatgcgaaaatgaccgctaagctgtgggttgcgtatgttcaggaaatgttgaagcgtaatgtgaccaatttggcagatgtctacgcgcatttaagtcatgcctgattcagtacaaggcatagcattcatatacacataaaacagcaagttcgcgatttcgtgggtttgctgtttttttgcgtcctgttcagatttagaaggttagaggtgggaacagtatgggcatcctatggagaaggtaagggtcatttagacgaaagacaggtgataagactgtgaaaagatttcttttcatcagagcgatggttatgctggttgtggttggggcttcgtggggagttattgaaaacacaacttatgcagcaaacccgtccatggaaaatgcaccattaaaagaggaatacggtagagaaagacttaaagctgagaaagaggtagaggatgaaacagcagatgcggtagaggtaatgaaaaagataaagcctgggcagcggcttccttctatgattttaaagggattaaacggcaagacctacgatgtaggggccacgcgcaataaagctttggttattagcttttgggcttcgtggtgcgatccgtgccgattagaagcgcctatgctgaatgagttgtatagtaagtacaaagatgatgtggatgtgtatggtatcaatgtaactcgctatgatcgattggaggatgtgcagaggttttcccgctctttggacctccaattccccattttacttgatgagcaaggagcattgtttgaacgatttggaggggtagcttttccaacccatgtaatggttgatcatcatggacaggtccgcgaaatcataatcggcatgctcagtgagcaggagttggaacgcaaaatagaaactcttgaaaaaaagaaggtgtctttgggagccgagtagaccccaaagacaccttataagctcatgcgagcacctgattagtgattaactaatccgtgatgagtaagctctgtctgatcgttttttggagtcggtgcttccaataatgcgtaacggaaactgtccaagagagcttcccagctggcttcaattacattttcggatacgcctacgttactccagacgtcctcgtaatttttagactcaatgagcacacgtaccttggcggcggtggcatccttttcgtcaagcacacgtaccttgtagtcagccaaatgcatgtcccgcaaggcagggaaatattgagaaagagccttgcggagtgcgttatcgagcgcgttgacaggaccgttaccttcagctgcggtatagacactcgtccctgcgacattcagtttcaaaaatgcttcggatacgaccgggcggccggcagttttctctaccagcactttgaaggattcaaaagagaacatttcctttacttcaccacctgcttcacgaatgagcagttccaacgaagcatccgcgccttcaaactggtacccctgatgctccagttccttgatgcggctaattacgccacgtgcctcatcactagatgggtcaagggtgatgcccagctcttgtgctttggataccacgttgctttgcccggccagttcggagaccaagacccgttgcttgttccccacgagttcaggagcgatgtgctcataagttcgcgagtcgcgcagaatggctgacacgtggatgccccccttatgggcaaaagctgcattgcctacataaggctggttcacaggcatattgacgttggcgacttcgctcacaaagcgggctgtattgtggagttgatttaacttctcagtatctagacagtcgtagcccagcttgagctgcaaattaggaatgacggagcacaggttagcgttaccacaccgttcaccgtagccgttgatggtaccctgaacctgccttgcgcctgcttgtacagcacttaaagagttcgctactgccaattcgcagtcattgtgtgtatgaatacccaactgagacctcgttatctggttttgcagcatagtgacaatttcctgaatctcatgcggtagggtaccgccgtttgtatcgcacatcacgagccaatccgcgcctgcttcttctgcttttttcataacggccattgcatactcgggattgtttttatatccgtcaaaaaaatgttcggcatcaaaaataacctccatgcccccttgctttaaaaaggcgatggagtcgtaaatcatagacagattttcctccagtgtcgtctgtagggcggtgtgtacatgaaaatcccatgatttacccacaagtgtagcagcctgagcgccggattccagaattcgttgtagattgacatcctgtgctgcgatgctatctttgcggcgcgtgctgccgaaggcgacaatctttgcctgaaggcctagctcttgtacccgtttgaaaaattcgatatccttgctgttgcttccgggaatcccgccttcaatataatgaacaccgagatcatcgagttttttggcgattttcaatttgtcatcagcagacaagctaattccttctccttgagtgccgtctcgcagcgttgtgtcaaagatagaaatagcggtggacatgagggactcctcctttgcggattgctcagattggtgatgctctgctttttttaagcacattaatttagttgtttaacgcttaaaaacaggaaagcgttagtttgtcgtgttcgtatgttagtcgattatatcaacttatgacttcaattgtaatatataattatcatttttagccgcaaaacctttattttttatgtaaaatagaaatagcatttaagggtatttcaagtataaaatcaaaacacatattcccgcaatgacgggtgaatttacagttaaaaagaagggttgagcatgaaagatgtcagtgcttattatccggctggtggacgagttattctgcatgtggatatgaatgcattttattgttccgttcatgcagcggaggagccggagaaatataagggactgcctaccgcggtggcaggcagtagtgagctgcgcaaaggtgtaattgtaacctgctcttatgaagctcgacgattgggcatttcaacagggatggtcgttcagcaggctcgtcggatctgtccgcagctcatcgtaatacagcctgattttcacttgtatcgtcgttattccaaggcatttatgagtattgcctattcatatacgcctatgctggaagcaacttcaatcgatgagtgctatctggatatttctggatccaaacagtttggaacacctatggaaattgctgaggaaatccagcgcagagtagaggacgaactgggtctgccctgttcaattggagttgctcccaacaagttgctggccaaaatggcctctgatctgaaaaaaccacgcgggatatctattctacgtttgcgtgatgtacccaacattttatggaaccttccttgtggtcaattgtttggtgtgggccgcaaaacggcagataagcttctacaaatgaacattcgcaccattggacaactagctaaggctgatgagcatatgctggttggcgtatttggtgtgacgggttcgtggttaaaattggccgctaatgggattaaccattctccagtcagcactgaacgggagccaaacaagtccattggtcacacgactaccctgcctatggatgtggtaaagctggaagaagcccaacgggtacttcttaacattagtaatcaggtagcccggcggcttcgacgacacggtatgctggcaggaggtatacaactgacgattcggacgccggatatgaagacctttacgcgttctcaggtcaggagtactcctacggaaagtgcagaggacatatataaggaagcttgttctttgtatcgtcgccattggggagaggataagccagtgcgcttgctggggataacgctacagcagctcattccaaaggaggaagcggccgttcaaatggatctatttgaataccaggatcagcctaagaaggaaagcttattgaagacgatggatgcactgcgcgataagtttggtgaaaatgcaattttgaccgctgggatgctgggagatgatccttcggtacttcttcgcaactccaagttgcgcggaacttcgctgcaaaaagacaatctaccaactccggagtgaacttttgggtagattattgcaagcatcacaagctacgttataagtgttttttgtatgaaggataaaggaaaataatttgtaataatattgggtttgtattaatatgtgaatagaatgcaaaagctggtttgtttgactgtataggaggaagagaaaagttatggctaaatacacttgggtagaaaaagatacatgcattgcttgcggagcgtgtggcgctacagcaccagacatttatgattatgatgatgaaggtttggcagaagtgatctttgaaggggatgcaaaccaaggcatcaaggcgatctcagaagatttgtttgatgatatgcaggatgcttgtgacggttgccctacagattccatcaaagtagcagacgagccgttcaataaagaaggttaagcgtaggcttcttcgataggcacagcactgacagctctcttcgccgtataacggtgaaagtaagctgttggtgctgtttttttagattatagaatggttcagcggagctgaactatcctataatcgcaagaaagacttctgccaagcgcggtctggcttccgtgagagtacgtcgatagacgtttttttatgtgctgtccatcgagtctatttttgccgatatacataataggaagtatgcaagattacacgatcaggaggatccgatgaaccattcgcctcatcttaaatcgtatgtaaaaaaacaccctgataataaaatggcctggtatttactcggcaaagagtatgagagcagcggtcaagagggcaaagcaaattattgctttaatcgcgcaggagaagtgttcgaagccttcgagcataaacagattccggcagacgtatggatggaatatcaggataaactggttcaaatgtcgaaggagaaggatcgaaggacggctcgaacacgccacctgttaactgcgttaatggtactactgctcatatgggttccttcagccaattcaccgagaccttcaaatgaaaatgcatctgatccctctggaactgagcaggtagcaattgataatattgaagttacgaaagtggccactgctgatccgaaggagatggcccagatcggtgtggttggtggtgtgtttacggctcaagcccgaaaagggagtggagctggaacggggcttactgatttgttggctaagactagccgactgccgtccaagactacagtgttgggtatggagcaagggggctcatggctgctctggagagagggtatgaagccattacttagtgtacagaacaaaggaaacggtggattagctgttcagtcttacgacgccgctgcgtgtgcttgcaagccatcagacagtgaaaatcttcgcaaagcaggtctaaaatgggctgctggacaggaggaattagctgtattgaatagctccatgcgtgcttttcgctcacagcatcaacgtcttccccagagtcttgatgaactgactcgagactttcccgctaatacgatgtacggtacgacagacgggatgaagaaggcttttacacctatgcgtaatttacttgcttcaccaggacagggaacagggaaggcagtagatttagacgctgactcgtcggccgaaagcagtccattactggcatcgtcattgcacggacgaccttttctggggcaaccgctgcgaattgtggtggacaaatccaagcacaggcttgccctggtaagtggcaatgtacttattcgaaattatcctatcggtttgggcggagaaagaacaccagaagggaagtttgtgattaccgataaagtagtaaatccgaacggcaaatccaacggtgagtttggcagccgtggaatgcaactgtctgcaacgaattatgccattcatggcacgaacgagccggacagcattggcaaaaatgagtcgttgggttgcgtccgaatgggtaaagaggatgtggaggaattgtttgcactcgtaccttcgggtacggaggtagttattggtaacgggggattgcctgatcaagtgcttgtgcctggttctcgatttacaagtgagccgcagcatgaccagacgaattcccgcaaaacctatcactggctaaattaacgttttgatgttattgctacttggtgtttaacgatttcctgcttgtgctaaaacaatgaccagaataatcacaatgatgaggagaacaaagctgacggcggtccatacaatcgctttcttgttcacctcatcctttttcttttgcagactgggcggcttgcgcttggtcttcatatcagcaatccctcttttctaacgggctaaggtcttgtcttactatgtccattgtaaatggtttgattatacattttcaatgacatctccatgacaactgaattgttctggagctacacctcgcaaattactttctttttggtatggaaaaagctaaactattttgtagagatgtttttttaggattgtgcaagggcatagaacggagtggatgaatcgtgttgtatcgaaggattgcgaaacctgttttttttaaaatgagtccagagacggcccatcatgtagtcattgacggcttaaaacatgcgggctcattccctggtggagcagcgacactgcgagggatgtacggagtcaaggaaacggaggatcttgccgttgatctgtttggcattcattttcccaacccgattggactggctgcaggactggataaaaatgcagaagcggttactggtttttcttccatcgggtttggatttatggaagtgggaacggtgacacctgtgggacagcccggcaatgatcggccccggttgttccgactacctcccgatgaggcgttagtcaatcggatgggctttaacaatctgggtgctgagagcatggccaaacgtctagctgcactcaaacatcgacctgttccggtcgcagttaatatcggcaaaaataaaatcactcccaatgaggatgctcataaagactatgaaaagtgtatttccgcactgtatccgtatgcggacttctttgtagtgaatattagctcgccaaatacgccggatttaagaaagctccagcatggtaatgaactgaagtcgctattggaagcggttcgggcagagatgggagttcaggcgaaaaagtatggcaatgccaagtctgtactggttaaaattgcgccagatgtatcggatgaagaattggaatatatgacagatgcgattgctgccagtggagtagacggcattattgcgaccaatacaacaatatccagagctggtctgacacaccgaaatgcgagtgaaacaggagggctgagtggtaagccgctgcgtgaccgttccacagaggtcatcggacgggtgtaccgccagacggaaggtaagctgcctattatcggatcaggcggcatcttcacgagtcgtgatgcctatgacaaaattaaagcaggcgcaagcctgattgaaatttatacagcattgatctacgaagggccggaagtaaatagggctatacatgctggcctgcgtgagctgcttcgaaaggacggctttagacacattaccgaggctgttggtgcagatcacagataaaaaagtgttgtcggaagagacaggaggtacggggatggacggaagagactggggaacatttttactgccatacgatcaggcggtggaagagcttaaggtcaagttcaaaacaatgcgtgcggagctgaaaaagcgcgaggaatacgctcctatcgaattcgtaaccggacgggttaaaaaaatatcaagcatcctcgataaggcaaagagattacaggttccttctgatcagctggagacgggaatcgaggatattgcaggcattcgcattatgtgccaatttgtagaggatattcggcgggtggccgaatatatcagaagacgtaaggatttgaccgtactgtatgaaaaggactatatcaccaattataaagacagcggctatcgcagctttcatatgattgtggagtatccggttcaaacagcagtggggctgaaaattgtgctagcagaaattcaaatccgtactttggctatgaatttttgggcaaccatagagcattctcttagctataagtatcgtgaaagcttgcctgataatatgcgcacacgattgaaaaaggcagctgaggcagcctttgtattggataatgagatgtcttctatgcgtcttgaaatattggaagcgcagaaaaagttcgaggatgaagccaatatcgtttctaaagtgctaacaggtatgcaccggctgtatttctaccataagatcagtgaaacgattgatgcgcagcgcagatttaatgaactgtgggaacggcacgacatggaaggaatcaagctgcttcacgatgaggtcaaagagatgctagaagcctctaccaaggaagaagacagggatgagtattaaatggaaaacctttcctatgaaccgctgtacgtgacttatttggtatacttcaatcgggatcgggattactttgaatgtcatgaggtactggaagagctgtggcttaagctggaccgtgaccctgtatataaaggtttgctgcaagttgctgtaggactgtatcatttccggaatggtaactatcgtggtggacatatgatgctgaatagtgcagtccacaggctggagcatgctccttcgcaggcgctgggcattaatatggcgaagctggtggacgaggcgcgcgtttgcgcccgtcagcttgctgaagctgttatgaccggtacggaagagcttcagcaccaaccgccggtttatcgggatttgacgattgaaatcgtcgagcccgggctgcgccgggccgtggagaaggcatcgtcgtccattccagtcaacatcccgcagcagagaggtcctcggcgtggggaaaagcatgagcagcgtcagcaggcgctggcagcttcaattaggcgaagacaggccgttgacggctcaggctctgtctcggcggaaacgaaggatacgccttgagtttgaagcgcatgctaagcaagcagcccgatccgtttcatgaggatcgggctgcttgatcgtttcaggtgtgtgaacgtttgactaggaggttacgttctttttatatttctcaaagaaggctttgaaatcgtcgagtgtatacccattgtccgaaggactttccttcaatccacctaccatacgttccttttccacgcctttttcgtaataaatgagcgtaggggtatactcaatcttatacttgtcccagccatcctcatactcacgcaggttaaattcgtgcatcgtaatgttctcctgcttgctcaaaggcaagagcttaggggtagtggcgcggcaatgcacacagtcggacgcgaaatgatagacgaagaagttttcctttttgtcaattttactctgtagatcttccggcttaataatttgctgatagttcgggtcatttagcagctcttgagtagcaggatttaacgaggctgtggaaacgccatacagcttgtttttagtgcctgaatttaaagcgagcagcactccaagcaaaatgaccagcacaacaaaaaagccgatgacaggtataagcttttttttgttggatttttgtgcgttcaatgcaatctctcctatcaaaattcaaaatatgtagctatgaatctcattattatacaacattacagattgtagtgaaagttcgtaaatcacaccgatattgcaggataacaggttgaatatggtacaataaaatttattttaaaaggacaggatgattacgattatgggtgtacatttccccacagcatttgtaaagcgcatggagcaactgctcggcgacgaatttgaagcatttatgaccgcctatgaccacacgccccatgccgggattcgcgtcaatacgttaaaaattccggtggaggactttaaggaacgttctccgttcgaactgcggccaattccatggtgtgccacgggtttttacattccgcacggtacgaaaccggggttacatccttactaccatgcgggactgtactatatacaggaaccgagtgcaatgtctccggttgaactgctcaacgtagctcaagatgaagctgtattggacttgtgcgctgcaccgggcgggaaatcgacccaaatagctgccaaactacaaggaagcggcgtattggtgaccaatgatattagcacggaccgaaccaaagcattggctaaaaatgtggaattgtacggtgtgcgtaatgccgtggtactgaatgaaagcccggatcgaatcgccgatgcctttcctcatttttttgacaagatactaattgatgcaccttgctcgggagaaggtatgttccgcaaagatgaggatatggcaaaacaatgggaaacgcattcggtggataaatgtgtagtcatgcaacgggacattttgcgtgtagcggcctcgatgctgagcacaggagggagaattgtctattcgacctgcacctttgcgccagaagaaaatgaaggaatgatcgcagaatttctggaggctcatcccgattttgacgtagtccctgttccatcggaagcaggttttgcaccaggccacccggaatggatgagtgaagaggtcgcggcatcacaccccgaactgcggggaacagcacgcctttggccgcatctcgtagagggagaaggccattttatcgctgtgttgcaacaccaaggtggtcgtgtcactggaactgaagatcacactgaatccggggatttgactccatttgagggcaagaatgacagggtattgaacatagatgcagcgtatccacggaaaaagcagtttttgtccgtcaaggaagcactgacgccaagcggtcaaggaagacatgcgactggtgagcctaaacgaagtggaaaaggaatggacgggaagtccggtaaaggaaagtccgcgcgcggcttgggtggcaataagtctcgttctggcaaagagaatgtaaaatccgctgcacgctccccacaagatgtgctggagtcctatcaccaatttgtgaaggatcagctggaggtgtcctttacaggctatacggtggtctatggagatcgtatttatcagtcgccattggaatcccatcgtttggacggccttaaggtggtgcgaccaggctggtttatgggtaacgacaagaatggtcgctttgtgccttcacacccgctggcggtggcattacgcccttcagaggcggctagaagcatcaatctctccagttcagatgctgaggccatccggtatttaaaaggggagaccttgtccatccccgttgagagaatggcactgcggaacgaagtccagcccaaaggctatactctcgtgtgcattgatggttattcggctgggtggggcaaatggcaggacggcatgctcaaaaatgaataccctacaggttggaggtggacatcggtatgagtggaaaagggagacaaacgcaacgtttggataaagttttgacccatatgggatatggctcccgtagtgatatcaaacgacaggtgaagcaagggatgatcacggtaaacgggaggatcaccaaggatagcggcttacaggttcatccataccaggatcagattgaagtgaacggggaacgtgttgtttttcgggagtatatttacatcatgctgcacaagccaccgggcgttatatctgcaaccgaagatacaagggagcggacggtgctggatttgctgagcgcggaggaacgacactttgagccttttccagttggacgcttagacaaagatacagaagggctattgttgttgaccaacgacggtaagctagcgcacgaactactttctccacggcggcatgtccctaaaacgtatgaggctaccgtgtcgggtgatgtcacggaggaggatattcatcaatttacagcaggggtggaactggatgatgggtatgttacccttcctgcacagttgaccattcttcgccatgaacatccgcaccaggcagatggggatgtcatttcttatatttcacttgtaatccatgagggaaagtttcatcaagtgaagcgtatgttcgaagcggttggtaaaaaggtgacctatttaaaaagaatagctatgggcccattgaagctagatgaacagcttccactgggcagctatcgagagctgactagtgaagaactggcatggatcggccgggatatagcatctgcaacgtcagaagtttgatgggcagattaaatataaatgacgcacaggctcttatgagattcctgtgcgtcattttatgatatagacaaccagacagagaattactcaaactcaacgttcaacactgaatcgtagtttacgaattattgtgcgcgtgctgcccgactctttttcacttcggctgctgtataagctgtaaccttgtttttacctgtcgttttggatatgtacatcgcttgatcggcctgcttgaccagttcatccgggttcatttccttcttcactgtactgtgtccgacactgatggtgacaatgctttcttccgcgacccgctcgcggatacgttctgcaacatgtccaaccttggcacgtcgatccacaaccattgcgaccagttcctcgccaccgtatcgtccggtcagtccgatttcatccagttcatcctccataatctgtgccacctgtttgagtacttcatccgcacgagcatggccctgcgtatcattcaactttttgaaattgtcaatatcgcaaaaaatgaccgacacgcggattccttgatccatatatcgccgtagtcgtcccgaaaaatatttacggttatatagccctgtcaggccatcggtgatggaagaacggtaaatcctttggagcagctccacaatccgttcaaacaggatgaggaataacgtagtgtagtacagcaatggtaaaaatgacatatataggactgtgtttgatcttccagcttctgcagggatgtcatttcgcagccacaaatagccaagccagagcaaatacatgaataagccggctacatacttctttggctgtccgattcgtggggtgatgaacacaaggctcagtataagtaccagtactcgataaaacagagtgaacccaactagtttcgctgcgctgatccaagcgggcaacaaacctgcagtccaggcaataaccggcaatatcaataacgcacccagcagcagcaaggtccatgtctgcgcacgtttcagcttccggtagagttgaaatacggcggcattgatgagcacgaaggcagacgcctccagcacatttttccacacgattccttggagttgcatcttgcctccacctgctgaatagagattcatggcttcatatgtcataataataatagcggcaaccgaaaaaaggatataggctttttttcgttgtctgctatatatgatcacgcacatcagtgccatcatgagtataatatacaaaccgcaggctgcacttacggccccggccagagatgggaaacccaaggttcccgataaggacaacaacgtcaacatcaccgactccatttgcaagaatagtcaatctattgaacggttgatatcgttccgatacaatagacaggatttatcctatttaaaatgttataattttcttttgtgactaacatttattctcaatatatcatctttcagaaaatccggaaacctatacatacaatctgtgatccgggcagtttaatgcttgaaaggggaagcacgtcatgaaattgctacaggctctctttttcccacccgagcaaccgggaggcgtttcatccatgattccatatctgcaagagcgatttacatccccccgttgggaaatggagctattttcaatccctaaacggattcgtaacaagggtagggacgaagtaacttttgacacctttgactggacgagatatgaacaatatccaatcgttcaaaaatatattcagacgtaccgcgactatttgtggtggacccggcttcgtattcagaagccctatgaccttattcacgctcatcatccgattgccggaatcgccatgaaaactgtttttcctgacattccgctcgtacagacgattcactcttcctatgagaaggaattaattctaaacgggaaaatagaggagaacgggcctgaacaccaattcttggtgtcactgtatggcgaaatggagcagaaggcggatcgcctgatagcggtatctcattcttttcagcattacttaactccttacgttcagaatccgcaagacattgcaatcattccgaatggatatgatgagaagcgcttcaaacccattccacacgaaaatgaagtgacacagctcataaccgtttgtcgccttgttccggcgaaaggactggatattttattgcgggcctgtgctgaacttaaaaaaagaaatctggattttgtgcttcatattattggagacggcccggttcgccctgagctggaagagatggcgcgacagctcgatatataccatgagacgattttttatggatatacccttcatccagaagagtttatgcctttctttgatgtatttgtcttgccttctcgggcggaggcctttggttcggtatttgcggaagcagcgttaagttgtctggcattggtaggtacagaagtgggaggaataccggagcagattgaagatggggtaaatggtctgctcgtgccacccgacaatccgagggcactggcagacgcattagaaaaggtcattgctgaccctgcctatcgttatgagctggctagatctgcctgcgataaagctaaatcaagctattctttaagtcgggcggttaacgagttgaagaaaatgtatttgaaatttccacattaaccatgacgagtaccacctggtttggaatcggaatgccgaaagctggagcgaggacgtgaggaacggaaagggctcctgcgtcctgctatgatcagtttgctaacccacatcagactgagcattccgaaaataggataaaggacagataacagtgaactgaagccgaactgactgattaaaaaacaggtgagcataatgaatagtgtgatgagcttgggcgaaatttggacatgctgacgaatttgcagactgactccataaatgtcggctacaaaggtactgaagatttccatgaaaatgagtagaatgtatatgatttcgacaaaggcacccagacggtaagcaatgcttcccatagggatttcaaattgctgaatacccggcatatgtgctgacatggcaaagtgtgcagccattagcataaacccgacaccaactccgcccaaaactccgccccagcggatggttcttcgggaaaaggtttggctgccaagtggtacaagcacggcttgggccatagttaggttgaaggacgtgtacagcagtggagagagcaaagttcgaaatgtactgtgatctgtcgtattcgtaataaaactctgaggattgggcatggagagcgtgctgtgaacgagcagaagagacataatgatcatcaaagggacaactacggtgttcatgtgcaagatggccttaatgcctttacttagcagcaaataagtaccaatcagtgtaataagcagtccggtttggtaatgcaggtgaaggtgctctacaaaaacagagccggctcctgccagcatgacgctgttcacgccaatcagcacgatgagtgtgaaccagctaatccatttcccggcattggcaccaaaaagatgtttgttcaggtcctcgtaggatttggctgaaatatcatgagcgatcagcatcattttcgtacccaaccatacaaatatgattgtggatagcataatagtgagtgtagcccaacgaccatactgcgtaaaaaattgcagaatttcttgtccggtagcaaatccggcaccgacgattgtaccgatgtatgtaaaagcaatttgaaaaacatgaatattacgtttcatccccagtccctccttgcctgcttgaataacgctgcagcgagcatataatacaaactatgttcaactgaaataggacatgactggatgagactgaaaataattaaagtgaattaatgaatagcttgacgggagcgtaatttatgggtcaaatccttgcatggatacttgaatacggatatttggcaatgttcggcttgcttgcacttggagtagcgggtatgccgatacccgacgaagtgctaatgatcgccttcggcgggctcgtgtctcaagggcactacaacttcattgctgcactggcagtcacatttttcggtagtatgacgggtatgatgcttagctacacattggggcgtctgttgggcaaaccacttttgcatcggtacggaaaatgggtgaggcttacgccttctaggattgcctcttctgaaaattggtttgggcgctatggtacctggggaatcctgttcggatattttgtccccggcctgagacatgtatcctcatatctggcaggtacaacccgtctaggcgtttttcgctacatcagttatgcatcagcaggagctttgctgtggtgcggcacatttttggggattggacatgcggtgggcatgcattgggagcaggtggcgaagctaatggagaaggtgacgcatcaggtagggctggtcgttattcttttaatcgttgcgggaggaatcaccgcatggttctggaacaagcgtaaaaaaaatgtcacatgaccgcatgggaaagcagctatagcttgaaagcggcgggtgaagtatggtacttttaccgcataggattgccgtgggaggtcatgtaatggaagtattaaagaaacgaattttaaatgaaggcgtgattgcatcagatcaggtgctgaagctggatggtttgcttaatcaccaggttgatccagaactgacaatgacaatgggacgagagttcgcagcacgtttccgagaagagaagattaccagagtagtgaccgtggagtcctcaggcattgccatcgggtttgcgacagcattggaattgggtgtaccgttggtatttgctcgtcgtaaaaagaccctattagctgatccagatgcgctgtgtgaacgcgtaccttcgtttactaaaggtattgttacggatattatgctgtctcgtcaatttattcacgaagatgaccgtgttctgttcattgatgatattattgctaatggtgatgcggcgcgaggtatggttaaaatcattcaacgctccggagcggagttggttggatttggtgtcgcggtggaaaaaagctttcaggccggagcgagaaccatccgtgagcagggtattcgtgtagagtcattggtcaaaatttcgtcgttagctgacggcaagattgagtttgctgaatagtaacaattcaaaactcctgatccttatttctaataataacctttgcatgagcttcaatttcgcttataatatagataaggttttggagaggaggcagcaacatggggaaagaacaattgaccgaacagttttttctggaaaaactggcagcggctaaagtacactttgagcgtgccttggattgtaagcatacggaattcgacgatttgtatccctatatgattgaacatcctcagtttttttggtataaacgctatgtggcctggtctgagttgttgacgttggttaacctatgcgaagaattgtccttctcttggaaagaagaatttactgctcaccaagtggagtatgtagatcagcgagtgttgtctgcacaagtgctggacttctggtatgagaagaacgatacaaaagaacatgatcacagtgtgaatcagtcgggataatttgtcgctctgttggcaatccatataagtagtaagagagaagagacctaaatgattcgtttaggtctctttttaaacttttttcatgtatatagaaccatgatcgttatgttaaaaaagtgaataaggaggggacaaggatgattatggacgaagaattggatgcttatcgactctccggtgaaaaggtgcgtgtcgtacgcgatggattggagtccaacgatgttgtgggcattgtactggcatgggatgaggaacaggtgcttattcgtcgccagaatcgacgtgtggtcaaattggatcgcagctatacataccagtcgttcagcgagccgcgtcacaatccgatagatctggattaggaatgggttctcaaatgggtgttggataaaaataactgggtgattcattaggcatacagaaactctaaatcggacacagtaatgaaggaaaatccaacagagaggacgtgctgtgtcaatgacggttatggacgaaaaagtacatgcatacaaggatcaaatcagccatttggaagatcagttgcccgaggtagttcatgcatatcatcgctttaccggagagtgctttcaagccggcagtctagatgagaaaaccaagcaactgattgcgctaggcattggcttatttgccaacaatgaagtatgcacgttttatcacgtggacgaggcgcggtccaaaggagccagtgatcaggaaattatggagaccattgctgtagccgcagcagtaggtggaggacatgctctaagccaaggggtaacgcgtgtacagaaggcgttgcaataaggcgaatcattaattgatgagcttatacttcgtcataacggttatagatcgatttggatatatgatgaatatggaaaggagcttccgcgcacagttggtgtctgcggaagcttttttcttttgcgtgttggttgtgcggggattatgctcttctgcttgcggcaaaagcagcagggcgagacgttttacgcttataagccaaagaggatgtaaccaaacttcgttcaacgatgcgtagaggtttggatgttgaattgtttggtaattcggagcgatgtttctctagtaaaggaagggcagctgtatggggcatagaggttgagagtccgagatatgctcgcatccgctcatacatttctttgcggaacgctggcattgccatactgaactgctctttattgcctttacttatataggtggcgtgaacgccggagtggttttgttgtatgtccagaacatgaatgtgatatttattaaattcatgttttatttcagacagcaggatcccggtacgatctacacctgcattaaccatttcgacataaagaccaggggttttcagcataccgctttcttcaagaattaggctgtcccgctcaaatactttttgaataaaggtaaggagcagataacttttcacaagagaccattcatgctgagtagtatctaaagagatcattaccattcaccgccttaggaaaatgtgatgataattcataaccgaatgaaaaaaagaaccttcgttcccgagaacttatgttcttattttagtttattattccttttttatcaagaggaaattaacaaacataaaaggtttgacatcttgatatgagcatggtatgatctatcttgtcgctaagaaggattgatctttcgaggataaacgacaatttatatgcggtcgtggcggaattggcagacgcgcacggttcaggtccgtgtgggctaaccccccgtggaggttcgagtcctctcgaccgcatctattagaaaaggtctataaaattgctctcgtagcagctttagaggccttttcttgtatttccggggatttgctcatagtttaagctgaacacgtttcttgtcttcccgaaaactatggatttccataaaggattctgacaaattactggatttcttttaggtggaatttttgcgaattcctcaagttcataaacaattcttttataaggttatcttttaagatatgatagaaaataacgcactttatgatgaagttattgaaaggttggatgtaagatggagaaagcgacttttgcaggtggatgcttctggtgtatggtgactccgtttgaagaacagccgggcattcatggcattgtgtcaggatacactggagggacgattgccgatccgacctacgagcaggttaaaacaggaactacaggtcactacgaggtggtgcagattacttttgaacctgagctgtttccttatgaaaagctgctcgaattatattggccgcaaacagatcctaccgacggggaaggtcaatttcaggaccggggtacacagtataaacccgcaattttttatcatacagagcagcaacgtgagcttgcacaacagtccaaggagcagttggcacaaagtggacgctttgataagccaattgtaacggagattcttcctgcttcgattttttatcctgcagaggattatcatcaggattaccacaagaaaaacgtgaagcactataaggaagatcgggcccaatcaggtcgtgatgaatttattgataagaactggtaagcggctttattatacgtttctacgcacgataaggcagatcagggattattccatggatctgccttatacatatttagacgacgttactcacacaatgaagggacagagaaggaggctgacctgcaatgagtacacgacggaagctgcacatgagaaatataataaaaaaggctttaaaggaatctcgcgctcggaaagagccagcttatgtacctgtattccattcaagctccaaaatgcgaagaaccgtagtactctgtatttcggtatgcatgttattcatggtctgtagtactggtgttgcagaagcaatagacaaacaggacgatccgcaaaagatggttgctgtcattattgacgatctgggaaaccatatgaaaggaactgagcaaattttaaatttacccgttaagattaccgttgctgtgatgcccttcctgcctacaaccaagcaggacgctatggaagcgcataagcgcggtcatgatgtcatcgtccatcttccaatggagccaaagcgtgggaagcccgaatggcttgggcctggggcaattaaggctaatatgacggatgaagaagtacatgcgaaggtgacagcagccattaaggatgttccttttgcgataggggtgaacaaccacatgggttccaaggtcacttcggataagcgcattatgtccattgttcttgatgtttgtaaggagcatggactattttttgtcgatagccgtactaattatcggtcagtgatccctgagcttgccgctaaaaagggaatgccaccagtacgaaatgatgtttttctggatgatgtccataaccttccccatgtgaatcggcaacttacaaaagtggttgaatggctggatgagcacaacacctgcgtaacgattgggcacgtcggcgtgtctggtatgtacacatcctccgctcttcattcgtcggttcccaagctaaaggagcacgccaaatttgtgggtattagcgatttggtacgagctgtatggggatggacgggagacccagccatcaacactaccatgccgtcagatgcgcaataatacctgcggcaatagcttcggcaatgcttttttgaccacgatcctcggaaagcatagctctgtcctgttcgttactgataaatccggtttcaacaattacagcaggatgctggattttattcaaaagataaaagggttttccgtacactgtttttctattcatgcaaaataagcggttcaatgaatgctgaatccgttcagctaacagatagctgctgccttcatcctgatacagtacaatgggtccccgtttttcggtacgtttgctccaattgacatgcaggcttacaaccaaagcggtgggcagttgttctgttaggcttttacgttgggcgaggtctttaaggtgccgggatttggactgcagccaacggttgtcgtcactcagtgcgtagtccttgtcccgattcaggacagcaggatatccctgggagcgtaaaatcaagtacagcttttgagcaatggcaagattgatatctttttccaaaatttctttgtgacttgttccaccatccacaccgccatggcctacatcaatcaggacaacgggcttagcaaaagcgtgataggacgaatgtacgttggatggactatctatatacttgttcggttcgttacttttctcgtcgagctgagcagctatataggtaaatggggtgaatacagcactgcaaaggatgcatagactgaaccccaagcatgtcagccatattttgtttaacttttttttcctcacattctattcccccagtggacgaattgattatttactgaaaaaccatgcataacaggcgtcaaacctaaagcagcgtagctgccttcaaatatgacaattagccttggggtaactgttatgttgaagatagtatgttccatttaagggaaaccatgcatagttatttccacaggggttagaccttttggaaaatgagcaagctagttttatctgcacctaacgtgtgaatccgatatttccaagtaacgtaagtggaaataataggcgcagattggaggaggtcatggaggatggcgaagagtgacgaactggtgacgtatattacgcagcggattgttcgctatatggaaacgccgcgtgatgttcggcgcagtcaaaaacaagctagagagccgtgggggaccaaatggtttggcatgttgcctctcgctctgaaaatgtggatgaaatccacacgcagagggcgaagggagcgacattaaactcgccaaagagaccacaagaggcatagggtatgccatttgaggtctctttttatgttgtagggatcattccgatcttttcgtgtttcttaataactaggagtccaaacgataaaattcgccagctgacaataactgttttagtggtacaaatcgggaaagtccatgatggtaggttaacgcatataaattgggttgggacggatgatctggggatatccaggactgatacccactaatggataagggacctccaaaggcaaaattgatacctgtggcagaaaatataatacgcggtgaaatattcagtgtatccataaattgggctgtgttacggacgaaaagtttttggttgggttgaagccaacccagatcgtcatagggatcgaaaggagcagacgagaccgtaactgcttgcgcctgtgttttcaaaaagggtacagaagaagagaatacgttgttttggagcttatgtttccaactcccatctgccacttctacaggtaacggatcgccagttacagcatcaatacatatttcgctgcctgtagaggaacgcaccagccagtaggctagtagcggttcctcatacatgggtgtgatttgcagcttgtcgatagatgaaagatcagtatctgtgagcgacaccagagattggcgaagtatatccatactataaggtccacccggaccattcccatattcgttgagttgatatacgccgtttgagtctgatccgataatcaggtagccgatgtattctcccgcatggtttacttgaacaagccaactatgggttccaggtccgagcggatgatagctaagctcagcatctttccacgagacaaaagggggctgcgacgatagggattgtaccatgttgtctgcagtctgttttacgtctgcgggcacgccttgctccccagtaggaaaacttgctgaaacatcacccggggaaggaatagcaggactcgtggagttcaatggaggaacccgcgagctttcgttgtagagagacaccaagtttaaattgttgccttgtgcgactgagggagccgcatgaatggaagcgaacggacagactgcggacaggccgatcagaacagctgcgatcatacctatgctatagtgcccggaatgattcttcttcaatgcaatccacctttctgtcggcttgattgcccgacggaggcattctttttatacagcatacagcctgtccgataaaaagactgctgcaccttgtcggcgcaaatgtcgtatccaggttcgctttttgctgtcgatacataggagacatgtttaaccaaacttgtggttacagcagcggaaactgatgtaggctgaagcaagatgttacaagctgacgatacctctgcaactctcctgcgaaggagcaagagatatcggttaccgtagatgaaatatcccgcagttaatggcggatacgagtaccttgggctcatactgccataccatttctttacggcgggcttgatgctgctctgatatggcttcttttttatcctcttcctctttctgctccttgattagatcatcatagtagtggtcaataacctccaattcctcgcgcaatcgttccttcgcctgctcagcccaatcataatcttgctgacggagctgttcggtgagatagctttcaagcgagctagaagcttcagggacagataactcggcaggctgcacatgcatattacccgccagcagcgggctgagctgccgagtttcgagcatggcgccaaaatcggttacaatggtgccgcttttaagcgaaatacctagccactgaagttcctcacgcttcaaatcgcaggcgaattcaatcttatagcaaatgctgagccaagcttcatagactacgggagagcgggcagacagctgacgggcatcaggctgctcaaacaaataaacatatttccctccatcacgtgcggcttcgaaaatttgatgcagccgacggcttccatatcgaagctcctcctgcaaaatacgtccaggtcccaattgtggtaatgtcggtacatgaccgaagtaacgccccatgacctgatcttgtgctgcgttgcctgatgctggagttggtggcgtatgatccgctaaacgttcctgttctgtgcgataggcttccccatcaaagatgaaagtgaaggacatcgtctgcgctggaacgccagtacgctctacgtatccccaatagtaggggcggtttgttaaggctttatccgcttctggagaaagcttgacggttacatgatgaggcgacctctcaatgacactgcatccggtagcttccagataggtgtgtacaaaacgctggacttgctgtgcattcatggtcaaactagcgacctcccttcacactgcgtcgagctttgcccggaggaatcgtattgcctgctaggcctaataaatcctcggtgtttggctggtctgtgcgcagttgttccatttcctgcttgatggaatccagcgagtggcccagcttttgcatttttttgcgaatttcatcatcgctactggattcgagcatgatcttatacagacttttttcaatagattcttttttctcaaacttctcaagaatgacgtccaatccgccaatgaccatctcaaacatatttatcttttcatgcagcagatgcaggatatgctcctcaatcgttccggttgtggacaagttgaaaatattaacatcatgcgtctgtccaagccgatgtacccgtccgatccgctgctccacacgcatgggattccacggtaaatcgaagttaatcatatggtgacaaaattgcaggttaatgccttcaccacccgcttcggtggcaatcatgacctgaattcgcccacggaacagatccatcatccaatccttgcgtccacggttcataccgcctcggtaaggaacagcagataggccacggtcacggaaatagttcagcaaatactcctgtgtggctcggtattctgtaaaaatgatcactttttcgttcatctgacggataagctcgagcgctttttctgctttggaattagccttgatcgctttaatatgtgcaaccaaatcccagacacgatcgcgtaggggagagtctggggccatctttttagacaagttgaccagcgtcacgaacacagcgtcccggctgctgcacacttcccgttgaagggtgacgagagacagcatgctacttaaatttccgccattcgcctggtattgctctttgacaaaagaggtcaccccatcgtacagcgcttgctcttccggcgaaagttccaagtgaatgttggaaacatttcgtttggtgaattgaaccgggccttctccgcgacgattgcggatcatgactttagatagctcatccttgagctgatcttcatttttgggcagacgtttatctacaacaaagttggctgaaaaatcgccatgccttcccaattgaccaggcttgagcagtgtaatcaggttaaacagctcagacagatcgttttgtacaggtgttgctgtcaggagcaaacaatattttttacgcagcttcataatgaactggtagttggatgtctttttatttttcagcttatgagcctcgtctataatgagcaggtcataatcggtatctagtaggatgttactatggggctcccgcttggcggtatccatagaggccacgacgacctcggaagaccaagaatacgcttttttctgggcgacagcgggaataccgaatttgctgttcagctcacgcacccattgtaggaccagagatgcgggtacaagaataagcactttggaagccagcccgcgaaccagatattcctttaggatcattccagcttcgattgttttgcccaggccgacttcatcggcaagaatggcacgtccggacatttgaaacagtacctttcgagcggtatccagctgatggggtagtggagtgaggtcttgcaaatgctgtagacattgaagctcatcaaagctcggcaccagtttgactttttcagcctcaatggccagctgatacagattccaatctccccaagggccacctttgcgcagccgctggtccagctcatcctgccagcttcgatcaaattgcaccggaacaggcagtggcgcttgattaggtatgtgcggggaacttgtcgatttggctttcatgatgattccctccctcctggtagtagcacagttgaagctcttggttctgtcacatatgtggcatctatttagcacagatcgtagatgtagtatggacggaaaaagatatcttcataacaggagggatgaaatcctttagctgccttccattaacttttggagtttactttccgtagaggtctgcgcaataggcgtgtagatgctgcaacggagatcaacactgccctgtacctgaagagaagtcaggccaaatagcattttgccagccttggcatgacgaaattcaatgagcacctccggcgcagagcttacttcactctgattccaaagctcgttaaactctgggtaggtctgactcatattttgtataaattgtgcataccaggggtctgttacgtattgtccgtaataagcgcggaaaattgcaaggaacccctttacaaagtgttcccaattcacggctagacttttaaactcctttttggtgaatagcagttcaatcatattgcgttgctcatgtggtagctcggcaaaatccataaaaacatgagcagcagcggcgttccagccgacaatatgacaacgccgatctgaaataatagcagggcagtagtgtagctcttgtacgatcttttgcagagagggggaaataacggcctgctctgcaggaacaggaaggctgtgagacccggcctcgatcgccaaatcatacaaatatttgcgctcgtctgtgttcaactgcaatgcggcagcaatagcatccaacacagaggcggacaccttaatatctcgtccttgctccagccaggtataccaggtcgtactgacacctgccagctgagcgacttcttctctgcgcaagcctggtgttctgcgacgtgatccttgggggagaccgaccatatgtgggtgtaggcgggccctttttgtttttagaaaaacagatagtgcttccagacgtgcttccgttttcataggtattttctctccattcaatgggtatatccgaagtgagcaaataaggcgtttactatagtagtgttcattataccaggataaacaaacacttgtaataggataagacaagggtaaaatgaggattataagtaagtcaccgagcaggaggaatgaatagcttatgcaaagagtagtgataacaggtatgggtgtcgtttccccactaggtaatgaagtggacacgttgtggaagaatttgctggaaggcaattcaggtatacgtaaaattgatacattcgatgtgtccgatttgaaagcacaaattgctggactggtacaggattttgatgcagaaaagcaatggggacgtaaagatgctagacgaatggatcggtttactcagtttgcattatatgcggcagaacaagcgcttaaggattccggtctggaactggatcacaccgatttggagcgtgtcggtgtctatgtgggatcgggagtcggcggtttggatacgttggtggacaatgtagatgttctgctacaacgtggaccgggtagagttagcccgacgctggtacccatgatgatctcgaatatggctgctgctcaaattagtatcgcgtttggagcgatgggacctacgctttcacccgtgacggcttgctctattgggaatacagcaattggagaggcatttcggacgattcgaacaggagatgcggatgtcatttttgctggtggagctgaagcggcggtgactagattggccttggcaagcttcgctaatgcgactgccttgtccacacgtaacgaggagccttctatagcaagtcgcccttttgatcaggatcgagacggctttgtcatgagcgaaggtgcaggtattctggtactggagtcactggaacacgctatccgccgtggtgcggaaatctatggtgaggtcatcggttatggagccagttcggatgcttatcacatggttgcaccgcatcccgaaggaaccggagcttacttggcgatgaaagcagcccttcattcggcccacatctcccctgaagaagtggacgtgattagcgcccacgcaacgagtacgtctgtcggggatgccgctgagacccttgcaatccataagctgtttggtgattatgcctatcagattccggttactgcgaataagtccatgctgggtcatatgctgggagctgcgggcggggtcgaagcgattgcgcttgtgcaaagcctacgggaaggcatcattccaccaacgatgcatctggacaatccggacccggtttgcgatctggattatgtgcctcacgaagcgcgcaaggctccactaaatattgggctatctaattctttcggcttcggtggtcataatgcggtcattgtgctgaagcgctacgagtcataatatgtaaggagttattgaaaccaaacctcaggcattctatccggctggatagagcacctgaggttattttaatcgaagaataacagattcattttagataagagatagagtaagatgaaggaaaacatttggagggacgggaagccatggttttaatcaggaacatacaaccagcagacgctgaggcttattggaatttgagactggaagccctacaaatgaaccccgaagcttttggaacctcctatgaggaagccgcactagttccgctatctgatgtggtgaagcagatacaaaataaacgagatcattacatacttggtgcatttacaaaggatcatcagctggttggcatgaccgggtttagaagagagcagaaaataaagacgcagcataagggagcaatttggggagtttatgtagcatcgacctatcgaggccaggggatcgctaaaaaacttttattggaagtgatcagccaaggtagaaaagtggaaggtttgaagcaaatcaacctgagtgtggtgactaccaatcaagctgctgttgagctgtataagaaattgggatttgaaacctatggtatagaaaagaatgctttggaatatcacggtcagggatatgatgaggagttcatggcttatttttattaatgacgaaaggttttgaaaaaatgaaaattgaccgattgctttctatcgtcattttgctgctaaagaaaaatagaatacaagccaaggaactggctgatttatatgaggtttcgatccggacgatctatagagatattgaagcgattagtatggcaggtattccggtggtcacttatcagggagccaacgggggaatcggtcttatggaaggataccgcctggatcgcagtatgctgacggatcatgatataaaggatatcgtgatgggtttgcagagtttgtcctcgtcgctgggcggcccgaatgtgtcgcggttacttcataaatttgaaagtattataccggaatctgggaaagagcaatttagtgtccataccacacagtttatcgtcgatcattcgggatggggaaatcgggctgcgcaggaaggtaaattgataaaggtgaaagaagcaatgagccaagcacgtactgtcgcctttacctatcgaaatgcggggggagccataacagaacggaatgttgaaccgcatacgctcgttctgaaaggacaacaatggtttgtatatgcatattgtcccgatagggagcagtttcgtctattcaaactttcgcgcatgaatgaccctgtggttacaaagaccgtttttgctcgcagggatctttcttatgaagtgctgccgtggaatgaggagcggatggaggtatccagagctgtacaaccatttacgctgcaatttaaccgtaactcaaggcatttggcggaggactggtttggtgtagaagcattgaccgagcaggaggaagggatctatacggtttcggtcccgttccccgaggatgcatgggcgtacggatttattttaagcttgggaccggatgtggttgtcaaagaaccagcccatttgcgggacaagattcataagatggcgctgcgtattgcatctaattatgaagaagttcgggaatcataaaggaaatcttagattaaagtaaaacaaacctgacccatagttgtcaggtttgtttcgttatactggtggcatacctaatatcagttagcgaaaggggatttacgaggatggataaagcttgtcaaagttgcgggatgccgctagagcatgaggaccaatatggaacggatgcacaacatcataaaacggatgagtattgcaagtattgttacaaggaaggcgaatttgtacagcctgaattgactatggagggaatgattcagcagtgtgtgcctatcctagtagaggaagggatgcaggcagaagaagcgacttcgatgctgcgcaattacctaccgtatttaaaacgatggcggtccccagaggatacagagcttcaacttgatggacccattcgggaggagtaccgaggtgaaatccatttaattgggttgaaagcacgtacaaataatcagaaggaacaaacatctcacgggatcattccaaacatgtgggaacgtttttggagtgaggacgtgcctggtcggataaaggaaaaagcaggacatgcttctgtctatggttgctatactgactatgaaaatggagctttgggcgagtatacgttttttatcggaaaggaagcggataaggatttccagactcctgatgaccttcaggaacttgtcattccggctgcacgctacgccatttttcaggcaactcaggaaccctcttctatcttccgtgtatggcagacgatctggcagtgggctgccacgggacaaggggagcggacatacacaggtgattttgaagtgtatggcagtcctgatgaacctgttttgatttatattgcaatcaagtgatgattttgtcatgacagaagagaaccgccggtcattgtcgtggacccggcggttttttctgattcaatcaatagcagtctccccatcaagttgaacgtcgagttaaagcccaaaagatgagagccagagcactgacaccagctcctaatagacacaccccgttccatccggcatagatgtacatatgagtggaagcaatggcaccggtggcgctaccaatggaataaaatatcatgtagcctgcagtaagtcggctccgtgcctcagggcgcacattgaaaatcaagctttggttggtgacatgtacagcctgtaccgccaagtccaaaagaatgacgccaagaactaaagcgaacagagaatgctcggtgtagcggataggtaaccaggacagcagcaacacaactagtgcgatacccgtcgtccgttgtcccaagccctgatcggcaagacgccctgctcgtgctgctgctaatgccccggcgactccagccagaccaaaggccccgatagcagtatgtgaaagagacaatgggggtgcactgagaggtaacacaagcgaagtccacaatatgctgaacgccgtaaaaatgagcaatgcaaggacagcacgaatacgcagaattcgttcttgcaaaaatagtacgataaccgatcggagcagttgcggataggaaagtgtcgtacttgtgggttcgttctttggcaacacccgcaacagagctccagccataaacagcgtaagtatagctgaaacaaggtaaactgaacgccagcctgccagatcagttaatacaccggccacggttcgtgccagcagaatgccgataacgactccactggtcaccagacctacgatacgcccacgttcagtcggattagccaaggtagaggcgaaagccacgagtgtttgagtgactacagccagcagaccaaccattgccattcccataagcagtattgtacgggtaggagcaaagctaaccacgattagtgccagcacggatagcagcatttgccctgtaatcagtcgccgtcgattcaaaagatcgccaagcgggacgagcagcaataatcccaacgcataacaaatttgcgtgatagtaatgaccatgcctaccgatgagtgcgtaatgccaaattcgtttgccagcgcatccagcaatggctgtgcatagtaaatgttagcgacagctagcccgcaggctatggcaaacaagagtgccacagatcgggatagggagggaatgggggctgtttcggcagcatttgctaccgtttgatgagggaggcgtatcgctttttcttctgacgtcttcattttcacataccacgtcgctttctgtaatttacataccgttgagtataatataccgattggtatgtaatgaatttaggtcaatataactcgtgtatatatgaaatgtcaagagttcatcatgtacatatttgacagtttcttatcgtgatcatacaatcttaatatactgaacgatatgaaaagaaggagctgcttatggttcgaccacgggaatttgatgaagatcaagcgttggatgcagcgatgcgaattttttgggaaaagggattcgaggctacatcattaagtgatttaacctccaaaatgggaattcagcgccctagcatttacgctgcctttggagacaagaagcaattattcgaagctgcgctgcgcaaatatacgcaatcccacgctgcttatgtacgctctagactacaaggcaattcttctgtaaaagaagcgttttacaatttttttggagaagtcgtggcagaagagtacgaggatgggcctaatagaggatgcttttgtattaatacgatggtagaattagcccctcatgatgagaaatttgagattttaaccagagaacatcagatgtatctttctgccgtctttcaggaaaccctcgagcgtggtataagatcaggagagctggaggctagcatggacgcacgagctctggcccatacgatggtctctttgttaattgggattaccgtgatgatgaagtcgcgcccagagcgttcttttgtggatcattcggttgcgactgcacttatgttactgaagtaagtttctttcatatagctgatagtacttgagagaggtattttgagtaaaactatataccgtacgagagaggggtttcttcattgcttaataaaatgaaagttattataacaggagctgcttccggcattggaaaggaaattactcagcaatgtctaagggaaggcgcaagtgttattgcgtgtgatatgaataaacgttctttaaacgaacttgaggctgaactgaattcaccaagtttgtacacctatctgatagatataagtaactatacggaagtaactgatttttttacatacattaagggagaacacccggacataacagctttagtcaataatgcaggtgtttatagaggaaagaatatactcgactatggtatggaagaaatagagaaggtgctggacataaatattaagggatgtgtatatttctcgcaattttttggaaagttcatgattgagaagaagcatcagggaattatcgtaaatatgtcttctgtttctggaatggaaggaagctcagatgcgatctatggattatcaaaagctgcaatattgggctttactaaaagctgtgccatgaatttttcaccttatataagagttaatgctgtggcaccaacgatggtaagtactccaatgatggatcatattcctgattggagaaaggaggaatatacaaatcatcagctaattcctgagcctttaaaagcagaagatgttgcttatactgtcctgtttctgctatcgaaaagatccaggcattatacgggagcgacctttgatattaataatgggtgttatctaagatgattttttacgagaggaggaggattaatgaatacccaaattgaacttagataaacgtgaatgttgttcataccgttggtcctgtgtggaatggtggcgaccatcaagaagaggagctattggcgaaatactaccagaatacactccaattggctttgcaactgaatgcacgaagcattgtctttccgaatatcagcacaggcatctaccgtttcccgaaagaaaaggcggcggatattgctatacaggaagtgacacgttttgtacgtgaacatgcggctttgaatgagattgtttttgtttgttttgatgcggaaaatgctcagttatacagccgtaagttacaagatggtgttaacgatattcaaaaagatacagttgaatgagagaatacatgagtagaaattaggggggatcatgaatgcatgaggagcaaaaccaggaacattggccggtgtgggctacggagcctgtaaaaatagtgaatcctgatcctgcctggtcagaacagggcttaaagatcatttatcaattgcgggagttattactgccgtttaaggtgacggaaatcgaacatataggaagcacggcaattcccaatctttctgctaagcccattattgacataatggcaaaattagaatcttgggatcaactggaacagatcgtgtctgctttacaaccagcaggctggaactatgttccgcctgaattggacggtcgggaatggagaagatttttggttaaagtggaacaggatcaaagaaagggacatctgcatctcatactgaaatctgatgagcattgggatcggcagctgttgtttcggaaccgacttcgtgaacagcctgagctgattcagcaatatgatgtattaaaaaggcggctggcgatggaaaatcagcatgatcgtgaagcgtacacggatgccaagactgattttgtgcaaaatgttctgaatatcggacatcctaaagattagaatgtccggactcccgggtactttccgaccaagcgccgaaatctccgacatttgttattgccgtgtaggggaatggccggaaggcttgccagcacaccagaaaaagcttattcagaagctactacaatagtgttcatccagtactcatgttcatttcgtgataggaaaatcgtatttatagacgtttcaagaatgcgctgatgcgttccaaagccatttccagctgttctcgcgatgacgcgtacgagcagcggataaagccctcgccgcctgggccaaatgcggaaccgggtacagtaatgactccttcttcttccagcaaccgcttggcaaactgctctgaacttaaccctgtgtgcataatggaaggaaaagcatagaaggcaccgtttggttcgtgacatggcagtcctgtctgacataggccttcaacgaaccattttctacgcagattgtaagattccatcatacgatctttttcctccagcccgttacggagggattcaatagcggcaatttgcccgataataggagcgcacatggcggtatattgatgaatcttcagcatagctgaaatcaactctcttgggccacacacatagccgaccctccagcctgtcatcgcaaatgctttggaaaagccgctaatgagcagggtacgctctttcattcccggcagagaagcgaagcttacatgcttctgtccataggtcagttcagcatatatttcgtctgatataacgacaagattatgctcctcaaccaggcgggcaatcggcaaccaatcctcataggtcatcaccccaccagtcggattattcggataacagagaataagcactttggaacgtggagtcagcttggcttggagtgcctcagctgttagcttgaactgctgatccgcagaggtttcaaccgttacggtatgtcctccgttcagaaacgtgatgggcgaatacgaaatataacatggagccggaataagtatttcatcgtgtgtggtgatcagggcgcgtagtgccaaatccagtgcttcactgcttccaatggttaccatgatttcatctgtcgggttgtaggatgtgctgaagctgctctccagatacccggcaatctcctcacgaagctcgggaagtccagcattcggtgtgtatgatgttttaccattttccagtgctgtgatacaggcctttctgacatgttgaggggttacaaagtcaggttcaccgacaccaagcgatacaatatcttttctgcctgtactatattcaaaaaacttacggatgcctgaaggtggcatttcccgtacagctggagtcaaaaaatcggttatagatactgctgtcaatacatttgtcatgatgatttcctcctttttgaaaaacaaaaaaacccgcccctgtaaagggacgagttttatacccgtgttaccaccctagtttcattccatacgaaatgacactctgttcacgtatccatcaatacgtgttccggttaacgctggaaaggcggcagagcttacttcaggttcagcccgcttctcagagatggcgttcggctaccctcggaatgttggctttcacctgccccaactctctgcaaatccgctgtatagcttactcgttctcgtcattgaaatttgttaccgtatcaagttaggtgtaattataagcacaacatttcaggatggcaagtctttttttataaaccttaaagacagatcatcattattgacgactggaaaataacgtatatagtggtatcaaggggattgtgccccagatttcaatgtgttatatgactatattgccagagaggaatggtatccatatgaacgtatttgaacgctttagcggtaaagttttgccggcggattggagttggatgaatgagccggctgtatggggattcgatgattccaagtctttgcaaatttctgcaccttcacaggcggatttctttagagatccgtctggcgcagcggtaaaatcgtccgcaccctttttgcatacaacgcttcaaggtgattttacaatatggacgagggttcgtgttgatatgaagcagccttatgattcaggatgcttgatgatgatggcggatgatacccactgggctaagctgtgttttgaatattttgaaagcactccatctattcttagtgtggtcactcgggatacatccgatgattgtgtctctggggcgatggacgtgtccaatccgtatttacgagtggcacgagctggaaattgctttgcatttcattattcatcagacggtcagcattggaagctggcgagatattttggtatgaatgttcctaaccagctcaaagtcggagttgttgctcaatctccggtgggggagggctgtgctgttacctttgatgccttgacgataacaacccatgtatccgaggacatacgaaacgtggagtaaatagacaaaggccctctctaagtatgaaagcgctaaaaaatagggcttaaaaagacgtatatacgcatgctcaggcaggaggtagatggaaacttgctgttaagaaggaagggttacaagctgcccagtttgttgggagtgctgcttgtagctacgttgggctgtttcggactcattatgtatttacagtccacaagtggaacgaggatgtatcaatttctgtattgggatatattcctggcctgggttccggtctttatcactctgggaatgatggctttatcccgactgcgaagtacaaaagtgagaagtattcttttatttttctcctcaattgtatggttgttttttctgccgaatgctctttatttggtgactgagttacttcatgcgtttcgtttttacgatgtgaatcctgatacacgtttttggttgaacacacaattttggttaatcttatttacgtctttttcagcagcagggcttggactttttcttacatccctttgtgtattggtgatccaccatatgctgaggaggatttgttcaggtgggcttgcatgggctgtagtttttgtgttgttgtggctggccagcataggcgtatatattggtagatttgcccgctggaatagctgggacatattattgcagccactggtgctccttacggatatttggagatggggagtacatgcagtaccaaggcttcatttgctgtccttttgctggttggtgtttgggatagcagtcattttttatttattgatctatatctctttaagtgaggatcaggatatttaggccgaggacatgtattcaatgaatacaggcttcggcctatttttacatgtggcgtgtcaggagttggcgttgtcctctccgtgcacatcataaagcacacgcacaagcagatcctgactgaaattcccaaatcttttgccgaaaatagtaagcccacctttgttttccgattgatcggttacggataagcggagtgtaatgtcgcttttatagttaaggttaatatcgtcaattgtgacttcggaaatgcggcacccgtcaatgaagctgccttgctgattgatgcgaattaatttgagcataccatattgatttaaatgcggtggccaccaatctggattgagaacccccggcacttctccaaaatctccggcgctggtccagtgcccaatagaaataccgttaatgtgaaaacaaatgtcggagggatattcctcacaatagcagggtgcttctgagcctagttctgcggagaattgaatttctttaaaggattgattcgctttcaaatagttggggatgcggtattccaaaaagccttcggccatccagatcatttccgactccagccgcccgggatctgcaaaatagcgtggatcatcaaaatcgccgataatgctgtctcgggtcaccaatccacaagtggggaacgcttgatagttactgtaatggcctacgcgaatctcaacctcatacacatttttttgttctctgctgcgcaaatctaccatcagcttatccttgttcaaataacacatttttcgggtaccgtgcttgccactcacggtattgatctccacaagaccgcattcttccaattttcgaatatgcattgtaattgtaccgttactcaaattaagtttattggcaatgtcattcatactttgtccctggtaagcaagtaactcgagaatttgaatgcggatttctgaacctagtgctttaaaaatatctaaccctgacattaagttcttaatataaatcatagctatagaccatccttatctataaaaattgtaatgtaagcgcttatatatttactttgatttatgttaaaataaaatcaaaaagaagtaaactgcttttttgtaaattttttttactaaaccaagaggggagcgaattgaactccaaattagggattatttcataaataaatcgtatttaagatttatttatagtttttttgatgtaaataaacttaaatacgatttaatttcgctttccatggtattctaacctatgttttataactatttaaaaagattgaaaaatacattgacgaaccgaggaaaggcatgctatattttgtttgtaaacgaattcattattgataaagaaaaatgttaattatacggtacatgagagggatgataatcacagcggcaatcaacaacgggttgtgtaccgcacagttaaagattaggccgagtggtatgaaattattttagcaccgattgtatgcggtttcatttaaatttaggaggggtcgcgttgataaagaaaaaaggttttgcaataacaatggttgttctgttgttaatggtggctgcactggctggttgtagtgggggaagttccagtggtgatggaagtaaggaactgacattcatgttccgtggtggaacagatgaacaaaaggcttataaggaagtaatcaagaaatttgaagaggaacatcctggcgtaaaggttaaaatggtcgtgacggcagcagatcaatatgctacaaagcttagagctgcgattacaggaaacaacctcccagatatcttttattttgcccctggagatgtgaaagcttatgtaaacagtggggtgttgaagaatctcactccttacattgagaagaacaaggatattaaactggataacatatggaaatacggtatagatttgtatcgctatgacggcaaaatggccggtcaaggagatatttacggtatgccgaaggacttgggtccattcgcacttggctacaacaaaacgatgttcgaaaaagcgggcgttccattgcctgataaagacaaaccgtatacatgggatgagttcatcaaggtcaaccaagagttaaccaaagatacaaatggtgacggcaagccggatcaatacggtacaggttttaacgttcagtgggcattgcaagcctttgtatggagtaatggggcggattggctggatgagagcaaaacgaaagtaacggttgatgatccgaaatttgcagaagcgcttcagtactttgctgacatgcaaaacaaatataaaatcacacctgggattgaacaatcacaaacattggacacataccaacgttggatgaagggcgaaatggcattcttcccggtaggtccttgggatatgagtacatttgaaaaactgccatttgaatatgatttgctgccgttcccagccggatcgactggcaaatcggcaacatggattggttctctgggtatcggcgtttcctctaaaacaaaatacccggatgaagctgttgaactggttaactatctgacaacttctaaagaaggaatgaagcagctcgtagatgccaaggtacaaattccaaatctgttggacatggctgatgaatggtccaaagatacgaaaaccaagcctaacaataaacaagagtttattgatatcgtgaatgactatggacgctcattaccaggcaactatacgtataatgcagaatggtacgatattttcttcacagatattcaacctgtgttggatggtaaaattacggcggcagattatgtgaaacaagaacaaccgaagatgcagaaactgctagataaagcggtggagcaagagaaaaaatcacagaaataatgcgtaaatagaggaaaaagggatgatgttagtggctaaatatcatgctgctaacatcatcttcattccaaattagaaacagaggtgagccctgtgataaccaaatctaatctctaccgcaaagagaaggtatatggatacttatttattcttccacctattctcggtctgctaatctttacgttattcccgtttgtctattcgttatacggctcttttacagactgggacggattgggacaaatgaactttattggcctcgacaattttaaagatttatttagcgatgagctcttttataaatcgatgtacaatactcttttcttaatgctgggtattccgatcggtcttgtactagctttactgctggcactaggtttgaatcgcaagattccaggtacgacaacatttcgtgtgatttactatatcccggttatttcttcgttggctgccgtttctattatgtggaactgggcatacaacggagactatggtttggtgaaccaattcctcgaaatattcggtattaagggtcctaactggctgatggataaagatacggtcaaaccggccttgattctcatgactgtctggaagggtctcggatatacgatgctgctatatttggcagccctgcaaagcgtatctcgctcttattatgaagcagcagagctagatggagctagcggattccagatgttccgtaatattacatggccaatggtgaaaccagtaaccttcttcctggtggtaactaatatcattggtggttcgcaaatctttactgaaatgaacattatgacacctacagggggtccggaatactcatccgcctcaatcgtcttttatatttgggataaggcatttaaaaacctgcaaatgggatatgcctccgcgatggctatgattctcggcatcttcatttttatcgtaactttgattcaatttaaaatgaatgaaaaatcgtcctttgatggggattgattttcgcggaaaggagtgagtctgattatgtcccatagtcaaaaaacgaaagttaccaatatcattatctttattgtactagcgattggagcgattgtgatgatcgcgccgctgctttggatgctgtccacttcggtgaaagaaaagcaggatgtctttgctcttccaccagtatggataccagaggtgttccagtttggcaagtataaggaaatttgggaagcaggacctttgttaagcgggatcaagaacagcgtgattgtggctgtaagtgttaccgttgtaggtaccttcacatccagtgtggccgcttttgcatttgcaaagctgagattccctcataaaaacaaactgtttttggcactcatcgcatctatgatgattccatacccaacggttatgattccacagtttatgatgttttccaaacttggctgggtcgatacacttctgcctctgatcgttccaggtttgttcggaaatgtagttatgatctttttcctacggcagtacttgcttagcgtaccggatgccattatcgaagctgcgaaaattgacggaagttcttatttccgactctattcgtcgattacgttcccgctcattaagccggcagttgcggcacagcttattttatggttcatggggatttggaacgattatttggcaccgattatttacttgaactcaccagaaacgcagacattgcagctggttatcgcgaattttaatgcgacttacgccattcagacggactatccgcttattatggcagcatcgattatagccttgttacctgtactgattatattcttgatcttccagaaacaaattattgaatcggttgccatttcgggtgtcaaaggttaattgacacttggaggggacggatgaatgttgtaaggcagtcacaatatgtaatgggtaaaggaaggaggagaataacagttatggtgatgctgctcatgctgggtctatccggctgtggggataacactccggaccctgtgtatccgcaggctccgcctcccgatcacttgtatgatcagagtacgattaatgatgaacagtgctggaccattaacaatgcacatgacccggcgattatcaaaacagatcaaggcttttatgtctactcaacggatgtaaagacaggtggagaattgagacctggtgtcatggtacgcaaatcgactgatctgattcactggaactgggttcagtatgcactccccggcattccaaaggaagcagaggcgtggtcatcggcaaccaatctgtgggcaccggacatcatcaaggtgggtgatacctatcggatgtattactccgcttctacctttggcagcacacggtctgcgattggattgcagacatccagctccccggaaggcccttggaaggatgaggggctggtcgttaaaacaggagagcatgacaagctgaatgcgattgatgccaatccggtgctggatgcagagggaaatccatggatggtatacggctcttttttcggcggtatctatattacaccgcttgatccccagactggaaagctcaaagaatctggctatggtaaaaatatcgctgccagagatcgggcaactgaggacggtgctgtagaagggccttacattgtgtacaatccaatgttccgtaaatactacttgttcgtctcgtatgattctttgtttgaggactacaatgttcgcgtagcccgctcggatttcatcacaggtccgtacgtagatatgaatggacatgacatggcggataccagttatttgcctcaatatgaggttgggaccaaggtactaggcggttatcgtttcagcgaaggagaaggctgggttgcaccaggtcataattctgtgctgaaggacggtgcggattattatattgtacatcatgcgcggggagaaacggacaagagctggccgtacctgcatgtacgcaaaatattgtggacggcagagggctggccggtcgtctctccggagcgctatgcgggcgaaaaggagcaggatatacccaaaaggctattatccggcaactgggagcgcatcgtgataaggcaggaagtagacggccaggtggaagctgaaccgctccgtctggaagatggagggcgggcaaccagcggttctcttgaaggtcactggagttttgatggcaagcgtactctaacaatggattggagcaatacatccggaggaacaaaggaagaattgttattgcttccttcatgggactgggagcttggtcgccatactttaattttcacgggtatgaatgaaaaaggaatttccatttggggaaaacgtatcagcgattaatttgtttgaactacatactacacatagaggagagaataaccatgaatcaatctgtacccattaataatccggtcattgagcaacgggcagacccttggatttacaagcatagtgacggatactattatttcaccggatctgtgccagagtatgaccgcattgaggttcgacgagcaagtactattcaaggcttgagtacagcagagcctgtcgcagtgtggcacaaatatgaaacgggcccgttaagtgcgaacatttgggcaccggaaattcattatattaacgacaaatggtacatttattttgcagcagctcgtacaacggaaacgaaggaaggcctgttcgaccaccgaatgttcgtgctggaaaatgaatcagctaatcctttggaagggaaatgggtggaaaaaggacagatcaaaacccgttgggagacgttcgctctcgatgcgacaaccttccagcataatggggttttgtattatgtgtgggctcagaaggaccctgacatcgtcggtaattccaatctgtatatttctgaaatgagcaatccatggacgctgcgcggtgagcaggtcatgatctccactcctgaatatgattgggaaatcatcggttttaaggtgaatgaaggagcagcggttctgaaacggaacgggcggatctttatcagttattcagctagcgccacagaccacaattattgcatgggtctgttgacagcagatgagaatgcggatttacttgatccgaaatcatggacgaaatcacctgagccggtattctgcaccaatgaggaaacaggacaattcgggccaggtcataacagttttacggttgctgctgacggtagcgatgtaatcgtatatcacgcccggaattacaaggaaattacaggcgacccgctgtatgacccgaatcgtcatacacgtgttcagccgtttaactggaaggaagatggaacacctgattttggtattccagtacccgatggcgttcctgtcgataaataagcgaaatctattatagatggttggttgacgtgttgcacagcggcactgtaactttctagaaattataggtaatcatgattcggatgcgtataacaagagtaataagatatcttctgagccttcaggctggaggatatctttttgcttttgggacgacaaggaggacacttttcaaaaacttcgatttctgctatatttaaatcgtaatatttacgaattgattaaggggtggaaatctcgtgaacgaacggattgatccgtttaccgttaaaaaggttgaatacctgctgaatggctatattgcgctaaaggtaccaggctacgtgcgttctgacgtgcgcctcatttatcaaatagaggataactgtttgatcttgacggaagaaaggccttctaatgaaattgagtcgtgggatcgcacggacattgtccaatttcgctgggaggaaaatcattggcatgtatatgcccggcaagaggctgaaagctggcagcgcgtaaaagagattgcacctaatccgtgctttgaagaacagctcgaacaggtagaaatagatccagcgggtattttttggacaggttaacgaagtgcagaataataagttcggaagatggagtgggagtcgtcccgttaaactgtatacggaaataaacaggctgaccgtaattccttatatggaagttacggtcatttgttttgtcaaaggtggcactgtctagtttgcgtttccatgtcttgtcatgaggcttgttacgggtcctatacatcagggtatgtgaaacacagagcgtgataacgagtggggagcggtgtgtagtgaatgagcagcaacgtaatgacagacaagggcgcgtaggtgagcagtactgagcatgcagatgtcattgccttatcccgcagtggagatcagcgtaaaaatacagagcatgtggaatggcgctcgtgtgattttttttccatggaggatgcaaatcaaggattacaaggagcggattatgccgtatatctcattcattccatgctgccctcggcgaagctgacacaaggaacgtttgaggatatggatgtgattttggcagagcattttgcccgggcagcacgtaataacggggtgaagcagattgtatacttgagcggtatccttcccgagcatacaagtgaggatgaactgtcccgacatttacgcagccgtctagaggttgagcgtgtattgaagtcttttggagtacctgtaaccacaattcgtgcaggcttgatcgtcggcccacagggtaatcgctgccttggtttatttataaatatacacaggccaaagtgcatttgggggttatgtatgcgtttggaaagtatgtcaagcggttgattgatacaaatgtttaatattttccacgagatggaagctacaaatgtatggtaaagtgtactatatacaaggttttatccaaatatcctatccaaagtctcctgtgcataccgaatccgaattacacgaggtgagaaaaatgctgcaatcgttaaaagccattgctaattacaggaaagaaaatgatctggcctgggatacaccgacttggttaaagctgcttgtttcggctgaggagcgtattgttaatctggaacgcattcgatccataggtgagttaaaggatgccaatcctgtactggattacgtggagcgtacgttgcttattttggacggacttccattgtcattctgggttaaagagctactggaggatgttttggtatggtctgagacagccaaaggaggcacagtccgcgaacggctacgttggcagcatgagggtataaatttatttgtacataatatcggctcctctcaactgtatgtcagacaggcccaagcggagtcccctgcttacccgcgcaatagcatgacccgaattctgattgagacgcatggattgattgggcaatatatacggggagaaattctttttgcggaaaatcgactgctgcttgaaattactcgtaagggctggctgagccctgaggaactggagcttgttttacgggctctgaacgaatgtattatcgccggggtagaacctgcattatgggaccaagtacgcagtgaagtggagcagctgatcggctggattgcatgggataacgcacctgtagtctggagtgtaaaggagcgactggaaagattacggtcggtttccattcatgaaggggagccgttcgagcaggcttacacagaactagagcgggacttgaatgtagagaaggctctggctccgttggagaatcggacactttggtatgtagaatcagctttgcaggatttttcacttcaagaactggtaaaggtatttttactcacattgagggatggcacagggcaggaacagcctgcaaccgttcgccatatcagtttcgaatcgctcatgaatacgatgtattatgactatcgtggtgtcaagaaaattaacgtatataaaaaacgaatgatagaaaaatatttaaacgcactgtcctggcaggatatctcaaaaggaaaacggaagcataatcctcatttgaatgtaactgtagagcataaagaggagctgccaagtactgtattttttaattttgtattttcatcagctgctgaaaaactaatcgatttttgtattgaggcagaaaaaacacctctgtatgacaaagcagtcctgctgctgttcgatctgttcgggttacggcgtgatgcttatgatcgctttcacaatgaggaaacgtatcttacagatatgaaccagaccgtagattacaaaagggtcattttggattatatgactggaacccgcatactggatatcggacctggcgggggcgtactgctggacctgatcgagcaggaaagaccggactcgaagccgttgggtcttgatatttctgtgaatgtgattgaggctcttaaacgtaaaaagcaattggagcaccgtcgttgggatgtcatcaaaggtgatgcgctccgactggaagaatttgtggaaacagaaagcatggacacggttattttctcttcgattcttcacgagctgtattcctacatcgaacgagatggaaaaaggttcaactcacaaacagtggaagctgctttgcaaagcgcttatcgtgtacttgcacccggcggacgcattatcattcgagacggtattatgaccgaacccgtagagcagcgtagacgcattcgatttttggagccggacggaatggaatggctgatgcggtatgcgcaggattttgcgggtcgtcccatagaaatagagcgtataggtgagcatgaggctgttttgccggtaaatgatgcaatggaattcctatatacctatacatggggagcggaagcctatgtgcatgaagtgcaggagcagtttggttattttactccgtcacagtatgaagaatgtattcgtaacacacttggtacacaagcgatcatccgggtgagccgccactatttacaggagggctatgccgaagcgctgtccagtcgtgttgagttcatggatgagcagggacagccggttcctttgccagacagtacctgtctgatcgtgattgagaagccaaatcatagggatgaagcaactaaatgatttttaatttgaacaagagaatgccttctgaggtgtgccaagcgcactgggaaggcattcttttagaaaacgaatggaggtgcgttcatgtccaagcaggtagtgatatccgaatataattcgcagtgggtagttgagtatacacgagaacgagaaaaaatgatagaggccctcggagacgtatgtgtcggcgtagagcatattggcagtacatccgttcctggtctgggagccaaggctattatcgacattatggttggagtagaagatttggctattattcaatccgaacagcgacagcgtttactaggtattgaatatgaatatgtacataagcctgattttccagagcgagctttctttcgccgtggagaatggggagctgggacccatcatttgcatatttataagtataaaggagaacattggaaaaaccatttattgttcagagattacttgaaagcgcatcctgatagcctgcgagcgtatgatactttaaaaaaagatttggcgcatcaattcaaacatgaccgtgcagcgtataccgaagccaagggacctttcattcggcagatagttgaacaagcaaagcttgaaagacaaaagcagagacaaatgagattttagtacgcatggacaaggtggaggtatgatgaagaatatgatgcttgatgcacaggtaactccgaatggtttaaaagagagaatgacgctgctgtcagcgctggacattatattgtctccagaagattggttacgcacttatcgtatgcagtctgaatggtctggtgatgtgtgcctaggtgaggtgaacaacggcgctggagatacgattcatatgctatggacgtgtggaggtgtgctgttgaagggttttgaccacgaatcccctgtaagtcctcatgcgagagacgaatatgaggtctggccgggaatgtacgacggtgtgcctgatgatatgatggagcttttggaagatgaagcactggagaaggaggacgttaccttttgtatgtggagggaagcgggagataaggagtggagtatgggcaacacgaactttcctgagggatatgacgatggctcatcctttttgctggggaaaattatagttacaccggaggaatatcaggattgggctgaaagttactatgagttgccgatttctctaggggtggtaagccagattttcaacggcgttccgatcactgcacagatgatctctgcgcttcatccacagcgtaacgttacggaagcgataaaggagctaaagcagcttggcgttcaagtgcatgaaagctaagaatacagatttgtttttcttgacaagttttgtatataatacaggagaaatgctgggttaatcacctcgaattaaaggagctgtgttgaagtgtccaaacgtttgattccttacatcacgatggatggaaatgcaaaagaagcaatcgatttttataaagaggcattggatgctcaactgctttttattcaaacctttggggaaatgccgaaaaaccccgattttcccattcccgcagaggtcaaggaacgtgtgggacatgctacccttaaagtgggtgagacagagctcatgttttctgatacctttcccggatcaccgtttagcagtgggaatcaggtgagcatctgtattacaaccgatagtgtggagcaagctcaaaaaatgtttgatgctctacagcaaggaggacaggtgggaatgcctttgcaggaaacccattttagtccagcttatgggaatgtaacagacaagtttggtgtcacctttcaaatgttcacagaggctcggtcttaagaaatggaaaacggctcgattccgctactttagcgatctggccgtttttttgcgtgtatgtcctcgtctgaagaataaatatacatacagcatggggagtgatatcttttttaccctgcttgctgtttagtagattaggtttatttactgaatgcttagacgcttgttgaaatagaaacaaaaatatattatattatgttgttaatgcaccaacgggtaggaggacaggccatgagcaaagaagaacaggtcataatgggtttcagggacttatataacaagatggtttggcttaataaggataagatggaagacagtcttaagggttataagtcttctgaagtccattgcatcgaatacattgaaagaaatgtagactccaacgtgacaaaacttgcggagtccctttatatgactagcggtgccataagtaaaataactaagaagctcataaaaaaaggcattatcgaaagctaccagaagccggataacaagaaagaaatctattttcggcttacggagcaagggaaagtaatctataaaatccatgaggacttgcataaagagtttcaagagcgagataaagccgtgtttgaacaggtaaccgaggaacaatttgatagtatgcttagcttcgtggaaaagtataataggcatttggatgcagaaataaagaaacagggtatagatattaagtcggaataaatctgaataatgaaaatcaaatcacaggtagccaggctctattgagaacaggctgccttttttttgctattattttgttgccgaggaagcaaaattgtgatacgatatttttgcttccaaggaaataaaaacatagcttttgaggggagaatttaatgttcaaatttagatcacacaatgaacagaacacagaacaaaccgtagataaacacgctttaatattcggtcttatctctgtgtttctttgcggaataggcttcagtatcatagcacctgtcgtcccattcttagtacagccttatataagcaatccgggagaacaagctatcgttgtcacgctgctgacctcggtttatgccttctgcgtgttttttgcggcccccgtgcttggagctctgagtgacaaatatggccgtcgtccattgctcttaatatgccttttgggttccgcaatcgggtacttggtttttggcatgggaggagctctatgggtactatttgcgggacgcataatagagggtataacaggtgggagcataagcacgatcttcgcctattttgcagacatcattcctccagaacagagaaccaaatactttggatgggtgagtgcggttgtaggtgtaggcactgtcattggcccaactgtaggcggattactcgccaagtttgattattctgtacccatgtattttggagcaatcataactttagtgaatgttatatatgggttcttttttatgcctgagagccttgacaagaaacatagactgaaagaaattacttttgcaagatttaatccattcatacagcttgcaaacctgctttccatgaaaaacttaaacaggttacttatctcagcgttcttactttggatacccaacggatctttacaggccgttttttcacaatttacaatggatacttttagttggaagcctgcactaatcggacttatgttctcaattatgggtgtccaagacattatctctcaaggtttcatcatgccaaagcttttgagaaaacttagtgataaacagatagccattcttgggatggtttcggagattataggctatagtcttattgcgctatctgctttgttctcattctatcctcttattatcgctggaatgtttatatttggttttggtgattcggtctttgggccttcattcaatgggatgctctccaagtctgttgattctagtgaacaaggaaggattcaaggaggtagtcaatctattcaggctttagcaagaatgatggggcctatcattggaggtcaaatctatgtatcacttggtcatgccgcacccgcttttatgggtataatccttatagcagcggcaataccagttttatataagcgaacgcaagtaatgagaattttgcaaaatcctaaaatatgtaaattatctactttgtttacagtctgagccatccgcatgcggacggctcttcatagtatcaccttgctaaattaatttcacgtatttgtacttagacgccaaaattaaaatcatcatctgtcagcggctctacattcatcgcccgcacatagccgtttccttttttagaaaagaaatcatgctgcttagtgtgagtgctgatgccgttgaatacaatgggattaacttcctcttcttcaaacagtggatcaaagcccaagttcatcatggccttgttggcgttgtagcgcaaaaagactttcacatcgtctacgagtccaataggagtgtaaatttgctcggtgtattgttcctcgttattgtgcaagtagcgcaacaagcctaccagcgtctggtaaagatcacgttgttcttcctcatccaattctgcataaatctcctgtgccagtacacctacgtacacaccgtgaatactttcgtcccgtaggatcaaatcgataatttctccactgcatgtcaacttgccctggcccgccagataaagagggtagaagaagccgctataaaataaatagctttctaacagcaccgacgctgccatcgcgagatacaggtctttcggtgtgtggatattcatataatactgacgaatggtttctgccttggtttggagatgtggattttcttccacccagcggaatacaccgtcaatttcttccgtggaagctagcgttgtaaagatgctactgtacgacttggcatgaatttgttccatcatcgccataaagcttagtacggctttgcgttgcagtccgtccacatgctccataatttgcggcatacccacgccgccttgaatggtatccagtagcgtcaatccgcccagcaccttcatgtaggcttctttttcgatatcactgagggttacccaggacattttatcgtcagacaacgggatttcatcatccgtccaaaattgcataatgttctggttccagaacatcagtgtgaaatcatcgtccgagcgattccagtttacagcttgtatacctgtcattgttagcattctcccttcagcttgcgagattccctggaaacaatagtgcaggcgaatcatcgtatgcttgacatacggaagctgtatccgtgagggtctgtccagtcccgtaaaggtctgaaccacacgctggatacagcttctaatgcaaagcatctatatctattcaaaatctaatttttatactacagcttgttaccctttatgctttagatggagcaggtgaggcactcttccacagacagctttttggtgcgtgtgtagtataatgatttaagtcctttgtgtgcagcgtacagatagcaacgtgctaactgacgcgtagtcacgtcactgttcacatgaagcacggtcgaaattccttggtccacgtgtggctggatttctgcaatcagatcaagcactttgaactggtccatttgataagcagatttatagaagaacacgttatccttttgtaaataaggcattggatagtaggtcgtcgaattggcataggtacgggtttcaatctgctcaacaatcggcatgacgctggatgttgcattttgaatgtacgaaatgctagcagtcggcgcaatcgccatacgataggcgtggtacagaccatttttcatcacatctgcttttaatttgtcccagtccgctgaagtcggaacatagatgtctttgaacaactcttgtacacgtgcagttgttggacgataatctgtgttcaggtatcggtcaaaatatacgcctgtcgcataatccgattcctcaaatccataaaagctttgtccagctgctttagcgatttccatacttttttcaatggaatgatagttcatcgtcatgaagaaggtacggacaaagtccttcgcttcattgctttcatacgcaattttgttcttggcaagatagccgtgcagattcataacacccagtccaacggagtgcatttcacggtttgctttcgcaacacccggtgcattagctacttgggtcatatcgctgaccgaggtgagagcaatcataccctcgtgaacggattcgcggattttgccatgttccatcacatttacaatgttcagagaagctagattacagctcacgtcccggcggatggtatcctgttggccgtaatctgtaatttcggaagtttcctgcaactggaagatttccgtgcataggttcgacatcttgacttgacccacgtttttaagagcatgtgcctggttcgcgttacttttgttcatgatatatggataaccagactccaactgaatcatggcaattttcgtcagcatgtcacgtgcgctcatcgctatttttttcttcacccgatcgtcagcgagcaacgtatcgtacatttcatccaaatccatgtcgtccagatgcgttccataggctttgaacacactgtaaggagcaaatacatgcagcggttcattatcttgagccagcttgtaaaagcggtttggcaccagcaatccaatagaaagtgtcttgagacgtactctttcgtcagcattgatctttttgctatccaggaactcaagcacgtcccatccgaaaatgttgtaataggctgccccagagcctttacgttgccccatttgatccgcataggagaaaccgtcttccatcagcttcagcacaggcataatgccttttgctgcgccttctacgcctttaatcgcttcgccgcgtgcccgcagtttcgacaggttgaccgcaacaccgcccccgattttggacaactgcatgcaggtgttcagcacatagttgattgagttcagggagtcgtccatttcgagcaggaagcaggataccaattccccacggcggcttttgcctgcattcaggaaggttggtgttgctggctggaggcgttgctccatcatcgagcgggacaacaggcgtgccgtatcggcgttaccgcgtcctaaatgcagcgcgacagcagcaacccggtcagggtaatgttccagatagactttccggtcgttactcttcattgcatagtcggtgtaaaacttggatgctgccatataggaaggaaatttaaaattatagctatgagtgatatggaaaatatcattaatttcgtcagccgtgtagctgttatagaaattttcgtaataatcattctcaatcatatacagcacttgagcggctgtgtcagcaaacttcaaactccgttcctgaacttccttcataaactctgctacagcctcttggtctttttccaattggaaaaagccgtctgtatcgcgtttcatcaacatgttgttcaattcaatatgccgcaactcggctcacctcctgtttaaaacgctctacatctccgaacgttccagataattcaaatttactaatcacggggacattataatgatcggcaatcaaatccgcacttttggcaaatttctcaccccagttacggttgccgcttgcagctacaccaacaaggttttgagcattctttttcaaaaaggaagataccctctcaggtatctgcccaaacccagttgtatatgtaataagtacgtaaggttcttctatagtcatttgctcctcgatctgaaccgctggaagcttgagcttgtttataaatctttttacattgccggtcttcgaatcatatgcaatcagcatggtatgcaacctccttaaacaattaacgaaaaaagaaaacgcattgcctgggatctattatagatggaatcccttgctggctgcgccacttaagattttgactctatatttacatgtattttcatacctgtatcttcaagatatcgggcataaatacgttttttacactatatttagagtacattctctattttatatctatatatagttttgtcaatcggtctagaggggataagaggacccagatcgggtataagtccaagcggggtgcggaaaagagcgaaagaacttttttttcgtaagtatgttaaaaaagtattggagtttttgagggtgaagatgtacgatttgtcaatgggcaatagaatggaaaatttacattttactgtagaaaggatgaagcgaatgggaagtgattttatggaatttcaatcgtttaatacaatcttttttatcgtatttggactcattgcttttgtaatgattatgggaattgtcaaaacgataggagcgggcttgtccaatcaagcagccgaacgggtacaacgttcatgtaaggttgtggataaacggacgagagtgcgtgggggatcaggcgatttttcagcttcgacatattattatatcacctttgagtttgacgggggtgagcgtatggagctggaggtgaaggatacagactttggtatgattgtgatcggggatcgtggggagcttcattataaaggtacacgttttctggagtttgtgagagtaatggaagcgtaaaggtgttggcggcgagttagtattgccaaaacaaatacataattggagggaagattacgatgccgcatatcattggaaaacgaatagtattgagagaataccgtcaagaagatataccagctatccgaaaatgggtcaatgacccggaaatcacacgtggtttaagcgacgtgtttatctacccgcattcacaggtgaatagcgaatcctttgtgcagatgatgattgacggcaaccccgagatcaaaggttttgtcattgcgcataaagacacactggactatatcggacaactggatttattcaaaatcaactgggtgaatcggcacgccacccttggtgttgtgatcgggcgtgacggtgatctgggtaaaggttacggacgggaagcgatacggctgttacaaaaattcgcatttcatacgctgaacctgcatcggctggagttggaggtctatgcgttcaatgaacgtgcacaccgttgctatctggcctgcggcttcaaggaggaagggcggctacgggaaaagctattcagggaagggcaatactatgacattattcagatggggattttgcgaagtgaatatgaggctgcagagcaagcgacggaatcctgaaagtgcaacctcataagctattttactccgtcagctttcttcaattttttatgagtgaaatcacggggactacgctcatcctatttgtattagctaaaggactttctttgcagagtgcgaacttcttactagttatattctttgtaaagtaattattggaaagaaaaagaaaccaaacagaatatttaatgtaaaagttaatgtagaagggctgaacagcatggtctgtcagccctataatatttcattaaaaagcaaaccttatttttcaccgtaccacagtttcagccgattttggattaggccagtatagatttcttcagcctttggcacacctgcctgatccagctcttggagcatgcggtcatacacagcgtcgaactgatctggcttggcgagtacagcctcaggaatccgtttgcgtacaatgtcctgcgacttttgataaataacattgtaattcgtatcggtcggaacaggcatgttgtaggcagcaccccactcttttaccggaaaatccttttcgttcggaaacaggtctttccacgtctgggctttgtatgcctgaagggactctttttcggcttgactataattttcggtaatcatctctggataattggttgtgtaatagttgccagaagggtccttcacgctatcaccataatgtggcccccatatccagtacaaaccgattcctgactctctgctaaaagaagcgttatcggtgtttttacgttgttgcacatccgcaggaatgactcgtttgccgttctctacgttgtaatgctggccttcaattccccaattgcgtaaaatttgtccttcgtcggaggctagaaaatccagaaacttgatagctcgcaccggattttcgcatgaggttgtaattccgatcccggatgcagtatcgaagccaatgggctggagggaatggtcctcgtatttctcatttaaagtgactggaaaatgggcgtaagtgaattcatccttacctgctgccttgagcgcattttcggcatcttgatagttccattcttgatcaatgagtccgatgacacgacctgcggcgattttggacttgtactgatcacttttttgcacaaaagtatccttatccaacagtccttcattgtacatatggttcaaccaacggaaatattcgcgttcttctgggcgcttgtagtgaagaatggctttgtgtgttttaggatcaatataatattcgccatcgtcgggtccacctgtagcagtaacagccgggttagtcactgtaatttgaattttccagtcttcggcatcaagtgatagggggatggttggctggccattggtggtagggtatttggcgacgtaatctttaagtgctttttcaaaatcttgaacggtgcggattttagggtatccgagcttcttaagtgcctgatgctgaatttcgaagccggcttgtgcatcaaacgcgatgtgatccacacccaaattggtcgggatcgtgtagatggctggatcttcactactatatttaatacgattaaaatagtctccatatacttttttaatgttagggccgtatttgtcaatgaggtcggttaagtcaatgagtgccccggcatcgaccatttttccaatgtctcccttggggtacacgagatctggatactctccgcttgctgccattaaagcaaacttttcctcgcctcgaccattgacagcatgttcggcatttagcgtaacacccgttttcttgataatttcctgcccgacagcatccttcatgttgttccagttagagctggaatcaccgccaaagaaagtaagagtaatgggactggtgtcattaggatcttccttttctgccttaccgtctgttccatttgcgcagcccgttgtaacgagcagcagcaaagacaggagtagaatggaactctgtcgaaccgacctgttcttgaacatttgcaaatccccccttaataagtatgatttacacaatgtaagtgctttcaatagtaaattgtaggaaataaagaacctcacgtcaagtaatttataattgcttgttatgcggtttgtttttttgttaagcaaacatattttggtggagggtatggatttgtacaaatctatcatttgatgatctaaaacaaagtatgctacgatggtaccagtttataggtacacccgtgtattagaaagattaaggtagaaaaagattccgaatagggttgggtgagaagatgcgtggaaaagtaacgttgcaagaaattgcggatgcggcgggcgtttcaaagttcgctgtttcgcgtgcactgtcaggcaaacccggtgtaagtgaagagacaagggcggttctggtcaagcttgccgcccagatgggctattttcgcagtcatcccaaaatgacaggggtagagcctcgggacacagataccagagaatggtcgggtaccgtgctagtgttatttccgaatattaggtaccagaacagggaatccagatactgggggcctgtatttgaagggatttccgagcgtctgaaccgtaagggtatggatatgatcacgttaacggagccctcaactgaagacatgttttctttactaaatccagagtcgattaaagggattatcacggtagggacgatttcaacttcattgttgctgaacatttatcggatgggtattccggtcgtcatggtagatcattgggattctgcatttttaagtgatacggtgtttacagataatcgcacatgcatgagtgaattaatgaaggacttgctgtgcaggggctatacccgctttcagtttgtgggtcatattgatgacgctcacagtttctacgaacgctgggaagcatgtcgttccacactggaaatgagcggagtagaattgcggcagattaaagctcttcttcacaggggagcgcaagcgcttgctgaggaaatggaaaagttgtccgaggacgaactgcctgaggtttttgtatgtgctaatgatgtgactgctgcgcaagtcgtggatgtgctgaaagaaaaggggattgacgttccgaggcgttgcggagtgaccgggtttgacgatacgaatgaacaaatgccaatttatgccacggtgagagtggataaggaattgctgggaatgcgtgcagtggaccagttgttatggcgcataacgaacccgaactcgcctgtcgagaaaaagttgctacatgctgagctattcgtacgggaagttcatgcaccccggatccgtcgggaaaatgatgaccgtgagcgtcccatcagcacaatcacatatagttaatgtccagatacgtgttatgacaccatacaccgtgaagacgaaggaggtcgcttttagcctgtttaggggcagagggcgacttttattttgtattttgtcatttgttctaaaaaacaattgactattttgttagcttaatgttatttttgttatgttactgacgaatccagatgttcccaatcatgcttataggaggcttgtgacgatggttaatgtgatagggttggatggctggaggtttagggaagcacaaagtgatgagtggctcagcgcgaaagtgccgggttgtgtgcatactgatcttttacgacatggcaaaattcctgatccgtttatcggtatgaacgagatggaggtacagtggattgataagcaggattggatatatgaagcccattttgagataaatgcagatcagcttcaatgtcaatgtgtagagttggtgttggaaggtctggacacatacgcggatgtaaaagtgaatggccaatatgtcttgtcagccaataatatgtttcgggtatggagacaggatgtgaaggcaattgttcagcaaggggaaaatcggctggaaatcagttttcgttctccgattgctgaagatgtacccaagctggaaagcttaggttatggactccctgcacccaatgatcagtccgagatcggtggtttgtccgacaaaaaggtaagcgttttcgcacgtaaggctccctaccactatggttgggactggggaccgaggctggtgacgagcggtatctggagagaggtccggatcgaggcgtggtccggtcttatcgtgaaagacttgtttattcgacaggacgaggtgaattcggtaggggctaaactcatggcagtggtagagatcgaaaatgcagatgagattagagatgccgagttgcgtatttccgctgacgggaaggtgtggtccaagccggtacggctgctgaaggggaagcagacggtcgagctggagctggagatgaagaagccgaagctgtggtggtgccgtggactgggggagccgcatttatatacgtttgtggccgaattggtggagcaagaacaaggagctgtaatcgcggaaaaatcagtaaaaacgggactgcgttccatccgtcttgtgcgtgaacgggatgcagcaggagagagcttttattttgagctgaacggaattcctgtgtttgcaaaaggggctaaccatattccgaatgacagctttgtcactgaagttacgatggaacgatatcggtatgaaattgccagtgcagccgcctcgaatatgaatatgctgcgggtgtggggtggcggtatttatgaacaagacatattttatgaactttgtgatgaatacggtttgctcgtgtggcaagattttatgttcgcctgcagtatgtacccgggggatgaggattttatggacaatgtggtacaggaggccgaggacaatattaagcggctgcgtcatcatccctgcattgccttatggtgcggcaacaatgagatcgattctgcatgggcgcattatgaagagaatggaggctggggctggaaaaaggactatacacctgagcaacgggaacgcctatggaatgattatgaaacactctttcatcggattctaccggaggcggtacacacctggtctgcgcagacagcctattggccctcctcccccctgattgacctgaccagagatcggaaccagcatgcccatcggtcttcaactgcaggtgatattcattattggggtgtatggcacgcgtctgagccgtttgagaattatcatttacatgtgggtcgttttatgagtgaatatggttttcagtcctttcctgaatacaagtctgttcgtacttatgcggaagagaaggatttggagctggaatctgaggtgatgctggcacatcagaagaacgatgcgggcaatcgtctgattaaagaatatatggagcggtacatgcgagagccaaaggattttacatgttttcttcacatgagccaaattttacaggcagaggcaatgaaagcagctatagaggcgcatcgtcgtcacaagccctattgcatgggaacattatactggcaaatgaatgactgctggcccgttgcctcctggtcgagtatggactattttggtcgttggaaggcgctccaatatacggctaagcgcagctttgctgatgtgctgttgagtgcaaccgatacagaacaggggaataaggccctgcatctagtcaacgatacactagagccgatatcgggtacgctgcggctgactcttttgcatatccgtagcagccaggcaattcatgaagagaacgttaaggtaaagcaaccagcaggcggtgcaggaattgtacatatactgcctatcgacaaatggctgagtggcctgaaccgtgcggagcatatgctggtcgcgcgtctaacgcagaatggtgaacaggtggcctctggtgaaatttattttgcagacacgaaagagatggatttaccgcaggcaaaaattgaagtgacagagattcagggaagcgggggcagcagattcatgctgtgttcggatgtacttgctaggcacgtgtggctatcggcagagcaggaaggtattttcagcgacaaccatctggatctagctcctggtattccgaagacagtggaattcttggtcatgcgcaacggttcatcagcatttgtgacagctgcgccgggtacattgacagtacattcgttggtcaattggatacaaggttagacaacagtaaaagcttatccgtctttaagtagatgatggataagcttcttttataatataaatttgttttatgatatgtagagcgtcttcataatgttaatatacataacaaaagagaacttgggagttaagtgataacagatcatttgtaagaaatctatttatttagcctctaactgttggaatataaaaaaagcatacggtcggccgagaacttgtagaggaaatccgtcagttgggctttagcagggtggagctgaactataacattacccgggaaatgctaacgacgattgaacctatgattgagcggggaacaatggcatatcgagtgtgcacaatacatttcctcatacaccagatccggattacggcacgaattccgttctgctcgggtttgacgatgaaagcaagcgacaacgtgtaatagagctactggtgcaatctgtggaatatgcgcatcattatgggcaaaagcggtaattgtgcatcccggacgccggatggcgaatggacggggttagtgacgaaatttataatgccgttagcgatattacgctaattcatactgcccgaatattaaaactaccggagctacgcctttacctgtgagtgaagtctaaaacacagtaagcatctatttttcggggatgaagtccattcccggagaacggatgtttttttgtgttcattgatgcagaggtagagcgcttccattgagcttgaagccattgtggtgtacactgtccagaacaggtgtaaattggaacgtcaggaaggcaggacggttacaaggagggaaagacacatatgtatgcccgtttaagatcgttaaattatccactaaaactctatgtttttttagcactggccttatgctccgtaatcagtacattgtggatcattaacgtgcgactgccctcagggggccgcccttatctttttatttggtggaatatgatgttggcctggattcctatgctgttgacgttactgcttgatgtaatgtacagctcgtggaggcggggaacgaggacatttttactctgggttacgggggcggcatggcttttcttttatcccaatacaccctatttgatcacagatttgctgcatgtattcgccagatatccatttctcggggagcaacgtttctggggcaatccgtacttttggaatcatgtactgggaatgctgctggtagccgtacttggcctgacaatgggttttgtatcgctcgaatccgtacgacagttggtacaacgtgcacgtggtgggcttgttagttggctgtttatgctggcggtactcttgttgagcagcctgggtatttacattggacgtttctttcgagggaacacatgggatattgtttctgcgccctctcaactgtatgcacaggtatcttccatatgggcagactccttgcaacgtactcattttgtggagtttagtgggatgctattcgtcattttgctcgtcagctatgtatccacgatgtgcgtagtctggatggggaacaaccgccaggacgaatggcgtcgctggtgatttgattgcagctgagtggctgaatatcatcaaaaaatgtaaaatcaaaggaggagtagctacaatgaacggacagaatcgatccgatatccgcgctggtcttcaggtggatattgtgcttaaaaaggatcagtctactggtaagttgacgcgaggaacggtgaaagatattttgaccaattccccgcgtcatccgcatggaatcaaagtgcgtttggcagacggacaggttgggcgtgtcaaacatatcgtaacgaacgaaggatagagctttgggtgaggaggaatgaagatgaatcaggcaacggcatggtctaaaaatgatcgctacccgcttgttttacttgtattgctggcgcttgccctcatttggtctttaattcgcccggcggatcattttacatgggtactggaagttctcccggcagttttgggagctgtgctgctggcggctttgtaccgtagatttcggtttaccaatctggtatacaccctaatctggctgcacgcattgatcctgattgtcggtggacattatacctatgccgaaatgccactgttcaactggattcgggatacgttcggactggagcgcaattattatgatcgacttgggcattttgtacaaggttttgtacctgcactcattgtcagggaagtgctgttgcgtaaaacggccttgggaagcgggagctggctcactttcctcacggttagtgtgtgtcttgcgatcagcgctgtgtacgagctgattgagtttgctgtagccaaggcaaccggaacggcagcagaagcctttttgggcacacagggagatgtatgggatacccaatgggatatgcttcttgcgttcatcggcgccttgaccgcagtgattttgttgagtggggtacataacaagctactgaagcaattaaggtattagcagaatttatttaacccgccactatcatgctatctgaaatttcgctgtttatgaaggctacattcgcgtcatgggacggctgtcgaggtgtagggttgctgcgtccatgtagctgtccagtagccgttcaaaaatacggtcccatgtctgctccaggctgtaggctctaccagctctggacatagcatcgcgaagtgaggcatcctcgtacaacagctgtacagctttggcaaaggcagcggcgtccccagcaggacacaataaccctgtatttccatggattagattatcttttaccccgccttcattggcaccgaccacaggtgtaccgctcgccatagcctccagtacaacattgccgaatgtttccgtggtggaagggaagagaaaaacgtcggctgcggcgtagagttcagctaattccggccctttcacaaaaccaagccagtggactgcatgctccggcacccctagatccgctgcagttttgaccttatacaatggaccacctcctgcaatgaccagcacagaggctgcgcggacgtcgtcgggtaactggagataggaatccagtaacgtgtctatccccttttccggtgcaagcctgcctacatacaaaataacaaatgcatctgcatgaacgccccatttcttccaaactgcattacggtccacctttggttggaatcggtcagtatcaatgcctctactccagatttcgagctgtcccattcctttattgcgcaacaattccatggttgattgagaagggacatataccctttcgcaatgtctgtgaaaccagagcatgtatttccataacgcaggttcaagccagcgaagcttgtaatattcgaggtatttatcaaaatgggtgtgatatgaggcgacgagtggaatatggtgtttggctgcgtagcttgttccatacaggccaaggttaaatggagtagcgacatgaatcagatgcggggaaaaggctgacagacgctcgttgatctgtttggcgttggggatcgcaagtctgcattcccggtacaataaaaagggaatactccgaaatcgctctacacccggcccagagggcagatgatggtctgcctccggtgcgaagacgagcgtagatactccatgtgtctccagatagccaatccatcgttccagggtcagagcagcgccattcacgtcaggcgtatacgtgtccgtaaataatgcaactcgaagcatgccttcattcctcctccgccattctcatttatcctatgacgttccaggggagtccgcttggaggctccggcttttattgtgtcatgattttgtttacgggcttgccgggttttgtaaaagctggcctgcggacgggcgcttttctcggaacattctgtaatagacgagggaggacaaaatatagaaaacacctgtcatgctaaatgtgatagcatagccccagtagtttccataagttgtaaccaaataggcttgtacaggtcccatacctgcggtgcctagcatccaggtcgtctggagaatggagttggcaatgccgcgatttttatctgacacacgttcgacgagaatggcggtttgcagcggattggctgcattcattagcgcttgcctgaatagaaagctgatggaagctatccatagcacgttcgtaaagcctgtaatgagaaggaagggtagcgaaagcagttggaagccaactacagctctgaccagtccaatccggctgccgagggtaggcccgatcaacatggagaggatggtcatgagctggccgagtgcaatcagtaaactcattgcgctgagcgatacggagaagcggttcgtaaaatacaaattaagatacgggatgaccagacctgaacctaacccaagaaaaaactgggccagaacaaattgtccaataacccggcgatcagaagcagcagcaggcgtctccaaggcagggatatcggatgtactgtgcggtgtatgtacttgttctgtttctgtttgaggtgaagattcggcaggagctggtgcttctaaggttgccgtagtttttgtgatgaacaatagaggaataaaggcagtcaatgttgccattcctccaaggaacagagcaacccgcagactggatagcggtgtgattccccacgtctgcagcccatctgcgagtacgccacccccgaagctgcccaggacttgagctgccagtacaagagcagagtaatagctgaatatttttaagcgctgggatttactaatgctttccgctaaaaaaggcacagccagcacctgaataaaggcggcgaatacacctgagattacggcaaataccaacatgcttccgctggtatctgtaaaggtacgggcgagaaaggccaggccgctgaataacgcgccgatgaccagcatatttttgcggctcgtccgatcccccaaaaatccgaccggaatgaacagcaacgccgtcgctagcgcctgcatgctgaccacttggccgttcatatcatcgtcaaagccaagcccttggatatacaggttatacagtacagaaaacattcctgtacccatctggtacagcagattggccataaaaaacaatcggatattacgcggccactttcgaggctcttctaacattttgctaatccatgacacgatgagttcctcctgtgacgttgttgcaaataagttaatactgttgatatgtattctatcaggaactgtacatttcataaatattcctgatctccgattgttttgggtaataataaagcatggactttacattgaattttcattatagtaattcggtatgaataaatttgaaaggtaagcaggagggatggctttggcttttggagcacgggtgttaaaaacgggaatcgcagtgacgctcgccctttttctgagcacgcttttgaacacccattcgcctgtgggggcagcgatagccgctatttttgccatgcaaccgtcgatatataggtcgtggcgttattttctggatcaactccaaacaagcacactcggtgcaatcatggcgttgctgggcggaatggtattttcgaatgagccgattgcagttggactggtatgtgtattggtacttatgatatgtctgaaaataaatatggctgatacggttggattgacactcgtgaccgttgtttctgtaatggaagcctcaggggactggaaatttgcggtgacccgctttgcgctcactttgattgggattgtgtctgcttttgtcatcaatgttagtgtttttcccccgaaaccgaaaaggcagtttattaatcagattcaaaatgtatttaacagcatgtccttgctgctgcgtactgccatttccgatgagattaaggagtctgtcttcaaagaggaaaaaggaaatctggagggagccattaaatcgctgtcggacaaatatcatttgttcgaggaagagcagaagaagctcaagcgctccaagtttagtcaaacgagacaaatggtagtatacaaacaaatgctcggaagtttgcacaaaggatatgaggtactggatgcagtggaaagacactatttccagtctttacggccaaagggaacggatgctttttttgacagtcatctggagctgctgattcgttttcacgagcatgctctactgaaattcgaagataagctaaagccgaatgaggacgaaagtgaattgtttcagcaagccaacggtgaatttatgaagcatgcgattacacgttttgaccattgtcaggaaggaatgctgcggctgtccatcgtcgctgcggcgatgtacgattatggtcatcagctggagaggttgagcagactggccgatcatattcatcctgtagaagagagcagataggcgaatttcctaaagaaaagcgaccgcattcatcaatcagatggacggtcgcttttttatgtaatgaattcaagtatgtaagaacaggttaatagatggttgccagaacacacaaaaaaagcccgctggttgcgaacagggactgaacttgctacaatagaggatgctctgtttaatggtgaaaccatatgcataagttgttaattacacttcttgttacattatagcatgcttcaaaggattagtcaattttcccggatcagggggatgccgcgagtatgcccgggtccataatagagcatagtttgtacgcaagggagccctgcatgagcaggaggaaacggaacaggagcgatgccagtgactactgaacagcaatggaatgaagaacaacgaagagtagaagatgtgaccgcagtgattagcgggcgtattcggaagctagagacagaggttggttctgtgcgcggagatgtcgtcgatatgcgtaaagacttctgggatgaggtaacgatcaatttcagtgaggcggacgatgtgggcgagacgtccaccagtttgcgtcagcagtctgagattttgtctgagcgggaacgaagacacaagcattccacagaggcgttaggtcgtttgaaaaagttgcttgattcaccgtattttgcacgaattgattttgctgaggaaggacagactgcggaacgtgtttatctggggattgcctccctgctggataatcaagatgaggaatttctgatctacgactggcgcgcgcctatttccaatctttattacgataacatgccggggcctgcctcatataagaccccggccggggagatggaaggggaactcacgcttaagcgccaattctcgattcgtgatggacagatccgttttatgttcgatacaggggtgacgattggagacgaacttcttcaagcagtattgagccgcagctcggatgctcaaatgaaaagtattgtcgctaccatccaaagggagcagaatcgcatcatccgtgatgatcgaagccggatgctcattgttcagggggcggcaggaagcggcaaaacctctgctgcgcttcagagagtagcgtatttgctgtataagtaccgggatcgcttacgagcggatcaggtcgtgctattttcgcctaacccgatgtttaacagttatgtatcgacagtattgcctgaattaggtgaggaaaatatgcttcaggccacgtttcaggaatatttggagcggcgtttgggccgggagtttcagttagaagatccatttgaacagctggaatatgtgctttcagcatcgttacagcctgggtatgaagctaggatggagggtatccgctttaagtcgtccaagacgttcttacatgtgattacaagctacaagacgtatttggaacaggagggaatgcgttttaaacccatccgttttcagggacgtgaggtggtttcagtagagcaaatggcacgcaagttttatgaattcgactctacggttcggctggcgaatcgattggaactgctacgggattggatgctcaaagagctggcccgctttggtaaggaagaatgctccgccccatgggtggatcaacaaatggatctgatggagccggaggattatcagcgtgcctataaccgcatgcgccgtaaatccaagaataagggcgataccttcgacgattttacgcgtgaaagagaaatattggcgcgtatggtggtcagtggccgcttaaagcccctgcgcaaatggattaaggcgcttcgcttcgtagatacgacccggctctacagcgagctgtttatgaatgaggcattgttgagccaactggcgaatcatgcagagctgcccgtcagctggggtgaaattagtcgacaaactctggaacgaattcgggctggggagttagcgtatgaggatgtgacaccctttttatatttgcgtgagctgatgctgggctttcgttccaatagcaacatccgtcacgtgtttattgatgaggcacaggactattccccattccagctggcgttcttcaagcgtttatttccacaggctaaaatgacggcactgggtgattttaatcaggcgatctatgcccatgcctcggtgcttcaggatgcagagccattgtatgacttgtatggtgcagatcagaccgagatgatttccctgacacgcagctatcgctcaacacaggagattgtggaatttacccgggggatggtcgctgggggagagcacattgtaccgtttaaccgtaaaggtgagaagcctcttgttactgaggtgcgttcgcttgaaaagttgcatcaattgatagttgggaatgtcacagaattgttggcagaaggctatgaatccatcgcggtgatctgtaaaaatgctgacgaaagcgcggcagcctacgaagcgctggaaggacagctgtcagtgaagccaaaactaattaagaaaacaactcctgcttttgaaaaggggattcatatcattccggcctacctggcaaaaggcgtggaattcgatgcggttctgatttatgacggatcagcgaaacaataccagcgtgagagtgagcgtaagctgttctacaccgcctgtacgcgagcgatgcatctgctgcatatttatagcataggggaggttacgccattcgtgagtttacgggattcggatacgtatacccgcaaagtggaagaaagtgatcgtgttctatagagaggacattggcaatcagccggggacaaatgccttagaaacccatgtgatgcctgaatagatgtagagctggctggcattatggagcatattccagtaacataagcaaataagcaaaacaggtaagaagcataaacggaggttacaaacgtaatggacatgaagagtgtatttcaacgcccgccgctggcggactgtgtacccgagttggtagctacagctagaggagagcgcaaggcatcgctggtgatccgcggaggaacactggtcaatgtggtatcgggcgagttgctgccgggcatgtctattgctgtgcaaggttctcgtatcacttacgtcggtagggacgtcagtcatacgattggagaagacaccataatcattgaagcggaaggccgctatatggcaccggggttactggatggacattgtcacatcgaaagcacgcagctgaccgtaacggagttcgctaaggctgtactgccgctgggagtgacgggtggtttttttgacccgcatgaaatttccaatgtactgggtctaaaagggcttcgtctgatgctggacgaagcacgtacgacaccgctggctgcttacatgcaggtggcttcttgcgtcccgtccacaggtccggagctggaaacgacgggtgcctccttcggcccggcggaagtcgcagaggcgttaagctggggcccggatatgatcgggctgggcgaagtcatgaatttccctggtgtcgtctatggagacgatgtgatgatcggtgaaattcaggccacgctgcgcgtgggcaaggtggcggatggccattttacatgggcctccgatgattggcggctgccggtctatgcagccgcgggaattacgggcgaccacgagtgtgtcacgcccgaggatgtagccgagcgtatccggctcggcatgtatgccaagatgcggcaaggctccgcatggcatgatgtggccgagacgatccgagccagcacggaaatgggtctcgacacgcgccgcatgatgctggtaacggatgaccgcagcgcagaatccttgctccatgaagggcagatggatttcgtcgtgcgtcatgccattgcacagggcgtcaagcccgtaaccgcgtttcagatggccacgctgaatacggcagagcgcttcggcgtggcacgggacatcggatcgatcattccgggtgcgattgccgacattattttgcttgatggccgattggccgaagtgaatgtgacggctaccatcgcagcgggccagctggtggccgagcacggtcaaatggtcgccgattgggacggcttcgtttatcctgcggaagtgatggacactgtccacctgggacgagagctgagtgctgcagattttcgcattgcggctccagtacgagaggggaatgtacctgtacgggtgattcgtgttacggaaaaccacgtggacacgaaggaagtgcgaatgaccgttccggtccgtaatggagaagtcacggcagatcctgcacaggatttgtgcaaaatagccgttttcgagcgccatcatgccagtggcagtcacgcggtggcacttgtgacaggtgtcggcttcaccgagccggctgcgattgccatgaccgtcgcgcatgatagccacaacctactcgtcattggtaatgatgacgagctcatgacccaggcggcgaagcaggctgttgccctgcgtggcggcgtggtggtcgtatccgcctcgggtgagacgcgcttcccgctgcctatcgccgggctgatgtccccagctccgtttgcagaggtagctgcgcagtccgaaagtatcagccgggcgcttcagcaatccggctgcatgctgaacaacgcgctgatgacattgtcactgctcgcactggtggttatccctgaaattcgcctgtcggatcaggggcttgtcgtgatcggagcggatggcatccgcaaggtatctctttttgtggaagaggatgctgcggaagtctgatagaacacgtcgctgggggttgtcctacaggtctgcccagacctgagggataacccctgtttttcatacacgaagtcaaaaaaatatcctcgattcctttataaaagtcaaggagcggtgaacagatgcatccctattatcgttcattagaaaaaatggctcatcatgcctcgattatagagcaggattggaacaggtttgtagagcaaacctgtgtgaagcatattcagcagggaacggttctcattgaaacgggtgagcctgtgaaacatgcctatttttgttcagagggattatttcgtttattttatacattagcagatggcagagaatataatgttggtttttcgccagaagatgattacgtaacctcttatggggctatgatccaaggaaaactatccactttttcgattgaggccatggaagattcggttgtcattgaaattccatatcacgtattgaaggagcttatggatacaagccatatgggggaaagattcgtccgtaaaagtgtagaaagactttatattcgaaaagaggaacgggagcgcgaattattgtatctttccgctaaggagcgttatcatgcttttcttctcaaataccccggattggacaaacgagttgcccaatatcatatagcttcgtacataggcgtctcccccgtatcacttagtcgtttgctgcgtagtgatccgcattaacctatgttaatgcgacgttgtagacaatcagcgtacaataacgataaatcattcaagcttcaccaaaaaaggagataaggcatatgcgttatatgatgattgtattattggagttctacccttcctggctggctctacctcgggaggaacgtcgaaaacatgcgggggccttgcaggctaccattcaaaaatatagcgaacatgttcagattcgtttttttgatgcagaagcactgcctggaaaggactacactgatttcgtcgtatgcgaaacggaggacatgaagcaatatcactatatgtgggaagaaattcgcgattcggagccgtataccaaaggatacatgaagattaaagatgtagtgatgggtatggaaaatgcttttcagtcctatgagtcagaaatgctacagatgggaaaataacgtcattccgatttctatgtaaaatgaagagttcatcctatatacgattaaaaagacgaattcctgtgctgtttatgttcagctgggaattcgccttttatcttttggagacgaaaaagtgtaataagaaaaatcacattatacaactgtgttacttataatcttcagaaaaccgttcttctcagcggtatccattaactgattaatggattttcttgcggtatcgttaaacaaataccactcatctttcgatacgtcatgaatcaaaatctctggatattctgttgaaagttcagatggaacaggactaattaaagaataaatatcaaaacgaactaagcttttccctttttggcctaaaaaatcatattgtgcatttttataataagatccagtgtgtcaatagtgaagctccaagagtagtttgcaggtgcttcgaccttttcacctatgttttttgcgaaaatattataaatggtttcattatatgcattgccatgaacttgctgaactaccccgcccataaacatatggtattcctgttgaagtgcttttacttgtacaccgtttatgaacaatggtttagtatcaacagtcactgcaaagttgctgtaattaacattgcagccaaacgcctctgcaataaaacgaagtggaacatatatgcgattatttttcgtatatggttttacatcaagcagcatctttttaccatttttctccgctatgcttctgtttactgctaattttactttcatctcgcttttagcgagaataacctcggaatcggaccattcgacactagcccccaaactttcgctcataacacgtagaggtaccatggcgcgtttattcttcatttcgggcttcacatcggatgtaatagtcacaccgtcaactttgatctgattttgtgctgcataagtagtggacgatgaaataaataaaaaaattgcaagaaaagccgcaaagaatgcttttttcataaatgattactcctttttcggttaaatttgttgcgcagtaactttcccccatatgaagacgcaactggataaaaaaacgttgcgctgtcctgtccgttaacttaacgtaacaaccagtttgtactatttaattatcttccgatatttaccaactaaaaattactaatcttcctggagaattatgtcgataacattgaatattattcataaaatttatcaaagtaaatccttagggggaaagttaatgagaaaacagctaaaagttgcgatttctctagtatgtttaatgatgtttataggttgttcagcttcacctgtatcacagcagacgaccaagattacacttttgaattccaaatcagaaataaaaacccaattagaagaagtagcaaaacaatacaatcaagagcaccctgaagtatctttagagattataaccgctcctgaggggtcgtctgcatatcaaaagctgatgtcgatgtacggctcaggaagtccagcaacgatgtcgatgcttgacccgggcgacacgcagacattcctggataaagccgttgatttaagtaaagagaagtgggtagccgatacgatagaaaatggacttgatgcagttaagaaaaacgatgctgtgctgggattcccatttgcagtggaaggctacggattaatctataacaagaaagtattggacaaggcaacagggggttcttttgatccttcttcggtgaaaagtagaagcaacctgaactcattaatggctaagattcagaagacgggagtagcaccggtcatgctttcaccaatggactggtctctcggctctcatcttttagctctgtcttattctgttcaacctggggggtttccggagtttgttaagggtatgcaggataacatagacatgtcccaaaataatgtaatgtctggatgggtacaaactttagacttgctcaaggataacagcatcaataagaattcgcctttggacagcacgtatgacgatggagccaaagcattaggagagggaaaagtggggctttggtttatgggaaactgggcttgggctgggataaagagcaatgatacagcaaatgaggaatacggttttttgcctcttccgttaagcgataatacggatgaccctaacaatgctaaaattacagtcggtgtaacaaagtatattttcattgactccacagctaccacacctcaggagcaagaggaagcaaagaagtttctgaactggctggtatacgacaagtccggacaagattttctggtaaacaaggctaatacggtacctgcgttcaaaaatattgatttagagcctgccgatcctttgggacgatcgatcaagtcgtatatctcgaccggaaagacactgccgtttatggcaacccttccacctgatcatgcggccatcacaggagcatctatccaaagctacctcagtggaaagatagataaggctgagctgttgcgccaaatacgcatatactggaaagctcagcagtgatgatacgagaccagttacgggaggaagataaagatgtttaaattaacgttaaagaaaaaaataattagtgcagcgctcatactggttatcgtactgtccctttcaagtgttataggcgtcattaagatgtcggaaatgggtgaggcttctgataaggtaaataacaggtctttacccgcggttattcttcttcaaggtatggataagcagattacagaaattgatagactcaccgttcgattgatacttgaagaggatgcggctgttcgcagcacttatcaagaagaattaaccaaagctacagcttcaatggataagagtgtaaatgaatatcaaagtttagcctcgacagtagaggaaaaagaactgttcaccaatttttatggtcagtgggcaatgtatcttcgccatctaaaggtggtttccgctgctatggaagaaaacgacaaagtgatggcctacatgatcattcatggaaattcttctatttataaggcagcattagacaatgtaaataaactgaagttacttaatgagcagtacgctactgatgccgctaatcaatcgagtcaatcttaccattcaggtagaattttgatgatttctctgactatcatatgtacgatcctaggaattatcggttcttttttactggctcaatcgttcactaagcccatattaaagattgcggaacagataaagctggtaacgaggggggacctgcaagtggagccccttagagtccggtcaaaagatgaggtcggggaactggcatccgattttaatgaaatgtgcgattcactgcgcaaccttttaaaggaagttgtggataattccttactggttgcctctacggctgaacagttaacggccagtgcggaacagacaagcatcgctaccgagcagatagctataagtgccacacaagtcgcagagggatctcagacacagcttgcagatatagctgaaacgctgaattacacggtagacgtttctaaaagtgtagacaacataaccaatcgctttgttcatgtggctaatctcacaacccaagcacaagaaaaagcaaacaacgggaaaacccaaatgtcttcgactgtcttccaaataagagatgtgcataccaaggtaactcaatccgctgaagtggtaaatattctaggcgaaaagtcggcggagattaaacagatcacagctatgatcagtgatatagcagcccgaaccaatttgctttcactaaatgcgagtatagaagctgcaagagcgggagagcagggaaaaggatttgcggttgtcgcttatgaagtacgcaatttatcggcacaagcaagtgaagcaacgggcaagatttcttcgctggtcaacgaaatcacattaagaacagatgaagttgtggtttcaatgaatgaaggtgttcaatctctgaatgaaggcatgatgcttgtcgaaggtgtaggtaacgttttttctgagattgtgggtgccgttgaagaagtgggtagtgaggtggacacggcggctttagaagcaagatccgtaaatgaaggaaccgtttctatggttgaatcgatgaagaaaattgctgaaatctccgaacgtgctgcagattctactcaaacagtcgcaagcgtagtcgaggaaactaccgcatccatgcaggaagtgtctgcaggtgctaacatgcttgccaagagagcggaagagatgaatcaaacggtgtcggtattcaagatttaaaataagcttcaaatcaagtggagttaagagcggcagccttggacgagaaaaaaagtcttagactgccgctgttttgttaagctcaaaccattagattacgaatgaacggcttcagcttttttggctgctcttttcagatcctgtttacgacgttcctccagataccgctccccattcttcttgtctgctgtcagtgtaaagcaggatatggtggtgaacaggcctgcaatggaacccagaattacataagttatcgggaaattcaatacttcatacatatgtcccacaatgggcgagaaaatggaaaccaccagggagcccataaataaatacagcaggtacatggtggaggacaagcgctggtcaaagttaacggtaatgtatttgaagatggctaccagaataagcggtttctccagagagtgaatcatcttcattgcagctacccatatggaaccgaatggcaacgaagagccgataatacgcagagacataatcgacccggcaataattaatgcccatttggcggtcgttttgttcacaaaccaaggggtaacgaaaaggaacacaaattccaggaaaacctgcacagcgcttaaatcaccgaggaattgatttccttccgctttggaactgaactgcgatacgaagtatgtggcaaactgctggtcatatacctcatagatttgggtcacgccaaccatgaatagcataagaaaccagaactttttggtacgcacgagatgcagcacatcgagtagcttcaacgattctgttttctgctgctcctgtccggaaatttcgactttggtcagaaagatgcagatcatggcaacaacggcagataccgaggcaatccagaaggtcaggtttacattgatattgatgacccgtcctgcaacaaaagtagccgccgcccacccaagtgaaccccacatacgaacccgtccgtattcaaagccgtatttacgcgaaactttgtccatatacgaatcgacgacaccgttacctgcattaaataccaggccgataaatagcgcaccaacaatggcaccaatgacgaactgcgtttgaagtaatggaccgtacacatagataaaaaagggtccgacgagcaaaagaattgtaaagagtatgtacagcagatgttttctcagacccagcttgtcggataagtaaccgaacaggggttgcataatcaaggccacgattgagttagccgcatatagaaatcccgtgtaggtttctgaaattcccaggctttgtcccagccaaatgacaaaaaaagacatggcggcagaccatgtaaacagataagcgaagttaaaaatactcagagaccaatagttgcgttttgccaaattcatcatgtttaagcaccccttcaaattgtagccgctcaatgtgttgccaacgtcaatatgtattgtctgtactattaattgtaaggattattcactcgcttccatagggcattttcccaagatttcctgtgcttatttcaatcagttgagaattcggataaaacagcagatcctgatatggattaaatgggggctcaaactattttaaatatgttgaagaagaatagtactatatctacatcttgtaagaaataagtcctaagtgtaaaattctcttatagttcattaagctcactaagttcattttgcaagtacaaagttacttgaaatactgatcgtatatagagtattgtgtaacgatgagttaagacgaaacccactcatcctaaaggcgcgggttatcactaggctctattaacatatattttataaattaaaaagaaaacgaataaaacaaaatgttgtgagttcgtagttggaggatttattatgtcgaaaagtgtttcttcgtcctttattatcattataggctcaatgctatttgccttattttttggtgcagggaatctaatctttccacctatgcttgggcaaatggctggaaagaatgtatgggtagccaatgcgggtttcttggttaccggagttggcttaccattactagccgtcacagcctttgttttttcgggcaaaagcaatttgcaaactttagcgagtcgtgtacatcctgtattcggccttgtctttacaacaattctttatctggccatcgggcctttatatgcaattcctagaaccggtagtgtgtcatttgaaattggagtaaagccttttttttctaacaatgcagatcatcctgtcgcacttgttgtatttactattcttttttttgcagttgcatgcttgttatcgcttaatcctacaaaaattattgatgttatcggaaagttcctaacacccattaaattgacattcattggattacttgtgattgtagctattattcacccaataggaaaattccaagaacctgcggaaggttatacatcgaatgtctttttcaaaggctttcaagagggttatttaacattggacgctcttgtagcctttatttttggaattatcattgtgaatgcaattaaggatagaggggttactacaaaaaaagagttgatgatcatttgtgccaaagcgatagcaattgcggttatactcttagcttttatctatacgtctctttcatacatgggagcttctagcgttgaaaaattgggtgttttgggaaatggcgctgaggtgttagctaaggtttcctcctattattttggatcttatggttctattctattaggcttaatgattacagtagcgtgtttaacgacaagtgtggggcttatcacttcctgttcttccttttttcatggattatttccaaaaatctcttataaaagagttgctctcatgttatctatatttagtgctcttgtagccaacataggtttaacacagcttattaaggtttcaacgccagtattaatggcaatatatcctattgctatttctcttatatttttaacttttttacatcccgtatttaaaggaaagccagaagtatatcaaggcagtttgatattaacctttatcgttagtttatttgatggcttgaatgctgctggaataaaaattaatgtaattaatgactttttcactcatcttcttccattatataatgtagggttagggtggttaattccctctgttttaggaggtgtagctggctacatatttactaaattaagaggaagaaaaataattttagtacttttgaagcccaaaaagaataaatgatttaccctatggcatattagtctgttatataagggacagcaagcgcctgatctgcttcgtgctgcttacggtactgcgaaggggtcaggccgttccattttttaaaggtcgcaataaaatagcttaaattgtcaaaaccaacatccagcgcaatatcaaccactttgcgatcactttgctccagcaacctgcaagccttctgaatccgatgatagttgatatattctaccgggcttttctgaaccatctgcttaaaaaaacggcaaaaatgcccctcactcattccaatctcatctgcgatctcccgtaaacgtataggttcatgagcatgactattgatatacgccagcgcttttttgatccgttcaactttgttgcgttgacccgccataatcacatcctctccgttagcaggggtcatgtgtggaaacaggcaggcaattatgctatagagctgcgccttggtcgccaattcacgggcagacgcattctgctcatggctggtgataatgtgtcgcaacgcaaccagcacctcctgctcccagggctgcacgcctcgaatgtgagggggagggacaagctttttactgataaatgggtcaataaactgcgtctgtaccgtatcctgcgtgcggctgtgtagcatgtctggatgaaacaccaccgctgaaaatatgcagcgagggcttttttgtaaataaccggcgtgaagctcgccgctgttgacaaaaagagcttcaccttcgttcacctccgtatagaccatatccgtctgaaaaatggcgcttccctgctccactacgataaactccatctcttcatgccaatgagactccagtatactatttccgttcaactgctctacgctcggatatacgctgactgggtacatgggattgccgtgaatgcggttttcccgcaacatttccctttgcatttcaacgactcctcttctgtaaactgatttatatagaaaacatcaaaatattgatacaatacgtcaaaataaacgaagtaaacccttacataaatcaatattattatagtaaggatttcgaaaaaatccaacaagcgatttgggatcaagaaataaagattgaagcggaggaagtaacagatgaaatttactgatggctattggatggttcgcaagggctatgaaatacaaaatcctgctgatatccgtgatattgtgacggacgatgcttctatgacggtatatgcagcgacccaccggatcgagcacaaaggagatacactgaacggagcgttgctgaaagcgacctacagctcgcctatgccgaatgtcattcaggtgcgtctgaaccaccataagggacgggtgcatcaggggccaaattttgaaattcacaccttgccaacagaggtagatattacagtggatgaggacgcagcggtactgaaaagcggcgatctgagtgtgcgagtcggtcgtgggaagagctgggatgtaggcttttatgtcgaggatcgtaaagtcacaggcagcggacatcggggaccaggctatattacagacccgcaggatcagccttttttccgagaacagctggagctgggcatcggtgagtacgtatacggactcggagagcgtttcaccccgttcgtaaaaaatggccaagtggtcgatatctggaatgaagatggcgggactagcagtgagcaggcctataaaaacattccattttatctttcgaataaagggtatggtgtgttcgtcaaccatccggaaaaggtatcctatgagattgcatcggaaaatgtatcaaaggttcagtttagcgtctccggcgaatcgttagagtattttattattggtggagctaaccctaaagaggtactggacaattacaccaaactgacgggtaagcctgcattaccaccagcctggacctttggtttgtggctgaccacttcgttcacaacagattatgatgaagcgaccgtgaaccattttgtggacgggatggctgagcgggatctaccactctcggtattccattttgactgcttctggatgaaggaataccaatggtgtgatttccagtgggatcaagatatgttcccagatccagaaggcatgctgcggagattgaaggctaagggcctcaaaatctgcgcatggatcaacccgtatattgcagaaaagtccattttgttcgatgaaggcatggagaatggctacctggtcaaaacagctgatggcagcgtttggcaatgggacctgtggcaggcagggatggggctggttgacttcacgaatccggctgctgtcgcatggtaccaggataagctgaaggtgctgatcgatcagggcgtggactgtttcaaaaccgactttggtgagcgtattccaacacatgtagtttatcatgatggctctgacccaatgaaaatgcataattattatacgcatttgtataacaaggcagtgtttgaagtgctggaggaaaagctgggtaaaaatgaagcagcgttatttgcacgttctgctacggccggggggcaacagttcccagttcactggggcggagactgctcgtcgacgtatgagtcgatggcagaatcattgcggggcggattatcacttggcttgagcggcttcggcttctggagccatgatattagcggctttgaactaacggctgcgccggacttatacaaacggtgggtgcagtttggacttttatcctcccatagccgactgcacggaaacgtgtcgtaccgtgttccttggctgtttgacgaagagtcagtcgacgtggtacgcagctttaccaaactcaaatgctcgctgatgccacacctgtatgcttctgctgtggaatcctcggtgaagggactgccgatgatgcgggctatggtgttggaattcccgcaggacccaacctgtgcaacgctcgatcgacagtacatgctaggagattccattttggtagctccgatctttaataaagaaggcagtgtacagtattatgtaccagagggtcagtggacgaatttgttaacaaacaagagcatgtctggtggtcgttgggtcaacgagtatcatgattttacaaccttgcctgtgctcgtgaagccgaacacactgttggcaattggtcatgaggacagtcgtccggactatgattatgcagatcaagtggagcttcatttgtttgagcttggagaggggcaacaggctcgaacggttatcgtgaatacgtcaggtgaagaagagctaacggttactgccagccgcaaggattctgttattacggtgaaggcagaaggtgctgttaaaccatggtcgatagttctgcgtggtatccacgaggctgttcaagtggaggaaggcagcagccagtcgggagaacagggtgtaatcattacaccagcttccagcggacagcaagagcttacgattcacttgggctaagtaaggctctagatagtggatgaagtatgtcataatgtatcgattatatgcaaaaaagggcttgcctgatccaacaggcaggccctttttgatgcagatttttgctagagccagttgcaacttttagctcggtatctattccttatccattctactggagtagcagcggtacaatatactgccgaaaaatatccacaggagcccgtttctttttgaatttatcagcggtaacgataacaaccatgtcatacgacgggacgacaacaatgtattgcccaccgaagccgagagcgtaaaaatagtccctttcagttcctgtctctgtttcatctgaaaaggaagaagtccaccagtgccagccgtaaaatgccttttgtggtttggcagcaggaagaagcggacgggttgaatatcgaactgtctctgtttggatgatctgccgtccttcccagcctccttcgttcagataaagccgcccgaatttgagcatgtccatcggcctgagatgcagtccgaatccacccgtatgcgtgccctgaggatcggtctcccaacggtagctttcgataccgagcggttggaataattgctgctcggcaaattcagcaattgtttgtccagaaacattacgtagtatggtggccaaaagttgagaacagccagaactgtattccattcgcgtccctggcacatccgataatggctgtgaaagcacaaattgcacccagtctgacgttttgctcatggtaggaaaagaattttgcccgccaaattccgtccagttaaagcctgcagacatcgtcagcagatgttcaatcgtaatatcacgctttcgagaatcactatctgtggccaactggggaaagaattcgaggattggcgtctccggtttcggtccccgttgctggtccatagcgatactaactaatgcagaaatcacgcttttggtacaggaatttattttatagagttcgttagcaatttgaggttcacgataataattcatgatcatgttaccctgctgctcaataaggcagctgcgggtttccaactcgttaagcacgtgaataagtggtttgagttccagacttttcatgcagttcctccttgaggcttatggcataccaatacatagtatatcattttaatagtctataattcgaaggctacaaactgaaaacagttcatttacctaattttgaatttttttgttttttgatattaaaaaaaatatatatgttcactgaatagacacaaatatatttaaaaatctatacactttttctgtttcattcaaaaaaacagtcaaataaaacgatatatagtaagttggacattttattcagaaataactgggggaccgattcatgaatttaaccattaaggccaaaatgattcttagcgcgatactgattccgagtgtgattgcagccatgctgctgaccaattacattttaagcgtacatagtgagaatgagtacaaggacattatgaatcgtgaagaggctattgcgtataactcgaagtctcttcaatttttgttaaacggtatatctaatgatgagcgggcatatttgctaactcgtgacgaacagtacgggcgagagatcggaaacaagcagagtgaagttgcaaagttgctacaggagacagaagctctgcttagtacaggtaatgaggattctaagaaaaagatgactgatctcaagacgggaattaatacctatatgaatcaagttcatcgcttactgactacagcggggtatcagagtacaagagatgatgctttcccgccattttctgatttgctcgatgattttgaaaacgaacgggtgttgcgcaagcaactggataccaaggtagtagcctttgtcaaagctcaagaggatatggtgacggtgaaagtacagcaagcgcaccaaacgatgacgaatacatccttgattacgagtgttgtaggacttctagttatcatttacagtatttttcaatccatcgtgctgattcgttccattcgtccattacaccatatgaatgagcagctgttggaaatgtctgaaggtgggggagatttgcgtagccgactggatattacgtccaaagacgaaatcggtatgattgcaagctcctacaacaagcttattgagggattccgcagtattatagtggatgctcaagatacggcgcgtacattaaccgtaaccgcagagcgggttagcgtaagtacagaggaaatgaatcaggccaatcgtcatacttccggtgtaatggaagagctagcggctggtatggagcatcaggtcgatgatattacacaaactacagataccgtgaaagagctagcccacgaactggagcatattgcagctacgagccagcaggtgtacgagttatctgatacagccgctaaagatgcagaagcaggagaacaatctataggtcaggctatgcgtcagatggaaaaggtaagcgaaagtgtagacagctctgcacgtgctgtgcgttcacttagtgaacaggccgaacagattggcatgattggagctgtcattaccggaatagccaaacagacaggaatgctagcgctcaacgcgtcgattgaagcggcaagagccggagagcaggggaaaggatttgctgttgtagcctctgaggtaagaagactggccgagcaggtatccgtttcagcagcagaaattacacaatttgtgcaaaatattcaggagcatgttggaaatgtcgcttctagtatgcagacaggtacggttgaagtgcagtctggagtaaaggtcatgcaatccgcagaaaccgcgtttcgtcagattgggagttccattcaacaggtcagcgaacagattcatagtgtaaatcggtctgtagaacaaatgtccggcggatccgagcgaatggtggaagcagtagaacgtattcgtgaagtagcagagcagtcggcagggggaacccagagtgtcagtgcggcggctgaagagcaactggcttccatggaggaaattgcgtcttccattcatacactggcggatatgtcgcaacttctgaatgcaagggtcggtggatttaaagtgtagccgcataaattgccaccaatgtaaacacaataacatctgttgaacgaatcagaacagctgtgttattactttgcaaaggtggtaacgggatgcaacaaaataaagggaatctgcttgcgttaggttccatcccgctgatgatgacgctgggtaattccatgctgattccagtcttaccggaaatcggacgtaagctacatgtaagctcttttcagattagcatgttgattacagtatatgcggtggtggccattttactgataccgattgcgggctatctttccgaccgatttggccgtaaggcggtgattgttccctgtctgattctgactgtgattggaggggggatttctgctgtgggagcatggctgcttcacgacttggcagcttactggaccattattgcaggccgtctacttcagggtgcgggagcggcaggggcttttcctatagtcattccacttgtgggtgatctgtacgaaaacgaggatgaggccagcaaaaacctaggggtagttgagacctacaacacatttggtaaagtgttaagtccgatactcggtgccgcgttaggagctgttctatggtttttgccattggcggtgattccggggctctgtctgatttcgcttattttagtgctttggctgatccatgtgcctaagcgtaagaagcaaccgattatgtttcgagagtttgtgggtaatgtgaagcaggtgcttgccgaaaaaggacgctggctctatgctatttttgctatgggcggtatttgtatgtttgtcatttttggcgtcctgttttacttatctgacatactggaaagtcgttacaacctccatggagtatggaaaggttttgtgttagccattccgctgatttccctctgtctgtgctcttatgtaggaggcaagatcatcggcaagcacaaaaagcgcatgaagtggatcggtttcagtggtttggccgtattgacgatcagctttgccattctcggatttttccaaaatatttatgcggtgatcggattgtttacgttagggggcggcgggattggcctcgcacttccttgtttggattccctcattacgaagggaattgaaaaagaggagcgcggaaccattacttcgttgtatagcagcatgcgctttgtcggggtatcgttaggccctccggttgtttcactgctgctgggtcgcagtggacatggtctgctttttggcgtgatggccgcagtgggaggcattgcagctatgctgatgctgtttgcggtcagacccaagcaggatgaacccacagatgacaaatccactgaccctatgaatgtggataaggggctaaccgatgtgtcccgagaaaagcctctttctcccaagctaagacgcaaagctcctgtgaaataagaaataacacccgttgtccatgaaattatggcaacgggtgtttttgaaaactgagcaagtataaactaatattcatttgtatatcatagacttacccttctagaggggcatgtgtcttaggcttacggcttgcgacgatttgtatgacatagatcagtaagaacagtacaataaacagcgaggagaggcggtacatccacgcataatcacttgctttggcgataatgccaagtataagcgctccggctgcaaccccaaaatcgagggaattgagaaacattccgtttgccatacccctctgtttaggagacacgacctgaatcatccaagtttgcagggtcggctgcatgacaccaaacccgataccgtagcaaagagcagacatatacatgaagacatcactgtgcgcgtaggatagcaggatcagaccgccaattaaaaacagggagccggggatgagcagtgcttttgccccctttttgtcataaatacggcccgagaagggacgcacgatcagcacggatactgcattaaacaggaaaaagtaggcagggtgcgccagatttgcttcatccccgtaaagcgccataaagccgagtaacccaccatatgtgatagacatcagcatgttcaacaaggcgggaatccacaatttacggttaaatgccggttttcgcccttcttccaaaggaaccataggtggttcgatgtgccccttaggtagtgtacgaatcagccagtaagccaacgggaatatcacaacaattacagctgctgtcgtataggcaagcaggttgaaactcccgtattgcagcatcgaaatgccgatggttggcccaatcgacatcgctagactggtggacagactaaagaaacccattccttcaccgagacgtttgggcgggatgacatcagaggccatcgttggaaaggctgtactactcataccgaagccgatcccaaataacatccgcatgagcagaagcactgtaatcgtaggtgaaacactgtaccccagcgttcctgccaatgcaaacagtaggcccacgaagatcagggtactgcggtgtcctttttccagcatacgggctgaaaagagtcgtgctgcaatcgcacttaaagcgaataaggtggtaacgagactcacctgaacggaactagcgtggaatgtatttttcacataagaaggaatggaagataggatcatctgtaattccaggaataaaaataaattggaaaccgtaagaacgataaattccttggtccaaagaggttgcttgccttgttgcatattaatcgttctctccttgtttctctgattcggtcatgttggcgtgaatttgtaaaagagtctggcggaattgcttcagatcggccgaggaaattccttttacaaaatcgtgattggcatcacgttcgacaggaagagtctcctccacaagctgtcggcctgcttcagtcaaatgaagcaaataggcccgacgatcctgtgggctattgacacgccgtacccagcccttcttgtccaacaaatcaataattcgagtcgtggtaggctggtccttcacggccttagctgcaatttctttctgatttaaaccctcagcctgatagatttggtacagaaccgaccattgttctggggatatatcataaggtttgaggcgctgcaagagctgctgactcattttgcggtgagtaatcccgagtaacatcccaatggaacactcggaaggcaagttattcatagatactcctttctgtttcccgtacataaattacttcgaaattaattagttgttataacaattatatgaacaacaagttattttgtcaaagaaagttgttcagcttttgggttctgccatcactaaagcaaaacaaaaaaaacagcccgtaaaatacgggctgtttgggttgatatagtatcgttttgccatgactggaaaattaagctttaggtacagtttcccagtccttcaggaagcgttcgataccgctgtctgtcagcgggtgtttccacagagaagggagcaaggaacctggaatggtggcaatatgtgcaccagacagagcagcatcttctacatgcttaatattacggatggatgcagcgatgatttcggatttcagaccatgaatgtccaaaatttgtctcagctcacgaatcagcttcataccatcaacagcaatatcatccagacgtcctacgaacgggctgataaaagtagcgccagctttggctgccatcaaaccttgagccgcggagaaaatcagtgttacattcgttttgattccgttcttggtcagctcgttacaagcgtacaagccgtcttcggtcatcggaagcttgataaccacgttgggtgcccacttggcgatatcataagcttctttgagcatatcttcagccttcagaccaataacctcagcacttacgggaccttcaacgatactgcaaatctcctgaatgacttccttgaacactcgaccttctttagcgatcagtgaagggttcgttgttacaccatcaaccagacccaaacgttcaatacgtttgatttcttcaatgttaccagtatccaagaaaaatttcatttgatttcctcctcaggtttatataatacataatacatatcacatgcgatgtacaatagttcatttaaatgtagcatattgcacacgttaaacttataattagtatgtattacattcttaattgtgacacattttaaattcgaaaacaagctgtgtatgattaaaatttgatgaattgtcggaagaagctgaaatttaccgatccatgctcgtctataatgtatactaccccactccataaggaggtaatcactattcaactgtctgaaagacagcgggaaattgttgaaattgtccggcgtctggcacctgttacgggggataaaattgctgaaacactgggactgacgcgtccgactctccgttctgaccttgctctgctcgttatgctcgggctggtggatgccaagccgaaggtaggctacctgccaggacgttatcctaaatatgatagtcatatcggcaacatgctcaaaaagctgactgtggcagatatacttagcgatccgattttgatttccggtgacacgaccgcctatgatgcggtgctgatgttgtttcagcaaaatacaggcacgctgatggtcacaggggaggagcaggagttcattgggattgttacccgcaaggatttgctgaaggtcatgctggggcataccgatcttcacaccgtcccggtgaccatggccatgacgcgccgggcccaaatgacgacgcttgctccagaagacactttactggaagcgatattgagactgattcggcatcaggtcaattgtcttccagttttggacgagcaatgtagctcctcaactccaattcgggggttggtaggacgggttacgaaaacggatatcatgaatgccattctgagcttgacagaagaaaaaacgtaaaacattgaataagggggccttgtatgtactggttggccatgctgacgatgctgattgaccatgtcggacttgtgttttttccgacggatccagcttggagaattgccggcaggcttgcttttccaatctacgcgtacgcgctgtatttgggatatactcatacccgagacatacggagctatatgctccgtctactcggactggctctgatatctcaagttccctatatgctagcgtttgatgtgcttagaccgaacgtaatctggacgctattggcctcattgttcgcgctggctgctgcatcccgcttgaagcactggacggctgtaatggttctgtacgtcctttcagctctggttatggagctcagccagatggattacggagcctatggactgctgttggttctcatttatcgatacacccgttcatatatgatgattgcagcccattttattttgaacgtagtgtatgatatagtgcatcacgcgaatctccaacactttagtctgctgtccagcattctgatcgtatgttttgcaactggagaaagcggattttataataaggtaccgcgctggttgtggcgtagcttttacccggtacatctggctgttatcgcggcaattcgtatctggccctaatctatatcttatacagcaaaagaacctttaaaaccacaacataaatggttttaaaggttcttttgttttcctttattaagctagccaacgtttaggataccttgttgggaccttgggcaaaaggaagtgggcgaaggggagcaccttccttcatgtattgcaccaacacttctggaatattatgtattccacctgcattgacgcgatagccgtttgtttgcccgggcgagttaatcccccgtttcaccgtgaacgtaacgtcaattcccaaggaacggcaaacttccagcgtctccttggtatacccaccataagggaaggcaagtacattctgatcattgtgtagatgcttaaacagcttcttgtcagccatgcccaagtcggtataaacccgctgtttgaattcattctcggtttccattcgccccagctttttcgaatacaccggacccatcagaagtggcttttgtttggtgcgcgctgtgttggagtatccgtaagcatgctggtcattggtatggttgtaaaaatcaataccctcggcatgcatctgatgaatttgatcccatgtcagcttaggaattccaatatgtttgggattgctgatcgtggacgtgataagaaaattggttgccggtacctggtactttttcaacacaggaaaagtgtccgtataaaaggactcatatccgtcgtcgaatgtcataagtactgcattatcaggaaccttggctttatgtaaaataaagtccgtatactctttcatcgtgatccagtggaagccgttagctttcatttcgtccaactgcctcgttaaattactaagcttgagagcgccgggatcaggtggagtcttggtcacctcatgatacatcaggacaattactttgttttggtaatatactttatctggtgtaggcgtcagtgagaataaatggcgtaccagtcgatctgcatgagctgtacgtgtacgatgagtccctttaactgtaggggtgtggtatatgctacgtgcttcatacaccaaaatccctaaaatagccaacaaacttatgattagcaacgttcttttaaaaaaagtgtgtttcattgaatgacatcccccgcatgcaaaaaaattctgaaagtatagaggtttatactaaatatgaaactagcaaaatctagtctatcataccgaaaacatgcgggggaaatatcacaactttgttacctctgtgttgcttttacagataccgatgaagaggtcgggaagtaaccgatctcgacggcatgctggatcatgttccgaataaagttaaggtcggttaccgggcattgaacgccagcttgttccagcagagctgcggttacagagcatccgtaacggtaagctgaatccttggctccgtcaccttccagttgtcccatagcaaggtgaagggcatcctcctgaatgccggaagacggattcagcagccaagcgctgtaatcgtcaaaaggcagagtttctactgcgtaaccgagttggtttaccatagcgatcagttcatcatatggcagtgggttcggattgcagatatggaaaatgcggtttgcgcttttttgatgaacggacagctctacgatagcacggctggcgtaatcaatcggtgtgaagtccgtatgccaatcggcttgtggcgctttgcccagcagcagcatcgccttcatcatacgataataagcattgctgtcgatatttcgctggaagcgtccgttggccgaatgggctgtcaaattgcctgcgcgatagatcgagacaggcgtacccgcttgagctgcttggaacaacagcttctccgccgagagtttactgttcgtgtacaggttgtccacgttcagttcttctgggaaggcagaaagctccaataccgactcccattttccttcgttagcaagatcctccggtattcccatagtagagacatgatggaaggatactcctggcttggcttgagcgattttcagcagttccagtgttccggttacattcgtgcgatcgaaggctaccgaatcaccaaaatggcgaacgtcagcggcgctgtgaatgatgccgtcgatttggtgctccagcatatggcggtcgacggaagagagacccagatcagcttgctccagatccccatagacagcttttacccgtccttcgatcaagctggagatatcttgtccaaaatatcccgtcaatacggactgaatacgctcgataccggatggaccgtcctgagaagggcgtaccatcgcgtatactttggcttctgtccgttgaagtaggtcatacagaatgtgcgagcccagatagcctgtagcaccggtcaacaaaatcacgcgcaagtcgcggacttcagctaagtcagaagcaccagacaactcaataggatgctcattcaagtccattttttcttgagaaatcgcgagtggcttgcgttgtggcgtttgttccgtacctaattgttccacatattcagcaagctcgcgaacggttttgtagcggaaaaaatctccgatgcgcaacgcgccatagcgcggttttagaatagccagcacatgaatgacacgaagcgaatcgcccccgatcaggaagaaatcatcggtagcgccaatgttatttttaccaagcacttgagtccatgcttcggcaatgagtgtttcggttccttctcggagaggttccccgccaaatgaaagatcagacgcttcgggaagtggtcgcagggccagctttttgcgatcgatcttgccagttggtgaaattggcatggcttctagatgaacgacatggcttggtacaaaataagaaggcagcttgcccccaatataagactgaataacgtcttgtggaatggattgtccatccgaagtggtaaaatagccaactaacatgttctgatctgtgtgatctttgacggctactacagcgacgtcctgaacacctggatgtttggaaaaatggtcttcaatttctccaatttcaatccgattcccccgaattttgagctgtgaatccttgcggcttacgtattcaatcgtaccgtctggcagcagcttggcgatatcacccgagcggtacattttttcacccggaacaaaaggattgtccacgaacgattgggctgtacgttctggctgatggagatagccatgggccaacgcaggcgtagcaatgcatacttcgcccggaatattgacagggcaaagcttgttatcatcgttaacgatatacactttgtaattgtaaatcggcttgccgatcggaatattgacgacatgctcaggcacggcaccacggactcgatgggtcgtcgtcgctacggtgcattcggtcggtccgtatacgtttacgatgtcggtatctgtaccgaatttgctttggaacgctcgaacttgtgagccgtacagcgcttcgcctgccacggtaacgatccgtaccttagcgagtttgcgataaccttcgtctgacaagtacgtagatagctgattaaagaatacggtcggcaaaatggtaataatcgtcgtgcctgtacgtgcaatggcttcagcgaattcttcaacagatacacgttcttcggcagacagcaagtacaattttgcaccgtaaaacaaggctccaattgtatcccaaacggatgcatcgaagctgtaggttgcaaattgggtcaatacatcctgaggtgtaatgtcgcaatcgcgttgcacgacagctcctaggttaacgacaccgcggtgagcgatcagggcacctttcggtttgcctgtagagccggatgtatagatgacataagctagatcatccggacttacattaacgtttggattgcttgcagcatagcctgccagtggtccgttaattgctaaaatttcttttaccgtctcaatggaaccgcacagttcagtcgcttgttccatgagtgcggaagttgttaagacaaaaggagaacgcgtgtcttcgacaatgtagctgctccggtcggcggggtgggcgggatcaacaggcacatacactcccccggctttcaggatacccagaagggaaataacggtctccaagcttcgttccatgaagatagtcacgaattcacctttggtaagacctttagataacaagacacgtgcgacttggttagcacgttcgttcaactcacggtacgtgtactctccagtgtgggaagcaatagccggacgatcagggtattgtgaagcagcctcctcaaacattccatgaatagtttgatgctcaggatatttcacgactgtattatttaaagcttcgtgagcagctcgatctgcatctgataatatatcaatggagttcacaagtgcatggctgttggttagcgcgccgcgcaaaagagtttcaaagtattctgcgtatcggacaaccgttgtttccagcaagagtgattgatcatatcggatctgtatttgataagtgccattgtgttcactaacagcccagtccataatacgggattctactccgctgtccgtaggcagatttgccgaaaatgaagtatcggcttgtggttctgcaaggtatgcattaggctcacggagcatctcctgaaataagtctgctagttcatgaaaagtcgtttccttttcaactgtcagcgaagctgtaagcagaccggtttgtggcacaaatgtagaaaaagaaacttcttcttctgcggataggcgatatacccatgcagtatatgctgataggagcaacgcttgtttgtcttccgcagttttttgctgatttaattgttccgagatggacgcttctaactctacttgataagtagaggatgtatgcgtgcgttgtatacgtgcacaatccaagggaactaggaatggggatggggttgtctgtgtgctgttttgtagtaatgaagccattacgctaacctcctgaatgtatgatgtcttaatataaatggtaaactcagtaaatgcctccgatcccttcaaatgcatgaacaggagggaggcattaccgaatgatttacttataaatgttggagcggataaatggttattatgatttggtacggttggtgtctgcaattttgaaataagatgtaatttcttgaagctcttcagacatggacgtcaatttatgggatgaatcaatgatcgaatccaaagaagctttttgctcctccaccgtttgcacaatgtgaacactgttattggctgttttggttacagtggaagaaagatcgtctgctgtcgcggtcatttcctgtgtacccgcagatatttgctcagtagcgctggaaacttcttggatttgccatgctacatttttagttgcttgaagaatatcattgaacagcacgcctgcttgtccggcaacgacgattccgttttgaacttcaacgtttccttgctccatcgacttcacagcttgtccgatttcactttgaatttcttcaatcagggacgtgatttgtttggttgcatccgcagattgttctgccagcttacgtacttcactggcaacaacggcaaagcctttaccttcttcaccaacgcgcgcagcttcaatagaagcgttcaaagcgagcaggttggtttgactggagatgcctgaaatggtactgatgatattgccaatttcctgcgaacgactgtccagcaacttgatgatacgggaagtattggtgactgtatcggtaatcaagtgcatttgggatgataccttgcttacaatctcgttgccttcgttagaacgtttctctaccgaattggcttcttccgcaacattggaagaactcgtggcaatattttgaattaccgaagccatttcagccatggcacgtgcactatcgcctgttgctttttcctgcgaacggatattctccgtgatttcactgatgttttgattgatgatgttggagttgattccgttttgttcgcagattgcgagtagttccttggcagattcattgacttcatcagttgtctgcttcactttggtcataatgctgttaatatgacttaccatatcgttgaaattctgatttacgagccctaaatcatcatgacctgcatgaatttggacatccagatttcctctgcttacttcactgataccgtacatcagttgcttaatcggggacagcgtgcgcttcacaacccaatattgaagcgccaggcagatcagtaggaaaatcactaaaatggtagcgccgctaatgagcagcttggttaagccggcaggtacggcaccagcatctgcatcgactgcaaaatatgcaaagattttgccacttgaatctttaatcggagtcatcaaagtcgtccatgtaccaaaagaatcatcgtagaagctagtgaatgttggtttgccactgtccaacataccggttacgccgactgccacgacattgggttgctcgtacatagagccaacgagcagcttatctttttcaaatgcttctctgagatccgttggcatcgctacaatagaagttagattgccattttcgagctccgtcccgaatatataggcatgagagatattcggattggtcgccatgatgttatctaggtacgtgcggagtttggtttgaacgggtccatcatagtttttctcttgaaccgcttgggttacttcatcggaattaatgccctgggcccacttcaatgtgattttttccacttgcccatgcaattggtctatcaaaatcgtacgttggatcaaatagctggacacaataaggactagcccaatcaatacgatgttgaagaaggataataataagtttttggtgaagaatgataagctactccactttttcaaaatgttccactccctggttgtatttttgtatatggtgttgaaccgcttatcgaatgagataatcaagttccccttacaaacataataatcgagataatagacccttgaattttatgtaataggtcttaagtccttttgcagacaagtatgatatccctatatatatgtcgtacgaaaagcccttgaaatgaataccttacacaataaaaaattaatttttaataggtaaacgctgtctgtgattcagtatattccaatttatacttctacttgaaatttgacttcattacagtccataagcaactattcaacagaaaccatcatactttataatagagtcaaatgcacttatcaatttgggacatttttcatatttaacgttggaaatgcttgatttatcgcggtttttgtaaattgtttgcgaaatgagtccttatatctatgcaaagagaagagggataagaagaatgtccaagcttacgattttaaaggttgagagtcatcacgaggatttgcatgagttgattcaaaggctggatgaggacttgctggaaaggtatcctgccgacgaaatttacttggtcgattttaccaatccgaaagttaaagaaatggttttcgctgttgtgtatgtggacgaaaaaccggtggcttgtggagggcttaggcctatagatgcggaagaaatggagctcaaaagattttatgtcgattcctcttatcgcagacaaggaattgcggtgagcctattatcttttttggaagaggaagccagcaaacggggagttgtaaggattaaactggagaccggagcggctcaacctgaagcgattgctctctataccaagcggggatacgaacctattgaacgatttggggagtatgaacacgatgaaaacagcctgtgttatggtaaaaagctgtctctgttattataaagcgttctcttataaaatggatgatgatcaatactagcctatatagcgggagagatgataatgaatttgaagcaaaaagcagccgaaaaagcagttgaggcgattcaggacggcatgaaagtaggacttggtacaggctcgacagccttttgggctattcaaaaaattggtgagcgtgtagcgcaaggattacatatacaggctgtagctacatcccaagcttcggaggatcaggccagggagctgggaattcccatcattccgtttgatcagattggaaggcttgacgttaccatcgacggtgcagacgaggtgaacgagcagctggtgctggtgaaaggtggaggcggagccttactgagagagaaaattgtggaaagcaatagcgaccgattaattattattgtcgatgagtccaaggatgtgaaggtactgggtgcatttcctttacccgttgaggtcgtaccctttgccagtgaatggacgttggaggctttgcggcagacgggctgtaaagcggagtggcgtatgaaagacggcgagcgcttccttacggataacggtaattatattgctgattgtcgctatggtacgattgagaatccgcaggagttggaaatccgcttgaatcaaattccgggtgtagtcgataacggactgttcattaatatggcggaccaagttattatcgcacgggccaatggacagatcgacgtccgtaacaagtaatgtttaggacccgcctgcttcatcatgtggcgttgatgttattgattttatatacagggcttctattatattggatgtttctcggttttggtcgtacattacggccaggacccccgtattcgtataatattgttccgtttgatacgatcaggcaatactggcgggcaatggagtcgtttccttttcgggtatggggtgttaatttgctcggcaatattggcgtattcattcccttcggtattcttgtgcctatcatttgggtgtccatgcgaagtataggcagtctgttgttaacgatagtgatcgcactggtcattctagaggtgtcccaaatgctgctgggcgcaggtacaatggatgtagatgacatcatattgaacgttctgggagtattatgcggccgtgttgcctacgtgtttttacgtaagaagttagggattacaacataatcgtcctgctctctggatcagtgcattaagactgactgagagcgggctttttttacataatgaactgtaaccttcacataatagacggtaattcctccatttataggccgtaggagcaggggaaggaacgcttaaacttgacaaaagtgcacaattaagatatcttggaataaagatatgagtaacggaggctgttaatatgtctgtaaaaccagatgatcaggacttagcgcttaatttgttcgttgttctggctcgtgcttataattcggtcacgtcccgtacgaatcgggacattcatagtcatggtttaaatacaacagaatttggagtgcttgatctgctgtattatcggggaccacagcctttgcagaagattggagaaaaggtactaatctctagtgggaatattacgtacgtggtagataaacttcagaaaaaaaacttgcttacccgtcgtgcatcacaagatgatcggcgtgtgatttatgcagaattgactgatgatggacgccatttctttgagcaaatattcccgcagcatcatcgtgtcattatggagaccgtagatggcttatctgtggaagagaaggagcaggctattcatctgttaaaaaagcttggactcacggctgagggacagaagagtaacggatcataaattgtgcgtgtgcaggttaaatctgctttagataaaataccgacttctcggtattttatttttttgtcgtattttgggggagtagggttaatgtagaggcgtaaatcaggtataattatctaatagtcacgtccggaacaaattcctagtacctgtttcgaatacaaaaccttgtcggggaaggagctgtacatgagtatacagcaatataccgcaggtgaatcgctattgatgcaagcaggagctttggctgaattagttacccataagcaatacgaattacagcccgatcttttgcagcgttttggggataacggtaaaataaagacaaaacaggattctatatatagtttgaactatttagctgaaagtgtaatcatgaacagccctattttatttacacagtatgtttcttggttaaaaaagcttctggagggtttcggcataacccaagaagacttgagcatcaatttcagattaatccaggagacgttggtagagcacttcgatcatacagataaagctatggtgctggagcatctggatttggggatacagcaaatagggaagaaagaggagtatgcctcttttattacagatgataatccctatgctgctgacgtggctcaatatttggaacatttactctcaggtaatcgcagacaggctttggattggatcgtccgtttgctggatgagggtatctctattcaacatacgtataaatatatttttcaaatttcgcaatatgaaataggtcgtctatggcatgaaggcaaaatcaccgttggtcaagagcatttttgcactgctgtgactcaatttattatttccagcctgtacccccaatggatgggaaatggaaataaggaacgctgcctcgtggcggcgtgtgtaggcagcgagcagcatgaaattggtctgcgtatgctggctgatatatttgaaatggatggttgggatacgtattatttaggcgccaatgtacctaatcggagtctgcttcaggccattgtgagttacgaggcggatgtggtggctatctcagctaccatggcttaccatgtccatctagtgaaagagttgattgctctcattcggcaagacccaacgactagccatgtgaaaattatggtcggaggcttgccttttaatctcgattcccacttgtggcaggaagtaggggcggacggatacgcaccaggtgcggaggaagcgctggaggttgcaggggacttactttcgctcaggaaataaggttagttatgtgaacctgtagtcattttgtaaagggggccttttaatatgaaggaaccgacagcagaaatggctgtcctgcggaaaacggtcgaacaattaacggatgagattgtgaaaagcaaggccgaggaagaaaagttgctgaatgaattttcatcaatgaacaacgagctggtcaatctgcagcgtcaacttgccaaaagcaatgcggaattaacacggacgaaggaagaagcggtacgggctaatgacctaaagagcacttttctggctgtggttagtcatgaatttagaacgccaatgaacggaatacttggaatgattgaaatgttaggttcatccaaactttccccagatcaacggcaggccatcgatgtcatatgtgagtcagcctctctgttgttgaacatgattaataatctgctcgatatatctaaagtggaagcaggacagatggaactggagatcggaaacgtcagagttcaggcgattatgagccacgttgctcagttgttggagccacaaatctatcagatgggtaaccgtttgagtatagagaccgattccggtgtggcagagcatttggagggagattcggcaaggatcatgcagatcttgctcaatctgttgaacaatgcgaataaatttaccagtgaaggattgctcatcattcgaacaaaattggtggaggaaacaaaagattcccaacgtgttcggtttgaggtgcaggattcgggtattggtatttcaccggaggatcagaataagctgtttcagccttatgtacaagccggtgaaggcagcgcctcccaatatggaggaacgggtttagggctatggatatgcagttcatttgtggaactcatgcagggaaaaattggggtcgtcagtaaagaaggccaaggctctacgttctggtttgaaattcccctcatgaaaggatcggagcaagcagacgaaatggagaagcatgaaaatggtgatttgaaggcatttagcgagttgctgcgtgagcatagtcattctcaaactattttggtagctgaggataatcgggtgaatcggcaggtggtgcaattacagcttaaccacctgggattccagcatattgattttgctgaggatggacaagctgctgtaagagcggcctccgaacgatcctacgcttgtattctaatggatcatcatatgcctctgctgaatggtcatgatgcggcaaaagcgatccgccagcgggaagcagaaaaccagcaaccccctgtaccgatcatttctttgaccggaaatgtatccgaggaggatcaggcacggagccaggaggttggagtgaacgattacttgatgaagccagtaacgattgaaaagctctctgaaaagcttgtaaaatggcttccaaagccggaaaccgagccgattttggatgaggaagttatacgtgaaattatgctgctggacgaggatggcagcacgggactactggagtcattggtcgaaatgtatacgagtgatacacctgccaaaatcaataagttaaatgaactggctgctgcgggcgaagttacaaaagtagtagaggctgctcatgagttgaaatcaggcagcgtgagtctgggtgtcggacgtttgtcctcgttgctgtccgatattgaacagcttgcacgggagaaccgactcgagaatgcgaaagcgaagttgtctgcgctccaatctgtctatcaagcaacgtgttcagaactggaacgttatattcaccagtgctagccaggtttcccccttgttagacttgcatacggaaggaggacgtaagagacatatatgaaagaacagttgcgttctattcacccgctggcctggacgattattgtcggtactatttttgggcggatggcgacatccatgagtatcccgtttttgtctatttaccttaccacccgtttaggggtgtccccctttcatacgggggtgatcgtatcggtcagctcgttggtcggcatttttgccagtttttacggtggatatatttcagatcgaatcggacggcgtaaggtgatgctggtgtccattgcgagctgggcgcttgtattcgttgcttttgcgttggcggaagcggcctgggccttttttgtcattaatgctctgaatggcctgtgcagatccttgttcgagccaacctcacgggcgctgttatcagatgtaaccctgaaggagaaaagactgcttatctacaatatgagatatgcggccattaatgttggggtggtggcagggccgttgcttggtttaatgctaggatctgcatccacgggtacgccgtttatggtagctgctggtgtgtacgcattgtacggggtactgttgttgatccaatttgcccggtatgcatcggatctgcatataggtacaacagcgggagaggctccactgcgaatgggtgaggcattccgtacagccagccgtgacccggtgtttatgccaattttgctgggaacggtattttgtgtgatgggctatgcgcattccaattccacaatgcctcaattcttgtccttatccttcgcagaaggaacccgatggtttacatacatgctgacggtcaacgcggtttgtgtattggcatttcaatatccgctggtgcgactggcaagccgattttccccggtgaattctttgattgcagggaatatatgtattgcggtcagcctgttgctgtgcggtatgctaaactcaggctggatgtttatactggatatggtgctgtttacggttggtgaagtgttattgttcacgatgctggacgtattgattgaccaaattgcagatgctcaatataaagggacctacttcggtacaatcggctttaataatttgggaagcgtgctggctcctttatttggtggctggttgctggatatctatggtcaaacggcgccgcttgccgtttttgttccggttgccctgtcggttgtgattggtattccattccttctggtcgcacgccgccgtctggtgcagcgtacagcacggatcgcggctcagggaggaaaatcggtgcagcaactgtcatcataaaaagggagttgagtgcaggatgaagtcggaagaaaatgcgctacgaatcatacaatatatgaatgatccgcaggtactgcaagacttgcgctatgtgcgagagctgaagttgccacaaggatgtattgccgcaggctatgtacgtaaccgggtttgggacaagctccatggctatacaactgctacacctttaaacgatattgatgttatttattttgacccgaaaaatacgctagaggaacgagatgagtatctagaattgtccttgaaccgtaagcaggccggacgtaactggtctgtcaaaaatcaggctcggatgcatattcgcaacggtgaggctccgtattcctcggtagaggatgcgatgagccgctggccagagacggcaacggctgtggcggttagaatgaatgacaaggatcaaatagaggtcatttgtccgcatggattggaagatttactggatatgcgggtacggcaaagccctttgtttcgtcacacaacggcttttcgtcagcgtgtatttgagaagcaatggcttgataactggccgttgcttattatggagaattagagtgtaatcctaatttcaggatattaaggagagacgacaaacaatgtttaaaaatataaaaacagattcagatcgtgaggaggttctggagctgttaacctacgctgtgctggatcaccctgaacgcggagaagcagctttacgtacctatcaagcctcggatgactggaagctgttcggtgtagaagatgaaggacttattgtaggtattgtcggctttgaggagcaggaggatgggacaaccgtaattcgtcatctggccgtgttgcctgaaaaccgtcatagaggatatgccagaggtatgctgcttacgctcattcaggagcgtaatccgaaacggcttactgtggacacggatgcggagggggcagatttcttccgcaacgtgggctttgccgtctatggatcagaggatttgccagagggtgggcaattccattgtgtatatgaaatagacgaagaataagcgaatctccgggtcccgcgtccctttttctacataagatatgttatgtagaaagagggaggtgagtttcattggcgtaccattacacagcgattggagattctttaacaacaggtgcagggacgttgctgagcggcggatttgtacctatctatcggcgaatgacagaaagacatctccgtacgccagtcagttacgagaatctgggaatcaatgggctgacatcgcaggagttgctgtcaatggtccgcaacaatccgctttttcggtcggcgctcagccgggctgaacttataaccgtaacgatcggcggaaatgatctgcgcccatacatcagcgcccttgctggaggttccggcttgtcgggttcttccattccgcaagcgttgaatcacacaaaagaacatgtgcgccaaattgtacatgccctgtatcagataaagtccggtcagcgtgagccatttatcatccgaatggtgggattatataatccttttccaggggtgagggaggcgggagtatatgtgcgccagtataactcgtttctctatacattgggcggaccaaattaccgggtggcgaacatttatcccgcatttgagggctatgaacgggcactgctttcgttagatcgggtgcatccgaacagtcgtggttatcgcgtgattgcggaagagctgaatcggcttggttatgcgccgttacggtgagcgtgagaggatgctttggatcggacaaagtatattagagaaagaggttcatgatggcagtagcaactgaccatcatgaacctctttctttgcattagtaggcgtgctgtttagccgattaatttacggaataagctacgtacagcccacttgcgctcacttcgtttacggtatttgggcagagagcgatagacggcaatggactggttaaaggctacaatggcctcatccttgcgtcccagcatacggtacatcaagcctgtcagataatagccctcactggaagaagactgaatttcctgaaattgctgcagataatgaagtgacttatttacgtcgcgttctttgaaagcagcggctaaatgcaaataaggctcaccgtatttcacccgcgggttaatatccagtgctttcagtaaatcctgttctccatcctccagatggtttgtgtgtacttcagccgttccccgtgcgttccaatagtctgctgaatcttcgtaacgggattgaatttccaataatagctccaaagcctgatgatatttcttgctttcgatccagatacgagccaaatcgaacttggcagccacatcgttggcgtttagcgtaatctgttggcgcaatcgagcggcattgcgtcttcttttccatggtttactgatgctgggcagtacaccgacaaagctgcgatccaatatatagatcacgattaggagtacgagcattgccaaaaacgggttgccgagcaaactccatagtagagagaaaattaaaaatttcccaatcattttgctccaatcctcctgtgcatgtaacaatccatactttccacattatagcatagtgttactttaagggtcattagcatgatggatttggaaggatggtagaggggagagaagaaacatacttatttgtgatgctcgatgtatagttttagagaaaaggaacctttttttatccccgccaaaaggttgaacagtctgccttatccaaaatattaaactcgatcattttctcaagtaatgagaaatcaacgggactatcccactggatacgtatcaactgcttggtgtgatcatagccagcctgcacaattaactcagaaaaatgattaatccctgccttttcaggagcaacggccaaatgatgtttggctacgctaaagccaataataaatgtgccgtgatccgtaaacataggctgactccacgcaatttttgccattaaatttggaaacttcttggttacccaagccaaaacctcttgcgttcgagcccgatgttgtgggttctcaatatgcgctaaatattctgtaaaagcttccatgttgttccctccttaattaaaaattatatcgttcagaaaagttcctcaaacctatttgtcgttaaaactcctcacagaatggctcagacagattcttaacaacacctatttccaactatatatattttcaaactagatagtcaaaatggtttaactatcattttatcgcagcaacatgtttcttaagaagtaattgtctgttgaaaaatataaaaatatatttagatataaaaaaataccttttatgtcctgttatattcctcagcaagaatagagtacaaatatgaatcatgaaactcgcctttgtagtaccagtgttcacgcatcaaaccttcacgttgcattccgatctgttgcataaccttctcagaagccttgttttctggacgacatgttgcataaatacggtggacagcaagtgtgctaaatccaaagtctagtaacgctcgtgctgcctctgctgcataacccttcccttgataatctggattcaaaacataaccgatttctgcattagtatctttgacatgaataccaacaccgccgatcagggttccattgtttttcagacaaacggctagttcatagtcttgtcgtggctgttcctgctgtgaagctagaacttgttctatatattcctttgtatcttcttctgtattcggtccccaggccgtatatctagtaacttcaggcaatgacgtgtaggtatgtatactttcccaatcggatctgccaatatcacgaatgatgagccggtttgtctcaaattgcataacgattcctcctgtctataatcaacagactctacttagtattttaaaacgattaacatctcaatccaatcttttatgcattcgtagcctttaaacgttagacctccatttaacaatgaacccagaccttttgccgcctgaacgcaaaccgcaatcagaagttaatgaatgtggtactggaatcctcctgttattggctatctggttcgtcctaaaacagcctgcgcgctgtgacgaaacgtttctgccatttatcatcaaacgtgtcaaaatgaacgccgcgttctttggagaaggtatgcagcaatgtgttgttccctgcatagatcgccacatggccgatctccaggccgcgtgcgctaaagaacagcagatcgcctttacgcagctcgttcagcccgaccttccggccttctttagcctgatcgtaagagacacgggggaggtcgatagagagcgtatgccggaacacttcctccacaaatgaagaacaatcaaaggtcgatgtctggccgcttgctgctccgaattcataaggagtaccaaggaatttttctccgtaggcgatcagttcatctccttgtcgttccaccagggatgggctggtataatcgctgtattttggtttagccgatatatatccggtcaggttgtctttagtgcgcacttccagccagagagcattgacctcgcgaatgacatgaaccttttcgtcggctggaataagccgtagggaagaggaagctatcgatgaatccggtttgctgcgcaggttgaccccgaaaagaaccgttgtgaaaaaatcgtccctggaggcaattcggatggtccgggtcaaggcctcccactttactgtgctcccaagtgcttcgcttacaaaacgcagtggaatcatcgtgttgccctcaacaatctgtcctggaacattcagggacagcgtatcgccgtttaaggtggcagcgagttccccgatgcgataggtcagcaccgtgtcgtttttggttgccgttacggttttgtcggatccatcccaggaaagcctggctccttgcgcctcaaacaactggcgcatggggatgagcgttgtcccgtctagcagcagcggctggacggcaagctgaagcgggcggtcatctacataaacggttgtcaccggagtcgtccgtaccgactttgcataagaggggggagcttggagcagtgataccgccagcagagccagcaatactttcttgttgattgtcatgctgttatcacctcattgtgaatgtgttcatctaagttgtacgagactgcctccgattagttgtacaccaaatattggatttattcaaaaaaacaaaacaaacaaaaataaaacaaaaaaatatctgtgttttattattgacatcaaaataaagtaaagataaaattatatttgtgaaatatttcactttagagattgattccataattagcgaggcattaagaagtgaattcttaggaggccgattttttatgagtgcacatgtattttttgtaccatctatcaatcttatgggaacaggatgtttgcatgaagttgggccgtatataaaagaactaaatttaaacaaagctctagtcgttacggataaatttttgatgaagagtggcattgcaggcaaggttacatctttgctggatgatattggattgaactatgcggtatacgatgaagtaaaaccaaatccgacctgtaaaaatgtacatgatggtgttcagtttctgcaagaaaacggatgtgactttttaatttcgattggcggaggatcaccacaggatacggctaagggaatcggcattattgctaccaatggggaacatataaccgagtatgagggcgttcataaatccacgcataaatcgcttcctattgtggctattaataccacagcaggaacatcggctgaaatcacgattaattatgtcattacggacgaagagcgcaaggtcaagatggttatggtggataagaatagtgtagctacgatttcggtcaacgaccctgaactgatggtagataaacccgccacattaacggcagctacaggactagatgctttgactcacgctattgaagctttggttacgccaggctcctatcctgtaacggatgcgactgcattggcagcagtagagattatttttaatcatttggctcgtacggtgagcaacggtcatgatatagaagcacgtgagcaaatggtatacgctattttcttgggaggactagcatttaataatgctggattgggttacgttcatgcaatggcgcatcagcttggcggcgtatacgatttacctcatggtgtttgcaatgccatgctgctgccgattgtggaggaggagaacgccaagcatgtaccagagaaatttcgtgccatcgctaaggtcatcggttttgaagataaggggaaaacggataaggaatgcgcagactatgtaatccaaagaatcaaagacctgtcgaaggaagttggaattccttccaaactttctgaactgggtgtaaatgaagtggatttggatctgcttgccgagaactcaatgaaggatgcttgcgctccgggcaatccgttcatacctagcaaagaacaagttatcgagatgtttaagaaaattctttaaataaaaggtacaattattgtgttaaatattataagggctgtctcaggaaatgatcgaagaatactgggaacggccctttttatttgcattttctactaagagatttgtgagactagagataagacagccccattgaagattaatggcacagctctctcggctaaagctgtaggagactctttttttccttccgcattccaacgaaaggttacaccataaatggaccagcttaatatgttcgcggcaagttctaacgttctttggtctgtattattggcttctcttgttatgagttgaagtatgaattgctctaattgattcttaatatgttcttccaggatcggtgccactgaattatatttatgaacgcattgattacttgagtcgtgatagtcacataacgaaagaataagtttctgaatggtctcctccgacaaacgtgcctcagcatcaatcctcttgataacatactccaaaaatacgtctgacaaaagggtttcaagcagtgcatatttatcttgaaaatgtgcatagaacgtggcacggttaatggtggctttttgggtaatgtcattgatcgtaatcgtgtagaagtctttcttatttaattggtcaacgaatgcgtcgagaattaatctacgtgttcgaatgacgcgcggatcgtttgggttgggtgaagttacaccaggcatcctcaagacactcctttcaggtaaatcaaatgatttccccattataaacatgtgttgttttgtcaacaagtgaatttagatatacaacaatttcataacccttttggttaagcaacagaaagaacattttgtcggttgaatgataaattaaacattgctaacattttacttgcaccccgtttgatgatgcacgagccttctatataatccttttaaaacgataaaagaaaatgaggaggtacaagccttgagtaatcaaccgcaaaatgtccattcaacagaagctttatttcaaccttataccattcataatctgaccttacagtctcgtattgtaatgccggcaatgggccgcgctttttcacccaatggtgtgccaggaccggatgtagccgcttattatcgccgtcgcgcagagaataatgtaggtcttattattactgaaggcgcagtgattgaccatccggctggaacaagtgagccgaggatacctaatttttatggggaagcggctttaaacggttgggctgaagtggtcagacaggttcatgaagctggtagtaaaattttcccacagctttggcatatgggaatggctcgtcctttgggatctcagccgaatccggaagcactatcgattggtccatcggggctggatctggatggtaataaagtgaccgagccgatgacagaagaagaaatcgccaaggtcattggcgcctatgtcgatgcagcggcgaatgcaaaacgactgggctttgacggcgttgaaattcacggagcacacggttatctggttgatcaattcttttgggagagaacgaaccaacgtacggatcgctatggtggcgatatcataaaacgtgcacaattcgccattgagcttgtggaagctattcgtgctgaggttggccctgactaccctattgccatgcgtctatcccaatggaaaatgaatgattacaacgcaaagccgttcgatacaccggataaactggggcagctactgaatgtgttagtacaagcgggcgtggacatcttccattgctcgacacgtcgcttttgggtacctgaatttgaaggctccgatttgagctttgccggatgggtgaagaagctgactggaaaaaccacgattacggttggttctgtaggtctggatgaggattttgtaagttatacggaagggaaaggggcaggacaccaagatattaatgaacttctggaacggctggacaacaatgaatttgacttggtagctgttgggcgtgcgcttctgggagatcctacttgggctacgaaaatacgtgaaggccgaattcatgatcttcaaacctttacacctgaggtacttcaaacgctcaactaaaacatatcatactttgaacaccacttcatttcataaataaacactgtaagccaaaatactcaaagtgaggtaaggaactttggtattttggcttttttatgcgtctgcgatagtagtccatcatgaaccattttagattaagtcatatttgctttaaagttttcttttcttgggtaatttagatctcattataacagacttaatcctagttctttgaaatcattcatatactaaaaccagatcagactgacatcaatacttgatatatatatagatgtctatgtaataatgcttgtatgttaaaaaataatgcagctgcactgataggaaccattagagacacaatcaataaattgattgtgtctgagcttgaagcgaatggaattgaagggattgttcctactcatggtggaattctaatgttcctttatcaaaaggacgggctttccattaaggaattgacgcaaaaaatttctcgtcagcaacccactgttactgttttgatcgacaagctagtgaagttggggtatgtcgaaagaaaaaaagaaagggaggatagtcgagttaccctgatatttctgaccgataagggaagagagatagagcctatatttgagatgatctccaacagattacaagaaacgatctatggtggtctcaaagatgaagaaaaagaacagctggaatatctgctggagcatgtcaaaaacagattataaatttttttaagtaaatgtatagatatctatattaatatcaaaataacaataaaacatcgggaggttattaaaatgaaacatcttatcatctatgctcactctaacgcagaaagctttaatcatgcgatactcgaaacggttgtaaataccttgaaagaaaaaggtgacgaagtcgttgtacgcgatctatatgcccttgattttcaacctgtattaaaacctgaggatactgccgctatgagagcagggcaaaccccagctgatatcaaagtcgagcaggaatacatctcacaatcggatacgattacttttatttctcccatctggtggacaggtcttccggctatcctgaaaggttacgttgaccgtgtatttgcatacggctttgcatatacggctggtgcagaagggattaataagctgcttagaggtaaaaaaggttttatcgtaaatacacatggcactcccaacgcgatctacgatgaaatcggtatgaccgcaggattgaagatcacatcagatacgggaatttttgatttcgttggaattgaatccgtcggtcacttactgcttggaagtattggttaccttgatgaagatggctataaaggactgctgaagcaagtccaagatacggttaaaacggtgctgtaaagtcagtttatgttctcttagaaacgtaagacattctttaaatgatgaggtcaacccgtatttagtggttggccttttcttatagtgcttatatatcttcaacatcccggttcatagatctttgaatttgtaatagcatcttggggcagatataactggaaattcaagggtgtgttgaagcatgactctatgatctttcgacggttttggtgaagagtaaaccgtttcatgttatataaacaactcctttaccgtaaactggcaagaggtgatcaagcgtattttttcttattcgacgctgagctcattaacccttgtattaaaattcacaaatatttcattgttattatcgtgggcaattcattatagtacatagtattaatagttaactgtatgtattatgtgtgttgcggaggttcactatgaaagattatgaactaagggacgaattgagagaatccgttaaccggatttatggcatggaattattcagtagcctgacggagcttgttcagggggaaaaccatgtgcttcaatatttagttcagcatcgagatgatgaaattaatccttccttgctcagcgatcatctgcatgtatccagatcaagaattacggcagcgcttacgggattaaggaaaaaaggctatgtgactatggaaatgtctgagcatgacagacgacgaatgtgtgtaaggctcacagtagctggtgaatccttgatcaaacagaagcaagagagaattgaaggttattttgaagcgcttgtagtaggtttgggtgagaagaatgtgaaggaatttatacggttaattgagctttctttgagtattatgaatgcgcgttctattgaaaaataacataatgtgagggtgtaccgggtgagatataaaataatagcggatagctgctgtgatttaacgagagagcttagagaagagatgcaagttactacgattccgttgaatatgacgctgggagataaatgctttgtagatgatgacacattggacttgcctcagtttatggaagaaatgaaagcctgtacaaccaaaattggatccgcatcaccgtcacctatgctgtataaggaagcctttcaaggtgcgcatacttcttttgccattacattatccagcaacctgtccagttcgtattccagtgcattggtaggaaaagatatggcggaagaagaaggggcggatgttcatgtgtttgattcgaaaagcgcttcggctggacagctcttgttagctctaaaactacgcaagttgattgacgagggatatcataaaagcgaaattatttcttccttggagagctttataagcaagatgaaaacctactttgttttagaaaatctggataatttggttaagaacggacgaatgaataaaatcactggaaagatactttcactcttgcatatcaggcctattttaggctcggatggtgacgggaatatcgcattttttactcaagcacgcggtcagaatcaaattatcgaaaagctggcagatactattgaaaaaagtggccgggctaccgaaggagaaagcatcgtcattactcactgcaataatcctgggctggcggaaaaattaatgaatgcgctgaagaaacgctatcaatttaaagatattcatattgtgtccaccagagggattagttcaatgtacgccaatgacaaagggatcattatggccttttaaaaatattcagggtttatcctcgctgtatggataaaccctttttagtacacggagactttgcgggagttcaagcctatcccaattttctaatgaggacagaagcgtttatgctggcttgagttcctccggcttgtgtttgcagggtaacagcagtagtagagctatggtttcgcaaagtaaggacgtcaccgcatgccagagcgaggatggcttgccctgtgttctgttgtgtcccggctcctgagccgtatacagttccctcagccagtgcgccattaataaagagggcgaattggttaggttccacaccggacaccgaaaagtgaacttcatattttccagcatcggatacagcaatctgtgtagttcctggaacatgagcaattccaggtgtaagtataccgtttgtatccaaaatgacatccccttcaatcggaacaacttggggcttcacattacaaatataaccgaactgcgctaaatcacctatggttccagaatccccttcaggccctaaagcgccatgattaatattcacacttacaagttgttttttgacgatgatatcttttccaaaccctttccgtttcgagcggccttttctctttgggggcttctcctcaaactttttttctaacttatcaaaccaggcacggacaaaaacattttttttacggcctttttttcgttttaattcagcatgacccaatacaaacacctccatatggtttgttgtatactactccattcatctagaggaggcatggatatctgtcctgtgatccataggaaacgatctattttgactaaaaacaggctactgtacaaggtacattcgtctagtatgtaaaaaagcacctttgaatgtgcacttggatgataaccaaggaacagacaaaggcgccagtagagacgtgtatcatgatgaagcggtttgaagccgctttttgcgcacatatagggcgtacaagatgcccccaagcagacacaggatgcaggcgaagcctgccagcaaccacgccgatgagactgctccaccacgatccatgctatttccgagccataaaggcagcagagctcctccaactccacctgcacctataagcaggctggtggtggattcttcggtgcctggcatcattttgctggcaaaaacaagtgcgatggagaagatcccggacatgcccagccccagcagtacaataaggataaaggcgccggcagtgcctttgatcagcgggaacacgcatagcagcaaggtcgctgccagcgagctcagggcgacaaagacaccgtagccgtatcgatcggcgatgtagcctgtgaataaccggccggtagccattgctaaccagaagcaggtgacactaagtgctgcttcggcttgtgtgagacccaaacgttcgatgaacatggagggcaggaaattagccaggctcatctctgttcctacatagataaagaaaaagacgataaatagtgcaagtagcttccaattgcctatagggctacctttagaagcctccaccgtgggggatttgggtgagttggtggaacgcgcatggttgtcacctcggtgttcctgttggtctaatacagcgtccagcgtgccgaatgacccacgcagccaagctatgacggtcacggctgcaaacatggaaatgatgggaaaggccaatcgccaccaaccgagagcaatgagctggctggcgatagcgggcatagccaaagcgccgatcccaaaaaagacttccagacggctcatcgccgcgcccgttccttgagtaataccgctgataataatagtgccaataagtgtttctaccatgccgaagccaaacccggctgctgccccgacggcatatagccaaccccaaggcagcagcaatgagtacagcacttcagccgcgcacagcaggagcagggcgaatactagacttcggcgtttgccgaaacgccgggcaagccacggcgacagcaggactccagccagaaaaccggaaaattgagcgaagattaggcttccgccgtccgtatagtttctaccgtaatgctctaacaacacaggcagtagggagcctacaaccacgtgtgccaggccgattaaaaaataagacaagctgccgatccatagcagtcgtttcatgatgaactcctttgatacctagatttgaatcatgcaacaaactgaactgcatgattcaaatctgagtgattatgatagctccagtacttgaaagccgtagccttcaatagaaatatctccttccagatatttaccgttgatcagctcattccctttctgatcatccagatgatattgctgcgtctgggcgttatgattcagaacgaatagatacgattttccatctttgatccgtacagtggcttctacacccgcaggagcgcgcagcagggatggaatccctttttgctcacaaatgtagcccagcaggccatcaaggaaagtctcttcaggatctgaagcaacgtaccatgcctcaccttgaccgaaacgattgcgtgtcagcactggcatgccctgatagaaatcatcgccgtattcggctagcacttcagcgccttcgctatgcaacaagtcgcagagcagaccgcatttatattcaccttgtaatacgcccaccttttctttcaatacaatgcgattgtgtgattccggcagaagcgcgtctatttcttccacccagatcccaagcaagttacgcagtttaccaggatatcctccggttgtgaccagatcattttcatttacaatgccactgaaaaaggtcgttacgaaggtgccaccatgctctgtgaattgttccagcttctcggcggtacccggcttgaccatgtagagtacaggcgcgataatgagatcatatttctggaaatctgcatcaacagaaaccaggtctacctgtacattccgccggaagaggggagcataatacttatgcacctgatccacatatttcaaggcgacagaagggccgcttgatttttccaaagcccaccaattatcccaatcgaataaaatggctactttggcattaacggtcgcgtcaagtagcgtgttgcctaatgcgccaagctcactgccaagctgtgccacctcgcgaaatacacgtgtgttctcatgcccggcatgctcaatgacggccccgtggaatttctcacaggcgccgatcgagcggcgaagctggaagaacatgaccgtgtccgcgccatgcgcgactgcctgataactccataaccgcataacgccaggccgtttaagcgaattatacgcctgccagttctgctggctcggtgtttgctccatcagcataaagggtttcccatccttcaagccgcgcatcagatcgtgcgccatcgccgtatagctcatcggagtattggccccgggatagctgtcccaagatacaatatccatgtgcttagcccatttaaaatagtccagttgtttaaaaaagcccatcagattggtcgttatcacggcatcgggaacatgttttttaatcgcgttatactccagcagataacaatcaagcatactgtctgaattaaagcgtgcataatcgagggatatgccctgaaaggtcgagtgattttctccccaatgctcgctcagattatttggtggtacaatttcatcccaatcatagaaggtgtgaccccagaaggaagtattccacacccggtttagttcttccagtgatccgtatttttgcttgagccacacccgaaatgcggccgcacagttatcacaatagcaatcccctccgtactcattggacacgtgccacacgaggatcgcaggatggtttttgtatcgttctgcaagtcgatcagccatctgctccgcatattttcggtaagttgggctattcggacaagagttgtggcggccgccgaatttccgcttacgcccgtcagcatcgactcgtagaatgtcgggataacgcgtagccatccaggctggatgcgctgccgtgcttgtagctaaacaaacgaagatatcgctttcataaagactgtcaatcaattgatccagccattcaaaataatatgtgatttcgtcggattgaattttggcccatgagaatacgttgaccgtggcgatatcaatccctgcctgcctgaacatccgcaaatcttcctgatgcgtggcctcatcccattgctcaggattataatctccaccgtaaaatactttaggaagtttactgcttatcatgccaatcacctctgtatataagaataatcctatcttataatacaaataactgcttttaaatataataaaatgaacgtgtatataacaatatggatctacatgtgaaatacatacccgcatacgccggaggtgctttttatgattttaactccccatcatttaagatttttcctgactacgcgcgagcattctttacccctttttattgaaagtatcggatttaacagcaggcaggaagatgtgtcccgtccagagggttatccgtgctttcactggattcagacggtgtctggtgaagggatgttttcatttaaaggggggagtttccgtctgggagagcagtccggggttctgctgctgcccggggaatcccatgcatacagacgggcgaccaaggtatggcgaacgttatacattacatttgacggccccatcgccgctgttgtattgactgcactgggattgaagcatacgcgtgggtatcattgggacccggatagcgagctacacagctttggggaaactatgctccattccatggttagtgaacgtgatttgtctggattagatgcttcggccaatatgtatcgttttctgactttactgcgtaaacatggacaacatagctcgatgccttccctatcccataatgtagaacgtttaacccctgtactagcctttatggagcaaaattatgccagtcccgatgtgggcctaggtgatatggcagttatgatgaatgtcagctcccgtcatttaaatacattatttaagcaagcgtttggtgtgacttcttatgcttatctgattgtaattcggctgcggaaggccaaggaaatgatgacggaatatccgcaattaacagtaaaggagatttcggagcgagtaggattccgagatgccagtcattttgtggcaacttttcgccgagctgaaggaattacgcctgaaaggttcaaattactgtatatataagggtattttatcgaaatactctttcttactcgggaatgctcattttagggagcattccttattgtttttttcaggatgagggagtataaaataatagttcatttgtttcatcaatctgatgttcaggtgacataataaaaataaacataagatccatagttcttttgcaaaaccctcatccaaagaaggagtcaacgaaatgctgagtaaagtcaaaagattattaatcggtcgtccgcgaaagtcgacggcccttgaagatgagaaactgaataagctcaaggcactggccattctgtcctcagatgccttgtcctctgtagcttacggaacggagcaaattctgctggttttaattacagccggcttcgctgccctatggtattccattcctatatccattgcggtattgggattgctgatcattctgatcctgtcctatagacagaccatattttcctatcctggtggcgggggagcatacattgttgcacaggacaatttggggaaaagtccgagtctgattgcaggcggatctctgctggtcgattatattctgacggtagcagttagctcatcagcaggtacagatgccattacatcggcgttcccatcgttacatgatcatcggatcgccattgctctgattatgattatctttttgactattatgaacttgcgcggggtgacagaatctgcctcggtgctggctgtaccgatttacttatttgttgttgccatttttgttttgattataagcggtatcattcattacgtggcagggggagctcatgctgcagcaccgcaatttggagctacggtatccaacgtcagtctgttcctgttactgaaggcgttcagctcgggttgctcggcgttaactggggtagaagctgtctcgaatgccattccgaacttccgcaagcctgctgccaaaaatgcagcaactacactaatgatgatgggtttgattctcgggtgtatgtttatcggaattagtttgctggcttattggtacggtgttcgtcctaatccgcatgaaacggtcatctcgcaaattgcgaacgccactttcgggcgcggtgtgatgtattacatcattcaaggcgtaacggcgctcatcttgtttttggcggcgaatacagcctattcggcctttccgttgcttgcttttatgctggcgaaggacaaatacatgccgcacatgttcatggtccgtggagatcggctcggatactctaatggtatcctgtttctgagtatcttctcggcattgctggtcatcgtatttggcggtaacacagaaaatctgattccgctttatgcggtaggggtatttattccgtttaccctttcacagcttggtatgatgattcgctggatcaagctcaaaccgccaggctggatcgttaaacttgctattaatacggttgggatgctgaccacgctgtcgattacgcttatctttatcttcaccaagtttagccaggtgtgggtaatctttatcttcctgcctttggttttgtatttctttatgaagatcaataggcattacaaaaatacggctgaacaactgcgcattgatattaccaaggataaacctatggtgaaaggcaatacgattattattccggtggcaggtattacgcgagtcgttatgaatacgatcagctatgccaaaaccttgtcggacaatgtggttgccgtatatgtgggtgtagatgatgaagcgattcgcaaaatggaacagaaatgggaagagtgggatgtcggtatacgtttggtggtactgaaatcccgttatcgcagcattattaatccgcttcgcaagttcatcgatacagtagagtggaaaaaagcagacgaggaccatatcactgttctcattccacaattcatcaccaagcactggtgggaaaatattctacacaatcagaccagcttactgatgagagcttatttgattaattataaagacgtgatcgtaacgaccgttccttttcatttaaacaaataaagtcactgccaattgtagggtacagctgaatatagcatgaccaaaatgaacatcttttggccgcatttctttgcggtcggagggtgttttttgcataacggagatatttactttggtgatacattttgtgtattatagatacgaaatgtatcatttaagactgttatggagggatacgatgcccgaagccacggggaaaatggaagatgacaagctgcaatttgtagatacgctgagggcgctggctattattggagttttacttgtgcatgtcagccagcatgtagacggattaaacggatggttgcaaaaaggcttgagtataggagctaaaggagtcgctttattttatatggccagcgcttttacactatttctgtccttgagcaaacgttcgggtgacaagagggaaagaatttcagcttacctgttgcgtcgtttttttcggattgctcctttgtattacgtgatgttaggaatctatttggttgtgaacgggacaggtccaagattttggcttgtagatcaggagggagtcactgccgccaatatcgctgctcatgtcctgtttttgaatggtctgaatccgtactggatcaacagcattattggtgtagaatggtccattgcggtggaatgtatgttttatctgtttatccccctattatttaagctgatccgatcagtccgccatgcgacctggtttgttgtgatggcgcttgtggtaagctttgggctaaatacggtatttgctcaatatccatggattagtaatcactctttatggggtcactatctgtatttatggtttccgaatcaattgcctgtctttgggctaggtatattgttgtttttcatttggaaagacgagcggcattggaaaagtatagaccgagtcagtggaggtatgttacttgtttctgtgctatttgcattttttggaggcatgaccgattatctcataggtttcgggttgctactgggagcgtatgctttgtatcactggcagccaatatggctgcttaatcggttatggtcatggatcggccgccttagctacagcatgtatttgacgcatatgctggctctggaactaatcgtacaggttaaaataccttttgctcccctagtcagcctcacacttatgtttatcatgacgttgctagtcaccatcggactatcttggtttacctactcgtggattgaacagccaggcatccggtgggggaaaaagcttatatcacgtatgaagcctgtgcgcaagcagggagattcggtcaaagaaagtgttgcctaagctacaacttgaagcagcatccgataacatttggttgaagtgcttgaataaatctatgaaataattgaaaagacctcttgaaaagtagctcttagccctttatattcgatgtacatccaagtttttgaatacaccgatgaggttggttggaattgtaaaggagatgcacgcatgcttttgaagccaatcggctttttgcttttctccacgcttgagggagtagctgtttttgcgctgattttgagtatttttaaagttaaaatgaccccttatctttggcaggccatttttgttaacctgattatgaatatgcaaagttatatgctccgagaggagttttccctttcgtatttggtgcctgtcgtaaatatgctgctttttatttttttactcgctacggtcgtgaagattccgattgtgtggtccggtattatgacggttacaggttattttgcatatgccgttgttcagtcggtattcttaaaagtcatgttcggcaaccttccggtttctgagctgcaggatgggtccttgaagggctatctgctacaagtggtaagcgcggcagtaggtctgcttatttcattgatgttgtatcgaaaagggatcggcttttcccctaatttcaagaagcttaagttcaaagaggaatatggcattgtcatcacactgattatcctgtccctcatttcaacttctattgtgctctactataacgaggtatggttaagtatgatattttttgcactggtttcgggatttttcatctattatgcaatcggaaaggaataccgggatgattgaagcgatggctttcaaacttgctaaccagattaaacgtactgtgcctgatcatccagcctctgtcgcagtacttaaatacgcacttgctctcattctgaatgcgtccatgatcatcgtgttaacactattcgcctcaatcttcacgggacggatggtagaagctgtatcgattcttgtcgctttcgccctactgcgccaaatatcaggaggcattcatttgaaaacgggcatggcatgtgtgttggtgacctcagcagcttttacttacatatcctgcattgccttaaatagttggtggacaaacctgtttaccggaatagctctcattctcgttttatgttttgccccgtccagaattgaaaagcagtcgcgcattccagtacgttgttatcccctcttgcgactgttatcctccttgcttgtatgtactaattttgtaatcggttcctctgtagtggctgttgcttttttggtccaaagtctaacattgatccgaggaaggaggtgagtggaatgatgaggaaaatggtatatggattagccacatcgttgtctatgtttgcaacatttgctgtatcagtggcgagttatgtgtatgtttatcaaggggatacacccgaggaactgctgaaataaacaaaatgccgaaatagaaaaatgatacatagagctgctactaagcagcttctttttatgtaaaaaaatcaggcgctccattaaagagcgcccgaatgggagaggagaaaccggacgaagagcttatggggaaacgtaagtcttctccgcggttgtctacgacattggttgaatgccgatatcctaaggatgcccagggaatggttttttatacctgcctcatcctaagtttttcaaacgacggtgcatgtggtacgatagcgtcataatcttatatggttatgaacacatatagaaaataggtgagtttcagcgtgagagtggtatcgggtagtgccaaaggaaggccgttaaaggcagttcccggcacagggacgcggccgaccacggataaggtcaaggaagcgctatttagcatgataggtccttattttgatgggggagtcgcacttgatctgtttgctggtagtggtggcctgggtatagaggcgcttagccggggaatggacaaggctgtttttattgatatggaatccaaaagcattgatgtcattaaagaaaatttacgaaaaactgggctggaaggacaggctgaagtgttccgcaatgatgccggacgagcactcaaggtgctggcaaaacgtggagctctttttgatgctgtttttctcgatccaccctatcgtctcaaacacggagatgaattaatgagccgtatggctgagttgaacttgcttcgttcagatgcaatcattgtgctggagtatgaatcgggacatgaatatccggaaagcttcggaccgttcgaacaggtcagaaaagcagtctatggtgaaacggcgttatctatttatcattttgcagccgatgctttgtcggatgtcgtagaacatacggaagccggagtggtcaaattcggcatcagcgaatcagacggggaggaccatcatgattgagcacaaaccacgtattgccgtatatccgggaacctttgatcccgtgacgatggggcaccaggatattattcaaagagcagccagacagtttgatctattgattgtcgcggttcttaacaatattagtaaaaacccgctgttttcacttgaggaacgaatggagctgctgcgaacggtaactcgcgatatcccgaacgttgaagtggacagcttccgtgatctgacagctaattatgtacgtcaaaaaggggcccaggttattgtcagaggaatccggtcggtgactgattttgaatatgagctgcaattagcctctacaaatcataagctgaacccggatgcggaaacgatctttatgatgaccaatccggcttattcatatctgagttccagtatggtgaaggaaattgcgcattttgatggcaaggttgtagatctggtggcacccgaggtggaagacgcgctgcgtgcgaaggtcaacgcgaatcgcggcggctccaccatgaagtcataaaggaaaaggccagcagggtaactataattgtacccagtagcgcaatggacagtacggttagttgccaggggtacatagatgttccttctatttgtgttagtaagccgctggctccggtcatggcaggatgcgtggcggattcatttacgctttccacaaaagaagacacagaactgcgactgacataagcgggagttgtattgctgacgaagcggttaagcgggacccatgtcgctaaggtaagtccaaaagcaatgatcccatggagcactcgtgacaaggtgaaggtgatgcccttgtcggaaggtctggtgacggcggtaatctgaagccagccgcacaggccgccccagcccaacacagcactgatcagggctgcttgtgtacggagatcgtagggcagacggctgatttcataggaacccaaatggatttccatccaggcaggccatatgaaagaaagcgatccttggcctgtgtatatggacagcagtcgaatcagtacggaaaagaaaataatgaatccacctgtcaccatcagcgtctgtacagcatgggatacggtttcgcccaacagttttccgaaactgcggccgtcccgttctctggcagagcgggtagcttcccatgcggatcggatcagggagggagaagtacgggaaactgaggtgcgccgtagggcagctggcgtttcccgtttttgcaattctttggacgatacaggtagtcttgcggtgatccagcctgccagcagcccggaaatccagtggactgcaagtaacatcacgcctgcggtagcattgtgcagtagccctgtcccgatgacgagcaggatggtaatcggattgcagaaatgagcgatagaggttagacgtcgaagctgaaacgcagtcatatcctcctgttgtgcccattggcgcaccgcttccgctgcagctgggaatcccgcggtcaggccgagggccaacacccagccgcttcgcccgggtagacgaaaccaggatcgcataaacggctccagcaggatacctagtccatgtactagaccaaaggcgatgagcatttcggacagcatcaaaaaaggcagcatggctgggaaaataatactccaccatagcttaaggccttgagtagaggcttgaaatacttcttctggtgaggcgacaacagccagtacaagcaaaatggctccgaggccaagtagtatggttgtccaataaggagcggaatgggcttccttttgcatcaaagaattcacctctcataaatatactaaggagagtgggatgctgtctccagtgtttattcacgttcgttgtcttgggataggttgttcgtatacgttgtcgtaaacaatgtatgctttttcggaaggcttgagaacaggtggcgcagaggcacttggataagataggagaagttaggctgcaagagggggagaagcaatgaaacgattaaaccggaaaagagtttttttttcaaccggttatgtcttaatgctggctgcaatggtctatgtgctggtctatatgccaaccccttatctgatctatggaccaggtggggctaacgagatcaaaccgatggttaaagtccgggagggtgacagcatcgaacgggggacctttatgatgacgacggtatcggcgcgttatgccaatgttattatgttgggcctgtccaagctggaccgcaattcggagatccagcgcaaagaggatcgtctgcatggaagaagtgaagacgaatatgcggcagagcaggtatggtatatgggggattcccaatcttccgcgatggaggctgcctacacccgtgcccatgttccctatcgcattgtgccggattatgtgtatgtatttaaggtcccgggatcgaacagcgtgtttgagcctggagatgaaatattggagctgaacggcgtgcgggtgaccgataatcgttccattcggaaggctttagaggatgaaaaatcgggaaaaatggctaaagtgaagctaaagcgcgatggaaagttgctgaccgtgcaagctcccttaacgaccatcacggacagtgagacgggtaagcaacgttctggatttggcgtcagtattgccacggtacagaaggtagagccgaaggacgaacgtaaaacgattcattttacatctacggatgttggcggtccttcggcaggtttgatgtttaccatggaaatctataaccaactgacaccaggtgatctgagtaagggatatcgtgtagccggtacgggtactattgataaggacggtcaggttggagcgattggtggtgcaaagtataaaatagttgctgctgaccgtcagggtgcggaattgtttttcgtccctgcggataattataaagaggccaaggccaaagctgagcaaatgggaagccggatgaagcttgtttcggttcgcaggcttgacgatgcgctgaattatatggaaaagctgcccatcaaaccataatgggcggtcgcaagtaatcagcatacatgccgcggatggcgggacgtggcatcccggctgcgtgtatggcggctgcggctgtatcccagtccaggtggggatgtgatccggcagaaagcttgacccataccggaagggtggctgtctgcttcatacgtgccagcagctcgcgtccagccctgttaaagccgagcacgcggatatagcccggacctttcgccagctcagccggagtcatatcggctttggcatgattcagcaaaatatgtgcacacatccgctgaagcttcgtacgagtataccgccttgtcttgatcgcggtgagcagggcctccacagaaggctggggcagcgtgtacagtgattgccgcagacgatgctccagcccttctgtgacctcgtgcagctccgccagctgctgcgggctacgtgtgattagggcgttcagcaacggctggctgaacgtttcccagtgcagcggcgcgcgttcagcttgccactcgcgccgcaaaatctccagtgtcgccgcaggtatgtacggcgacgcggcctccggcccgccgtccagcagcagacggcggatggccgtggcgctggcgatgattccgtccgcaggggccacggcttcgtggtagcccgatcccgtgcgggttaccgtgaagggcttgattgtgctgcccagccgttccagcgcaatcaaataatgcagccccaacgtattgttgggctgctgcatgagggcagcgagcgcagcgccgtccgctccttcggccgcgagcgcggctgcggctcccgcgtaggcagcgggatagctcgtgccgctgcttagg

SEQ ID NO: 2646 - DNA, 37058 bp, Unknown
  Kingdom: Bacteria, Phylum: Firmicutes, Class: Bacilli, Order: Bacillales, Family: Paenibacillaceae, Genus: Paenibacillus
actttaaggggtcacttcacttctggacggctgcctttaattatttttgaagttgacttcaataaaatgagaggttactcatttgtagttctatatgtgcctgtgctgcccttttcgggttgattttaattacagagcgcgagtaacggagaagaaggcaatcatttgatcgtatggacttattgcagcaactttttatgcaatcctgactttgatcaacaaattcattaggaatatgaatggactggaaatcacgattgtacaactattattatcatcgatattcttgattcctgttctttttattactcaagagaaattagaaatataagataaagtctgcccttgcatacagtagaatctatggaaaaggaacatcaaacttcatgtagataccttcacagtagatcctactgttgtggttctactggggggactataaaattatacatttttatcctccttcaacagtggattcattcttataagtcctagcatgttaatcaattgaaacaatttgccatgcgccatctttatctttttcaaaatagaagatatatcgtatatcgggtgaaaatccttcttcattattcagtcgttcccctacaacaggtatcaatatccgattattttcttttacagcttcggcaatactagtaaacttcaccggatgatcgaagaggtaatcgtgacctgtgccaacgtctgcacctagcacagcatggaattgatccaaatcttttgacacgaaggcagctactgctactttgagttttgttatcatggtatcctcaataagagggtctttaacatcattccatttgatctcgtctaagctttgcaggtcggctgattgatctattccttcttttactaccgtttctgaggttgttggtactgtttcattggtagatgtatccgttgtttcctgcttgccacaaccagcaaacgcacttacacttacggaaagtagaagaatagaaataatttgagcaggtttgttcatattagattcacacatcctttctctttctataacgaatactatttttttgtgaggaggagatgtaatgaaattacgaaaagctgacgaaatggaaaagtatagggttgtttaccgtagaaaaatgaataaataaatgaaatgaccttctcagattaaagaaggtcattttttaattcaggaatcattattaaatgtagcacgccttttgcttataggcgttatcgcttgcaattcatgcagtggttctttatacctagtgtggaattttcgcatggacgttcatgtgttttgtcggttagctatgatgctgcgtatcacggttcaaaagtagctgcacatgatgaaatctctggtgtatatctatgtagggtatcaagctgtagttagagcatttttttgagctgggatatacgggcttgggaaacctcaagtattttggcatattcgtgctgtgctgcattggggtgtttttgcattaattcttttagactttcgatcatttgttgtgtcgatcgccgcagacgtttggactctttattagatcgttgtgagttggataaagctgatttggctggtcttaggatagggctgaaatttatccccttctttaaactttcaatacattccccgcaaataaagctgtctctaaaataagttaactgttctgttgaaccacacattttacacgtcaccccagtgtactttcgaaaggcgagaataccagtttcctcatctgcaaaaatctcaacaggatcacccacattataatccatggaaattcgcatttctttgggaataacgatgcggcctaacgcatctaggggacgtgtcatacctgtacttttcaaatgataacctcctttttttatatccttataatactaaatagttatgataaaaaagaataggcttagagaagcaatcgcatatatttagtaaactgttgaaaagtatacaagtaatttccaaaatatgttttgttatggagagaaacgtgttgaggagattataaagaatttccgatatatattcataaagattattctagacgatttttgttatgaggcacaaatgcccacgttttattttctatccgaactaacgggccataagaaggttgcctcgctgctgccaggtagtaggaatcttaattttgcactctttactatgaaaacttatacttatcgttaaagctgacttgaagagaaaataaaagaacgaggaggggaataaatatgtactccattaaagaagctcaaatgaagagcggattgcccgcatctactcttcgttactatgaaaaagaaggcatattacctgatgtgggtcgggatggaggtggaagaagggtatataccgaaaaacaaatcgattggattaggttccttatggctatgaaagatacagggatgaccattgaagaaattaaggcataccttgagctaaatgtaaaaggagaagccacaatccaagagagaagagacttccttgtagcccacaaaaagaaagtagaagaacatgtggcacaaacgcagcacaatttggagaaaattattcaaaagatagctttttatgatcatgtggttatggggaaaagcctctcttaggtatcgtatgatctgtaaatagtggtaaagtcaaatcgaatatatggagcccccggcatatttgagaatacgtgctggagggcttttttgcatagatttctaaagatgcagattctaggtcgtaagtatggaaaatggttgcaaatgggcggttcacaactcgcttacagggtaaaagtgtagtaccaaggtgggcgagtgggggcgttgactctcacgccacgtgagactgtagactgtcaaacaagggaggtgaagcggaatggcttatacggtgaaggaagtatctaatctgtcgggaatcagcgtacgaacattgcattattatgatgaaatcggattgctgaaaccgcatcatattggaaataatggatatcgctattacgagcaggaacaactgttgaggcttcagcaaatcatgatgtacagggaactggatttgcctttatctgaaattggaaatgtgctggagcaaaccaaggaacaaaaggccgaggttttgcaggagcatcgagccaaggtcgaggccaaagtcttccgcttgcatactctcctacagaccatcgacgaaacggtggctcatttgaaaggggaacaagcaatgaaaccagagcacatgtaccaaggatttaatcgggaaaagcaggaaatgtatgaacgtgatttgacagaccgttatggtcaagaggctgaggaaacaattcaggagagcaagacggcgacgaagaactggagcaaagaggattatttggattcgcaggcagaggctgatcagattcatcggcggctggcagaagccatgaataaaggattgaagcataacagtgaagaggtacaggcgctaatccgccgtcatcttcaatgggtaagccgattctatacccctacagcagaaatttatagcgggctgggagacttgtatgtggagcatgaagatttcaataaaatgtatgaaggctatcgccccggactggctgagtatttgcgagacgggatgaaggttctagccgaacgggaattaaattaacaaaggggtgaacaacaagccgattccgatggcctgctgttcaccctttttgtgtgtaaagcagcttacatgctgctttgtgctgttctcatgccttgctgactgctgtttccgtaatgttgcatgccactgcttgcgaaatgttgtccagtcgttcccatatgttgcggaaagctctgattcatgtggcttcctgtattaaaggaggttggttgcatactgcgggaagcaaagctatcgccaaatccaggctgagtcatttgattgctggaacgaatggagttttccaactgactacacagttgaatcacttgctggtattgctgcatagcctgctggtgatgctgaattgcagtttggatcatttgagctgcgcttcgttcacgttgcaccaggctttcaagactggatgcattttgttgttcctgttgcagcaactgctgatacatagcagttccttgctgtgtttgttgtaccaattgctgcatgatttgttcacattgatgaagttgttgttgtggagccatgttgttgtacatgaatcatcaatctccttcgccggatagttttgggtttcagaccctcctatattgtggcgaaggaagacgatatatatgcgctatttttggttataggctggctaccagaatagccgtaaattcctctaggaatacgcgatcttcgtgatcaaagcggccttttagcgggctgtcaatgtccagcactccaatcagttccccattcttgacaaggggaataacgatttcactattggaagcagcatcacaggcaatatgtcctggaaacgcatgtacatcatctataacaagcgtccgttgttctgctgctgcggtaccgcatacgccacgtcctaatggaatccgtatacatgcaggtaagccctggaaaggaccaagtacaagctcagtgccatcataaagatagaaaccgctccaattaatatctggaaggaaatgaccaagtaatgctgaagcatttgccagattggcaatggtattggattcatcatgaataagtgcccggagttgtccgagaaccgattcgaattgttcatgacgtgtgccttcgtaaggaatagcttgaaacatgtagggttcacgctcctaacattaaatttttacattaagtgttgtatatatcgtaaaaaataggtaattatccaattcgcttttaccattggttaattaattcaagatataacgattgtatatattcagtcaagtggaaaatcactctgtaaccttttcgtacactccgtactctaacctctgtacagaatcattttggaaagggaaagctatatgttttagcgggacaaacattatagaaagtaattcagcgagggttgccctcatctgtttccagcttatcctctatgggtaaaaacagtgtaacatggtggcctaggccagggaggagttacaattatgcatgcagatgttcagaacttgtttatccgtatacagatgctttcttatgcacatcagaacgatctcacggtaagagatattcaacctgtgttggaagagcgcggttaccgtgtaggagaacgtgaggtcaagcaggagcttgaaaacctgacgcaggaaaactttctgacaccgcatgatgatatgttcagcattaccggcgcagggatcgatgaattacaggaaattcagtcgatgctgggcgtactgtacaaggatgttgtgaagaaaccgacgcgcaccacagtttaatctcttatagtatagaagatgcccttctaattcctaatcctaggaacaggagggctatttatatatataagcttcgtagctttaaataaggttgtgtttgttgaaggtgtatgcttaaatgtagcgtatatttattgtcattttaatgctggaaggatgattgaacatgtgtgcatatgcatgtaaggggcatataccactgctggaaagtgcgcgtcttcggctgcgaaggatggagagcagggatgcggctacaatgttcgcttgctggtctgacccggaggttcaccgttatatgaacctttctggtatgtcagtacgtgaggacgcagaggatatgattgagctgttgaatgagctggcgaagacggaggatgcgctgcgctggggaatagagctgaaggagaacgggaaattgattggaagctgtggatttaattattggcagacggagggagcttataaagccgagattggttatgaaatagccaagccttattggcgacagggttacatgaccgaggcgctacgcttggtactgtcattcgggtataacacgattcggttgaatcggatcgaagcgctggtggacccgcgcaatacaggctcgcaagccctgctgtcctcgatggcctggacacaggaaggactgttgcggcaggtacagcatacatctacaggctttaaggatatgctgatgtattctttactgcatgaagaatggctcagactggaggcacaacgaaatgctgtttcagtataacggcggttcgtcgccgctgcacaggttagggccgttaagtaagctaatatgggtgggatgttttagcctcctgtcgatggcttgggattcgacgctgcgggaagcagcactcttggctgtactgattgctgtggctggcttgggcgcatgtttgcccttagcgcgccaacttcgggctatgtcgttcctgattggtttaggtattccgtattttatattgtctatcctagcgattcgagaaggacataccgtggctgcatggggacccattgtcattacagcagaggggctggacatcgcaggggcgttaacgttgcggatttttgtgttgtttttggcatcttatatctatctctcgacgaccgatccccgagattttgtgcaggcattgaatctgcgcttgcgtgttccttatcggtttgcgttcggtatttcggtggcattgacgtttctccccttattggaagaagaagggagaacaattatggcagcacggcgtgttcgtggacaggaaccaccacgagggtggagcaatcggttatcatggtggagcgggtatgcggctgccgtgttggtgaatgctgtaagacgggttcagcagacggcgctggctatggagggcaaaggtttcggtgcttatgcagaacggacatatcttcgtacactgaacaatgggcgtttaggcaacttatgtgcggtgactgctatattagctacggctgttttatggtggagcttataaagtgaagcctcttatttttggccttattgtcaacttgtgaaataaaattaggttgacaataagggcgcagatgaatacatttatacagtagcagcttgtacaaggaacagagctgtaatcttatagattagatagggagaggagtcaagaaatacatatgaaggaatctcgtatgtttgcaaagtttacaacgctggatatcgtactcatggcgatgctggctacgttgaacggcgtcatgaccgtgtatttgtcgctcattaacaaaacattaaacagtctgggagggcctatcgcaacttcctcaattgtcgggctgtacatgatatacggcttgttggcttattatattattcgtaagccgggtacggcggttattgcttatgcatttggcgcggtggtgcaatcctttatgggctctgcctatggaattgcttctattatcgcggcggctgtctgctatatgattgcggctgagttggtatttgccttgttgcggtatcgacgctggaacgcagtttcgctgatgctagtgggtggggctatggttccgctgtggtttattgtcgcagccaatatgtttggctatatgcattggggctggaaggtgctgacgattgcactggtcgttcgtatcctgagcggcattgtcctgtgcggtctgctgacgaaagtgttgggtgatgctttaaatcgtacgggactgttaaaacgttttgaacgggggcgcgcttcacgtgcatagccgtggctatacatgtggttatatcttcaacaatggggatcgaggatatttcagttatgaatgaacatagcgattataactctagcagtaaaatagccgtatccttgaagaattttggctatcggtatgatgaccaggtggagccagctttacatggtctgacactggacattgcggtgggcgaacatgtagccattgtcggagccagtggaagtggaaagtctacgctatgtcagctacttcatggcgggttgtcccgttccggtgaaggcgaacggacgggggagctgaccgtgtacgggatggaccccgataccgccgatttggctactgtcgccaccactgtcggcgtcgtgcttcaggacccggatgcccagctggtgcagggaatcgtcgaagacgagattgcttttgggccggagaacctgcgcgtgcctccggcagaaatagcgcagcgcattgccgctgcgctggaggccgtcggcctagctcccgagcgcgactccttcgtgcggcgcctctcgggaggccagcgccaacgcaccgcgattgctgcggtactggcgttggaagcgccgctggtcgtgttcgacgacgcagctgcgcagttggacccgccggctgtacgcgactttgccctgctatgtcggcggctccatgccgaaggccggacggtagttaccgcgtccggccgcatagacgatggcgcgcgggcagcacagcgcgtcatcgtcttgaagggcgggactgtgcagatgcagggtccgcccgaaacgctgctgcgcgaacatggtgcgcagctggccgccttggggctgctcccctcttccgcagggaggggagacatgcggcgtgagccgggggtgaatcccggctcagcagcggaccgcgctgggcagccgttgttggaggtgaagggattgaccttcacctatcctggcagccagcggtcagcgctaaagggcgtgagcctagctcttgcgcccggtgaacgagccgtgctgctgggtgagaacggctcgggtaaaaccacgctcggcaagctgctcatgggtctactcccagcacagaaggggtgcatgcggtgggaggggcaggatatggcgaagctgccaattcatcagctggctgccggaatcggctatgtgttccagcagccagagcatcagtttgcagctgcaacggtgtgggaggaatgcttgtacagcgtgcgcgccaagcttggtttacggaccggggagccggttcccgccgcatatgtggaacgggcgcagcgcttactggcttccgccaggctggagcacagactggatgcctccccgtacctgctaagtggaggcgaaaaaaggctcttgagcgttgcggcacagttcatcttgcccaaaaagctatacattttggatgagcctaccgcaggaacggattacgaaggagcgaatattctgctccgtatgtgcacagagcagtctgccgaaggtgcggcttttctggtcatcacccacgatatgcaggtagctgaaagctttgccagcgatgttctgtgcatggaagagggccatctccataaaatggaaaatagtgagattaatcatacgattatagttgacaaaaattaacgatatgtagacaataatatatatacatcgtacaaaacaggcggcctatataggccgcctgtttacgattatgcggggcgggtaataatccattctggaaaggcaaaccgcacagatacaacacagtttttataagggaaggatttgtgatttgcttgggaaacgataaacccatgaagcgcggactcgtgctgacaggtgttctattggccacttttctggccgcaattgaaggaacggttatcggtccagcgggaccgacgattgttagcgagctgggtagcgtgaaattgctcagttggattttcacggcatatttgctgacgatggctgtgaccacgcccattttcggcaagcttagcgatttgtttggccgaaaacccatttttttaatcggctgttcgttgtttgtacttggctcgttgctttgtatgatggctggtagtatggagcagcttattatctaccgggctatacaagggattggtgcgggtggtgtcattcccgttacctttaccatcatcggtgatatatacaaaatggaggaacgcggcaaagtccaaggcatgatcagctccgtatggggaatttcttccttgatcgggcctctcttgggcggttatgtggttacctattttggctgggagtggattttcggctttaacgtcccctttggattgctggctatgttcttcatcgcccgttacttgcgggaacaggtaagcaagcgtaccgcacgtattgacgtgccgggagcggttacctttaccatcgggatgacggccctcttgctcgtattggcactgggtgggcagtatatcggctgggcttctcctgaattgctggccttggctgccgtagccattttgttcctgattctgtttttggttattgaaaaacgcgctcaggaaccgatggtgccactaaagctattttggatacgggatattgctttttcctgtgccgcagcactgttagtcagcactctattgatcggactgactagctatcttccactatggattcaaggtgtacacggtggagatgccgcttcatctggtctcgcgctggctccaatgtccgtaggctggctatttggctccatgatcggaggacgcattttgctgaccctgggctcgcgtcgaacctctttgattgggctgaccctgattgtattgggggctttcgtcatgaccttgatgggccaaacggctccgatctggctgctgttcctgtctacattgttgtatggactgggattcggcttctcgataactgtgtttacgattattgcccagtcctcggtcgggttccagctgcgtggcgcctctacagctttgaatacattcctgcgcacgttggggcaaacgattggggttgcagccttcggctcatggctgaactatcgcatcgctgcccagacagccgatggacagctaactcagcaaggggttacgcaggaggatattaatggtctgctggccccgcatgcttcacaaagtctaagtgacaaggttgccggattacttcgttctgtactggaaaacagtctgcattccctgttcgttatcatggtcgttattgcagttattagctggtttgtcgtcctcggactgcggaaccgtccgccgggtacggaagaagaggcagatcagcgcgtaaagacaccacaaagagaacacgcataaaaaataatataaatctttcatgataaagagacagtccggtacaccaaataagggtccgggctgtctctttatgcaatggtctctcctcctactgattcagcaaaatagccacctcgtataggaccgataaattccccagtatacaaaaaggagataaaattcccctagagttgctatatattcatagggtataggtaacaaaatggtaaaaaagtcttaagaaattgtaacaaaaaatgtgtttctgaattgagctgtagggtactaaggaaccatttttttgaacccgcttacaaatcgggctttgtatgattaattttagaacgattttgcatgtaaatgaagcaaccaacctagcaaaatgggacacggaaaaaaatcaagtagcaaatatttctgaatgtaataggaatgaaaaaaaaggaattttcagaaaattactaggaaaatatgaggatgaaattcatagaggaacctgttttcttacctcacataatagggcttttcagtctatatcaatcgtttgacataccatataaaatggccctaccaaccaaaaagttgggtttcaaatctagaagcataattagattaagggagatggagtacttgaagtttaacaaatggttcagtaaagcagccactgcaacagtagcaactaccttgctgttaggaggcggcgttcaggcttttgccgaggaaaatgatgcatctgatctcaaaacagacaatgcatttacgcaaattacgcgtaatgacatgctgaatattttcaaacagcaaggcaaagagaaatatgaggttccgtccttcgatgcgtctacaattaagaatattccttctgctatgggtcgcgacagctcaggcaagctgattgatttcgatgtctgggactcttggccgttacaaaatgccgatggcacagtagccaattacaaggggtacaatatcgtttttggactggcaggcgatcctaaaagaggcgaggatacattcatatacttgttctatcaaaaagccggcaatacatcactgagcggctggaaaaacgctggcagagtatttaaagacaatgataaactgcttgccaacgatccgattctaaaaaatcagtcagaagaatggtcaggttcagctaccttaacctctgatggacaagtacgtttattctataccagcagacagccttatgatccgaataacaaattatacggcaagcaaaccttgagcacggctcaaattaatgtctctcagcctgatgataagacactgaaagtagatggagtcgaggatttgaaatcgatctatgacggtggagatgggaaaatctatcaaaatgtacagcaaagcgtcggagtggaaatggataatcatacctttagagaccctcactatgtcgaggatcaaggccacaaatatattatatttgaagccaacacagggacagaaacaggctatcagggcgaagattcgattcaaaacccagcttattatggcggcaataagaaatttttcacggaagagcaacaaaacctgctgcaaagtcctaagaaaaagggagctgagctggcgaacggcgcactgggtatcgttgaattgaatgatgattatacgttgaaaaatgtaatgcctcctttgattgcatccaatctggtaacagatgaaattgaacgggcgaatgtgttcaaaatgaacggtttgtggtatttatttacgagtacaagaggttctaaggtgactgtagatgcgatcggtgacgatgatatttacatgctgggttatgtttctacttccttgacagggccttataaaccgttgaatggaaccggtctcgttcttcaccaggatctggatcgtgatgatattacctggacgtatgcccattttgctatcccgcaaggcaaaggcaataacgtagttgtgtcgagttatatgaccaatcgtgggcttttcccggatcacaaatctactttcgcgccaagcttcctgctgaatattaaaggttcgaaaacgtctgttgtgaaaaacggtattctggaacaagggcaaatcacgattgatccagaaaaggacaaaaaagaaccccaaaatgagtatggcaagaaataagtaggtataagcagtatgtccgaaggcggcagcttggtagcaacccgatctgtcgtccatcggacgatacataacgatgcaatgagaggtaaggaggatcgtcataatgagaaacaaagctcccaagaatatttggatacgatccgttgtaatcatcacaggcttaactatatttatagctatgggttggagtatgtaccaacaggatacagccgaacccccaaaatctgctgcaactccaaaaaatcaagcgaatcaaagtaagccaacaacaccgacctaccggtcagcctatcattttaccgttccggataagtggaagaatgatccgcaacggcctatttatatggatggaaaatatcattattactatttatataatcgtgattatcccaaaaagaacggtacagaatggcgacatgccacatccaccgatctggttcattggaaagatgaaggggtggcgattcccaaatatacgaacccgaatggagatccttggtccggttcggtcgtgatcgatgataataataccgcaggttttggaaaaggcacgctggtagccattgtgacacagccctccgcagatggcggaaagcaggaacaatttttgtggtacagtaaggacaaaggtaagacgtttacttcttaccgcaacaagcctgtgatgtccaaccccggtacaaaggacttcagagatcccaaaatcatccgagatcctcaacgtaatcaatgggtgatggtcatggcagagggaacgaagattggcttttatgagtctgataatttaaagaattggcggtatacgagcggctttcaaacagaaaatattgggcttgtggaatgtcctgacctttaccggatgcgtgcggataatggaacctatcaatgggttctgggtgtgagcgccaatagcaaatcaacaggcggacccaacacgtatgcctactggacgggagattttaatggagaagcatttctccctaatcacagtgaacctgagtggctggattatgggtttgactggtatggtgcagttacgttcgaggaaggaaaaggcaaagataaatatagtaaccgttatgctctggcctggatgaataattgggattatgccaataacacgcctaccctaaaggaaggctttaatggaatggattcgattgttcgccaaattcggctgaaacatacggaagatgttggatatcgtttggtttcacagccggtacccaatttggagcgattccaaacatccaaaaaatcattaggaacaattaaagtagagggtgctcaccggcttccggtttcaggcgatgcctatcagttagaggcggatgtatcttggtctacgattaaaaatgtaggattgaggcttcgagagtcgacggatggcaagcgtcatgtcgatgtgggtgtctcagtggacggtcaatactcctacgtaaatagagccaacaccgggcagccggatcagagtggaaaatatgtggagagcaaggcgccttttgatgctaataagaaaaaggtccacctgaacattctcgtcgataaaaccagcattgaagtgtttgtagatggtggagaagtagcttattcctctttaatattcccacgattagaggatcagaaaattactcttttttccgatggcggtccggcagtgtttaacaatgtagtgatcaagcattttagccgatagcaggtacttatgctgttcgtaagcttaggcatatttcgctctatccaggtatataaaaagtccacccatgaatataagggtggacttttctgtgtaaatctaaattttcgttttagcacagctataagattgttcgtttattcacaaacgattagttgctaaaattactattcattctatttgtgataaggtgacaagttatcagcgctacggcccaattttttgagcaagccgatgagttgatctctttcggtttcactaattccgctaaaggcacgttcaatctgacgtgtataatcaggataaatttcgtccatgacacgttgtccttcgtccgtcaattctgcatatataatccgacgatcttggtcgcacgggtgacggtgcaaataaccgcggctttccagtttgtcgataacataagtgacatttccgctttgcagaagcagctttgctccaatttgttggattggctgcgcgcctttgtgatataaaacttccatcacggcgaaggccgttgggttaaagcccaccgttttgatgccagcaaccgcatgttcgtttacacttttgaatgacttggcaaacacgctatacaaatgcatggattgctgtgtcaccaatgttcggtaatctatcatcttcattccgcctttatgtatggatttgggcatcctttgaccgctcggctcggatgaccgggcaaccatacccttgttactagcataaagggatttacgtagcgaaaacatgcgatttgtcacagtagctgcttttttaactatttaatttcaaagctttaaagtaaatttttgaaaaataaaggttttgaatgtaaaaatactgtttcggttggttatattaaaaataactacctagcttgatgaaccccaattaaccaaataagctacttcagaggagatgaaacacatggatacaggttctttccgttttcaatttcgtgatccgcagcaagccgcccaagcctgtgaaacattaaaggaaattggatactccgccagcacaaatggtaacacaggtctcagtgttcatattgagaaccaggatgtgctgtctgcattggaaatttgccaagcctatgaaggaagcatgattgaggtagggactcttttctctaaaccggatcaatatcccggtttgcaaggaaatataggtgtacaacatccaggttatagcccggaagattggattatcccggcacacacgatcaacgaagactggagcgaagcgtataaaaatggctcctctcaaacgtacactaatacgatggaggagcacaacgtcagctctgatcaacaacctgaagacgatgtggatggattttctggaagcatccatatctgattttgtcctaaaagtcatgattagaatttgagtcctcactgttcaactcatattaggataaagctcctataagaccattaattattatggctttgaaggagctttttttgtgtgagaaaaactcagttagaagtttcaccagaattggaattctgtaggatatgcataaatagcaacgacagcagggaataacaatttcagaaaggaggttttgaccttgcaaaaattaggagttcacgaaaaattggaattacatgagctacttacgtttaaaacaacttgcctgacaaaagcacaaaccatgattcctttagtatcagacacaaatttaaaaaacattttgcagcaggatgtaaacggtggtacacaagatattcaacaacttaaaaatctgctcgtgtaatttaaaggaggattaacgtgaattctattgttcagaacatgactggaatgggcggaatgacggatcaggtgatcgcttctgacctgttgatttcggctaaaagtggaattaaaagctatgcaattgccctgacagagtcaaccagctcggaagttcgcaatgttctttgcgaccaattgagcaaagctgttaatcttcatgaacaaatttttaattatatgaagaacaatggctactataatgcttatgatccagagcagcaaattcaaatggatatccaaaatgcggacaaggcactttctatgtctaaattttgataattaatcattaacgcaacaaaagatctatttagtcccaaatgaagtctctggttttatgtagaaaaagcatcagcaaaccttaaacgagtttgctggtgcttttttattacataaatagtcacacttctaatctagaaatcacaaatgacgaaatgaattgctgtccacatgaaatatggtgaagaaggcaatcataatatcggagaactaggtctcaatatcaggaatagggtgattttcattatgggcaagtcttcagctgttaagcaaaaagatcaaaaactaaaatggtggcaattaagcttattaggagttgcaggtaccattggtacaggatatttcctcgggtctggcttggcgatctccataggtggtccagcagtgctaattgcatacttttttgcagcagtgggaacatatgtggtgtttgatgccctttcgcgcatgacggcagatcatcctgaacagggttctttccgttcctatgcccaaaaagcatttggaagttgggcaggattcggcagtggatgggtgtattggttctcagaattgcttatcaatgggagtcaactaaccgcgctatctatattctcacgcttttggtttcctcaggtaccgatgtggatatttgcagcaggcttcgggattttagggcttgtgattgttttttttggcaataagggttttgatcgagttgaaaatgtactggccatcattaagatggcagctattgttatgtttctggttttggccgttgctcttttggcaggctggatcggaggaggaaaatataatccgaagttccccatcagttacaaagaattttttccgactgggggcataggattgtggtcatcttttatttttgccttttatgcatacggaggtattgaagtgctcggaattatgtctaatcggcttcaaaaaccggaggatgcacctaaagcaggcaaggtaatgctgattacactggttgcagtgtatgtgatttcaattggtctggctgtgtctatggtgccattaagtgcctttaacccgaaagaaagtccttttgtgcttgcgcttagcagtgatcacctggtttttgtgcctcatttatttaatggagtgcttattattgcagggttctccacaatgacagcatccctatacgcagagacatctatgatgcttacgcttgcacaggaaggagatgcgcccaaattattttcacggaagtggaagggcaaatatcccctttatgcacttagtttgatctccgttggattaatatcagccatcgtaatgtcgttgctgctaccgggaaaagtatatgaatatatcactacagcagcgggtttaatgctgttgtataattggtgctttattttgctgtcttcaggtaagctactggaatcgagcagatcaaacaatattaaacgttggattggattattgttgatagctatggccgtggtcggatcattttttcataaacttagccgcccgggagtgtacatcagcttactgcttgtcttgttaattgcaatatgtgacctcattgtacaatgggttcgccgaaagcacgacaaggaatctcgttaacgttgtcagtgagttaagcgttagcgtaaaaaaagtaattgaaatgcttgtacgccaaaataaaagccaaaaccgataagagataatccggacatccaagaaatggttttaagcaagccggtttttaagaaccgccggaaaatacttgaagcggctgccatggtcacatcccagagtaacacgcctaatacaatcgctccgctatagatcattagctgttgtactggatatgtattagcgacgtttgcgagtatggatccgtaaatgccaagccaaaaaaggatggagaggggattaaataatgacattagaaaaccggacataaatgagttacttaatgtattaccatttccccttaattcggattctgaaatcacacctgcatttttgatgctttcaatacctgtatacacaagtacgaaaaaaccaaacagccataaaaaagctttgacaaacggagcattaagaaggtgaatcattcccaaataaacaagcagcatatagataatgtctgcggttattgcaccaagcccaataaaccaggcgtgccaaaaaccattcttgatacctcgatccaactgtgcggcattaatcggtccaataggggccgaaagtgacagaccaagaaaaatataactgataaaagtattaatggtgactccctccttgttttttattggatgttatgtattttgtctatttaagtttattcggacaaacccatttataagaccatattttttgtgcgtatattgtaggagtagcctcgttattgccaaccaacctatcaatgaattaaatctaaaaaaggagctctaattccgttcacacaaggattagagcttttttaatgacaggttataaaaaaagtttatttgatcgaataattggggttgacacttttattgaaagcgcttatatttatctcgtgaacaatacgttatataacgttatataaaaaggagagataaaaatgaatgtacaacagacggttcagacgatttatgaacaagcaagcggagagatttctgaggtgtatttagtagcctgcgggggctcattagtcgatatgtatccctcaaaatattttttggatagtgaaggaaagaagctggtagcagggatgtatacggcgaatgagtttgtgcacgcactgccaaaacgattaggtaaaaacgctgtagtcatcgtgtgttcccatggaggaaacacgccggaatcggttgcagctgctaaatcagccaaagagaaaggcgcttacaccatcggcttaacccacaatagtgaagcgacactgctcaattattctgattattcattcctctacgagtggggagatgagagcgatgtcaaaaataacccgatggctattattttggagcttgctgttgagttgcttcaaatcgctgaaggctatgtgcattatcaagctttccagaacggcttgggagcaattaatggaattattaaccgggccaaaatacaagttgaaccgcgtgccagtgtattcgctgacaaatatcgcaatgaaaacctcttctatatcctgaccagcggagcttcttatggacatgcgtacggatttgctatctgctctctaatggaaatgcaatggcttcatgcggcttcaatccattcgggtgaatttttccacggaccgtttgaagtaacggataaagaaactccatttattctgatgatcaacgaaggacgcacacgggcattggatgagcgggcacagactttcctgaatcaatatgccgagaaagtagaagtgatcgatgcgaaggagcttggaatcggaaccattgccgacgaggtcgtcgagttttttaacccggttttattttacagcattgtatgtgtttatcgtgaagcactcgcaaatgtacgcaatcacccactggaaactcgccgttatatgggcaaagtagcttactaagcgcacttaccaacaggaggtaaccatcatgaaagttctaggcattggcgataatgtggtagataaatatgttcatctgcgcatgatgtatcctggcggcaatgcgcttaatttcagtgtgtttgccaaaaaagcgggagtagatgcagcctttatcggagtattcggagatgataacgaagcacagcatgtagaacacattctccgtgagctggaaatcgacatttcacggtgcagatatcacagcggtgagaacggctgcgcacgtgtaaccctggaagacggagacagagtatttctgggcagcaatgagggaggagttacacgtctccatccgctgaagctgagtgaagatgacaaggcctatgttggcgggttcgaccttattcacaccggcttgtacagtcatacagggcacttgctgcctgaattgaagatgctgggaatccctctttcttttgacttttcggatgatttcatagatgcacaggtggagaaatatattgcgtacgccgatttcgctttcttctcttgcagccatatgacggatgaagagacgcagaactatatccgctccaatcgaaaaaaggaggggcaaattctggtagccacacgcggcggagatagatctatcgcctatgatggtactaagttctattttcaaatgcctgattccgtggacgctgtggatacgatgggggcaggagactcttatataaccgcctttttactgagctttttgaaaaatggcaacattcaggacgctatggcagaaggcacgagggttgccgcccagagctgtctggtagaaggttctttcggatacggcgtccgctactaaaaaattatgttcaaatatcttcacttgtaagaatatgtaacatttgatactctaagtgggagtaatataacgttatatgacaagtgagggcacagtatgttgaattcagaccaagcagagccattatatattcaattacaaaaagcggtcaaaacggctattcataatggaacatttacgcagggaagccgtataccgaccgaaactgagctaagcgagacctacaatgtaagtcgaattaccgtaagaaaagccattgccgaattggttcatgaaggttatctgaccaaacgtcaaggaaaaggtacctttgtcaatgtacccaaaattgggcggaagattgaacatgtcatcagcttcacggctgcctgcaaatccaacggcctatcttcacacagtgtggtcacagaacgtgaaatcatagaagcagatgaggaaattgcacatcagttgcagctgctacaaggagaacaagtgttatatattcagcgcaaaagatacgccggtgatcgaccactaatgctggagaataacttttatccttatgaccgattttcttttctaatggaagaacagttggtggactctgtatacgaactgttgcgtcataaatacagcattgatcctaaccaaccaggagagacgatattacaaatcgctttggcggatgaatatcaggcaaagctgctggagacggccatcggacaggcgttgttctacatgcacacgattatttatgatcagcatggaggccccgttcatgtaggtaaacagtacatcattggagatcgttatcaattctcaatataaatccgttgcctgttatgtaaatgtattcaggtacggcgcagcttctgcttccactctataagagaagcagaagctatattataacgttatattacgttatgtagtgaggcggatgaataatgagggggtgaaattgtgcaagggaagaatgatacattagcggacaaagttttactgtcaaatgctatttttaatggcttagaaaatgaagcctcgccggggtttattgcactgcgaggagaatgtattgcagcagtggggcgtcccgaggaggcacaagcttggataggagcgggaacggttgtctgtgatttgggcgatgcttttatcatgccaggagttcatgacaaccatgtattttttaccggatatatgtcgatgcatcggggcgtggatttgactcatgcagcctctattgaagaagcaatggaatccatgctacaagcggcaaacaaccttccgccagggaaagatgtaaccgcttacggctggagcgaggaaggttggggcaagctgcctgagcaaagcttgttagacgagctgttccctgatcgggcggtaattgccattaacctaaataaaagctactgctggatgaaccgactggctcaggagaaatatcaatttttgccggatcaatgcagtgctgaggcacgcgctttgctgctccaagctatgatgaaggatcacagccttgtcaaacaagagtttatggagttttgccgcatactagctgcacgaggagttacctccataaaagatattggctttgaccggcatagcgagctgctgccgattctagaagaattgaaagaaacaggagaactgccgctccgatttcatttctcacttgaacccgttgttgaaccgttggatattggcaccggtatgaagtataaagcactttataatggggaccttattcgtttccaaggatacaagctgatgcttgacggcgtcgtagcagatcatacgggggacatgctggaaccgtatgcagatatgcctgaagtcacgaatttgaggacggttgattacgaaaaaattgaagcctctgtgctggaagcggacagccaaggtatcaaatgctgcctaactgcagaaggtgatgctgcgattcgccaagcggtatccatgattgaaaaatgccgcgaacaacaaggtaataaccttatcagacattctatcagtgatctagagtatcctcatccagatgatctggtcagaatgggcaaaaacgaaatttttgccgaagtctacgcccaaatcctgctactgaatccaacctatgaagaggcctatatgcctgttgtggtaggcaaaggtaatgaaaaccgattttataattataaatctatgctggaggctaacgtgccaataaccattgggactgatctgcctttatttatcacgagtgtccctgattcactgtactcagcttctcatcggttatttccggacggatcacctgctggaggctggtatcccgatcatgggatgccgccatccgaagttttaaaagcatggaccattaatggagccagacattgttatatggaagaggtcacaggcacgctggaggctggaaaatatgctgacatcgccgtttttgaccgcaaccttcttaatgcatccgctagtgatatcagggatgcccaagtgatactgaccattatgggagggaaggttacttataaccattcttggaatgagggatagacatgaacatcgagaaaaagaaatggaaattaaccttgccccatagctatactttaatatttttgattattattacagtcgccgcattgacatggattgtacccagcggacaatttgaccggcatgaagtgacagtgaacggtgtgaccaaaactgcgatcgtttcgggaacctatcacactgtacccaaaacgggtgagaacggtgatttaagacaaggactcccccaaatcctaagcgctcctattgaggggattatcaatgccgccgatgtggtctcttttgtccttattgtgggcggctccttcgggattatactgcagacgggagccattgaccgtgcccttacagctcttgccagacggctgaagaataaggggattctgcttattccaattgccatggttatattcagtctcggaggctctacctttgggatgagcgaagaaattattccgctttatgcgatttttattccattaatgtttgccctaggcttcgattctatgactgctattctcattctatttctgggaacgcaaattggctatgttggttcgactgttaatcctttttcagtattgattgcccaggggatcgcaggggtggaggggaatcctcagctctggctgagatttattgaatggcttgtatttactatgatttctattgcctttacaatgtggtatgcgcaccgggttaagagaaatccggagaaatccattgtttttcagagtgatattataaatcgcgagcagtttataaaagaaaatacaggtgaggacgtcgtcttcacgtttcgggacaaattaattataggtggatttattgtaacgcttggagcaattgtctggggaattttggtcaaaggctggtatatgactgaaatcggcgcccttttcttcgcactcggtctttttgtcggggtagttactaaaatgagccagaaggaaatagctgagaattttgtaaaagggtgtggagaattcatctacgctgcagtgatcataggtctcgcccgcggaattctgatcatcgccgagcagggtatgatcatcgataccgtattgaatgcactcgcaagcattctggaaggattgccaagttacttgttcaccaccattatgttggttgcacacaatattattactttcctggttccatcttcttcgggggaagctgcactaacaatgcctgtacttgcaccgcttggcgatcttgtaggtatcaatcgtgaagcagtagtcacagcgtaccaattcggtaacgggttaaccaatctcatttcaccgacaggcggagtactgctggcgggattggccattgcccggatcagctttggacagtggctgaaggtaatcttcaagctattccccatcctgtggttagttgctgctatttttgctgcgatttcggctgcggtgggtatctaataaatcaagtgagagcccctgtcttttagagacaagggttctttttgtgcataagtttacgtaaaaaatgaataatatggatagcattttcctaaggaggaaataaaattgatgcacgctgataatagattactcattgctgctctaggcggtgttaatgaaatcgggaaaaacatgtatttcatccaatacgatcaggatattgtcgttatcgattgtggctccaagtttcctgatgagaacttgcctggtattgaccttattgtgcccgatgtcacctatctgctggaaaatcaagataaagtcagagcgctcattgtgactcatggacatgaggatcacatcggaggtattccctatttgctgaagcagattaatatgcccgtttttggcacaaagctcaccatcgaattaattaagattaagttaagggagcacaatcttttacgtgatgctgagcttcatcttatagatgcagattcaaccgttcaagcgggaacgattcaggcctcctttttcaccacggtccacagtattccggattgcctgggtgtcttttttcagacaccggaaggcaatgtggtccataccggggatttcaaattcgatatgtctcccgtaagcggaccttttcccgatcttcatcgaatggctgaaataggaaagaagggggtaaaagtgctgctctccgaaagtacaaatgcggaaaggccaggatttaccccttcagaacgtttggttggcgggcatattctagatgcatttgccagagccaagcagcaggtatttatctccacgttcgcttctaatgtgaaccgtgttcaacaagtcattgacgcggctgtggaaacaggtcgcaaactggttttactcggacgcagtatggtaaatgtggtttcggtggccaaggagctgggcttcttgcatatgcctgaggatttgttgattgagccgggggaaacagagcggttccccgcagaagaaattgcagttttatgtaccggtagccagggagagccgatggccgcattgtcacgtttagccaattccctgcatcccaaaatcgaaattttgcctggtgatacggtcatcattgctgcgggagccataccggggaatgagcgaaacctttcccaggtcattgataacttgtatgtgctcggtgcccaggttatttatggatcaggcagttccacggggatgcacgtatccggtcatggcagtcaggaagaattaaaattaatgatgaccctgatgaaaccggagtatttgattcccatacacggtgaattcaggatgttgtatcagcatcgtcagctagcggagtctgtggggattccgatggagaatgtatttatcgtccataacggtgacactgttcaaatcgaagagggaagagcatccctggggcccaaagtatcagccggcaatagcttggtagacgggttggtaacaggggacgtaggtaatattgtactacgagaccgtaaaaagctttcttcagacggaatgctgattattgtgatgacgttgagcaaaaacgagaagcaaatgctcgcaacgccagaggtcatttcaagaggctttgtatatgttaaggattccgaagagctcatgagtcagatccacgacacgattatgtccacagtgaacgagttaacagaaatcgaaatgagtcagtggggactgattaagcagatgttaaaagatgatgttggccggtttatttacagccagacgaagagaagacccatgattttacctatcattattgaggtatagaatagcgacaaatgtcaaaacaagatagagcttgttcaatacgcgattactcaaaaaaagacttaaatcagcaatacaactgatttaagtctttttgatttcctgtttttcctaaaaatgcggttgtaatggtggtttctagcgaagcggaggatttgaatctggagaagcgacagcgatcgtaagatcaaatcctacgcgtagtgcctccaactcctacagcatcatgtttaaagccgcttgggttcctgctgtatgccctgtcgtaaacgccgctgtaatattataaccacctgtgtaaccgtgaatatcgagaatctcaccgcagaagaacaatccaggcatcagcttggactccattgttttcggattaatttccttcaaattcacaccgcccccggtaacaaatgcttccttcagagagagcgtaccgttcacacggattggaaacgccttaatgcgatgagcaagttcttgccattgctgcttgggaatatgatcataggtcaagtcctcacgcagttcggcttgctggagcaacaatggaatcaagcgttccggtaaataaggcttaagcacatttttgatcgcttttttagcatcgaccgatgccaattccagcgtctcacggtagacttcatcggcaagtttgtgaggctgtaaatccagagtcaacaacaccgtgtttaccttatcctttttcattcccttgacgacaaactgactgcagcgcaaagcagttgggccagataaaccgaaatgtgtaaaaatcatatctccttcatggacgacaacttttttttgcttagcattccatacggtcaggctgatatcgcgtaaggatagtccctgaagctctttcgtctggatgaacgcctcgcctgaggtcaacggcacctctgttgggtacagttccgtaatcgtatgccctgcttgttctgcccatgcatagccgtcaccttccgagcctgtatgcgggacggatttgccgccaacggctacaatgacattacggctatgtaatatttcaccggaacgcagccgcaccccagccgtatgaccttcattgtaaataacctcttgaacaggacagcttgtccgaatctcgactccttgagagcgtaccttgttgatcaaagcatcgacaactgttttggctttgtccgtcactggaaacatacgcccattgtcttcttcctttaaggctatacccagctgttcaaaaaaggcgatgatatcccgattgccgaaagccgccagtgcactgtgcagaaaacggccattgccaggaatgtgtcgaatgagttcgtccagctctttggcattcgtgacattgcaacgacccccaccagagatccccagctttcgcccgagcttatttcctttttcaagcaaaagcaccttggcgccctcaccgctggcagcggcagcagccattaatccggctgagccgcctccgattacaataacgtcgtaagtcataaacctcttccttttcgtcgacaaattttcaaaaaattcagaatgatgtaaccgattttccatcatatcgtaataccgtcgctttagatagccttagagcacagcaaacacgtatatatttcaattttaaagaatttaaaacacgtaaaaacgttcctcttatatacatctggtatttagcagattttgtcgttctacaccgggattttaacacatatattgtaatatattgtagcctgtgctttaattcaactaacggcgtcaaggaaagatgatgagggggagaagtccttgttaattgcgttgaaggaaagtgtgctccaagttctccttgccgttatatcggcgggttttttctctatattaacggattatggggataagaaaaaggtttggggcggcaatctgcttcctggacctaatcaaggaatactgtatctgtgttgcttgccagccatattgctatgtacactctttcaatatcagtctccgtatggtctaccctccaatctcggtattattccccttgctgttggcatcatgtacggtagacgtcgcactgccttcgtgctcgctgcttccgcactgatgggtgttctgattatagcccagtcgacagaaatgtccccgatgtttgtgggcacggggtttatcctttttccttttatgctgctgcatgtcaagttttttcaaagaggaaccttgttggacaaaaaactcctaatctccgcatatgttgtggctgatatgctgtttaaggcgatatttccgctactgtggggcaaacaggatattgcggtatacgttcctgacttacttacaacgttctggaatattggtgcaggggtgctggcaagttttacggttgtgagtctgatgcataatgcctttgagaagctggcgctgcggcgtgatgtgactgaatttacgagcaaatacttaattgaagtggataagctgcgtcaagttatggatttgatgccgttatctcttgttactctggacagcgaagaacgagttatacatatgaacaaaacgatgctggaactctaccaggacttcgatccctacattacactgcctgaggtagtaggccgtccattgacctcgttatatggttttagcgctttgcctgtggttaacgaacgagttgcaaaagcgttggaaggagaggcgggtgctgattttataaatgttcctcccaaagtattcttctcaagtttccttcctattcgtgataaacatgtaaaccaaacgacaggcgtcattatcgccttgcaagatattacagagctggagacgctgcgcagtgagctaggcaactttgaaaggctcagtctggtcggacagatggcagcgggcattactcatgaaatacgtaatccgatggcggttgtgcgtggttttttacagcttatgcgtgagaaaagtccagaatctctcaaccattactaccgcattgtgatggaggaactcgatcgggcgaacggaattattaacgatttcctttcactggcccagaatcggattgtcgagaaggagcaatgtcatctgcatgatattattcgcgaactgacgcctttattgtgggcagatgcgaatctgagagggcagacgattgagctaaagctggaggagcatgtgacgatgctgcatttgaaccctaaggaaatgaagcagttgctgcttaatttatcacgtaatgcgatggaagctatgggagaaaaaggggtgctgactatttctactcatgaggaagaggattttgtggaactggaagtaaaggatacaggtccgggaattccgcaaaaacagcttgaaaagctgttccaacctttttacaccaccaaaacaaaaggtacaggtttggggctggccttatgtcaaagtatagtggagcgtcatcacggtacgattgcagtagactcggtggagggaatgggcacgcagtttaaagtccgattgcgcagaaccgtcccgacttaccgggatcatgctgagcctcctgtcatgaattcgatacagaaataatcgtgcaaatatatagccggatttttgcaaattacgtgaaaaagattgtataatgaagtttagatgtccatgcctttactacggcaaaggatgaaattagaaatgtagtatacatgatttttggaaaaggagtgaaagaatatgtctatgtctttcgatcaatatatgagagattcagttcagccaatgcgcgatgaactgacgaatcttggaattcaggaactgcgtacttctgaagatgtggaggccaagcttcctaatgctaaaggtacagtgctggttgttgtgaactcggtatgtggttgtgccgcaggccaatgccgcccgggtgtggctgaagcgttgaagcatgatcttacgccagatcatctgtattcggtttttgccggacaggacaaggaagcaacggcaaaggctcgcgaatttttcgcaccttacccaccgtcttccccttccatcgcgctgttgaaagacggcgagctggttcacttcatcgagcgtcatcaggtggaggatcgttcggcagatcagatcgctgctgatttgactagtgcatttgatcgtttttgccggtaagactgctcaagctatgccccgcatttttcgcctgcgaaacttgccggggcttttgcatgttggcttatgaaggaaattcctaaaaaagaggtgcttatctgatgagtttgcaggaacagattattgctgaattgggagtacagcctacgattaatgtagaggcggaggtccgtaagcgtgtggatttcctcaagtcgtatgtaacgaaaacgggaagcaaagggctgttaatcgccatcagtggcgggattgatagtgccgtagcagccgctttgtgcaagcgggctacagatgaattgacgcaggaacaaggggacgaatacaaaacgctgggtgtattccagccatacggccaacaggaagatatcgagcatagctacgcggtagctaaagcgttcgacctgaaatatgctggggaaacgaacattaaggaagccgtggacaaggttgccgtggaagtagagcatacgttaaaggatatcggtctggagcgttccattactccgcaagtgagagggaatgtaaaggcaagaacacgtatggtggtgcagtacgcactcgcgaatgagctgaatctgctcgtcgttggcacagatcacgcttcagaagccatcacaggcttttataccaaatggggcgacggtgcggttgatattacgccacttagcacgctcaacaaacgtcaggtgcgcttgctcgctagctttcttggagtcccgcaggccattttggacaaagcgcctacagcaggattgtgggaaggccagacggatgaaaaagaactggggatctcctacgaagcaaacagcgactacctggaaggcaaggaaattgacccggcggcacgcgaaaagctagaaagcttctttacacgtacagcgcataagcggacaagcatcccaggagtgtaagcattaatcattatggaattgtaaaatcctgaagtaaataaatgcggcgatccgcccggcggatcgccgtttgtattgaaggggcaataatttaattggtgatccactcaatgaaacggcgggtttcagtaatcgcttgatccagtggaaggctacctccccggaatggatgaacggtattaaaggtatgattgccgccttgaatttgtacccattcgatgtcgggacgaacggatgtgagcagggcagagccctcccgtagacgtttggaatcttcggttccctggatcagtacagctgggagctggctgttggcaagtctgtctacaatggcaaaacgctggtgattttgttccaggtcttccagaatgacagcatccagcggaagctgttgtccggttctagcgttctccacatagctgcgccccttggcgcgcatttcttctttttgcggtaaagtaaacaaatcaagatctgtcacgccattccatgaaatgacgccagcaatctcgccgggatgatctagagcatatacaaagcagcttcccgcgcctcggctatgtcctaacagaaacaacggcaattctctgaactcatgacgtgctctcagattggacagcaatagttccaaatcctcttgttcgcggctataggtgttgcgtgcgaacttttccagctcggtaaaattctctaaatcctcacctatgccattatgtgaaaagttgaaggtcacaacatggttattcttactcaatgcttctgctatataggggaacatgccccaatccttaaatcctttgtagccgtgagcgatgatgagcaggcttttggctgtatttttagcgggaaaccaggaagcccggatcaccgcatctgttcctgcttcggtacctgcttcaacaataatggtttctgacatcctatccttcctttctacgggattttttttaaatgggcatatgagctgaatttcaaaacattcacctatagcctttcttattttaacatattttggtgccgcttttacgcctttgtgactcgccagggtgtgtacgcactgttacaatagatccagtaaagtaaaaaggacggggaatacccaaatgatctacggaattggacatgatgtgctggaaataagccgtatggctcatattttagcaggtaaatatgcagatgcgtttttgaatcgggtgctgaccccggcagaacgtgagcttgctgtggaacgcaagggtagactaacggagttcgtagctgggcgctttgccgccaaggaagcgataacgaaagccttcggttgcggaattgggcaaatcatcgggttcggcgatatggatattttaccggaacctggggggaagccagccgtttatttgtcttcatccgcatgggatagactgagattgccgtctacaggtgactcgaattacagcattcacttgagtattacacatcagcctaacattgcctctgcttttgtgattgtcgaatataaggagatgtgatgtgatgactacaaatacattggaacaaaagcgttatttcagctttgaactgttgaattggtatacacgtaacaaacgtgatttgccgtggcgccgccatcggaatcctttttatatctggatctcggaaattatgcttcagcagacgcgtgtcgatacggtcattccgtattttaatcgctttattgcacgttttcctacaattgaagcgttggcggaagcacccgaggaggatgtgcttaagctgtgggaagggctgggttattattcgcgggcccggaatttgcaaactgcggcaaaacaagtagttgagcttcacggcgggcaggtgccggatgatacacaggctgtcgctgcactgaaaggagtaggcccgtatacgacgggggcgattatgagtatcgccttcaatcgaccagagcctgctgtggacggaaatgtaatgcgtgtgctgtcgcgttattttcttattgaagaggatattatgaagggcagcacgcgggcgcatatggaaagtctggtacgggagctgattcccgaaggaagggcctctgattttaatcaggctctgatggagctgggggcgctggtctgcacgccgaagtcgcctcattgtctgacctgcccggtcatggagcattgctcgggcaggttggcaggtcgcgaggagacgctgccagtcaagaccaaggcgaagccgcctcggctggagccacgttccgtagccctcatcgagggcagcggagcgaacgcaggccgcctgctcgtacggcagcgcccggccaagggcctgttggcccgcatgtgggagctgccgcatgagcttgccgggccggagggctacaacggcccggtgccggatgagcccgccatggaccatttggcggctcatttgctggcagagggcgtgcttgcgcgcccgatgcggtttgtacgtgaggcggagcacacgttcagccacattcactggaacctgcgtgtgttccagtgtgaagaggtcgccgtccctgccggggaggcgggaggacatccgctggctgccgaacagcgggccagctacagcaccgaagcgaagccgggtgcgttgattgcgctggctgagcaggcggagcacgcgcataatgcgctgccagcggggtaccgctggatcagcgaagcggatatggccaccttggcgtttcccaaggtgttcctcgatctgatcaccgagtattatgcgaagcaaaaagagaactgatgttagttgaatagctgtcagcaaaaaattagactgagcctagaaaatggaaacagcgacaaccaaggacgagaaaataaagtccaagactgtcgctgtttcctttgaactaacgtttcccgttagcggaatgctcgctaaccgtaacaacgttagacgtacctttttcgcgtattgttctctccacccctagagtcttcactcttgtccccgatggggttagatttgatttcacataacaagctacctacccctacctgaataaataatattccttaactggatgacctgacttttaagctctttctctctctccaaaaagtagagcgaagcttgcagcaacgggaagttcggttccgctttacgagtttcgttctggataaaatggtaaacctctttcaactccgaacgatgttttgcgccggatggaagaacattaagggccgaatccatctcccggaacagctcggtaaggaactgctctctctccccttggcggtcctcgagcccccagcttaaatacctctcgaacgaagcctgtttcagcagaggcttcaggttagaggccatcatatgcttaacgagcacattgagcttatccaaaatgaaccttgccgtttcctcaagcgataaagacttttcttcataaacgatccaaaataagtactccttcagaatcgcacgatagatggaaaccaaatcccacaggaacggataaatttcttcgccataaacctgtatcaagcactctttatgccatcggatgagccgccctctaaccttgtgtctaagcggctggaacttgggatcctgttggatggggagctccgtgaattcgaccagaatatgcttgtattccataaaataacggaatcgcagaatgatctgctgcagaaactgctcttctggcgagagttcgggaaagcgtttcagttcatcgacttgatcaaaataggcgttatggcattgatcaaacacctcgctgaagaggtcttccttggaagggaaatatttatagactgatcctttggcaataccgcaatcctcggcaatatcttgtatcgtcgtcgaaagaaacccatgttccttaaaaagcttcatcgccgattttaaaacctcttcccttgtcacactcataagaaaaatctcccccttgactattcatgaatgatagtacaaaatacgaaacatgaagtcaaatgactatatgttcacgtaattaaacatacggtcaaatcgaagagatgaggagaacatacagaatggaacgattatgggatccacaaaaaacagcattggttgttattgacttgcaaaagtggataggaaatcaatacgccccttattctgctgagcaggtagtgtctaacgccgcagccttggcagatactttccgtgagcaaggctcaatggttgcactggtccgggtatctagtaaagatttgaaggatatcccgcgtcctaagttggattcgcctgcaccacccctgaatctgcctgaaggatgggatcaaatcgtcccggaaatgcggatcaccgagacagaccatatcatcacgaagaagcaatggggggctttttacggaacggagctcgaccttcagttgcgccgccggggaattgataccatcgtcttatgcggcatcgctactgagttgggcgttgatacgactgcgcgggaagcgtttatgcatgggtatcagctgattttggcgattgatgcgatgactggattttccgaaaccgggcatgattacgtaaaaaatttcatttttccacgcatcgggcgtacccggacaacacaggaaatcctctctgccctttcaggcaactgtttatagttgaaaaaatgactttcccattccccgtgtattatttgaccgaatacacgaagaacgccacagcttgaaactcgctttgcgtttgctgggaatctcatctggccatacttaaaggacgattatgtgttctcagggtgcacatatgggctgacggcatgggatacgacctgttgcacccaatatacaaagtaaccgctgaatgatatagagcgaacggctcgtcgcaattggcacgcgcttcttgtatagcaaccagcatgagttccgcaatgcccaatgggacgagtacgcctattggcgcagcgcttatgctaataaatttgcatattgccagtggaattggtggtgctcttttaaacggtcttttccaatcataagctgcgcttttattgtctttcgtaaggccatacgatttatcgaaagctttaaactatcctgcccgttacttaaacaaaggcagccgatcactatgatcggctgccttcttgtcttttatgagctatcgttttccgttagaattcctgtaaaa

SEQ ID NO: 2647 - DNA, 71839 bp, Unknown
  Kingdom: Bacteria, Phylum: Firmicutes, Class: Bacilli, Order: Bacillales, Family: Paenibacillaceae, Genus: Paenibacillus
atcctaagaataaaacgcaaataagtttcggatccagttttcagggtgtaaccttgaatgtatgtacaagtgaatacaagaagcgcatggctattcattcacacgataagtgatgaagcgaataaccatacggtagaatttgcacagcaaattcatgtttggtggcgatagcggaggggttccacacgtacccatcccgaacacgaccgttaagccctccagcgccgatggtacttggaccgcagggtcctgggagagtaggacgtcgccaagcaaaaagtaaaagagaccaagatcttcagaagatcttggtctcttttttgcgttataaggcagtgggattttatttaaagtgagtttgttataagtttaactggataagtggatattaactaataaataagaagacggttttaaaataatttagtaccaggtattagtatctggtgttataatgtgaataaggattacaaaggagagtgatcagattgttgaattcaaaagctaagcttacggcctttggcacttatgtacctgaacggattttgacgaacgctgacttggagaagcttgtggatacgagtaacgagtggattgtacagagaacgggtatgcatgaaagacgcattgcggctgaagatcaatatgtatcggatttatgtatacaagctattactcgtatgattaacctgtatgacgtaaatataaacgatgttgagatgatcattgtagcgacgagtacacctgattactactttccaagcacggcttcacgtattcaggctcattttgatattccaaacacaggatcaatagatgttagtgcagcatgtgcaggtttttcctatggacttcatttggcaaatggccttattacgagtggtctgcatcgtaaggtgctggtagtgggagccgaaacgttgtccaaaattacagattatacggatcggacgacgtgcatactttttggagatggtgcaggggttgcacttgtagaatatgacgaggatgaaggatcatttttaacttcagatataggtacctatgggcaagggggagcacatctttaccgtgtgggattatctgatcatttggatggagagaagctgcaagaccatggatttattgctcaaaatggacgagaggtttataaatgggctgttcgctctgttccaacgggaatcgaacgattattggataaggcaaatatgaagaaggcggatcttgattggtttgtacctcatagcgctaatttgagaatgatcgagtccatatgtgaaagaagtacagtacctttggaaaaaacgctgacaagcgtagaattgtatggtaatacatcggcggcatccatcccgttggctttgcagtgtggtttggatgatggacgtttacggtatggacaacatgtgttgttatatggatttgggggaggcctcacctatgcgggtctgctattaaaatggagtgtgcctgatttgtaagttatcctaacccatgtagaagcaatagcactagtatgtacgatcatgttaataagagccgttggcattagaatttatcgtaagttggcaggatgctataattaacactatgagagaaaggagcgtaacatgaaggtattggtattggcagaaaaaccgtccgtggccagagagattgcacgtgtgatgggtagccgcgagaagcataaaagttatatagaaggaccccagtacgtggtgacgtgggcactgggacatttggttggcttagcagagccagaggattacgattctaagtatgcgacctggaatttggaggacctacctattcttccgaagagttcaaagttaaaggtgctgcgcgaaagtaatcatcagttcaaagctgtgcagcagctcatgaagcggcaggacattggagagcttatcgtggcaaccgatgctgcccgcgaaggagaattgttggcacgctggatcatccaaatggcaaactggaaaaagcccttccggcgcttatggatctcctcgcagacggacaaggcgattaaagcaggtttcgcaaagctattgcctggtcagcagtttgatcgtttatatgaatcggctcgctgtagagctgaagcagactggatgattggtctcaatgtaactcgcgcgttgacttgtcgttataacgcccaactttcggctggaagagtgcagacaccaacgctggggatgattatggaacgtgagaaggaaattaccgaattccgttctcaggaatatgatactctgacggcggattttggcgattttcaggcaacttggcgggcagaaagcggggattcacgcatgtttgaccgcactcaagcagaggctttgcgccgaagacttgagggggccaaaggcacagttgccagtgttaaaaagagcgaaaagaacgagcctcacccgctggcgtatgatttaacggagctgcaaagagatgctaaccagcgctatggcttttcggctaaacagacttctaatctgcttcagcgtctgtatgagcagcataagctggtgacctatccacgtacagacagccgttatctgacatccgatatggtggatacacttaaggaaaggctcagtagtgtagcagtaggtccgtatgcttccttggcacgtccgctattgcgtaacaacctaccaatcacaaagcgaattgtggatgacagtaaagtcacggatcatcatgcgattattcctactgagcagacattattgcttaatcagttgagccctgaggaacgtaagctgtatgatctgattgcacgacgttttatcagtctattctatccacctgcacgttatgatgctgtagccgtatcagtaacggtggagcaggagacgtttcaggtaaaaggtacaacggtaaaagatagcggatggcgtgctgtatatgacgcgaaccattatgatatggatgatgaagaagcagaggatcgggaaaacaatggacgaggcgttattttacctgagctgcaaaaaggagattctgtccggttacagcgttgtcttgtacgacctgggcgaacaatgccgccgaagcgttatacagaagctgccctgctcgctcagatggaaaaacatggactgggtactcctgctacccgtgccgatctgattgagaagcttgtcagctcggatacgattgagcgtcaggggaacgtgatgcatccaaccgggaaaggtaagcaactgattgaactggcggctccacagcttcgaacgcccgaattgacggcacgttgggaagcggagctagaacggattgctcgtggtcaaggacaaccggaaccgtttttgaattctattcgtgctatggcgaaagagctggtttccactgtgaaaaatagcaatgcggagtacaagccccataatgtgacgaatagtcattgtccagattgtggtacaaagctattggagaagaagggtaagaaaggcaagttccttgtatgtccaagtgcggattgcggttaccgtcgttcaggggaaaaacgtttgtccaatcgacgttgcccgcagtgtcataagaaaatggaaatgaaagagggcaaagcaggattgtatgtaagatgcctgccctgtggcattaccgagacgttggataaggacaagcaacgggtaaacaaacgggaacagcaaaagctagtaagacaatttgaaaaacaggaatcttttggctccagtttgggtgatttgcttaaagcagcgatggaacaaaagcagggcaaatagcaggcaaataacggatgaccaaaaatgctacagtcaacataatcagcaggtatacgtcggtataaaaacgatcactccttggcatggtaagccgaggaggtgagtatttatgtccaaacataaaccgcttaaaatcaataatcagcaaaataaatcaagcatactggaggaggaaattgctgctcatccagagaagcaagcgaaatatcctccaagcttgaatgggattcccaaacagcagtcttgatgcgcgtgggagggacaacgaattactgtatagaaccaagacgattggacgtcagatgaagtagttactaatgctagacctgtctcgcaaaaaaaagaagcagcagttacggtggtcaaccgttactgctgcttcttttgcataataaggatgatgttttatttgatttggatgactacttttagtattcattgaaaaaggattgaatttggttaacatcgtgtgtttgggtcaaagcaagcatgagcaaaatccgtgctttttgcggattaagcgaatcggtcgatacaaagttcgatgccgcgtcttttgttgacggggacaccactccacttcccacgcggctggagcgggcaatgatcactccttttttacctgcggcctctgcgccttctgaggaggtcttggacaaggaaccattaccggaaccagctacgacaatacccttggcaccagctgctacggctgcatcatacagatagcgaccattgttttgatattcgtataaaatatctacttgtggcagttgagtcaggttagagatgtcgaatacagaagaagtcgtatgcttgtgtgtggatttgttgtagtagtacacttgatcgcccacaacagctccaaggtacccctgctccacagacttgaacgtatcgactgctgttgtgttcgttttggtgatgtatcttgctgcaccgatacggtcgttcaacaggacgagtacaccctgacctttagaggccgaagccccggcgactttcactgcattataaaggttgaagggaccatcagcactgatggcagtagctggacgcatagagccaacgacaactactggcttatcgcttttgataacaagattgaggaaataagctgtttcttctaatgtatctgtaccatgtgtaatgacaacgccatctatatcgtctctggcaagcagttcattggtgcgtttggcaagttttaagaggatctcattattaacgtcgggactacctacattaacaacttgctcaccactgacatttgcaatacttttcatctcaggaacggcattgatcagagtttctacacccaacgcgcctgctttgtagccggttgtatccgtattgacggaagatgatcctgcaatggtccctcctgtggcaagtattttaatattgggtaaatgattggtttgaggattttcggatttgtccgacgtagtagtggtagaagcaggtgcagttgtgctgttggtagctgctgccgcaaccgcagcgttggcggtaaatccaccactccataaggtactaccgagaataaagctagccaacaggggaatcatcgtcatttttttcatgttagtcatataaagctcctctccaatcttaaacctcaaatataaatgatagattaactgacaaatattttgtcgaattacgttaatatcacgaattatagggtgtaaaattacttttagtcaacacctatgttaggaaatatgactttagaacttatttattataaatgtaatcgatttcaaaaaagacatgtgcaaaacaaaacaacaagcagatatctcataaggagtctgcttgctgttattgtggaagctaaacaatagagtttaccctgtaatcaattcgcataaaaggctgcagggttaagttaatactttaggttaataacgcggctatacagcttaatgcagattcgttgatcaaggattgttggaatgctgttttgtcggcaagctggcgctgggagttccttttcctcgtttacggttgcgttctgccttttttgcattttctcgcagcttttcaacgtattcatgggtgctttccatcgcagttcctcctttaagacgaaatagatgcactcggggattgcccttatgccaccttactatttccgcaaaagcgctatccaagtcagaagaggcgttgtttctgtaaaaggggtggggttataatgagggggagagcgctatataaggcctaatacctgaacttggtacggtgtgcaaaaggaggagagacattgcagacaggcttgttggtatggctgctgtttatcaatgcagtaggctatctggtaatgtcggaggataaaaagagagcacgtaaacatcgtgatcgtgtacctgaacggacgttgtttttcctggccctgatcgggggagcgttaggcgttctaattgccatgtaccgtaaacgccataaaacacggcatatgagcttcagactaggtattcctgcgttgctattcatgaacgcattgctgtttggttattttttacggtaaggctgggggtttaggttctcatagggaagtttaatgatgagtgagaagactatttcagccatccggtgacatggaatgaacaaccacaggaatacatatttcaggctttgaatcaataaactgaatgaggaagaggtgcatattatgatattttcaaaagtattgcttgcttatgacggttcggatgcatccaacaaggctttgttaaaggcggctgaattggtcaaggcatcaccgtcctcgaagcttgaggtggtaacggcattcgattttcctcggatctttatgggcgaaggtttggctccaattccggcttcaataaataaagaatattacgatttggccgaacaaactacggatgaagttaaaaaacgacttgctgagcagggtgtagatgccaaggtggaactgattcaaggttctccagccgaagtcattttggattatgccaatgagaatggcttcgatgcgattgtgatcggcagccgaggtttaggtggtatccgtgaatttgtattgggtagcgtaagtcacaatgtggtgcagcatgcgcgtattcctgtgctggtcgtaaaataactaaataaaaagtaaaagtcggtttactgcctgtatagggagtgccgacttttattttttttcagtgggatgcgttgcggtcgctgttatcaggggaggggagcgatagctaaatataatacaatagtcctgacctgtaggtatataagggtactgattccactaaacacgaacattctattgtatgattattctaatgttcgttttcaagttgacataaggtgtagggaattgttaaactaggaagtgtattatcgataaaaaatgaacttaaggtacaatttaataaggtacacatgtttgagccgaaacaaaccacgatcatacttgtaaagaatatcgattgggatggaataggcacaatgctaactcgtataatgccggggatatggcccggaagtttctacctggaaaccttaaatttccggactacgggagacatacggctgaagccgcattggatgcggtggaagaggcttgcttttggcatgcctttaagaggctctgtcgtttgttttttcgtagtccggtgtcttgaaaataacgttattttcgagtgccggatttttggcgcttattgataaacagggagtgaaggacatgtcagtgcaggtcgctgtcattatgggcagcacatcagactgggacaccatgcagcatgcatgtgctgtgctggacgagcttgaaatcggatatgagaaaaaagtagtttcagcccatcgtacaccggatttaatgtttcgttttgcagaagaggccgctgggcgtggactaaaggtcattattgctggagcgggtggggctgcgcatctgccaggaatggtggctgcgaagacagcattgccggtcattggtgtgcctgttcagtcgaaggctctgaacggtctggactccctgctctccattgtgcagatgccgggtggtattccggttgccactgtggcaattggtaaggcaggcgctacaaatgcagggctgctggcagcacaaatattaggcgcttttgacgaaaagataagccagcgggttttggcgagacgcgaccgtattcgtgatgaggtgctggaaggcagtgactcgctatgaatggggcaagtgaacccgcaggccgtatccgacctcctggtacaacgattggacttttaggaggcgggcaattaggaagaatgcttgtactggccggaaccaatctaggatatcgctttgtgacactggaccctgcaccggatagcccttgtggacaggtgtcagaacaaatccgcgctgcctatgatgatgagcatgcggccagagagctggctgagcggtgcgatgtgatcacgtatgagtttgaaaatgtggacgcaggtgtggctgcgcttttggaacaggaatccagcgtaccgcaaggtagtagtcttttgtacacaacacagcatcgtctgagagaaaagcgttctattgaagctgctggtgtccctgtcgctccctatcgtgaaatcagtagttctgcggatatggttcaagcggtagctgaactgggtgtaccgtgtgtgctcaagacagcagtcggtggttatgatggcaagggacaagtggtcattcgccaaccggagcaagccacggctgcctacgaacaactggcaggaggcggtgcggaactggtattggaacagttcatccgttttcgctgcgaaatctcggtgattgtagctcgcagcacgaacggtgaagccaaagcctttccacctgccgaaaacattcacgtgaacaatattttgcacacgtcgattgtgcctgcacgtgtgccagagcctgtccaggaggaagcacgcaagttggcgctggctgtggcagagtcgctgggtgcggtgggactgctcgctgtggagatgtttgtcaccgaagacggacaattgtacgttaatgagttagcaccacgaccgcataactccggtcattacacgatggaggggtgcgcgacgtcgcaattcgagcagcacatacgtgcgatttgcggtttacccttgggcagcacgaagctgctgacttccgtcgtgatggtcaatgtgctaggtgagcatttggaggatgtggttcggcggtttgcgcaagcggatgttgaagctgaaagattggatgttgtacccaagctgcatttgtatggaaaaagtgaagccaagccaggccgaaagatgggacatattaatctattgtgcgaggatgcggaacaagcgctggaatggattgaacaaaccaatatttgggggaataaatagtcatgatcgaacgctatagcagaccggaaatgagagcgatttggacggaagaaaataaatttaaagcgtggctggaagtagagctgtgtgcctgtgaagcatgggcggaattaggggttatcccaaaagaggatactgttgctctgcgtaagaatgcaagttttgatattgaacggatctatgaaattgagcaggagacaagacatgatgtcattgcttttacccgcacggtatccgaaagtcttggagacgagcgcaaatgggtacattacggtctgacctccacagatgtagttgatacggcactgggctacctgttaaagcaggcgaatgaaatcctggagcgcgatatcttgaattttattgaaattttgaaggaaaaggcattggcttacaagcatacaccgatgatgggacgtacacatggagtgcatgccgagccgaccacattcggactgaagatgggattgtggtacgaggaaatgaagcgcaatctggaacgctttcgttttgcggctgaccaagtacaatacggtaaaatgtccggtgcagttgggacatatgccaacattgacccggctgtagaagaatttgtatgccgcaagctgggcaccaagcctgcacccatttctacacagacgcttcagcgcgaccgtcatgccgaatacatggcaacattagcgttgatcgccacatcgttggacaaatttgctacagaagtccgtgctctgcaaaagagtgagttccgtgaggtggaagaagcttttgccaaaggtcaaaaaggttcttccgcgatgccgcataaacgcaatccgatcggcagtgaaaacatctccggtctggcgcgtgtgattcgtgggcatatggtatctgcgtatgagaacgtaaccctgtggcatgaacgcgacatctcgcattcttctgtggaacgtattatcctgccggatgcaacaatgctgttgaactacatgctgaaccgttttggcaatatcgtaaaaaatctgacggtcttccctgaaaatatgaagcgcaatatggcacgtacgtatggtgtaccattctccggccgtattatgacgaagctgatcgacaaaggctttagtcgtgaaaaagcctacgataccgtgcagccgcgtgctatgcaggcgtgggaagaacaacgccagttccgcgaaatcgtcgaggcgaccccggaaattactgccgtgctcagcgcagacgaaatcgaggatgcgttcaacccagcctggcatctgaagaacgtggatacgatcttcaaaaagctgggattaggggagtaggagggaaggttgctgcgtggtgaggccgctgcgcgaacggatcattcttccgattgctgttgcccctggattcctatgattgtataagaccagatattggttggaatccagaggcaaaggcaagcgctgacgcttctccagaacgattccgtccgctccgctgcacccagcatcaaccctcatgtgggagcagaactatgggaaggtgcggcacataagatgccgcacctccccaaaggcgatggaaaagcgtgttccactgctttctatcgcaggccacgttctcgtgagggctgccgaatttgcgcagcaaacagcccgctgccctcccgagaacgcgcaggctcaagaagcgaagccttgagccaccgtatccgtgcgcagcgtagcacatgcgcacaacagggcgaagcccaatgctcgctgcacggcatgccgtgctacggccacgggccgaatggtattgcggcgacatgcgcgtaaaaacgttgttttgtaccaacgtaaaagcgttgcttgatgaaagcttgtgcgaacaagccttcatcaagcgaaacgcgctcacatcactctagccacataataaacgcccccatcccgctcaccaagccaacccttgcgggagtcccgagggcagcagccctgggggtcctccccgaggggaggatttaggagggggaatactcttttggaagaggtgtaatgaaatgtcattgtctactgccgaaggtctgatccaggcgccgctcttgtataaaggcaaggtgcgtgaactgtatgatctcggagagcattttctgattgtggtgacagaccgaatttcggcttttgattatgtgttagagccacccgtgcccgaaaaggggaatgtgctgaataagctcagcgctttctggtttgagcagacgaaagacttgttggaaaaccatgtcgtgcacactgatgtgaacaagctcgggcatgtgatcgacgaacagaataaagagttactgaaggaccggatcatggtcacgctgaaggctgaacgcatcgacattgagtgtgtggtgcgcggatatattaccggaggcggctggcgtcagtatgagcagaacggtgaggtgaacggcattccattgccagaggggctgcgtaaaaacgagcgctttcccaagccattatttacaccggctgcaaaaaatgatgttggacacgacgaggacatttcccttcaccaaatgaaagaactggtcggggttgaactaacaggtgagcttgaagaaaagagcttggcgttgtacgaatttgcacgtgctttctgcgagaagcgggggattattttagccgattgcaagtttgagtttggtcttgttaacggtaaggtgattttgattgacgaaattttcactccagattcatcccgtttctgggcgcaggaaaagtatgagctggatgttgagattgacagcatggacaaggagccggtacgaagctatttggcatcatccggttgggacaagaatagcaagcccgatccattgcctgctgaggtcgtagaagaaacaactgcaagatatacggatatttggcggcgtctgacggcacagtaaatagtaatcataattcaaccaataggattcactcattcggaggaggaactgaaggaacatgatgaaagcaacagtctatgtcacgattaagcaaagcgttttggacccgcagggggttgcggtgcaaggcgcactacattctatgggtttcggagaagtggacagcgtcagaattggtaagtatatggaattgaatctggatacaacagaccgcgagagtgctgaaaagcgcatcattgagatgtgcgaaaagctattggccaacacggtcattgaagactaccgctacgaactggagggctgattccatgaaatttgcagttctggtttttccgggctccaactgtgatattgactgctataaggcggtagaggacacggtcggtgaacctgtcgattatgtttggcatactgcgacggatctgtcgccttatgattgtattcttgttccaggaggcttctcctacggggattacctgcgttgcggtgcgatttcccggtttgctccggtgatgaaggaagttgccaaagcggctgccgagggcaaatatattttagggatttgcaacggatttcaaattctgaccgaagccgggttgttgccaggggctttacgccgtaatctgtcgatgaaattcctatgccgggatacggtgttgcaggttgcgaataaccaaacaccttttacaagagactatgctgctggtgaagagatcattattccgatcgcccacggcgaaggcaactattactgtgatgatgagacgctggctcgtttgcaggcgaacaatcagattgtatttaagtataaagataatcctaatggttccatgacggatattgcagggatttgtaatgagcaaggtaatgtgctgggcatgatgccccatccggaacgcgcggtggacgcattgctcgggacggatgacggcaaacgtatgtttacatctattttgaacgcttggagggatcgacatggcgcagcaagtgtccgctaaggaaccgacggcagagcaggttgccgaacataaactgtatcagcagatgggtgtatcggacagtgaatatgcgttgatctgtgaattcatgggacgtcagcccaattatacggagataggcgtgttcagtgtcatgtggtcagagcattgtgcttacaaaaactccaagccgttgttgcgtcgttttccaacgagcggtccgcgagttctgatgggacccggcgagggcgcaggcattgtagatatcggtgacaaccaagcggttgtatttaaaatcgaaagccataaccatccgtcggctgtggagccttttcaaggggcagcgactggggtaggcggtatcattcgtgatattttctccatgggtgcaagaccagttgcggtgttgaactctctgcgttttggcaagctggagagcgaccgtgtgaaatatttgttcgagcatgtggtatctggtattgcgggatacgggaactgtatcggtattccgactgtaggtggcgaggttgtatttgatgaaagctacgaaggcaatccgctcgtcaatgcaatgtgtgtcggactgattgaccatgataaaatccagcgtggtgttgctaaaggggtcggtaacccggtgttctacgtgggaccgccgacaggtcgtgatgggattcacggagcgacattcgcatcggttgagctgacagaggaatctgaagcgaaccggactgcggttcaagtaggcgatccttttatggagaagctggttatggaatcatgtctggaattgatcgacagcggtattgtgctgggtattcaagatatgggtgccgcgggacttacctgctccagcgcggagatggcgagtaaggctggcaacggtctggagctgtatctggatcaggtaccgcagcgtgaagaaggcatgacaccttatgaaatgatgctgtctgaatcacaggaacggatgctgttcgtagtagagcctaaggatgaagcacaggcactggaaattttcgagcgctggggtgttatttgtgcaaaggtcggtaaagtgacggatgacggtcgtttgcgtttgttccatcacaatgaagtggtcggagatatgccagtgacggcgctggttgacgagtgtccgatttatgacaagccttccgaagtccctgcttattatgagcaaaatgctgctattgacacacttcgttatgcagaagtgacggatttgaacggtgcgttgaaaaaggtgctgtcatcaccaagtgtagccagtaaaaaatgggtatacgagcagtatgactacatggtacgcacgagtacagccgttcgtccgggatcggatgcagctgttgtgactgtgcgcggaactcgtaagggactcgccatgacgacagattgtaacggacgttatgtataccttgatccagaggtaggcggacggattgcagttagcgaagcagcgcgtaacattgtatgctccggcggcgagccgttggcaattacggataatctgaacttcggtaaccctgaaaagccagatattttctggcaaatggaaaaagccgtggacggtatggcagaagcttgccgtgtactggatacacctgtcatcgggggcaatgtcagcttgtataatgaaaatgctaaaggctccatctatccgacgcctgttgtcggtatggtaggtttggtacatgatacagatcatattacgacacaaggcttcaaagccgaaggcgatgtgattttcctggtgggggaaacgaaggccgagctgggaggcagtgagttccaagctgtcgtacacggtgtatccgagggacgccctcctgagctggatttgaacgtagagaaaagactgctgactgcggtactgggagcgattcagggcggattggtacaatctgcgcatgatttggcagagggcggattggctgtagcgcttgcggaatctgggattagcagcggattgggagcacaggtcaacgtagaaacgactttgcgtcctgaccatgctttgtttagcgaaagccaatcccgtattttgttatctgcatcgccggataaagcgtcagctctggaagcacatctgcgtagtttggaagtgccagttactgtattaggaaaagttgaaggatcacaattgacagttgaggtgaacggacaacccgctttgaatgaggcagtcgccagtttgaagcaaatctgggaggatgtcattccatgtctgatgaaataacagcacggacgttgtggactggagattattataatgaaggctctggtaaagaggggctgtttgataaattaaaagaggaatgcggcgtgtttggagtgtataggcactccgatgccgcttccctagcatattacggattgcatgcactccagcatcgcggggaggaaagtgcaggcatctgtgtgagcagtggcgacgagttccattatcatcgtggaatggggcttgtaaaagaagtattcaataaagatttgatggcttcgctgacaggcgatattgccataggacatgtgcgctactcgacaagtggagacagtaagctaacgaatgcacagcctttggtgttcaagtatcgtgatggcgatctagcggtagctacgaacgggaatattgtgaatgctttgcaaatccggcatgagctggagcagggcgggtctatttttcaaacgaccagcgatacagaagtagtggcgcatttgatcgcacgatcatccaaggatttagtggaggccgcgaaagatgcattgaagcgtattgtcggcggatttgcctttctgattatgaccaacgataaactgctggtcgcttctgatcccaatggcttgcgtccgttgacgatgggcagattaggtgatgcatatttgtttgcttctgaaacctgtgctttggaaacgattggagcagagctattgcgcgatatcgagccgggtgaactgttggtattggacaaaaatggtctgcacgaagaccgttacagtgaaggcaagcatcgtaaagcactgtgcgcgatggaatatatttattttgctcgtcctgacagtgatttgaatggttccaatcttcatgctgcgcgcaaaagaatgggtagccagatggcgttggaagcttttgtcgatgcagatctggtgacaggagtgccagattccagtatttcggctgcgattggttatgctgagcagacaggtattccttatgagctgggtatgattaaaaataaatacactggacgtaccttcattcagccgagtcaggagttacgcgagcagggtgtgaaaatgaagctgagcgctgtacgacgtgttgttgaaggtaaacgagtcattatgatcgacgattctattgtccggggcactacatcccgccgaatcgtgaatatgttgcgggatgcaggggcactggaggtacatgtacgtattacctcaccgcctttcaaaaacccgtgcttctatggtattgatacgccggatcgccgggagctgattgcttcatctaaaaccgtcgaggaaattcgtgaggaaattaacgccgattcgctttactttatgagcgccgagggtttgattgccgctgtaggtggatataacgaacaggattacaaaggcggcttgtgcctagcctgtttcgataatgattacccgactcaagtagatttcaaaggtgaagaaaagttcggatgtagttgttgagaaacgggaacaaaagagatacaggtggcgcatggtgcaggtgaagcggttctgagggggcactccgcgtgtggaaggttcttccgatcgctgttgccgctggattcctggattggaataaccccttagagggttggaatccagcggcaaaggcgaacgcttcgcttctccagaatccttccacccgctccgttcctcagatgtgcagcattttgcagcagtgcctgtacctctttggttcccatcgggaagaggataggtaaggtcgttaaaaactcatggcataactatttcatgccatgagtttttaacggagcggtgactcataaaaagtcaccctgctcttataagaaggttgagcaagcgaagcgaagctcaaaagcaggcaaggcgaagctgcctgcctcaaagggcaaagaagtgagccgctcgtaggcgccgctcacttctttgcccggcacgtccccgcctttgcgaagcaaacagtccgggacgtgccccgccgcctctattcaaggcggccacgcactaaagcgtgtcctttgtatccgtgggcatagcccacgaatacaaaggacaacacgcgactcacagcacgaaccaccaccaagcagcacccaaccttacacatctgaccgactcttgaggggtccagggggagcatccccatggaatcctccctgttagggaggacttaggagggtcaatcatttgaaggagtgttcatgaatgtccgaagcatacaaaaacgcaggggtagatatcgctgccggtaatgaagcagtagaacggatgaaaaagcacgttaaacgtaccttccgtcccgaagtgctgacggacttgggcggattcggtgcattgttcggcctgaataaggataagtacgaggagcctgtactcgtttccggtaccgatggtgtcggcacgaagctgaagcttgctttcgcaatggatcgtcatgacaccattggtattgacgcggttgcgatgtgtgtaaacgacattgtcgtcgggggagcggagccacttttttttctggattacctcgcttgtgacaaggttgtgcccgagaaaattgaagctatagtcgctggaatcgcagagggatgccatcaatcgggctgtgcgctggtcggcggtgaaaccgcagaaatgccagggatgtatagcgagggtgaatatgatattgccggattcacggtagggattgtagataaaagcaaaattatcaacggtagctccattgctcccggagatacagtgatcggtctggcctccagtggagttcacagtaacggcttctccttggtgcgcaagctgttattggaacagcagggttatgatttgcatgatgaaatcgaaggcttgaacggcaaactgggcgatgtactgctggagccgacgaaaatttacgtgaaatccgttttggcattgctggacaaggtaaaagtaaaaggcatggcgcatatcacaggtggcggttttattgaaaatatccctagagtgttaccggatcacgtcaatgtggatatagaatacggcacttggccgattttgccaatcttccagctcatgcaggaaaaaggcgcaatctccaacaaagacatgttcacaacctttaatatgggaattgggatggtaatcgttgtaggcgaagagcatgcacagactgcactggaagttctgaaggaacagggcgaagctgcatatgtgatcggaaaagtaacggaaggcagttctatcgtgacctttacgggagcagaggtgtaatgaacgagtaccggattgctgtttttgcatcaggcgaagggacgaattttcagtcattggtggatgcggctgcgcgaggagaactgggcggcgcctcggtagaattgctcatctgtgacaagcctgcggctactgccgtagctagagcacagaaagctggaattgcgtgccatacttttcgacccaaggaatatccttctcgagaagactatgagcgtgaattggtggctttactggagcagaaatcgattgatctcatcgtgttagctggctacatgcgtttgctatccagcgtcatggtcgatgcctacgcaggaaaaattattaatattcatccgtcactacttccggcatttccagggaaagatgctgttggacaggcattgacctatggggtcaaggtaagtggcgttaccgttcattttgtggacgggggcatggacacgggagccattattgcccagcgtgtcgtggaagttgacgaccatgatacagcggaatctttatccgcagccattcaatccgtggaacgtcagctatatccagaggtagttggcaaattggcccaaggtaaaatccaattaaatggtcgcaaagtgatttcacttctctaagaatgattgtaatttgtcatatcattgtcatatcaaggatgctgtacaggcattttccgatatttctcgggaaataaaatgataaaagagaattttgcaaaattctgaaagagctaaaggaggagacagggtgagtattaaaagagcgctcgtcagcgtatcggataagcgggggatcgtggaattttgccgcgagttgtccaaattgggtgtggagatcgtttcgacagggggaacgagcagcttgttgtcgaaggagggcattcccgtcatcggtatttcagaggtaacgggttttcctgaaattatggatggacgtgttaaaacactccaccctgcggtacacagcggcttgctggctgttcgggataatgaagagcatcagcgtcagatgaaagaacttggattgggttatattgatctggtcgttgtgaatctgtatccttttgcggaaacgatcgccaaacccggtgtaacttatgaggacgcgattgaaaatatcgacatcggcggtccaacgatgcttcgttctgcggcaaaaaatcatgcttttgtcagtgtggtagtcgatgctgatgactatagcacagtgttggaggaaatccgtaaggatggcgatacggagctcaatacccgtaagcgtttggccgcaaaagttttccgtcatacggcgtcatacgacgctttgatatccgattatttgtcgaatgtgacaggcgagccgttgcctgagcgttacactgtaacctatgaaaaaattcaggatttgcgttatggcgaaaatccacatcagcaggcggcattttaccgtgagccattggcggcaaagggtacgctgacaacagcgaaacaacttcacggcaaagagctgtcttacaataacatcaatgatgctaatgccgctttgcaaatcgtcaaagaattcagcgaacctaccgtagtagcagttaagcatatgaatccttgtggtgtgggaattggcggaagtatttacgaagcgtacagcaaggcgtatgcagctgatccaacctcgattttcggtggcatcgtagcggctaaccggattattgatggtgatacagcgaataagctgagtgagatctttttggaaattgtactggcaccgggctttacgaaagaagcattggagattttaacgaaaaagaaaaatattcgtttgcttgatctgggtgagctttcccggtctgaacaggcagagagccgtttcgtcgtgacttccattgaaggcggtatggtagttcagcaaaatgacattcacgctgtagattcggatgcacttacaattgtaacggagcgggcaccatccgaggaagaactgaaacagcttttgtttagctggaaagtggttaagcatgtgaaatccaacgccatcgtactggcggcagataatatgaccattggcgtaggcgcaggacaaatgaaccgtgtcggtgcggccaagattgctatcgagcaggccggtgacaaagcaaaaggtgccgtactggcatccgatgcatttttcccgatgggcgatacgttggagttggcagctaaagcaggtatcacagcagttattcagccgggcggctccatcaaagacgaagagtccatcaaggttgctaacgaatacggcattgccatggtctttacaggcgtacgtcatttcaagcactaacttgtatgagttgaggatgcagcagcattttcacctgaacatcttaatgggagcgggaggaaacacctgaatggatattttggttatcggagggggcggccgcgaacatgcaattgtgtgggcgctgaagaaaagccccaaggccgggcaaatctattgtgcaccaggcaatgctggtatcggacagttagcggagtgcgtgccgattccggtgagtgactttgacgcgctgacagagctggcggaatccaaaaaggtaggacttgtcgtggttggtcccgatgatccactggcagatggcattgtggatgcttttgaagcgaaaggcattccagtattcggaccgcgtaaaaatgcagcggaaattgaaggcagtaaaatcttcatgaaggatttgctccataaatatcatattccgacagcaacctatcgcaagttttatacttatgaggaagcacatgcatacttgaaggaacaaccgattccggttgtcattaaggcagacggactcgcggcaggtaaaggggtaacggtcgcttactcgatggaggaagcggaaaaggctctctccgacattatggtgaccaaggtgtttggtgaagccggggcacaggtcgtgattgaggagtttctggctggtcaggaaatgtcgattctctcctttgtcgacggtgaaacggttcgtccgatggccgcggcccaagaccacaagcccatttttgatggtgacaaagggccgaatacaggtggcatgggtacgtattctccgttgcctcacatagccaattctattattgaggaagcaattgagacgatcatcaagccgacggccaaggccatggttgctgaagggcgcccgttccgaggtgtattatttgccggattgatgatttcgccggacggcaagccaaagactattgagtttaatgcacgtttcggtgatccggaaactcaagtggttctgcctcgtttaaaatccgatctgctcgatatttttcttgctgctgtaaatggcacgctggatcaggtggagatcgagtggaaggatgaagcggcggtatgtgtggtgctggcatctggaggttatcctggagcttacgccaaaggtgtacctatccacggattggaacaggtagacgaagctatcgtgttccatgctggaacgggcatcaacgaacagggtgaatgggtaacgaacggcggacgtgtattaggtgtggtcggcttgggacgtgatattgccggggcacggaacaaagcttacgaacaggcggatcgtattacctttgaaggtaaacaaaaccgtacggacattgcggcaaaagcattgctgtagcagcgatataaaggataaagagaacctctgtggaggttctctttttgttcaaaggaaataaagttgtagactgagaaaataaagcgttttcttagtgcttagattacagcaacaaggaattccccctaaaaaggttgttttagttcattcaaatgattaaactaacggttaatagtaggttcaagtaatcgatgagacgaagagggggaaaccgaaatgaagacgatcaagtgcatgatggaccacctgtactgggcggacggacgcatcttggacgcgctcgaggagagtgagacgaagaacaaggaccttctgaagctggttcggcacgtcgcggtcgcggaacgagtctggctgtcccgattgcagggcaagggcagcgcgcaatattcattgtgggaggaagcagaagacctgacggcgatccggacgatgttcgaagaaaacgccgagcaatatcgcgtctatatcgaagggctcgaggaatccgagttggacgagatgatcgactatgcgaaccagagcggggttccgttccgaacgtccgtccgggacatcctgtcgcaggtcctcttacatgggcaatatcaccggggacagatcaaccgggcgcttcggatcgaatcggcagagcctgtccaaatcgattacatcacgttcgcgaggctcagagcctaataatcaccattactcggaatgggattgacattgaacgacggtatgatagctcaacaaattgcttttaccatataagaacaatatgctaatgtatattagcagacgatgatattttataagtgataagaacctacactgccttatttaggatcaaagagagcccatacccttataaattggaaaattaatttgcttccaaatacggttatgggcttatttacttttcataagcactacattagactgccggtacttgtttaagctaacgggcaggggagttacaatatgtagaattgtaggataaccaactcgatggaaatattatgtcattcaaaaagagtataacgattctttactgatcgttctcaatatgttatattaattgagggagggagattggaatggcgagaagcaaggagtttgaagagaaagaagtcttggataaggcgatgcggctcttttgggagcaggggtacgagaaaacgtccatgaccgagttggttgagcatatgggtattcatcgaagaagcttgtatgatacttttggagataagcataatctgttcctgaaagcgatggatcggtttgacgacaaaatcagcgccgcgcttgcaggaggggttaaaggatccaagaccgcatcggaggcattacagtttatttttggttttatgatcgacggggatgaggactcgccagccggctgcttaatggtgaattcggccgtagaattggcggcgcgtgacgtcgaggtggataacaagtccacgaaagcattcacgacagcagagcaattgctcagggagattattctttggggacaacgtgacggtgaattcacctccacatacaatgctgaggaattggcggaatacctgcataatgtatggattgggttaagggtaatggcaagaacctcggcttccagagaaaagcttcaccgtattactcatatttcgatgaagatcctggaataataagggtaattgttagtcagttcagatgtgaagtatcccttctgttaatccagctctttcagatcgagttatcttacgcctaatttagaatgaacattctaaaaacgccgaaagaagctctaaagcatagtttacaatgaagtttatcagcgcagttaaaacaacaaacaacacaacacataaaaacaacagagtaaggcactcagcattttttttaacgattttaagaatgaccgttctcgttagaaaacaagtatcgagtaaaactcgcttaccgtaattactacgtatcaaaacgcagaccaaatagcttcaagaaaacaatttcacaaacaaaatacaataaaaggagcacatgaaaatgaatatttctcaacaagttgcatttgtcactggcgcgaaccgaggttttggtcgccatcttgcccttgaacttctatccagaggggctaaggtgtatgccggagcaagaaatccgcagtccattgacattcccggtgcaattcctgtaaagcttgatattacgaaccctcaagaggtagcggcagctgctatggccgctcaagatgttacgcttctgatcaacaatgcaggctcggctacaggagctactttgcttgacggtgatctcgatcaaatacagttggaatttaatacgcacttctttggcacattatccatgattcgcaatttcgcacctattcttattaataatggtgggggatccatactgaatatcctttccgcattatcatggttcagtagtggcgggagtgaaggcgcttattcggctgcaaaggcggctgcgtgggcaatgacgaacgagttgcgcttaaatctgtatcctcaaaatgtgagagtagctggcttgcatgtgggctttatggatacagacatgacgtcaggcgttgaagctccgaagtccaaccctgctgatattgcaaaaattgcaattgatggaatagagtccgatagctttgaaattcttgctgatgaaccgagccgtcaactccagcgtgctctcgctggcggtgtagctgctatttacccacagcttaaatgatgagcaaaactgtactaattaccggagcgtcgggtggaattggaaaagagctggcggatcgtttcgccaaagacggatacgatttggtgctggtcgcacgcagcgaggacaagctcgtggatctcgcgggggaatatcggaaaaagtaccgtgtccaaacgacatacatcgccaaagatgttgcattacctggcgtggcagaggaaatctacagggagcttaaagaaaaagggatcaccgtcgactttcttgttaataatgcgggcttcggcttgtacggggaattcttggagacacagttggagcaagagatgaatatgatcgacattaatatcaaggctctgactgtaatgactaaggtgttcttaccggatatggtcaaaaggcagcaagggggcgtgctgaatgtggcttcgttggtggctttttttcctggaccactgatggcagtttactatgcgacaaaagcgtacgtactatcgttcactgaggctttggagaatgagctgcgcggcacaggcgtgactgtgtccgcactctgtccgggagcgacagcgactggctttgtcgatcgtgctgggctagccacctcaaagctgtttagaagcggcgtcatggaggttgggcaggtggctgacataggatatcgcgaattcttgcggggcaagactttaatcataacaggggggcgcaacaagttcatggcgttcttgccgcggttgctgcctcgcaagctcatgacaaatgcggtcagatccgcacaggctaaagtggagcgataatcgaaagacattggagttaataaactcaattcaaagagggggttttaaaatggaaaaactgtggagcaaaacgaaattggcaacctggaattaccccatcggttagcgatggcaccaatgacacgtagtagagcgcaagaggatggtacgccgggagagctaacttcccattattatgctcaaagagcatcgatgggtttaattattactgaaggcacacaaccttctgatgatggtcaaggttacttaaggtcaccgggcatctatacggaaaagcatattgaaggttggaaaaaggttacggatgcggtacatgaagaaggtggatttatatttatccaattaatgcatgtcggtcgtgtttcgcaccccgacaatacaccacatcatcgtcaacccgttgcaccatctgcgatcgcacccggtgtagaaatgtttacggctaaagggatgcaggaaataaccgttccaagagagttaagtgaagaaaatatccagacgacaattgcagacttccggaaagcagcagcggcagctattaaagcaggagccgacggcgttgaaattcatggagcaaatggttatctgattaatcaatttattggggagaattctaatatggtcattagctaatccggacttagttgaacgtcttaaagaaggctttcctttgaatgaagcagatcgtaaaacattgtactctggtaacggaagcgagggttacacagattatcctacgatgaaagaacttcaatctcaacatcagtaaagaataacatggatattgctttatgatggcgtacaagttaaagtacgccatcaatttttccaataaacgaatgtggaattaagataaatgagaaaaggagaagatgaagaattgaaagctgcgcaaatgcaaaaatattcaaaacaaatccaattagaaataaacaatataaaaataccggaaatcaataaccatgaggttcttatcaaagtaaaagctgcaggtgtaaatcccttagacattcttattttaaatggtagtattcgcatgattgccgattatgacttccctttaactttaggaaacgaactatccggcgttattgaggctgttggaaaagatgttgtgaaatgcaaggttggagatcccgtttatacgaggctgccaataaataaaatcggagcttttgctgagtatgcggcagtcaatgaggatgcgatttccgttatgcctaaaaatctttcttttattgaggccgccgcggtacccctcacggctttgactgcatatcaagccttgcatgatgtacttcatgttcaacccgataaaaaactatttatttctggaggaaccggcggctttggtacgatggctatcccgattgccaaatcgatggggttatatgtgattacgagcggcagtgaaagagggagatcacgaacactgtccatcggcgctgatcaattcattaactataaagaggaaaattattttgatttgctatctaatatcgattatgttatcgatacattgggggcaaaagaaattaaaacggaacttgctattctcaaaccccaagggaaattggtatcattgaaggctttacccaattaccgctttgctgctgaaaataactttccaatatggaaaaagctattgtttggtttagtaggtgctcgtttagatcgattagcagttaaacagaataaagaatatcgattcttattcgtgtccgctaatggcaggcaattacaaaaactgacgaaactagttgaggatgaagatattaagcccgctatagattcagtttataattttgatgacattaacatggctttaaataaagtttctactggccactccgaaggaaaagtgatagtaaccttctaaggagaggatatatgaattttggaaatacgctcgaaaggtgccttggcataaccccacattcacgcttcgtagcatggagcagcaaaactttattttcttctgacacttttttctttgacaaaagtatacttatcctataggattaaaatacaaaactgactgactgatcaatcgggaggagggaacccatgcagccacgaaaggcgaagcagtccgagaccgtctcaaatgaccaacctgctgagcacgcgggggaagaaacagaccgcagaacacagcttcttcacattgcattgaagcggttcgccgagcagggttaccatcaaacgaagatttcagatatcgtggtagaggcgggagtagcccaaggcacgttttattggcattttaaaagcaaagaggcactggcgctggagattatcgctaccggtcgtgaacaactactgtcagcgattggacagggatatcgccgtgatgcgggaacgctggctgatatggttaaggcatcggaggcgctgtttgttcggttatttgattttgcattggagaaccgctatctgatgggtttgctgctgatcggtagtggtgtcgatgaaccggtgcgccagagtatccgagagacaagggccgcgatggagctggcattccggcgcaatatggaaagagcgatcgagctgaacatgttgcctgctgaattggatgtcgaattaagggcggcactactcatgagtatgatcgaaggtgtcattacacgctggctattcggttcagagggaacatatgaccacatcacgcagataactgctaaaagattggcagcagaggcggctaattttgagttttatggactattaggtcaaagctagagggtcaacatcgcatgaatgggtagttggcaacaaataatatagccaaatcacatatatgaactcaatcatttacatccagacaggagagaaggatacatgaaaacacgtaaaaaagggttcttggtaactacactcatggctgtggcattgttcagccttgtgctaagcgcttgcggtactaagccagaagcttctaatactagcaatggagcgggtagcagtaatgtggcagcgagtaaccagctcgaagcaatcaagaaggctggtgtaattaaggtaggcatgatgggcacctatccgccgtacaatttcttgaacgataacaaggaattggacggatttgatgtggatatcgccaaagaattggcgaagcggattggagtgaaaccagagttcacggcacaagaattctcgggactggttccaagtttgcaaaagaaaaaattcgatgcagtgattagtcaggtgacgattacagaggatcgtaagaaggctattgacttcacagagccttatatcacaaacaatgtaaacattatcgtaaacagcaaaacaaatgatattaccaagctggaggactttaaaggcaaaaccattggtgtcggcttgggaacgaatgatgaatcttatctgcggaatgaagtactgccgaaggtaggcgattttgagattaaaacgtatgatgatgtcattacttccttaaaggatctaaactctggtcgtattgacgcaacaatcaacaatctgtatgctctcaagcctattatcgataaaaacgggttccaaattaaagccgtaggcgagccgattaaatcggatcaagcgggtgtagccattaaccagaaaactcctgagctcaaagaagccttgaacaaggctttgaaggaaatgaaggaagacggcacttacaaaacaattttcaaaaaatggtttggcgaggagccaaaagaataacgtaagcctgttagaggcgtctggctccagtcttggctttcatgctgacatggggccactcgtctgaaagaagggaatataaccaatgcttgaattaatgtgggagaacgtcccttttttattaaagggtgcttattatacgctatatattacgattgtctctatgttttttggcctaatcattggtttgattgttgctgtggcccggttgaaggggaatcgacctgttcgatggctggcgcgcatgtatgtatcgatcattcgggggacgccggttttggtgcagattgcggtcatttattatggactggatgattatggaatatcattcggatcgctgacagctgcttgtctggcacttagcattaatacaggggcgtacttatcggagacgttccgtggagctattttagccgtaccccagggacagaccgaggcagcttatgcaacgggaatgtcgcctggtcaaacgatgtggcgtattattcttcctcaggcggtacggatcgcaattgcaccgatggggaatacatttgtaggtatgcttaaagaaacgtcgctggtgtcggttatcggggtcagtgaattgatgcggcaggcacagcttttacaggcgcagtatttgctttacatgccgtttttgctcgaaattggcctgatgtactggattatgagcattggattctccgccatactggagcgggtggaaaagcgtctggctcgagcttattaaggtggagatgatagatgatgataacaactaacggattaggtaaacgattcggacaggtagaggttttgaaaagcattgattttcaggttgccgctcgtgaaatcgtcgtattactcggcccgagcggttcaggtaaaagtaccttgctgcgctgcctgaacggtctagaagagctgtcttccggcaagtttgaggtgaatgggattgaggtcgatgctacggctcccgttcgtgtccgccaagcagccattcgtgagattcgcaaacagacagggatggtgttccagcagttcaatctgtatccgcacaaaaccgcaatcggcaatgtcattgaaggactgctgacagtaaaaaaaatgccgcgcgacaaggctatttccatcggacaacggttgttggagcgggtggggttatcggaaaagcaggatgtacatccttcacgtctgtccggtggacaacagcaacgagttgccattgcgcgtgcgctggcgatggacccggcgattatgctgttcgacgagccgacatcggcgcttgatcccgagctggtaggggaagtgctgggtgttatgcgagagctggctcaagacggaatgacgatggtcgtcgttactcatgagatgaaatttgctcgcgaggtggcggacaaggtcgtatttatggcagatggtatcattttggaggaggcagcgccacaggcgttttttgacactccccagcatgagagaacacagaaatttttacgccaaatcagtgaattttaaagtaagatcgaggatgaatcatagattattaagatggaaagaaggcctttgaacatgaaagtatctacaacttggcacggcaaacgcgcgtttacttcggagggtccatccggttattccgttgggatggatgctacggcggcttatggcggtgatggtaaagggatgacacccatggaactgctgttggcgggtctggcgggatgtatgggcattgatattacgatgattttggatcgtttcttgtcggacattactcgcatcgatattgacgcagaaggtacgcgcaaggaagaaatgccgacaggctttacagcgattgatctgacattccacgtagatggagatattccggattaccgcgtatggaaagcgattcagatgggtaaggaaaaatattgtgcagtatccgattccttaaaagcagaaattcggatgcacctcatattgaatggaaccgaagtaccctatccagcataagtgttaaaggatagtgaaagagagtcagcctgtgttatatacaggaggctctcttttttatgttatttgaaaatatgacacgtaatgaaactttttgtactctattttcgtttaaaatagaaattgaaatataaaaatgggaaaataaacctgtgtgtgaagtgcatacggggggaggtaatagtgaaacgaaagcgccttattgtggtagcaactagtttggctacagtgctcatcgttatgggtgtagcggcaggcttactatctttcatgcagaatcaagtggctaatcccccgaataccgtccggcccacaactgcgattgcagctgacgttaaggaagaaacgaaggaacaggatgctgcccgccgtttacttcattttgtggaggcgaatgcagaaaaagtttcgattacgattctaagagatggaaaaaagctggcaggccaagaggaaaaccggatgatgcctttggcgagcaccgtcaaaacaatcattgcgatcgaatatgccaagcaagcgatggtgggtaagattaacccggaagggagagtgaagctgatctcgctggaaaggttttatttgccgggtttggatgggggtgctcatacggcgtggctacagaatatggaggctaaagggcggatacagaatgaaactgtatctgtacgagacgtcgccaaggggatgattcaattcagttccaacgccaatgcggagtatttaatggacaaactgggggtgggtgcgatcaatcggacgagagccaaaatggggctgaaaaatcatgatcctatttatccgtttgtatcctccattttgattccctacgaatggatgagggagagacaaggtgagaattggaataatacaaagaataatatttctgccaaagaagccattcaggcgatgtctgatacggaatttcgccgatatgcccgcgtgattcataacaagctgcgccgtgatgtgagtggttcttacaagagaaacgcagatattacgacttggtatgatcaggattatgatcgtatcaatacggatcgctttatagcttcaacgacagccgattatgcctctttaatgagtaagctgaatcgtcgtcaagggttcacaaaagctgagcaaaagttattgtccgaggtcttggaggaaccatttatggttcttcctgaaaaccagcaatccctgaaacatactgggcaaaaaggtggctccacggcttatgctttgacactgaccatgtatgcgacagataaggaagggcattcgacagagctagctgtcttttttaacgatttggacccaagcacaaatgccagctttcccgaaatgataaatgattttaaaaagaggctactgcatgatgaatcgtttagaaaagaagttaatcggcgtatcggtgtacaggtagcgctgctaaacgctagggtatagtactgcgtttagctgcgctgcgcaacttcttatcctcatcctatccgctgtctttttgtttgcgttcccgcagcaatagatacagaaaatagggcgcgccaatgacggctgtcacgatgccagcgggaatttcgagcggcggcttcaggcctcgtcccagcgcgtcagcgaggacgagaatcagggcgccgatcatcgccgaaccgggcaatagatagcggtggcgattgccaaataaccgccgtgccagatgtggtgccagcagtccaataaatccgatggagccgatggcagcgacacaggaggcagccaaggcgactgacacggctagcagtcctgtacgcacatgcttcacgctaagtcccagcccagcagagctttcctcatctaggctcataatgtccagcttgcgctgtagtgtataggcgagaggcagcaacacgattaaccacggcagtagcccatacacttcgtcccagcctttgccccacagacttccagctagccaagtgagcgtgtcgctggcttcgagtggatacttgaccagtatataatcggtcgcagcctgaaaaatagcgcccaccgccagtccggtcaaggctagcatattgggacgcatgcctcccttcatcgaaagctgtacgagcaacagtgcagctagcccagccccgacaaaggcggctacaggtagcagtgccactggggatgagggcagcagcacgatgacgagaaccgccgcaaagccggcccccttggatacacctaccacatctggcgaggctagcgggttgcggatcatgccttgcagcagaacaccggctactgccagcccagctccggccatgatggccagcagaccgcgtggcagccgataatgatgaacgatgaaccaggaagaggcactccggtccgtcagagccttgatcagctcagagggcgtaatgtaggtgctgcccacgcctatagctataaaagcaacacctagcatgagcgtgagtaaaatccacatttttttcatcgtgaagccctcccgttcttatgcgccagatataaaaagaagggcgcacccaccagcgcggttacaatgccaacgggtgattcataaggaaatgcaataaatcgtccaagcacgtctgcatatgtcagcagcagagctccgcagattgcagacaggggaatgacccgtttgtaattgtcgcctgtaaacatcttgatgatattcggtaccatcaagcccacaaagccgatggacccggctaccgctatggcagagcctgccagcataatcactgaggccgaggccagtagacggacaagacgtacgttttgtcccaatccctgtgcgacctccgtcccgaggctcagcacagatagcgagggggccagcgccagcgcaagaatcatacccacagcgaaccatggtagcaccagacgcgtgtcggcccaagtggacccgtcgatggctccggcgagccaatacagcacatcagatatttgctcgttgaacacgagcagtccttgggtgatggaggccagcagcagatgcacggccatcccggcaagggccagcttgaccggcgtcatgcccgccgttccggccagcgcgtatacgaaggagccgcctgcgatggccccggcaaaagcaaaataaatgctgccggacgatccgatattcggcagcagcacgacggacagcacgacagccagcgaagcgcctgagctgaccccgaatacctgcggcgaagccagcgggttgcgtgtgatggcctgcatcagggctccagccacggcaagcccggccccgacgattaggccaataacggcacgcggtaggcgtaccgtcaagacaatgagctgatccttagacggatgctcagtgaacagcgcagtcagcatggtggggatgtccatcctgactgggccaatcgccacgctaagcagcaatccagccagcaacgcagcgataagtgcaaagaagaccggcttattcagccggtcgcgtgaggcttgtccgatcaacgggagccgtctcctttactttgcgcgggatacagaagcgaaatggcttgctccagtattttttcggctgagccgagtccacggtaccgggtccacagtgcccggtttacttcgtaaacttccccttttttgacggccgtaatgttttgccaaagcgggtttttcttccattccgcaatcagcttctcatcggcttctaccaaaaagatcacatcaggatccgattgtgaaatttgttccagcgtcagcttgacggtaggctcgcttgtattttgaagggcattgtggatacccgcttgctccagtagttgtccatcaaaggatgaagcgccgtgagccgatagtgaatcagaacggaatacccctagcaatacgctgcgtggctccccagctttgatgccttctttcaacttttccattgtagctttatgcgtagcgagaatttgctcgcctttttccttctcacccaacgcatcggcgatgacaccgaaggatgccaagttttgttcataggaggaattgcggctctttagaacaatggtcggagcaatctcactaagttctttgtatatgcttttatgacgattcagatcagcaataatcaaatccggcttcaaggagctgatcgtttccaggtttggctgtttgcgtgtgcctactggtgtgaagtcgattttcttgccgagcagcccatcaatatcatcgtcattttcctgagctataccgacaggagttacgcccagttgggttgtggcatcgacaaaagagaattccagggttacgattcttttgggtgtacctgtaactttggtttctcccatctcatgtttaatcattcgagtgtcgcctgttgcttgaggtgttactgcgctgttatcttgtgactggcttccacatcccgccataatgaccatcagtagtgccaggatcgctgcaagcagcatacctgtgcgcagtggttgtttcggtgttgccatatgttatcccccgttccagtatgattatcagagaaactgataatcattatcaatcaactaactgttgatcattctagcaatcgggaaggagaacgtaaataatgtggttatttaaaccgttttgaccgattaagtgaattaaattcaataaaattatgaataggaggaggggaagtaccaggacatcagagttggacggtttatgcatccctccgctgtcggcgatagatacgctccggtctgccgacggttccgtacacctgatcgtggtgcgcgtcgccactttccactaaatactccagataccttctggctgtagaacggctcatacccagctcgattcccactgtacctgtagtcacctcacctcgtcgattcaggagatccagcactttgtcgcaagttactttatcgatgcctttggcccatagttctccgactccgttccccgccatccgaccggtgcccgcgctttgaagcaaactgtcaatttcagattgctcgactgtggattgttcctcttgccatgttgtgatttgtcgccgaaaccgggcatattcctccaaggtcgcacgcaatctctcgaatataagcggctttacgataaaatcaaacacgcctgctcgaacggcttgtaccactgtttcagcttctttggcggcagtcagcataataacatctgtacccggatagtgttgcttgatgaacgatagcagggttagaccatccgtatcaggaaaataaacatccagcacgactagaggaggacggagcacgtccagttgaagttttgcctcaaattcgttcgtcgcgattgcacatacggtgaacccgtccaccttttcaataaatcggcggttaatctccgcaattcgcgaatcgtcttcaataataagaacctcaatgtccgataaaacccgctcattcatgggcataacctccttttgcatcattactcgtatctgttccatgtaaaggagtgtaaacctcaaaaatacttcctccaccaggacgtttgtgcacttctatagagccgcccattcgttcagtgtactccagcacgagagcaaggccatatccatgtcctgcttctgctttggtcgaagctcctctgacaaacaacttttcttggatatcgtccgaaattcccgatccgttatctgcaacttcgacgatgatggcttcagtcgtttcttcaagccggaaccagacctgtccgtcagagatggaggacatcgcaacagcttccatggcattgtccagcaggtttccggctatggaagcgagaaaggaccactccaacgtaggggactgggttgagaatgctcctttaatttcagaatggagtaaaacccctttttccagcgcctgtttcttcttaccgatcagtaggctggcgatgattgaatcggtgaggagagctgtgccaatcggcctgtgtacacgatattcctctgattcctgggtgataaagtccaccgcttcgtcataacactccaactgaatcaggccggatatgagatacagccgattggcgtattcgtgtgtttgtgatcgcagtacttccgcgtaatctttgacctctgtcaactgttgtgtcatgtggagcagttcggtcttgtcacgcagactggcaaccgtgcccatgatgcgaccggaacgatcctggatcggcacacggctgacgactacaattcgctgctggacctcaatttccttattccatatgtactgtccctgatctggccccatcgttgaatgctctactgtgtaatcggcaacaagcatatcaatcagtagatccggaacaccagtcaagtgacgaagttcgcatccgtagatagaggtttccggagggagtccgatcaagcgagctgcctgtggattggcaagtgtgatttgtccgttactattcaccgcgataatcccttcgccgatggactcaataatggcttgcttttcctggtacaaccgtccgatctccactggctccagtccatgcagtgcgcggcgtacccgttgcgctataaccaggcttcccaatatgccgatcatcagcgcgcccaccataaaccagagccatgcatatgtgtatgtacgaatattttgctgcacatctgtcattaaaaaacctacagagacgagcccgatggccttaccttgcgtatcataaacggctgttttggcgcgtattgacggtccgagagagcccgtcgattcagtgataaaggactgcccttgcagtaccttatcattcatggggtctatcataggcgtgccgatgcgctctgggtttacatgccactgccggatgagatgacgatcagcaatagtaataaaatcagcgccgctgctggcttggacaggctttatgacctcgttgatacgcgaacgcaattgcgtcgtctcagtctgctccagagcgtctctaacctgcgcatctacggcgagggtattggcgacggtgagcgccctttctccgatttcatcatatagagcggaggtgatcatatatcgaaaggataatcccaacagtccggtaactaccagtactaaaagggatataaataccattagttttgtctgaaaacgcatatgccttcaccgccgttaaacaaaatataggaggaacggatctgccgatcttctcccccatacgatctattttactgtattacagaaacgcccgcacttttattctttcgaaagaatggtctataatagaaatagttacataatacgaggaggaacataaaatgattattattcatgccgatatgaaagttttacctgaaaaaagagaggcttttttgcaacaaaccgaagggctggtcagcgcatcccaagctgaagaaggcaatgtacgctacacgttaatgcaggatctgaatgatcccaacgcatttacgatggttgaagagtggaaagatgctgctgctgtagatttccataataattctgcccatttccaggcatttgttgccgcggctaaagaattgttggctgctccgcttcaagtgaatgcttttcaggatgcaactaaactgtaatcatcccgttggatcattcataatcaggaacaggaggaatagacatggggaacattgcggatacaactgtactgaataacggagttcagatgccttggctcggttttggtacttacaaggcggaaggcaatgaggtctacgaagcggtcaaaacagctattgaggtcggttaccgtcacattgatacagcggcgatctacggtaacgaggaactggttggacaagccattcgtgatagtggtacgtctagagaaaatctgtttgtaaccaccaagctatggaatcaggatcagggctacgattcaacactgcgtgcctttgaggaaagccgtaagcggctgggtctggatatcattgatctgtatctcattcattggcctggcaaggataagtacaaggaaacctggaaggcattcgaacaactgtatgaagaaggaagcgtacgcgctatcggagttagtaacttccaagttcaccatctcgaagacctcctcaaagacagcaacatggttcctgtcatcaaccaagtggagcttcaccctcgtctgactcaacaagaactgcatcaatactgccgggagcaccagattcagcttgaatcgtggagtccactgatgaaggggaaattaaccgagcaagcggacatcgttgagattgctgccaaatacggtaaaacctcttcgcaggttattttgcgttggcatctggatcgggggattgtgacgattcccaaatctgtaaccccgcatcgtattcgcgaaaatgctgatttattcgactttgaattgacggctgaggatattgaacgaatcaatggtcttcatcttgatgagcgtgtaggcacgcatcccgataaactgttgttttaaataaatattcacttgtaaaaagaacctcccattctgcgtttatcgcggtttgggaggttcctttttaggttcaggtgtagctttgtttaattacttgtttagcttacgatacaacaagtaagaatagagtacaggagagataacggatatgatcagcacggtaaggaaagtgactactcccgccattccaccgacccataccgccaccaacgctgaagcaccgccaagcatcatcataggcccaccgaaacggtgcgttttacgccatacctcgggattagacagagtccacggcgtgcggataccgaacgtatagttcggctgtacctgagtcatataattccccatcgccatcagcatcaggcctattaaccctaaaattatagcattcatttgcagtcgtatattcaggttatacagcagcattccccatccagctacagcgagaactacagaaacacctgcacgcgtaacttcataggcttttgaaaatttctcataattagctctgttggggtccatgtggcgagccaatcgaatgaccagcgggactaggcccaacaacacgagcatgataatagaaccacttttgctcgtatacccgtctgctgtattgttaaagttaatatgcgaggctagaacattgggaagtcggtcgtacagcagtatagcgcctatggcgggtgataaggcaatcaaagttgtcaaaacatccgtcaagctccaacgtgttcgcaatttcattcagattcctccgcatccttaatatgatttacatttttcttggcaggggtatcagagtgggcgatactgaacatccaaccgatgacatccgccacaaccgttgtatgcagggtgtagataatgttttgcccctgtcgttcatccagcaccagcccagcctgcttcaggatattgagatggtgggagatactgggcttactaatttgaaaatgttcagccacttcgcctgcgctcatacttttctcctttaaaagctgtaagattgtacgccgggtcggatcagccaaagctttgaaggcatcgttcaaaatacatttcctcctttagatatttagataatattctaaatatctaacatcatagtaaaatagagctatactacatgtcaatggaacaagtcatcattttagaaaaaagatttagatcagactcattaggtttgtaaaaggcagcgaagttggctataattaatttataataaaaataagaatcttaatttaaagaaaattgaggaggaaatataaatgaaacacgtatttcgtaaaggaactcatccgcaagccccagttattttgctgttgcatggtacaggcgggaacgaacaagacctgatacctttggctgagatggtagcaccgggagcttctgtattaggcgtgagaggaaatgtgctggaaaatgggatgccgcgtttctttcgccgtttggcagaaggagtgttcgacattgaggatctcgtatttcgcaccaaagaattgagcgaatttgtggatacagctgcagagcaatacgattttgatcgtaataacgtggtggctcttggctattccaatggtgcaaacatagccgccagcatgctctttcacgatgcaaaagcgttacgtggagctattttacaccatgcaatggtgccgttgcgtgggctggatttgcccgctttgaatggtatccctgtatttttatcttccggtgagaatgatcccattgttccgatttcggaatctcaggagctgcaagcattattggaaggggccggagcgcaggtggaagcttattgggaacgcaatggtcatcaattgacgcggactgaagccgaagccgcaggaaagtggtttggggagcattttaatgcataaaatgatccgatagcgatcaagctacggattagcgctctactgagcgaccccattattaggaggcgacaaacgaatggcaaaaccagataatcgagccgacaatgttgaacatttgcaacaaagtattcagaacacacagcagaacctgcatgaagctgaaggatatctaaacgaattttcctctgaaatcagcaacgaggagcgtaagcagatcgaagaaaaaaataatcgtcgtaaagaaagtattagatcatttcgggaagaagtgaaggacgaagcagcacattcgcaagaataatttaaaaagcgcgacccaattccgagtttcaattggaattgggtcgtttttttatgcaaaaatcatcatagcctcatacaattcattttccccctataatgcaagggggacgctaatctgcattgaaaataaatattttataaataatgttgttgtaaactaatttgtattgatgttaaataataaaagaaagcgcaatcatttatgaattaggatttcatcatgcgaagggggaaggatatgctgctgcgaagaaaaagcatggctttgatgcttatggcggtggttttgatggctggactgctgcaaggctgttctttcaagaccgatgagaaggatgggccgggaacagaacttgtattatggacgttcaatgaactgcatgagaagttttttctgcaaatggctgaccaatggaaccaacagcaccctgatgaactgattaatttgaaagcgaatacattcccctatgacaaccaccacagcaagctgtcgattgcgctgcaatcaggggtgggagcgccggatatcgcggatatcgaggtgaacaagatcggtaatttcctcaaagggataccgcaactggtcccactcaatccggtgattgaccccgagatcaataacattgtgccttccagagtacagatttacggtaaagacgggaagtattacggtattgatttccatgtcggggccgaagtgatgtattacaataaagaaattttggatcaggcgggggtagacccggattccatcgtcacctgggcagactatgctgctgcaggcaagcaagtgctggcgaaaacaggcaagccgatggcgaccctggaaacgaatgacctgtggaactattggccgatgatctcccagcagaattcggattttctggatgacaagggcgagttgacgttggataacgaaaccaatattaaaacactcgagtttcttcaacagatgataaaagacaaaatcgctgttcccgcaccgggcggcgggcatcacatggaggaatactacggatttatgaacaaaggtggggccgcttcggtatggatgccgatgtggtatatgggacgttttacggattacatgcctgacctgaaagggaaaatcatcatcagacccatgccagcgtgggaaaaaggcggttttcgctcagcgggtatgggcggaaccggaacagtagtcacgaaccaatcagagcaccaggatctggcgatgcgctttctagcctttgccaagctatccaagcaagggaatgtggagatctggaagcagcttggttttgatcccatccgcagtgaagtgtggaccatgccggaagccaaagccaagaataaatttacggagtatttcggaacgaatatttttgacacgctcatcgaagtcaaagatgaaatcaatgcggtgcatatcggaccgaaaacacctgatattgccagtgctgtgcgcaataaaatactttatcggacactacagaatggcgaagatccagccacggtgctacatgagctggcagatgaactgagatagaccccaacaggaaagggagtgagattcatggcaatgcccgttcatacgaacgctaatgtaccgacaggtcagccgccacaacctcagcgtccgaccagaagccgatggagtcgctttattcattccagccgtacggcaccgtatgtgtttgtccttccatttttactgtcctttgcgctattttttgcctatccagtcatctcgacggtcattatgagctttcaggaagtcctgccagggataacaacttatgttggactggaaaattataaggacttaatcaatcctacgtttggaaaggcgatattgaacagcgtcctgtatacgctgcttacactagtcgtgctgattcctctgccgctggtattggcagtattgctgaattcgcctaaaatgccgggcagagggttgtttcgctccgtgatgtttatacctgcactaacctcggtggtggtagcaggaacgatcttccgcctcatgttcggggaattggatggttcgctgatgaactccctgttgggggtattcggtctggagccttacaaatggctaatgaatgcgaacaccggctttttagcgttgattgtgctggccttgtggagatggttgggcgtaaatatgttgtactacatgtcgggactccagaacattcctcctgagttgtatgaggctgcgcagattgatggagccagtcgtttcgattcattttggcggattacgattcctatgctgaaaccagtaacgatctacgtatttacgattagcatttatgcgggtttgtccatgttcacggagagctacatgttgtggaacggaaataactccccgaacgatattggtttaacaattgttggctatctctatcgccaaggtctagagcagaacagtatgggcttcggagctgcggtgggcattgtattgctcgtatttacactagtgctgaacctgatccagctcaaatttttcggcatgttccggaaggaggattaagcgatggctcagaaacaaaaaggctcgttatccgcattgctcgttgtcctgtttattctatttgccggatttgccctgtttccgctatttgctgtgacgcttgcctcgttcaagccatcgacggagctattgcgctacggattgaatcttaagctggagtgggacatcatgtccctgaaaaactatgcgttcatctttcaggggacgacggattattttcaatggtactggaacagtattgtcattaccgtcttgtttacggtgttatgtctgatattgtccgcgatggtaggctatggtctggagatgtaccgttttagattgaaaaatgtgattttcacactggtgctggtcgtgatgatgatcccggtagaaattatcatgctgccgctctacaagctaatgatcggcatgaagctgatcaatacagtatggggtgtaattctaccattcgtcgtcgcgccgatcccgatctttttcttccgtcaatatttgagtggtgttcccaaggacttcatggatgctgcacgggttgacggctgttcagaatatggcattttcgtgcgaattatgatgcctctgatggcgcctgcatttgcagcaatggctattttgcaggcgatgaacagttggaataacttcctctggccgatgattgtattgcgtaccaacgacatgctgacactgccaattggactgtccagtctgctgacgccatatggcaacaattatgatgtgctgatcgcgggttccgttttggctattttaccgattctcgtcgtgttcctgttcttccagcgttactttattgaagggatgacggcaggcggagtaaaaggataatcggaaaggtattataaatagagcaacggagtacaagaaatgtgcaacgtcagaaaaggctgatcgggcattgtcccggtctgcctttttttagatttgattgattttcattctcattttcattttcatgactatcatctgcacaagctatgggtaaacgtggtatgatatttgaaagatttcaaatacagaaatattcaggcggagcgtggagaacctatggaaccaacagaaacccagaaaactgacccggccatgacgtcagccgttggcatggaggatattgtacgagcgcatcatatgctgcgtgaggtgattgtacgtacacctttacagagggatgccgtcctatcggccaaatataactgtaatgtgtatctgaaaagagaggatctccaagtcgtgcggtcctttaaaatccgtggagcttacaacatgatccgcagcttgacccctgagcaaatggaaaaaggcatcgtgtgtgcgagtgcggggaatcatgcgcaaggtgtggctttttcatgtaatgcacttggtatccacggtaaaatatttatgccgagtacaacgcctaatcagaaggtgaagcaggttcgtcgctttggcggtaacagtgtagaggtcattctgaccggagacacgtttgacgatgcttatgatgaggccatgaaggtgtgcagcgagcaggcaatgaccttcatccatccgttcgatcagccgaaaattattgcgggcaatggtacgattgcgatggaagtgatggagagcctagatacacctatggactatgtgttcgtaacgattggcggcggcggtttggcggcaggcgtaggtacgtatgttaaaaccatgagtccgtccaccaaggtaattggcgtggagcccctcggcgcggcgtcgatgacggaagcgatgcgtttgcgcaaggtcgttacactggatcaaatagacaagtttgttgacggagctgcggtgaagcgtgtgggtcagctgacatacgatatttgtaaacacaccttggacgatattgtgaaggtaccggaaggcaaagcatgtaccgcgattctggagttgtataatgaaaatgcgattgttgtggagcctgcgggttcactgcctgtggcagcacttgatctgtatcgcgagcaaattcaaggcaaaacggttgtctgtatcgtcagcggtggtaacaacgatatagatcgtatgcaggagattaaggaacggtccctaatttacgaaggactgaagcattattttatggtgaatttcccgcaaagagccggggcactgcgtgagtttctacaggatgtgcttggaccggacgacgatattactaggtttgaatatacgaaaaagaatgataaggaaaatggaccagctctggtcggcattgagctgttccacaaggaagactatcttcctttaattgaacgaatgaaccgcaaggggcttaaatatacggaactgaacaaaaacgaaaatctatttaatatgttaatttaaaaaggagcctacgggctcctttttatgtataatgcatagtttataaatttctttttatttgaaataaagcgtttacaaaactgattatgataggttaatatatgggtaacttcataagtataaacactaacgtaatagatgtgtcacctgatttttattataagatactcattcggaggtgcgtaagaatgttggaagcatggaaaaaatcagtacagagtaaattgacccgaacggcgtttgctgctgtaacctcggctgctttaatgctgtcagtgatgccatctgcatccgcagagcattgggcgttaactggcgatgtggcagtgcatgatccgtccattacgaaggaaggcaacgcatggtatattttctccacaggacaggggatacaggttcaaagatcggacgacggtcgcaatttttacagattgccgcaaatattcctgtcgccgccatcatggtggaaatcgtatgtacctaagcaaaagcctaacgatgtatgggcaccggatgctcaaaagtataatggacgggtatggctgtactattccatttctacttttggtgcccggacctcggctatcggactagcctccgcaacgagtattggcgcggggagctggagagatgatggactagtgctgcgtacgacggatgctaacgattacaatgccattgacccgaatctcgtcattgacgcttcaggtaacccgtggctttcctttggttcatggaattcaggcttgaaagtgactcgactggacaaaaatacgatgaagcctacgggccagatctattctatcgccaagcgtacggctggtggtttggaagcgccacatgttacataccgcgacggctattattatctatttgcttccattgataactgctgcaaaggcgtagacagtaattataagattatttacggtcgctctactagtattaccggaccgtatgtggacaagagcggaaaaagcttgatggatggcggtggaacgatactggatgcggggaatgaccgttggaagggaccgggtggacaatctgtctataacaacagtgtgattgcacgtcatgcctatgatgccactgacggtggaaatccaaagcttctgattagtgatttgaaatgggattcggcaggctggcctacgtactaaagagagtaccgtttggagtcacctgtgtagtaaaatcatatagatatattcaaaaactgttccttttaaggggaacagtttttggcttgcaatgtcatagaaacatgctattatgtatcaagttgataataattatcattatcgttatcgttatgaaagatgtgatgattttcaggtacggagggagtgacctcaccaaatgcagtctaaagacagcatggacaaacatacagatctgacagagagggcggttcctaaagtagtcataacagcacctccagtgcttcgagcgggtaggattcggcaggcggtgttgttcacagcttcggcagtattgttggctttggccatattcgccgccatttctctcggagccaaggacttgaacgtaagcaccgtgtggtcggcagtatttcactatgatcgttcgctaatgacacatcagatcattcacgagctgagattaccgcgtgtactgggtgcagctgttattggagctgcgctggcggtggcaggctctctgattcagggtattacacgcaacccgctgggagatacaggtgtgctgggcattaacgcaggagcgatgtttgtagttgctgtgagttttgcctttttccccaatctaccttatgggacgttaattgtattgtcgttcctgggggcgctgatgagtaccttactagtatttggtctgggagcatctgcaccgggaggattgacacctatgagattgacggtgtctggagctgtgacggctgccttgttaggttccatgacttcggggattgcgatttattttgatctaagtcaggatttagccttctggtatgcgggtggtgtagccgggattaaatggtcgcagcttgagattcttgcaccgattttacttatggtgatcgcctggtctatggggctggcacgttccatttcgctgatttcgatgggtgatgaggtggcgttaaaccttgggttgaatctcaggcgtatccggcttttgggtctgctgactgtagtagtactggctggactctctgtatcggctgccggagccatcggctttgtaggtttggttatcccacatatcgcgcgcaagctaatcggtgtggattatcgccagatcgtgccgctgtctgcgttattgggagccgtgctactggtgctggcagatttgggagcgagaatggcaaatccaccagaggagctagctatcggaattatggtgtcttttatcggagtaccctttttcctctttctcgcccgtaaggaaaggagggatttatagtgagacgctctttagggatcggggatacaaggacgacaaaggcttggctcgtctgtttggtattggcggggatcagctttgccgtccttgttttgggtttgaataccggaacgattcgtattccaccgctacgcgtgctggatacgttgtttggcggtggcagtggacgtgatcatatcgttctgttcgagtatcgtttgcctcgtatcgttgtaacggtgatggccggagcgggactaggcgcagccggggcggtcatgcaaggcttgtcacggaacgcactcgctgatcccggagttctgggacttcacgcaggggcagcgttggggctggtaatgttcgttagcttttttcgcgatctggacggatcagccgccgttctgatccccttgtttacctttgcaggaggtgtcattgcggccgtgctgattgttttgttgtcctatagccgcaacagaggaatcgtgcccgtgcgtctgattttgtccggcatcggtgtagcctcgggtcttagcgccataacgctgtattggtcgttgcggttggatgaggatacgtacgcatttactgcacgttggttggctggcagcgtttggggccgggactggatacatgcagcggctttgctgccctggataatcattgttttaccctacgttctgtcgcagacgcgtagtctgaacaacctgtcgttgggcgacgagaccgcagctggaatcggcacaagtgtgaagcgccagcgcctattactgctgggcgtagccgtggctctatcgagtgccagcgtatccatggccgggggcatcggttttattgggctgattgcacctcatctggctcgccgtctggttgggccgatgtaccagcatttgctgccagtagcttgtttggtcggggtcgtcattctggtcaccgctgacacgattgggcgttcggtgtttcagccgaatgcgattcccgcaggtgtggtggttgctgtggtaggagctccgtattttttattcctgctgtcccgaacaaaatgacagaaggaataggtacatatgaaatcatatggtacaaatgatacaacccgctgaaattaataactaagtagaagccttctatattgatcattataatgtagagtttctgtggcataggagagagtaatcatgagaaagcacaaatttgagggttcaggttttaaacgttcatggatagtcacaactcttgttgtatgcatgatcatgttgtccgcttgcggacaagcagccgacaagcaggctaccgatacgaaagcggctggcaatgcgcaggcaaccattagtgcggattcgcgtattgcttcgatgtctattcatttgacgaacaacctgctggcattgggcattactccggctggttcggtcattggcggagatgtgaaggattttctgccccatgtaaaagatcgtcttcaaaatacccgtaagctaggtgttgtcacagacccggatatggaagcggtactggagcttcaacctgatcatattttcttggacaaaaaatattcgggaaccgatgtggccaaatttgaaaaaattgcgccaaccgaagtttttgatctggatgaaggcacatggaaggatcaattaaaaaaaatagccgttatggtcaaacatgaagcacaggcagacgcatttctaaaagactatgatacacagaaggaacgagtcaaaaagctgattcattcaaaaattggggacggaacggttatggctgtacgtgtgacggcgaaagaggtccgtgttatggggatgaagcgtccggtgggaccgctgttgtatcaggacttgggcttgaagccagccaaaggtgtagaaaagatcagcaaggcttatcaggttgtttcccaagaggttttaccggattatgatgctgatgcgatccttgttatcatcagtaaaggcgcggatgcccaaaaggtatacaagcagctggaaggaaatacagtatggcaaggtctcaaggcggtgaagcaagggcatgtctacatgttggacggacagccttggctggactattccgcgacgggacataaaattgctctggataatgcagaacaactattttccaaataagttctaaagtatatcaagccgtattcccccatgcagcttcttgcaggccaggaatacggctttttggcgcacacccatgctgtaagtcggttgcctgatcgaaatgaaaaggagctgctgcgatccaaaatgaggcagctccatataatgagaattgcgggctatgaacgttttttacggagaaaaatcggtttgagtccaataaatccaatggcggcgagaattaaattcacccaaggtgagattctgaatactggcagtacactgcgcagcgccagtccggcgacaagaatcacgacaactaacacaacatacatcaagatggatttaagattcatctggggctttacaggggcatggtctggctgttgtgtctcctcgccttcttcgggacggtccataaaattcatcagagcttcaacgagtagaatggctcctgcggcgatgatgataagggtggataggctgattttttcaaagggtttgatatccccacctgtaaaggtgacaaaccatccgataattgcctgtgtcaagaaaaacatagataaggcaatccatgcaataagcgtataattttttgctttattcatttcttcctcctgcattatgagcgtatcccgggctgatggaaccgccatttcgtaacaaagacagtatacgtgaggaagcgtcggatggcaaaagactttatctataaaatgtatattaccgctgcattctcctcaaactggatacagggtgagcacatagagcaacctgaatataaacgttaagagggtgtggcatcatgaaactggagaaccaggcagattattcagtccaaaaacgactggcaaacgcttcgaacgggaatagcggggtggcctcgtctacaaatgtgagtcaccggagcgttcaaggatcatctccaacgtaccgtatactggacgatatcgaagtggctaaggatacagaatttgcgggtgaactaggtgcacagaactaccgcagcctgtggcatgaggatgaacataacggcgcctcttgtaagctggagtgggagggacgaacggagacccaccaaatgtttaggaacagctacgaataacgaacgtctactttaatgtagtggattcactctaataagtgtagtatagcgttctccggaatcgcatcggggagcgctatttgtttacttttttaacgatgtgaactgacaggttgacaaggaagcagggcaatgatagactgactttactataaaatcttattaaacttatcggaattaaagtgaatgaatatcctggatggatattccacgttacgatatgagtttgaattcataaatgtgtagtgaagcttgaaacagggggaatcaggatggaacggcaaattggaattcgctttgaacatgaagaactggcagcaacaattcattatccaaaccgtacaaatgagggagatcgtcagagaagggttcctctcgttgttatatgtcacggttttgtaggcaatcgtatcggagtagatcgattattcgtcaagactgcgcgtgaactggcggaagggggatattttgtcctgcgttttgattttgccggttgtggagaaagcacaggggaatatggcaagcaggggttagaatccatgattaatcagacacgtaccgtgttggattacgccgtcaattgcgcggacattgacccgaccaaggtgacgctgatcggtcacagtctggggggcgcggtagcccttctcacagccgtacgggacaagagagtacaaaatctggttctttggtccgcagtgggctatccgttcaacgacatcgtcaaaattacggagcgaagcgtgtacgatgagtctgttaaaaccggtcatgccgactatttgggctataagtttacgcctgcttattttgagtcgttagctcaatttcagccgttccaggaggccgttaaatttaacggagatgtgctcgttgttcatggcacctcggatgatattattcctgtggattatgcatttctgtttcaaaagatattctggatgcgtccagaggggcgctgtgataaagagattattttccagggagatcacactttctcgtcaggtaaagagcggcaacggctgattgatcgaacactagaatggctggatgaacaggaaaatattcaacgggattggcagcactggatgatctgatttcagtgtgtaacggattgtattggaaattgcgcctccgccggagtaaaatggaagagtaacactatactggcgtgtggaggttggcagcgatgacattaccctcaatttttgttgcgcatggttcaccgacactggctgtagaaaataacgcatataccagctttcttgcaaagctgggcgcgagcctgccccgacccaaaggaattgtcattttttccgcgcattgggatagccccgatcaatgtattggcgcggatgatcagcatgcagcgttgcacgatttctatggctttcccgaagaaatgtactcaattgattaccctgcaccaggcgatccaaagctgtatgaggagatagagcatctgttcagtcagcataacctgttccaccagccggttcggaaccgaggactggatcatggagcatgggtggttttgcggcatatatatcctgatgcagacataccggtcgtacccttatccattgattctcggcgcgctccccaggagcaatacgagattgggcgaatgctggcgccgttgcgagaacaagggattttgattatcggtagcggtggattggtccacaacttgcggacactcaagcagacgagtgagccagccgattgggccgttcaatatgatgactggattgcacagcagcttcaagactggaatttgcgtcacctattccaatatgacaagaaggctccatatgccaaacaggcggtaccttcttatggaatagagcatttttcacctttgttttatgcgatgggggctgcggatcatgagcgctccgcgcgtaagctttttcaatcgtatgtccttggctcgttaagtctcaattgttgggcttttggtcaagaaagtgatacgtaaatgtaaaaaaagaacttccgaatccacatggtgtgtgggaatggaagttcttttgtgtattttgcgtcttcgattaattagaaggcacgtgtatcgtgagcataacagcgcaaaaaaataaccattatcccggaggataacggttattttggggatggttaagctatttttcgactagggtccgctggaaaggtatctttatttttacgaaacagtccacgcaggaagggcagtacccaacggtcaaagccaattcttccggcatttgcaccagcaactacaaggaagatttcaaacagcaggtagattgcattggtgcttactgtacccgagaacaggaacgagaagttcataaccatagccatcaaagcagccagtgtagtcaatgtaccgagaagcaggccaaccccgaccaagaactcacccaatgggatcaggacgttgaacaaacctacattcggcagggcaaaggcttccaggaacgatccccaccagccttgtacagcgggatggtctccacctgttttagcaatggcccccgagataaatccgcctgcatcgaatccacctgtcagcttttcaagtccgtgggtcatccattcataacctagataaacccgtactacagtcagcaaccacattgcgactttgttttcacgtaaccagctgttaaacattcaaaccactcctctttattaatctataatgttggttgtatttcattttgttggggatgatcatctttgctacacctttattgtagtaggttcagttacagttatttgtgataaaaatcacaaagtctgaatattttttaaattttaatgtctttagataagtattctatagagtggttacgcttcaatcaagacaaaaacaggaaataaagcttataatgagaaaaataactaagtggagggatgaacttgtccgggcccatttctcaacgaaatcattggttgcgtgtgatggcctcagctctgttatgcatgacgctgatgtcttgtactgctatgtccaatacgggtgaatctgaatccgttccccaaccgaccaagcaagtaacagagaaggaggcacttgaaccgccgaaggagcagtctattccggcatttacagctccgcttaccggtcttccggtggagcagcctgttttggagcggccgctcgctgtcatgattaacaatgctccggctgcacgtccacaggcaggacttagccaggcagacatggtatatgaagttcttgcagaaggcgggattacccgtctggtcgcttttttccaaagtcatggtggagatgtaaagatcggaccggtccgtagcattcgaccgtatttgattgagctgggcgaaacctatggtgcgttgcctatacacgcagggggaagcacagatgcctatgcgattttacagcagcagcggaaggaacatctggatgagatttcaaatggaggggcttacttctggcgaagcaaagatcgtcgtcctccacataatttatacacagacgtgaacagactgcgcaaaggaagcgatagtaaagggtatgccaagcatacggatgttccagtatattcttaccttaaatccggtgaaaccccagttatggtggacgagacagcagcatctttgcaaattcggtttttgcttaaaagctatcgggtatcttatacctatgatccagcaaatcaacaatataagcgttttgtgaacgaaaagtcacatgtggatcaaaataataaccaacagctctcagcagccaatgttattgtaatgagcgctagacatcgaacgttggatgatgtaggcagattaagtgttgagctggacggcagtggagaggccatggtgtttcaacaaggacagttaatacaggctgagtggcggcatacaccaggcgatgcgattcgttttatgaaaaatggggttgaaatcccgttaacgccaggtacatcctatatacatgtggtacctgcagatacttcactgaaggaacatgtaaccatagcagcaaattagaaaacgaaatacacctttttaggaagaaattgtcggataatgaccttccatgtcgggcactgtatacgtatgtcatgaaatttgcttttacaaacattacaaaaacattgatgagtgtgataagatagcaaaggttgtctattgcagtcgaaacaggttgcggatattttcgtaaaggggtaatcgttatgagattgaagaaaaaggatatattcttcgagacgttggaaaatatggcagatacgatcgtgcaagcagccgattattttgcccaacatacttcaaatcttcaggatgtgactttgtttacaaatgaaatgaagaagtatgaaaataagtgtgatgattacacacacacgattattactgagctgaacaagaccttcattacgccgttggaacgcgacgacatcatggaactgacaacaaccatggatgatgtgttggacggtcttgaagcgacggcttctcgtttttatatgtacaacattacggagccggacgagtatattgtgcagttcgctgatattctgcgtcaatcagcttacgaaattcagaaagctgtacatttgctttcacagaaaaaattgctggccattcgtgaatacactattcgcctgaatgatttggaaaatcagggggatgaattattgcgtatttgcatcaaaaacctgtttgcaactgtaactgaccctattgaactgattaaacgcaaagaattgtacgaacgccttgaaacgacaacggattcatgcgaggatgttgcaaatatgctggaatccatcattatgcgtaactcgtaagggagtccttttacatggatacaagtttactggtattgggtattgttatttttcttgctctggcatttgattttattaatggttttcatgatacggcgaacgcgattgcaacttcggtatcgacccgtgcattgaccccgcgacgtgcgattattatggctgcggtcatgaactttctcggggcaatattgtttacaggcgttgcgaagaccattggtggaagtgtcgctgatccaaccaagcttacgaatggaattgatatcgtcattgcgacgctgatcgctgcgattatttggaacctcttaacctggtggttcggtattccttcatcctcttctcatgcactaattggtgcattggctggagcggtgtatgtaggtgcgggatcggataaattgaactggagcggcttcatcgggattgtcgaaggacttattttctccccgttgattgcttttgttgtcggttacatcgtgatgataattttaaaatacatcttcgctcgtcgtagtccgcatacggtaaacaaagggtttcgtacaatgcaggtcattacggcagcgcttcagtcgttcacgcatggtacgaatgatgctcaaaaggcgatggggattattacattcgcactcgtttcggcggggtatcaggaccatttggaagtacccatgtgggtaaaaatttcagccgcaacagctatggcgctgggtacatctatcgggggctggaaaatcatcaagacgatgggaaccaagatttttaaaatcgagccaattaacggattcgcagccgacatttcgggagcctctgttattttcacagctacattgcttcatttgcccgtaagtaccactcatgccattacttcggctattttgggtgtgggttctgcgaagcgtttttccgctgtgcgttggtcgctggccggtcgaattattattacttgggttataacgataccgattgctgcgctgttatctggattgattttcaaaattcttttctagttcattattatttcttgaaaaataggtacacactatagaatacacaataagcttccgtccgctttttgcggcaggggcttattggcattctggggcaaaactttcttcaaagtttacacatccagatagttccatgaaacgtttttcaaaaatacctgacatcaaagtagtcaatttttaataactcctgtagaataaacagaaaactttgaaccgttcaactgactggaggaaattatgcaaaaatctagaaaactaatagcactcatgatttgtttgttttttgtggttgccctggccggtaatttcggtgtagtggcacatgcagaaaataaaacaaagtatgatatcggcacggatacaacgttcgcgccttttgagtttgaagatgtaaatggtaaatttgtcggaatcgacatggatttgctggcagctattgccaaggatcagaattttgaatatacgattaagcctcttggctttaacgcggcagtgcaggcccttgaaacgaatcaagtggatggtgtcattgccgggatgagtattaccgatgaacgtaagcggaaatttgatttttccgagccttattttgattcaggcgtcgtcatggcggtccgcaaggataatgatacggttaaacgctatgaggacttgaaaggacagcgtgtcgctgtcaaaacaggaacggaaggttacacattcgcagaatcgattaaggccaaatacggctttactacagttccgttcgatgattcttctcaaatgtatgatgaagttaaaacaggtaattcggttgcctgctttgatgactatccggtactggcatacggtgtaaaccaaaataacggccttaagttggtaacagataaggaaaaaggtgcttcttacgggtttgctgttaaccaaggcaagaaccaggagttgctggagaaatttaatgcagggcttgttaatctgcgcaatagcggggaatacgataaaattttggccaaatatcttggcgaatcgggcaaaggtgtggcgcctgtagagaccagccgctggggactgatttccgcttcgctgccttcgctgattaagggcatgggaaatacgttgctgtacacacttgtatctttactcgtagcctttatcctagggttggtgtttggctttatgaaagtaagccataacaaggtgttccgtggtattgcaactgtattcgtcgatatattccgcggtattccgctgatcgtgcttgctttctttatttactttggtattccacaggcactggatttcaaaatgccgctttttgtcgcggctgtactgacattatccctgaatgcgggtgcgtatgtaactgagattatccgtggtggtattcagtccattgatccgggacaaatggaagcagctcgttcgcttggtctaccctatcggacggctatgcttaaaatcattttgccacaagctgtgaaaatcatgatcccgtcgtttatcaatcagttggttattacgttgaaggatacgtccattttgtctgttatcggtctggtcgagttgacccaatcgggtaagatcattattgcgcggacattccaatcctttgatatttggctggtagtagcggtgatgtatcttatcgtcattacagttctgaccaaaatttccaaccgtctcgaagggagagttcgccgtgggtaaaattatcgttaaaaacctgaaaaaaagctatggtagtaatcaagtattaaagggcatcgatatgcaagtacgtgaaggcgaggttgtgtgtgtcattggcccctctggttcggggaaaagtacgtttttgcgttgtatgaacatgcttgaagaaattaccgcaggtgaggtcattgtcgatgactacaacttgagtgacaaaaacgtggacattaacaaagtccgtgaaaatataggtatggtatttcaacactttaatctgtttccgcatatgaccgtgctcaagaacattatgttcgcgccgactgaactggggaaacagtccaaggcagaggcccgggaaacggctatgaagctgctggatcgtgtaggtttggccgataaggcaaatgcactgccaggacagctttccggcggtcagaagcagcgtgtggcgattgcacgtgcgctggcaatgaacccagacattatgctgttcgacgagcctacctcggcgctcgatcctgaaatggtaggcgaagtgctgggcgtaatgaaagatctggcgcgtgaaggcatgacgatgatgatcgtaacgcatgagatgggttttgcacgcgaagtaagcgaccgtgttgtgtttatggacggtggttacatcgtagaagaaggaacgccacaagaggtatttggtaatccaaaaaacgagcggactattagtttcttggaaaaagtattgtaagtgggcaaggtttgccgtgagtgcaggtgaggacgtagtgtgagaccgctccgcgttccatttgatctttcgatcgctgttgcccttgaatttttttgattataaaagaccttataaggtgaaaattctagggcaaaggcgaacgcttcgcttctccagattcaaatggcccgctacgctactactcgctgagtagtcccttttcgtgcaaagagccggcctcacttttgaatgagtgggtgcaggggaagagggcgcgagtgatttttcatttttgatgtttattttcataagtggagggcttgcttttgaagataaggactgctcatcatgaggatattccggctttggcttatctgatggaggagcttggttatcctacgactgtagaagatatgaagatgagatatgatcgtatcgcttctgaccctaactaccatactctggtggctgaagatgaaggggaagtcgttgggatggttggactacatgctgatatcttttatgaaagaaatgaagattacgcgcgtatcgtcgtttttgtgatggattcaaaacatcgtaataaaggcatcgggaaggcgttaaatgaggaagcggaagcttgggctaaagagaacgggttggttgccattgctttgaacagtggtaatcgaagtgagcgacaggatgctcatcatttttatcgccgattaggatatgaagcgacaagcacaggatttgtaaaaaagatttaaattataatgaattgattgttttataaggatatcttgggaggcatgttggcccggagatatccttttctttattaaaaggaatacaggacttgagattggtataatgttaattggcttatataaaatataaataacataacagacgcgaagtgtaagcgagggggacgtacggtgatacgtacattgactataggtcatgatcatcaggtaacagtgggaaaaccattggatcagatcgtcatggaggattacatatggatatgggtagattttagcgagcctacagatcgagagacggagctgctgacgagttattttcattttcacccattggctgtggaggattgtatgcatgttctgcaacgtcccaaattggattattacgaggatgtgcagtttctggtcgtgcatgcgcttgatgtagatacgttagctgcggaagaagtggatatgtttattagcagtcgttttttggttacatatcaccatcatgagttagaggagctggatcaagcctgggagcggattgtccagcatgcgaatgaacgtaaaatatggtcgcgagggccgctgtctgcagcctacacggtgatggacaagctggtagataactattttccgagcctttttatgattgaggatgaattggccgagctggagggcttgggcggtcgcgaatccgtagaggaattaatgaagcaggtgtttgacctgcgtggcaggctgctcaagctacgccgtaccatcgtgcctatgcgtgatctgatgtaccgagttttgaattcgcagcatgtgcagggccaaggagatcatatggcttattttaccgatatatatgatcatttattgaagctgacagacatgctggaggccgaccgcgagatgacagccgacctgagggacagttatatatcgctcaattccaatcgcatgaattcaattatgaagacgctgaccgtaattacgaccgtctttatgcccttgacgctgattgcaggaatttatggtatgaatttttcgaatatgcccgagttgacctggaaatatggatattttggtgtactgttcttcatgtttttgttgagtgttgcaatggtggtctggtttatgcgccgaggctggttcaaatagtataatctactttcttttgcgcttgcgcggacgtctgcgcggggtagtggtgcttttgcgctgcgtctttttccggcgtgggcgtggtggtgtgtattcatccaattcctcggtgatatcggtggcagaatttttgctcgcggatttgccgaatgctgggagcgagcccataatcagcttcgccattggagcaaattgctgcacactagacataaccttttgcaccttgccgaccgtagcaacaattccatcaatgccacccatacggtcaatgaagcctttgatttcgttgagattaccgaggttgccaagccccccaagcagtcctcctttggctggaaccgggtctggtgtgaccacggcagaatccgtaatactcgctggcgcctcgtaaggaaccagcccggaagaaccggcttgcggaacctcgttgtatggatcgagtccgggataaggagatgaactatacggatcggaaagggaacgctgtagcggcctccgatgatagtagtgtccaggcatgagatcacattcctttgcaggttgatactctactgtatgttacaaacgcacagtgggtttaggcgcgtgtcccgaaatcaggtataaaagcggaattgggcattcgtacggtacgtttctatggtcataatgttgttctgtaatgcgtgaaaccgttaatgcttgaaaaaccgactattcctcgggtacaatgaggagagatcgtaaccttgggagatgataatccatgcagcttaaaaagcttaatgataaaagtattgatcaattgttcgaagctattttaactcttaaaaatttggaagagtgctatgtattttttgatgatctgtgcacgattaatgaaattcaatccctctcccaacgtctagaggttgcccgtatgctaggcaaaggcagcacatataatcagattgaagcagagacgggggccagtacagctaccatttcacgtgttaaacgttgtttgaactatggtaatgacgggtacaaaatgactctggaacgtctgggacgctaatgcggagccctgggatactggtaatcagccatggctctagggagccatattgggtggaacaggtggatcaggcagttgcgaagcttcatttgtcggaagaaatgccgatagaggtttcatttttggaaacggttaaaggaagattgattcaaaatggtatcgaccgtctggaagccttgggtgtaacagatatattggttatacctctgtttgtgtcatcaggcagtacgcatgtagatgagattagctatgcgctgggtgtcaaagatgcgccggacaaagaaacagatttggagccgtttcgactgaaggtgcaagtgcattttggcagcccgctggatgacggagaagatgttgcccgcatggtgtgggacaaggttcgcccgctatcttccgaccctgcgagagaggttattttactcgtaggtcacggcagtgtgcacaacggcttttttcagcgctgggagcaggggatttcttcgttggcccgtacggtgcaaagcgtgagcggtatcatcacggaccacgctttgctaaatcccgagagtgtgtacgacaaggcagcgtattggaatcaggagcggggtcatgatgttattgtggcaccgctatttttgagttcgggatattttacaagtcgtatgattcccaaacgcttgcagggactcgaataccgttattcaggagcccctttattaccgcatcctttgctcacaagctggatggatagacaaattcgtgaattattgcaaagtgtgcagaagcaagcaaggtcaagtcataggtagtctggttcagctatagcgtcatcttagccttaaatttccttatttgggcaaagtctggcttcttttattgtaaaagaggtctttttccagtatgatgatattttgtacagactgaatgtgatgaactgctatgtgaatataaatatcattaaatatacgggtggcgtaacggaatgaaaagagctagattaatctataatccgacctctgggcgtgaggaaatgaagcgtcgtcttgcggatgttttgcagcgcctggatgaagggggtattgaagcctcttgccatgcaactacgggtgaaggggacgcaacgcgtgccgcaatagaggccattgagcgtgggtatgacatgattatcgccgctggtggcgacggtacattgtatgaggtcattaacgggatggctgaaagagaaaaccgcccgcccctaggtgtgtttcctctggggacgacgaatgatttcgccagagcactgggcatccccaagcactgggaggattattgcgacctcgttattcgtcaaaatccgaagccgctggatatcggaaaagcgaacgaccgctactttatcaacattgcaggcgggggaactttaaccgagcttacgtatgaagttccgagcaagctaaaaacgatgattggccagttggcgtattattttaaaggtatggagaagatggtcagccttgctccacaggagctgatcatcaaggcatcgggtcaggaagtgatccacgacgagtttatgctcttcctgattgcgaatacgaattcggtgggcgggtttgaaaagcttgctcccggggcgacaatagatgatgggctgcttgacgttattgctgtgcggaaatgcaatctggcggaaatgatccgattggtaacacttgcgctgcgtggtgagcatttgcaggacaagaagattgtttattttaaaacagattacatggaagtgacctcacccggctatgtccagcttaatctggatggcgaactggggggcactttgccagcgaccttccggaatttaccgcatcatttgaatgtatttcggtaaggaatgatgaggaaatacttctgtttccgggcgacgacgcaatatagtatatggaatgcagagtaggtagttgtttttgtgaacatattggttcttgccgttctctgtggggagtaacggcattttcgagttgatgtttgtatgtttagatgaacgttcaaattagacgtccgaaagaaaataccgcataaaaagaagatcagaaagaagtgacaatcatgacgaataaccgtagcggacgtggaaaaagccgccggaatgcagcaacagcaactccatccaatcgtattcgatccagtgcagagcgtaccgatctgcctgtacaaaagaacgatgaggccgtgatagacatcatcggcatgaaccacgatggcgagggtgtaggacgtgttgagggttttacgcttttcgttccgggtgcgttaccgggggaaaaggtacgagtaaaggtgttgaaaacgaaaaagcagtacggctatgccaagctgctggatattgcgcaggctagccccgaccggattgcagctccgtgcgccatctacgatcaatgcggcggttgtcagatccagcatatgagctacgaagcgcagctcagctggaaacgccagcatgtggtggatgtgctggagcgtatcgggaagctgagtgtggttacggagtccagtgagcatactggacaggttttggctgcatctgcggatggaaatgcagaccgcatgtcgcgtgtacaaggtgtagtcgtgcatcctacactcggtatgagtgagccgtggcggtatcgcaacaaagcccaggtgccgattggtgtcaccgaaggtgggcttgtcggcggcttctacgcacgtggcagccatcgcattgtggatatgaacacctgtctcattcaggatgaacgcaatgacgaagttgtcgcacgtgtgaaagagattggccgaatgctcggcatcagcgcatataatgaagaaaccggacgtgggctgctgcgccatgttgtggtgaagactgcttttcgcacaggtgaaatgatgctggtgctcgtgacgaatgggcgagatatcccgcatgcagatgcgtggatcggcagtatccgtgagcatatcccacacgtggcaagcatatgccagaacgtgaatacgaagcgaacgaacgttatttttggcgacgagactcgtgtactgtggggatgtgacgtgatctacgattacattggaaacgtccagtttgcgatttccgcgagatccttttatcaggtgaatccggttcaaacggaagtgctgtatagcaaaaccgtcgaatatgccgggctcacgggcaaagaaacggtaattgatgcgtattgcggcatcggcacgatttctttgttcctcgctcagcatgcggatcaggtgtatggggttgagatcgtcaaagaagccatcgatgatgcacggagcaatgcgctgttgaacgaaatgcgcaatgtgaaatttgaggtaggcgcgtccgaggacgtcattcctgcgtggaaagagcaaggcatcaccgccgacgttatcgtcgtcgatccgccccgtaagggctgtgatccacgcctgctcgacaccattctggagatgaagccagaacgcgtggtgtacgtatcctgtaacccaagcacactggcgcgggatttaaggatactggaggatggcgggtatagtacagtggaagtacagcctgtggatatgtttccgcatacggtgcatgttgagtgtacagtgttactcaaatggaaaggggcttccgactaagcccctgcaaataattcacccattccttgaggatgggcgatgttgtagtgaatcttgatagagccatctagatggctctctatcttttcaattacctgatggagcagttgttttagaacttgctcatcatcaatatcaagctgtgcaaacaatgtaattttcttctgaaaggcacggaactgctcttccgtgtctttttgtatttcgagaagggattgcaattctgctttgcgtttggcaagagattgttgttctgtctgatttcgttgattttgggcggtaaactgttcaatagtaagagcctgattagagaatagggttataagcccctgaacattcttctctaattgttcttgttgcttactcagcttgtttaactctttgatttgagcgggctcttttagaccaacattccctttcacggcatcgaataacctgtccaaactgacgttactatcaatcagttcctttaggtcattcttcactaccgcgagtaacgtatcatacccgataatgtgggaggaacaaaaggcttttcctcgcttcacgtatccacaacaaacgtaagccccattctgcttctttaacctatccttacggtaggtcataccatgaccacaatcggggcataacatgaggtgtgcaaaaaggctttcctgaccgttactgtggctctttccttttgatttcataaggttttgtacggctaggaaatcttcctttgaaatctgtgcagggtgggcgtcttcaaagataatttgtctatctccagggattttcacccgttctttagacatgtgacttatcacttcttcacgatgttggcatagtgttccagtgtaggtgacgttggtcaaaatacatttaatgcttgattgatgccaaaccgtcccttgattacctgcgttagacactgttcttggagtagggtagccatgctcagtcaagtagttactgattttttgcattccccacccttcatttaaataccagtgaaagatgctttgcacagttggggcggtaacttcatcagggactaagtttccgttctcatcccgtctgtaaccataagccggtaatgaagcctgatactttccccgtttagcactcccttgtcttcccagcttgattctacgcgagaatgttgcactatcctcttccgctaataaagctcgaatattgaaattaaatttactttggcttgtagcagaatcgtaattatcctcaggaagaatcaaacgagcaccggaattaacgataatgtctgccgtctgcaagttttctactaaattccgcccaagtcgagaaacggatttagctataaccgcatcaaacttcttctttttcgcatcggcaagcaatcgttgcatttgtgcacgatttttgacttttagcccactaataccattgtcgatgtaattacctgccacgatccacccgttgcgtgtaaccaaatccatagcataagcaatttgattatcaatgctatctttctgagcgtccctagtggtgctcactcgtgaataaattgctactttcaaactcatttaactcgccatcccttcagtgtcctgtgaaggaatggtgtttgctctattttcatcgtaatcaggcttatttatcttgtcaatgtgagccttgataatcgaaagtagaatttcttctagattgttacttccgttaaatgtgcgttccactttcatatttttcaaccccctcactttagttgtcgttctatgtcctcaactaggtgcaatgaggttgaaaaatttaaaaagtaccccttttccatttttaagaattcactgttacatttcattcgttcagatagtatctcgctataattacggtttaactgaaaaaaattgtacggtaatgctccgttttacccaaaaatggttagcttcattctctctctctctcttcctgaaataaaataattcgttctaatcgaatatttcaggaatttactttatttctacgttcctttgttaattttgcgagctgccttcttatattgttactgtagccaattcacaaccgaaaggagcggtcttcatggaacgcttgtacaacattaaagaggtaatggacatccttcagctttcttacacaacggtctatgcgatgtgttcaaacgctactctgccaagctgtaaggtgggcggtagcatccgtattccccaagaatcgttaaggaacttcatcctcaataacacaaagggaggtcaataattatggaagacatgaaatcgtttctaggccgtttgtatagtgctgatgaagtagccaaacttctgaaccttgatatgaatacttgctacaagtggcttggcgaaggaaggattaaaggaatgaagttagcaggggcactttggaggattcgggatgcagatttaagggcattcgtagagcagtccattaaagaagggagacgttaatcatggagaagtattacacggttgcaacaattgctcagcggctttcacttcatagccgccaaaccgtcagtgatgatgctgtctacgcttggattaggcaaggaaagttagaggtcgaacgtatctcaggcaatatacgaggctatggtaagtacccctattatgtgaagagaacacgcttaaaggcatttcttcgggaattgaactatgacgttgagaggttatttcctgacagcgaataaccatccaaaaggacacaataagcccctgttgaccaagcaggggcaataaggaagaaacgtgtaatttgattataagcagattcttccgcaacttatcgcatacatagaacgacaactaaagtgagaggggtatttttttttaccctccactgtcactaacttataccatcatcggggggaacagaaatgagagaggtaatgaatcgcaaagaagcggctaaagccgtaggagtcagctctagaacgattctgagggcaatacaagcccgtaagcttgaggctgtgaaaataggtgagggtaagacttgctcatacattataagccgttcagccgttgctgagtacattcaaagaagggagcggaaataatgaaaaagtttattgaagatattgtattttacggtgctgaaatggaatggacagagtttaaagatagtggtgatagtcacgacataactcgaagtaaaattgctccgaataatggaaaatacatgaccttgcctgaaaacgtaaaacgttgctactatctcaatgcaaacgagaagctagttttatttgaactgtactcgtgggcctcggaggatggtaaaagcaaaatagcaatggacttggtatcattaaaacttggtatcactgagagaacggttagaaaatgcgtaaaggaacttgcaaacaagaagttcgttcagattagcaaacaaggcaagtcgaatgtctacaaatttgacaatttaaaagagaacccctaccttgttctttctgaaattgttcatgagtttatcgacaggtactactataaaaaaggattacgtcagtatgaagattggttacaacgtgtaggagatgagggatttcgtctatggagagaagcacttgtcgacaccttagctaaagaagcaaagaaagagaggttttacgagccatatctagaaagattgaatgagacgcctgaagattatgaaaatatccatattagctttgttgatgaactattggagtttgtcaatgaaaccgcaataaaaagagcaactaagcaagggctagttttagaagctatatagcagaaaaaaattcctcttttgataagggaaaagattgcctatctaagcagtaaacctttccgctgaaggtactcaataggggaaattaattcccctgtaccttgacctcagtggaaaaatataacccactattacttacacttattaaagatattaaagacacttaaagagagatattaagaacactcacaaacacgccgcctttcggcgacgaggtttccacttcgctattttaagaaacatagctttagtacgaaaacgattgtttatgaaacggtgttttaaggattcagatcaattgtgatagaaaccttaaaaagtgtacgaaactcgtttcaaaaacaaatttacgaaaaggtatgtttatggtactatctaagtgccgtacatacgaggggaaggaaaacgaatgagaatagcatatgcaagagtttcgacagcagaccaatccctagatttacaaatagattcactaaagaagtttgggtatgaccgtatctatacggagaaggctagcggcggcaaggatgaccgccctgaactagcgaagacattggagatgctacgcgaaggggatacctttatcgtctacaaacttgaccgtttggcacgttcgacgttgaagttaattgaaacccttgacctactgaataagaagggcgtggagttcataagcctatctgataacatcgatacgtctacagcggcaggaaaagcaatgtttggtatgatggcggtattcgcagaatttgagcgttcaatcattcgagagcgtacattagcaggacttgaagcggccagagcacgtggacgtaaaggtggtcgccctatgacggataagaagaaactagacaaagcagtgaagcttcacgagagcagggaatttactataactcaaattgaggaaatgacaggagttagcaaaggttcactctatcgtgaacttaaacgtaggaagcaagaagaagccaatacggtttgaggatcgcttacgctctgatgataaacgaggaagtaagagtcacccaaagtgaagtgcaccccttagaa

SEQ ID NO: 2648 - DNA, 24926 bp, Unknown
  Kingdom: Bacteria, Phylum: Firmicutes, Class: Bacilli, Order: Bacillales, Family: Paenibacillaceae, Genus: Paenibacillus
ttacggtcgattttgccgttaggtgtgagcggcatttgctccatctgaacaaagtgcgagggaaccatataatttggaagctcttcactcagctgcttgcgaagctcgccccccgttacttcccgttccgccacgtagtaggcaaccagttcgtgttggttttggctatttgcatgtgccagtacgatgacctcttgcatgcgatctgccttcagcattgccgcttcaacttcgcccagttcaatccggtaaccgcgaattttgacctgctgatcgatccggcccagatactcaatgttgccgttcggcatccatcttgccaggtcgcctgtccgatacatgcgttcatagcccgcttccccatctacaaacggattagccacaaattgctcagccgttaattctgggcggtgcaagtaaccgcgtgccaatcctggaccggatacacataactctcctgctactccagcaggtaaaagatgaccaagagcatcgatcatgtacacccggtggttgggtacgggacgtcctatagaaatggtatcgattgctccgggctgttccgacaccggccaaatggacgttgctaccgagttttctgtcgggccatagccattaaaataggcaacctgatccttccacttgtttacaagctccatcgaggaagcggaaccagcggtgaacagaatacgcagatccggcattcgttctgggtttagatacacagcgtaggtaggaggtaatgccgctaccgaaattttatgttccgccatatactgttcaaactggttgtagttcagaatgatttccgaagtaggcacgtaaagtgtcgcaccacaaaatagcgcctgaaatatttcccagcatgcagcatcaaatgcgtagctcgcaaacagtagggcatgatctgacggacttatctgcaatgtttcatcaaaatacgttttcaggttacacaatccatggtgctccagcattacacctttaggctgtcctgtagtacctgaagtatatataacataggctaggtcgtttgcccctgatacggcttccagatttgatccttccatgtgatatacagttggatctacatccaataccagaacttttcctccaaaggcggcttctttgaccttttccacaagatgggtttgtgttaaaagcaggtctgcaccggaatcgtcaaatatataacggatacgttcctctggatatgacggatcgatgggtacatatgcccctcctgctttaagaatagcaagaatgccaatcaccatatctatagaacgatcagtcatgagtccaactagccgatcagttgtggtgccgtaactacgcagggtacgagccagtcggttagcacgttcattcagctcagcataagtcagactggagttctcacagacaattgctgttgccttcggtgtcttttctacttgtttttcaaaacaaagatggatggtatcactagaaggatatgagatctgtactccgctaaattcggataaaacctgacttttctcttctgttgtcagaaattccaaagcggaaatcggtagatccggctgttgaacaatctgctccagtccctgtttaagatgagctgcaattagcttaatccaattttcatcgtaaaccagccgattataactaaatgtaacttcatactgtgatccaggaacgacaatcacattaaaatcatagttggtctgtacaatatcctctacgtcggtaacctgaagtgtatcaggccctttttccgcatgaataagctcctctgaataaggatagttctcaaaaacaacaatatgacggactaaattttgtttcaaatccgtgtgattctgaatatctgccaaggaagaataagagtactgagtagactcgatgttggagttttgcacagatatcagcagatctgagaatctctggtccgcatcactggttatgcgtgttggtattgtattaatgaacaatccaaccatattttcaattcccggaacttcatctggtctgccggatactacggacccgaacacaacatcccggctgtggttgtacatttgaagcaataatccccataccgtttgaaatacagtgctgactgtcgtgtggtagtgtttagctattctctccattccttgagtcagttctttccccagcttgcatgtgtaacgttctgcttcgaagattggattcaatggacggttataacccggcaaaattgtttcattttcaagcccatttaaatatccccgccaataggctgtcgcttcttccttgtcctgttgctctagccactgaataaaactgctgtacggatataccgtatccaattgcgcaggcactccagaccgaagggaagtatacatagtaaaaaattcctgggctaccgttcccatgcaccaaccatccattataatgtgatgaacactccaaacaagcctggaagactcatcatcccattgaaacagagcaagccgaatcggaacatctttttccaagtcaaaacccgcttggcgctctgcctttaaaaaggccgtaaaatgctcccttttctcagcttcgggaaaagcacggatattttcgaaatgaacaggcaacgcatcacgttcctccaagacaatttgaagcggacgttctgtttctttatacataaaaatggtacggaatatatcatatcgattcatgagctgctgcaagctttgctgaaccaaatgaacatctagcacttcattaaaggtaataacggtctgctcaaagtaagcttctgattttgcgtcgaggatggaatgaaacaacattccctcctgcatcggggatagcggatagatatctttaatatttacctgtgccaaatcattcacctttcctttatccatgcagaatttgagtttcaacttgctgatatcctttatttcaacagatttcccagcttatccgataatcggcttgatatttgttcaaattgccccatagacaattgattatatgtaaaatccgtagggctgcgctccgcctgatctttagtgcaacaatgatggataatattcaatagatgttttttaaagccgttcgttaatcgctctaccgtcgctacaccatattcaagcccgttatattcaaattcaaaccgaaggattccgttcgtgatcatgccgttaatgtcaaatgtattcgtcttttccgcacgcgggcttctctcaccattggctaagtttgctaatcgggaaatacgccaaggcatgtctgtcttgttttcttcgtcgaattgtcccaaataattgaagctgatttccgggaatggtgcagcgactagagaagcggctttagtctggtccttggtcaaataacgtaaaataccataaccgacgcccttattaggcacccgccgcagcttatctttaaccattttgatctgataggccaagttctcaggtctgttgacctcgattacaaagggatacagggaggtaaaccagccgactgtacgagagatgtccaaatctttaatgatctcctccctgccgtgtccctccagcaaaatcggaatttcgttgtaaccgctccattcataaaaagccaggcccaaggctgtaagcaacagatcattcatttccgtatgataggcatgatgtacatgcttcaatagcttttccgtctcatccctgctgagtaccacctccgcttggcgtcggtcttgcatcaggctaaccgcgatttcatgatctcttggcaaccgacgtatcctgcgtgaatctacattgttccagtagctgatttcttggcgtacctgcacactttcggcgtaagtggtcagtcctgaagcccactctttgtaagcatcagtcttggcgggcagattcggcatctcaccccgagctacctgatcataggcggtgcccaaatcttccagcaaaattctccaagacacaccgtctacaataagatggtggataacgatcatcagatgatcttcaccggataaatggaataaagccaaacgtatgagaggacctcgttgcagatccaaactgctttgcagctcatcaccaatgtgtcggatttcttcttcaggctggcttgattgtgtcaaatcatagctcgttaatgtaaagaactcaccttcgttcactcctctgttataggcggtgtttcccttttcctcttccacaaaaatgatgcgtaatgcatcgtgatgagctaccagcttgtccatagcgtttttcagccataattcattccatcctctatcattttgcagcatgactgcctgattataatggtgacgatctctccgatgatgctgaaaaaaatcgagttgaataggtgtcaattctacctcaccttctacaatcccctggggaatgatacgggtgattttttttataaacggtgctatcaagtgaatttcagggtaacggaataagtcctttacttccattttcaggcctttggcatttaagcggattgcaatttgcaatgctttaatcgagtccccgccaagctcgaaaaagttgttgtgtaatccaattggtttaacgccaatcacttcttcccagatcaaagcgattgttttttccaattcatcctgtggtgcctcatatatgctatccaccgatgctatttcatccggttcgggcagattggatcggtctattttcccgttatgggtcaatggcaactgttccaatacaatgatttgagctggaaccatgtagactggtaactgctgagccagtttatctcgcagcatgtctttctcagctgcacctgcaacataggcacataagtacttttgtcccgccgtgtccagtcgatcaacaacaaccgcctggcgtactccttccgtttcgagcaaaatagattcaatttctccaggctcaatccggtatccgcgaattttatattggtagtcagctcgcccgataaaatctatattcccatctggctgccagcgtgccagatcccccgtacgatacaagcgtccaccgggcgagaaaggatcagacacgaatttctccgctgtaagctcaggcctgttcagatatccccgcgctacagaagctccaccaatacacagctcgcccgttacaccgacagggaccggacgcatcctgtcatcaacaatgtatagcttatgattcggtagagctcttccgatagggacaataccggacagcggcaatttttccagctcgtcctcataaaagctagattcgattgcggcttcggtaactccatacgtattaataattcgcatcttgctgccaaaacgggtcaacatcttacggtaatctgcaacagccaagctatctgctccagtagtaagcagctttagtgaactgatatttgtaccgtgctcatagatgtaattcaatagcagagctaaaagcacaggaggcgtctcaaacgtagtaatctcctgctgctccaacagtgtagccagggcagctggatcatttctcacgttttcaggacaaatgactaaggtacctccattgacaaataccttggccaaatcgcatgcaaacacatcaaacgacatgctggcaatttgcagtagcttaactggaaaatctttgaatccttggctgtgtctgtagccaagtgcagtgttaacatattgttgatgttcaaccataacgcctttgggcttacctgtggtacccgatgtataaatgacatacgccaaagagccaggctcatatgtggagatatactgcttgtctaaatccatctcgggctggagtggcaacgtagcgagatcgactacctcgcccatgaaatctattgttttcagccagcccgtcaggtgagattgcgtaagcacaatcgtcgttccgcagtcacgcagcatatattcaatacgttcttctggatacacgggatctactggtacataggcagctcctgctttcataattcccagcaccgccactatcatctcaacagacctgtcaaccatgacagcgaccagactctcacgtgtaatcccacgcttctgcaaaagatgggcaagagcgtctgccctatcattaagttgtctgtaagtgagcattgtatctttatatatgacggccgctcgttctggtgtacgctccgtctgcgcttcgaatatcccgtgaaaagtaagtgcaggaaactggacaacgggtccgctccatattttcgtcatattagcctcttcttcggttgttaacagccgaacatcacggaggcaaacatccggattgctggcgatttggaggaagacatgcttcaaatgatgggccagatgcttcatcgcttcactgctatagaccttgccgttataggacaatatgaaactcattgccttcttgtcttcaacttcaatattaaagtcatacggtatttcttcgaataaccgggcgtcttcaataatgaatccgagtttgtcttgccagtcccgtctcccgaccatgttttccagcggatagttctcgaatacaaggatatgatcgagcaagcgttgcttcagtgcagattgcgactggatttcagcaagtgaacagtatccattcatccttccttggacagaggctctctggacatcgcgcaataattcaacaaaactcttttcttcatttaatctaattcgtaatggaatggtattaatgaacaatcccacaattcgctctacttcatccaattccgacgggcggccagataccaccgtgccaaaaactacgtccttgcttccgttgtaacgaccaagtacaattccccaggcggccagaaaaagactgctaagcgtggtcccattgcattcagcaatcgtacgcaaagtgctggtctctgtttccgtcagcgtcgttctatattcctgcagcagatagccgcctttttcaggagttgtagctggagtttttagcatcggaagtccagccgtttgttcgtaatcttgtaattcagaactccagtagtccttggccgcctcctgatcctgttcttcaagccagtcggcatacccggtgtaaggtcgtggttcaggcaattgaacggaacggcctgtacgataggcctcataggccgttaacaactcgtccattatgatgccaagacaccagccgtccataataatatggtgaaaacttaaaagcaacgtataagcatctttatccgtctgaagtacagccatccggatgagcatatccctgctcaaatcgtaatggctgttacggtccacatccataaatctacgaatagcgtcggcttgctcctttccggtcagctctgtcatattttcgtaagtaatcgccgtgtttcgctttttaaagacaatcagccgagaacgagaagcggatttatgataaatgttcgagcgcagcgtttcatgacgctgaaccagtaactgaaagcttttttgtagggcattccaatccagatctcctcgaatagaaatacgtaattgctcgtaataagcctgtgattctggttccatcagcgcatggacgagcattccttcctgtaagggagtcaagttgaccactttttcaatttcaagtcctttgatcatggatatcctcctcgtacgaatcgttatagattctcataaaactgcttcatgtcttcaaactcatccagatccaaaccacgtgctcccacatccgatggtgttagttgccgtccggattggtccagacaatgctgaataatgcccgacaaatgatgttcaaaacgcaacagaagcattcggatagtatctgcttcatacgcttgacggttataaagcatgcagatggaaagcttaccgtctttcagccgcccatccagatagaggtgataggctaaatctgaaacgctacaattctggtcggaccataattcaacatccataggtgatgtatgaaagtgacaggaactaaccgattcagaatgaatcaagcggaagccaatttctgggtaatacttagcattaagttccgatttaccagaggttgcagatccatattttagtaatccatatcctaaaccctggttgggtacttgccggactgtctcctttacgtttctgagcaaaagagaactgtcgttcccaggctccatattcaggacaagcggatatatggaaccgaattgacctacggttcttgaaaggtccggtttgtccaaagtcaccgtttgttgctcccgatcataatgttcaaatccaatggcgatcttagactgtccagaccattccactatagtcagtcccaatgcagcaagcagtaactcagcggtcaccgtattataggtttgattagcccgtgttaacagctggcttgttttctcgtccgaaagctgtatgatgcaatgttctactggacgaagtgtttctgaatgtgcaggtgccttatggtccttcggtataaattcgccattgaaatgaaccttatccagccagtagagtttctctttggccagctttttgctgtctgcatagtcttctagccaccgcatccaggagcggtaagaatctgttttgtcaggaagcactatcggttccccggtaagagcttgttcataggcagttgtgaaatcctcaagcaggatacgccaagatgtggtatcagccactagcggatctacagaaaggaagaactggtcggagcccgacatccggaataagcctgcgcgtactctgggtccctcaaacattccataactgttttgaatccggaagcattcactctgtaattgcttgctagcttgatggtcatcatctgcaagtgagaacacatcaagtgtgaacagttcttcatttccatctcggtacataaggatattcggctcatcgatcgacgccagaccaagccgtagtccttcgtgatgagtagtcaatgtttgcagcacagaccgtaacagatcctcatcgaagtctgggttacccgcaaatagcatggatgttgtcgtacgcaaggtatacaatgtacccagttcattcaactgccgctgaatcgatgttattggaatctctccatgtatcgaattctggtctgtgtagcggaacaaagttgtcacaagcttgctaaggtcctcaatgaccgggtgctccatcaaaagagaaatgtcaagggaataaccatgctgacgcagacgtgaggccacctgaacggccttaatagaatcgccgccaagcagaaaaaaatgatctcgaacgcctatttgatcacatcccaaaacgtcttgccataccacgaccagcgccctttccacatcagttctcggagcaacataatctgtttgtaaagagtcatgtcggtccggctcaggtaaagcttttcggtcagtttttccatttgccgtaagaggaagctgctgcagaggcaccacatatactggaatcatataaaacggcagcttctgcttgagcgcattttgcacgtctagcggacttaatggctcagaagccacaaagtatgcacacaaatccttgaagccatctttgttttcccgcgctacgaccactgctgactggattccgtctacggacagcaactgcgcttcaatctcacccagttcaatgcgatatcctcttactttaacctgttgatcgatccgccccagatattcaatgttgccgtcaggcatccaacgcgccaaatcccctgtgcggtacatccgctcataaccctccgcgctgttaaacggattagtagcgaacttctcctttgtcaattccggtcgattaaggtagccccgggctactcctataccactgatacaaagttctcccaccactccaattggttgcaatcgctccgtgccttcctgtacaacgtacaaatgaatattatcaatcggtttaccgatcgggatcaccgagtgctcctccacaggctcgcattcaaagaatgaaacgtctacagtagcttctgttggaccatacaagttaattagttttgcgcttccaatccctgacataattcgatagaaacgcgccacctgctgaggaggcaatgcttcgccgctggcaaatacatgctttagcgttttcaatttggcttgcacgacttcccttggttgctgctccagatattccagaaaaatatgcagcatcgcgggtacaaaatgaagggtgcttaccttgtcttcattaatcgtgttcaggatctgttcgggagacttttctccgccgattggcaacaagcttactttagagcccaccatcgaccaccagaacaactcccatacggatacgtcaaaagtaaaggcagttttttgcaaaatcgtatcttctacgttcagcccatatctattgtgcatccagcagagccgattcacgacggagcggtgctcaacaataacccctttcggtttccctgtggaaccggaagtatagatgatataggccgcatggtttggttctgctagaggcgcaaggttggaggcatcttcatgccagctactcatgcagtcggtcataggctccgtcgacctggacgcttgcaaagccatgatcgtggaagcataatccagcaccattaccttgcagtccgcatattgcttcagctgttctgcaaactgtggttgtgtcagcaccagttgtgttcttgaatcttcaagcatatattgaattctttcttgtgggtatcccgggtcaattggtacataagctccacccgcttttagaattgcatagataccaatcatcatctcaggtgaacgctgagcgataatccccaccggctgatccggtcccactccttccgcccgcagcgttcgcgctaaacgattcgccagctcattcaactcttggtaagtcatacacttatctccaaatatgattgccatgtcatctggagtcctgctaacctgctgctcaaaccttccatgaatcgttgcatcccgcggaaaataggcagaggtgttgttgaactcatatagtaatatgtgcttatcttcttctgtcagcatatccatgtcagccaagcgaattccgacatcttgagttgcgatttccaacacttttatataatggagggcaaatcgctcaatcgtctccaacttaaacaggctggtcgaatactcccaggtgaaagttaaatggtcttgagtttccgttacatgtaatgaaagatcgaacttcgatacacctgcattaaactcattcggttgcaaacgaagtccctcgaattcaatgacctctgttcccttattttgcagactgaacatcgtatcaaagatgggattgcggcttacatcgcgtactcgatccagttggtcgaccagttgttcaaatggatattcctggtgctccaacgcaagcagagtgttatgtttgacgtcctccaggaaagcactgaatggctgggacgctagcggtcgattacggagaactaaagtattcacaaacatgccgatcatcgcttccgtatccgcatgccctctacccgctgccggcgtacctacgaggatgtcctcttgcccggagtatttgcttaacagcacattataagctgccaaaagcaccataaagagcgttgctcccgtgtctcttgccaattgattaagtctatccgttagcttggattgcacaatgacggtaaggctgtcccctgcgaagctctgacttggcggacgagcaaagtcagttggcaggtccaatacagggagctcgccgtccaacgtgtctaaccaaaatgcttcatcctttgcttggctgtctccggcataatgttgtttttgccaaacgacatagtctttgtagtgcacgtcaatgggggcaagtggcataccctgataccgcgtgctgatctcatccattaatactgccattgagaagccgtctgaaatgatatggtgcatatcgatcagcaacataaactggttacgatggattgcgaacagttcagcacgaattaaaggagccttactcaggtcaaaaggctgaataaacagttcatgggcgtgactagcatcctcttcggaaattggagtaacaggaatgttcagtgaaagcacatcctttaccttctgcacggtttccccgtctactaactcaaaatacgtccgaaaggattcatgccgtgaaaaaacctccttcactgcatcaatgaacctggaaacgtctaatcctccctctatatgcagttgacccgatacatgatacgctgcacctccacccagttgatccagcacatacattcttttttgagcgggagatagcggataaaagggctgtaaatctgccggaacaagcggctcaaactttcgcttttgtcctccttttacatgtgccgccagttgtgcaatcgtttgcaaatgtaaaatttgtaccagcggaatatatacttcgaattccttgttaattctgcttagaataacagtcgcttttaaggagtctccacccatttgaaaaaaattatcgttgtatccgatattagatacattcaaaacttccttacatatggatatcagtttgtcctcaatcatattaccgtcagaaacctgcttctgcgagtcctctatcctgatatcttctggtttcggtaatgattgaaaatccggcttcccatcagccaaaagagggatgctatccattaaaacccaaaagcgaggttgcccataatcaggaagtattgagcttacactctctttcagcttcgctatatcccacgaattagaattattgtccactatataagccactagatacgatgagttactgctctcgccgtctttccgtgccgtcaaaacacaggcatccaaatcgagtgctcgcaaaagacgtttctctatctgctcaagattcacttgatgcccgcgaataagaacatctcggttaactgcaccaatatgtcgaattctccctccaacctcaacataagcccattccagcgtcgttcccagtaaaccagcggatgtggccaaatatacttgtccgatggtacccgtaggagacggatgtttatatttatccaagacacaaggataattccctttagaatccgagtgtgtcgcccacacttccagaagccgctccctttgcgtacttcgaagcaaagacagcgcagatacacgcattccgtcttcctgcacaatcgagctcagcagatgtaaaaagtattgcgcccatacctctatagtgtcttgttgaaaaagactcgcagcatagtcaaaatcaagccgcaattgctgaccagactccgtaacattcaggaacaactcatactgacaggacaatatttcatgttccaacaattctgtttccagtccgtaatagtgaaactccggaatgggcctgtccatattgaacaacaccttaagaatgggcaaatggcttaatcctagctgggcaagtccggcaaagctgtatttctgataagcatccagcgtatgcattactcgcttgaccgtctgcgtgaattccgtgaacgttgctccagagtctacctcacaaatcactggaagtaagttaacgcagtggccaattagcggggacacacccatatgagattgccctgcggttggaatacctactattatttgatgttggcctgtcagtctgtgcaagaaaagctgaaaagcagacaataaagtcacaaacaagctgtttccaagccgaatactgactgatttcagttgcttcaccagaaacgcatccaccacaatggtgtgccgtgctccgcgcgaagaaggagagctgatgttgcgttggagagacggcaagtcaagaactggcaatggcttcgcaagtacatccgaccaaaaagcaagggcagctgctccacctgcctctaactggttttgctgccatgctgcgaaaagtcggaacggaacaggatcgggaagcgtgcagcgttcgccctgtacacaagcggaataaagttgttccagttcatggaaaaacacaccgatggaccagccatctgcaatcagatgatgaaatgtaaatgcagcgatgtgcttctcattcgacgtttttaaaagctggatacggaataaaggttcccccgcacttattgggaatacggtctccctgtccttctccatccaagcacggatatcgtgtttctgctcctctccagaaagactgctgatatcatgtagcggaatgctgacagtcattgcccgggcgatgatctgcgtttctccgtcctcccccataaaggtgcgtaaggcttcgtggcgctcaacgatgtgatggacagcctcattaaattccttaacatgtaacgggccccggaaacgcagtaaaacagtctcatgaagcgaccccgatccctttgaatccgagactgaggcgaaccataattgcttctgatccggagtcagcttaatcgtcgattccttaaggtctgcagttgcagtttcaggaaaaaaagccttgtttagatcgctttcatgagggtgtggatccggcagaaatcctcctttgcgcagctcattaacgctctctttaattgcctgtacaatccgcactatatcttccgaagtatgagccgttgacaaaaaacagttccggccttcccatatataaattcctttatccagcatgtgatagaagaatagttccaagtcacctttaaggacgaagcggaacaaggaaccgaagtaaacgacctttataggtatctgttcctccgtaaaatagtggttcagttctgctgcgagcgccttcgtacggctattcagctcgttatgcagttgccccctgtccttctccaaccgctctagtacggccagcgaagctgccatagccaaggggtgatggcaaaaagttcctgctacaaacgttcgctgttgctcatgcggtggataagagtcatctccgaagctccacattcctccatcaattccatccatgaacgatgctttccctgccacgataccgatcggaagaccgccgccaatgattttaccgtaagttacaaggtcggcttcaatgccgtaccacgcctgcgcaccccccggctgaatacggaagcccgtaattacctcatcaaaaatgaacgcggtcccggattgctccgtaatctggcgtacttccttcagaaaagctgcgggatggaaatcagggcggcgactctgcactggctctatgagaacagcagccagtgcatgggcatgggagcggatatattggagtgactcgtccgttccatagctgagcacaacgacatcgtccaccatgtgctgtagtacaccaggtgccagaggagtggaatgttgttccctgtcatccgttgctccccccaatgccaatattccatcaaaggtaccgtgataggaaccagaaaaaatcaccactttatcccgcccggtggcagcccgtgctaaccgaagagcgaccataatcgcctctgtccccgagttatatagcgcaattcgttccatgcctgtcattttgcaaattttttcagcaatctgcccggccatattagacatcggtccaaggcacatcccgttatgtatttcctttactatcgattcacgaataaaggatgggttgtgaccaaacaaattgaccccaaaccccatcgtcaaatcaatatattcattaccatccaaatcccaaattttagaaccctctgcacgttgggatataatctgatacaccatttccttgagagcaagcctaaatccggccacattccggttattggcgtatacagatctgtattgctgagtatattctttggtttttcgtgtgcgcatcgtgtaatgttcaatcagcttttgcagatgcttttcctgcctaagtgaaagtgaattatgggtttgtacatttattttttgatagggaacaaatgctttcgttttttttctgtctggcaaaacagctgacatggaagcttgtacgggggaaacagaagtaactgtagcagctacctccttcatcgcggatgtctgaggctcgacagcagtttgtagtgaatgcgattcaggcattgccactggtgcaagccgagattgacacagtatttccatctgctgcgacatgagttgaagttgcatttctaaaattcgttctctccccgcaaatatatccttatttgatagcttgctttcatgggatgcaggatcttctatagggatagtggatttttgactccagtccggcaagacggaaggcaccgaagaggtgacactggacgacgcagtcaactgaagctcctccgaattccgggtcaattcttcagaggtcgaggttaccctatcagcaatatagtttgtcagcaactccagcgtagtcagtgattcaaaaaactcgttcatcgggatatccaagccaaacgtacttttaatgctgtgtctaacctgagatagaagaatagagtctaaacccagttctaaaaaatgtttttgcggctctaattcgtctggactgagttgggatacactttcgattatttttgacagtttattagcaatcgtagatttttgcggattggaagcagattccgtcgagaaatactcattcaccatcttttcagactcctttactatgggggattcaaggaataattttatctttttcagctgtgacgctagcctaaaaagtacgatacaacctagctaggggtagagatagagttctctcataggaaggtaaatatgaacggtccactgtataagaaaaccatcttcatactaataaaatataattatccatctgttaaagcgaggatctaatttgttttattaaaccattaatggctaaattcttttattcaacttattatgcaggatatagtttttttccagtaatgattcttaaaaactcaaatcttttcttttacccgctgacatgcgtcctcataaactttaaaattcacgacactcaaagctcaaattaaagactcaaaggctttaatatggttgctctgccctttacgagcgattacaaccacttgcaaaatatgacctttgttgtcgattcagcgcagcctcacagcccaattgcgattttcttccactggcttttttataattggtacccgcactactaaaaatgccaagtcctaagaatagaacctgacattttatcaaatttggagcgtaaagacgccgaggtgcactttacttaatttttcggcaaaataatacgggattggccaattcacttaacgtctcacattaatataagttcgcatgttaagaagtcacttcgtttcttgacattaagcgaaccagaactgcctttgatccggggttagtggaatgaccgtttcatccacatccactgtcgatacttctgaagggtcagctatatacacacttcgcttacctggacctgggcctttcccgatcggggtcagatcaggcaagaagccccctttacgcagctcatctacactgtccttgacagcttgtatgatccgcgcaatatcttcctccgtatgagcggtcgacaagaagcaattccgcccttcccagatgtaaatacccttttccagcatgtgatagaagaaaagctccagatcacccttgagtacgaagcgaaatagtgaaccaaagtgaacaatcttcatgggtatctgctcatgggtaaagtaactatttaactctgctgccaacgccgaagtacggctgttcaactgattttgcagctgttcgccgtggttttccaaataattcaacactgctagggatgccgccatcgccagcgggtgatgacagaacgtaccagctacaaaggttcgccgatgctcattctgaggataggaattatctccgaagctccaggtgcctccgtcaatcccatccataaaggcggctttccctgctacgataccgatcggcatccctccgccaataactttaccgtaggtcacaaggtcagcttgtacatcaaaccacgcttgagcgcctcccggttgaattcggaagcctgtaatcacttcatcaaaaataaaagctgtaccggattgctccgtgaattggcgaacctcctgcaaaaagactttcggctgaaaatcgggacgacggctttgcactggttccacaagcacagcagccagctcatgcccatgtgtgcgtatataatccagcgattcatccgttccatagttaagtacaacgatatcgtccaccatgtgctgcaaaatgccaggcgcaagaggtgtggaatgctccttattgttgccagcgctacccaacgcaagcaccccatcgaatgtaccgtgataggagccggcaaaaatggctactttggctcgcccggtggcagcacgcgccaaacgaagagcaaccataaccgcctcagtgccggaattgtacaaagcgatcctttctacaccggtcagcttgcaaatcttctcggcgacttgtcctgccatgttggacataggtccgacacacatgccgttctttagctctgcctcaattttttcacggataaaggctggattgtgtccaaacagattaacaccaaagcccatggtcaaatctacatattcattcccatccaaatcccaaattttggacccgtctgcacgttgagatacaatttgatagaccatttcctttaaaataggccggaagccagctacattacggttattcgcgtagacagaccgatactgctgagtgtactgcttggtgcttcgcgtccgagcagtaaagcgctcaatcagctcttgcagatgttgttcttgtcggtgtgaaagcaattcatgggctttgacctccagctttttataaggcgtaaacagttttgcttcatggcctgtcttcttcggaacagctagtaccggtgaaacagtagctaatgcagttgcgacttcctgtttggtttcaatgatctctgcgcttcctctatttgctgacgacaaatccctttccggttgaaatgattgagaaacggatgtcggaggagtcggttgagttcggagcacatcaagctgctgtgacatcacgtgcagctgctgctgcaaaatctgctcgataccagcagaagtcgctataactgttgtgctttgaaatggctcttgcccggacgtaactattccatgagtcgatgtaccaatttcgctggaatcctgccctgtccaggttgatactgtagtagcatctacccgattaaggggtattttcggttggctttcaggagcaccaactgctgcctcgtcagaaacggaaatactcacctgttctgcgacgtagctagtcaacagttcgagcgtggttagcgattcaaaaaattcattcattgggacatccaggtcgaatgtatccttgatgctgtggcggacctgggacaaattaatggagtccagccctagttctagaaaatgtgtttgcggttccagttcctcaagactaagttgtgacacattaccgatcattttcgctaatttttgttgaatggaagatttatgctgttcagtaaacgacactgacgtcgaatactcattccccataatttcagactcccttactatagtatttttataaacaggtgcagtctgctccgctcgaacctgttctggaacatgaatccagcacctcttcctttcaaacggatacgtaggcagcgaaatccttttgtacgggtgatctacgtatagcgtgtcccaatctatttgtgccccctgaacgtacttcactgctacttgctccagtgcttgcaaagtgtccgagcttccgacggctgtttctgtaccaccactactatctactttcccaatgtatacaccttcaatggccttgccctgctcatgaagctgatgtaatttcgctttcagggccttcgctccttcggctaacacagccactcgatatgttaagtgacttctgcctgtgttagctgtatagcagacatcctccatcggcaattcttcctcacgttcaaagcgatccacgtaccgtgcaatcaactcgcttaaagctccttcagttcgcgccgatagtgtcagcagcaatggcgatgatccattttttcggtcggtggtttcttggtccgcaccctttttcgctatatattcttccagcaccacgtgacagtttgtcccgctgaagccaaaggaactcaccccgcatcttctcgggaatccgtctgtcttccattccctcagtctagtgttggcatacaccggagattcttcaaaatggatgttccggttgggtgtgcgaaaatgaacgagcggtgcaatctgctgatgtttcattgacagcacgcatttgatcaatcccgcaatcccagcagcttcgtataaatgcccaatattcgttttgaccgtgcttatcgccacaaactgcttgcgctgtgtaaatttgcggaatgcctgggtaatgcccttaatctcaacgggatcgcctagcttggtgccggtaccgtgagcttcaatataactcactgtctcgggatcaatccgtgcatcacgccacgcctgcgaaatgacttctgattgagccagcgcattgggcgcggaaattccaatcgtactgccgtcctgattaatcgcgcttcctttgatcacacccagaatgtgatctccgtctttttccgcttgacgaagcggctttaagagaacggctccaacgccttcgccccagcctgtgccgtccgactgatcgtcgaatgctcgtgcccggtcatcggaggattccatgccaatgccagctttcaacggtagcaaaatggtcttcactccaccggccaaagccatctcgcagtctccattcaaaatcgacttacacgccagatgtaccgccacgagtgatgaggagcatgccgtatcaatggtcagtgccgggccttttaaatcaagcaaatacgcaatccgactggagataacggacggaagattgcctatgccaaagtttggaagcgcccctggctccacttcggacaacaatcgttcatattcaaagctggttttggagaatccgacatacactcctacctttttccccgacagctgttttcctccatagcctgcatcctcaatcgtgctccaagcagtttgcagaaataaacgttgattcgggtccatcagagaagcttcccgtggagttagcttgaagaaggtgtagtcaaatttgtccacttcatccagatagccaccttcggcgatttgcatgtttctcccttccatattcagacgggaaataaaagcttcggcatccttttttctttcgtcgctatatggactgatatggtctgtaccggaagctacatttgcccaaaactgctccagtgtatccgcatgaggaaacttgccggacatgccaatgatagcaatatccaggtcctctacctcctctttggattccagttgtggtgctgtaatcaccttatgacctaaatcctggctggatatataaccagctagcttggcgatagtcggataagagaaaaagtccgttacctcaatatgaatcccgagctgttcctctaattggtccacgatctgaacgagttgtaaggaagttacgccgatatcaaagtagctgtcttccgtcccaattgactgtacatttaaaatagcttggcaaatcccaatcagtttttgctcgatctcaccttgaggcacaggggcatggttcgcttcctgtatatttcgagcggcctcggtcagggatgccaaaactacatcaaattctccctgctcgtagctctgagccagcttgtagcgctgaacctttccactagtagttttgggaatacggcggattggaactacatcttgaatatgccatcctccccgataattcaaatggcttttcagcctttggactagtggcaaaaataactctatttttttcgtgtgcatcacaaaaacaacaatacgatcctgtcgagtttgtgcatcatgtacaccgcagacagctactttccccagatccaccccgtccagttcctctgcaatcctttcgatatcatgcggataaatgttctgaccgttcacgaaaataatgtccttggctctgcctgtaatcaccagtcgtccgtttctcataaaacccaaatctccggtaatgagccagccatcctctgtcttgacctttgcggtagcctcaggattgttatagtacccggcagtcacatttttgccgcgaatttgggtgtatccgattacattgtcctttagcacctgattttgctcatcacaaatacgaacggaggtgctggccatggggtagcccaaatccgcaaacgtaagacaacgcttatcggatgaatctacttcttctataggttcacctacatgcagctgctgccgatttaaatgaatagtaacaaaattatctttatccaaaggtggagtggagacacctacgctggcctctgccaagccgtatacaggatacatgatatttttatttaatccatgtacactcatggcttccataaatacatggcaaagctccaccgatatgggctcagccccatttaaaatcatacgaacacttgacaaatcccagttatccgctgttttggatttatattgatcaaggaaaaatttatagccgaagttaggagaacagatttgagtcaccttatgctccgacaccttttttagccataatgaaggacgtcttataaaaagagctgttggcataatgagttgcttggcatgggcgatgacacaagttaaatgaaaagcgatcaaccccaaatcatgtgtaagtggcatccagcccagatacgcatcacttgaagtcattcccgtttgactggcgatatcccgaatattgtatacgagattctcatgcgtcagcatgactcccttaggatcacctgtcgaaccagaggaaaattgaataaacgccaaatcttccggtctggattcatgtatggtccctttgttctgatcggaataatcaaaatcatgactagaaaaggtcgctttttttacagaatcaaagaaatccagcatctcatgctggtgagaatacttttctagctgctctagtactttatgatccgcaatcatgtaagggcaagtaagggtactccagattttaaacagcttcattttatgttcatcattatttccgatacttacaggtacggggacaattcctccgagcagacagccccaaaacacatttacaaaggtatgattgtcttcaatttgcataattagcttattgccaggctgtactcctttttcctgcaattgatgaagtacctgcagtgcttgctccagaagttgactgtagcttacatactcctcctgtgtatcacccgaaatgaaaataatcccattttcagctctactggctcggtcctgaatgatttcaattaaagtttgaaactgctccatcctgatccctcctcaaaaggtctaaaacttccttctgctctcctgcagatacttgtttggtttgcaatatcaggcgaatacactccagcgcttcgcgtcttagttcataagcagaagaagagttgcccgattctatgcttttgagtaactcttccaacctgcgaataggtaaaataacccctttatgatactcatcctcattccaattggcattgggtgtagacaccgccaccgccagcggtttgaccaaccaatcacggatcgaaaaacgacgttccagttcaatccgatccaagcctctgtccaaggaaagcacctcaaaagcgatgtttgtttccttagccaagtttttcagtaccgttcgcggtcctaattcaattccctgcttcaccccatgtttctccatatactgcatcgtttgtatccaccgcaccggatgaatcatttgcaaatgcaaaccttgacgaatactgttggcatccgtatatggcagtgctgtaacattagaaatgacaggccacagcggttcatgaaatgtatatttttgcaactccaatgctaatcggtcagcagcatgctgcataagcgggctgtgaaaagggccgcttacctgcaaacgggtaatttggaaccctcgttgctctaattgttccgccaccgcagcaacagaggcatgatgaccagaaacgacgtattgatagaaggagttataacaagcgatagtaataggctgactggttacggcatagtgatcgcacagctcttctagcagatttaaatcagccccacgaacagcaaccatgcaacccactccggcctctgaggcttcttccataaagcgtcctcgttcttgcaccacccgcaaagcatcgccaaacgacaagactccgctgcttaccaatgcagagtactcacccaaactatgtcctgccgaaaattcaggaataatcccaacatcgtgcatgtaacgtctgaatgcgattacactggtcgtaagaagtgcaggctgggtgtaggatgttctcgataattgggagatgggtcctttcatacataaagttttcaaatcataccccaaaatatcagcagcctcttcaaaaatgtgacctgcctctgaaaaaccgtcatgccatgccgctcccatcccgacatactgagatccttgtcccgaaaaaagcaaagtcatgcgattcatgtccaacccctttcctcaccataaaaaagcggtaaaacaaatgttttatgggattcagatgttcacattcctatgtatttaagatagatacagcaaaaacaacaaaatgtcttgccacaaacaaacagtaataaacatgttaaagtaaatcgtttttgagtttcatgatgtagttagaaataaaaagtgtgtaagtagacttggaagtgtaaaaaaatggagtgtgcttgaagttcagacttgatacttagaaacttcagcatcatagatgagtgtaagacatagattaaggctattaatttattataaacattaaagtgaattaaagtacagtgatatatactacatatattttataaaacaaaagaataccctcttttgtttaaaaaaaggaattgttttcagctttttaatgaatttacatgaaaatttcatattctaaactattgactggcatctatcgttaaaacaaaaaagccgccaatttggtcatacccctgtcaagt

SEQ ID NO: 2649 - DNA, 18032 bp, Unknown
  Kingdom: Bacteria, Phylum: Firmicutes, Class: Bacilli, Order: Bacillales, Family: Paenibacillaceae, Genus: Paenibacillus
acaaacgggggtcagtcccaaatgatggccaggtcttttttcgtggagccgtctcaaaaacctacacattggggctaggctgctgaaggctgctttctgatgatcgctgttttgttttatattcttctccccaatccttcatcaggttaataatcgggatcagcgtttttccaaattcagttagagagtattcgaccttaggaggaacctgttggtagacttcacggtgaacgactccgtcctcttccagctcgcgcaattggagtgtcagcatacgctgagtaattcccggacagatccgccgaaaatcactaaatcgcttagtcccatacataagatgatatagaataatccctttccatttgcccccaatcacgtccagcgtgaactcaactggacacgcctgatcatttccagcggtacattccccaaagccgcctttccgattgcgcataggcttttctcctccttggtatcattttatatactacagcacattaatgtgcgtacttcaaaaacgatcatgtatattctaatattaagcatgtcacttggtaagcgtcaattttaatcacatcataaggagtggaataacgatggaaaccttaactactactaaagatcaaatcttatctgcatacgagttcagacatgcaacgaaggaatttaatagtcataagaaaattagcgattccgattttgattttattcttgaaaccggtcgtttatctccaagctcatttggctttgaaccttggaaatttgttatcgttcagagtaaagcaatgcgtgagaagctgctgccttattcttggggggcgcaaaaacaactgccaacagccagccattttgtactcatcctctctagacttccagaagatatggtagcctcctccgattatatcaagagtatgatggagaacgtgcagcaattacccgctgaagtgattcaaggcagagaaaaagtgtatgacgcctttctaaaatctgattttgggctggaggaaaataaaagagccttgttcgagtggggctgccgacaaacctacatcgcactgggtaacatgatgactgccgcagctcaaatcggcattgattcctgtcctatcgaaggttttaataaacaggaaattgaacgcatcctctccgaagaaggcatcatggatgccgagcatttcggtatttcctgtatggtggcatttggataccgtctgaacgagccgcgcggcaaaagccggcgctctgtagatcaggttattgaatgggtgtaaaacctttactctaaaacaaagaggcgtcccacagccatttccatggctatgggcgcccctttttcataaaatctcaagtcttataaaaaatctgtcattcaaaatccttactgatagtttacttcttctgcaaagtaaatctccttcaaacgatcctttacgcgctgaatttcatctgctgttaacggagctgtaggatgcagcttaaagttccttccagtgacatagcttacatccgtgttcttatccagattgtatgccatcttcggaaccggacttcgggtatagtcagtaaagtcaataatggaccatgccgcatctccatcctccttggataaaataatccgctgtgaggcgttttcagtccacaagtaacgcagattggctggtgaattattggagtccataactgccttaaagcctgagcctctaaacatgagcgaaaactccgtatgatcattactcaatccagctaccgattcataaatctgtttcagcccgtccacgcctacaatctcaacctcacggtcaacagggaagtgattcacaaagttctcccatatttgagacatgttatggtttttggcaagccagttgacatccaaaataatggacatgtagtttactgtattcaaacgttgatacgggttatctaaatactgctgcgctatatacagttgtggtgccgcatccgtttcggtcacatatggatcgcccggatggagagtccagcgtgaggaatctttggtataacgtgatccaatcggatcaatcgtaatcgagttcataaatacgataccgctattatttgtaagcccctgtgccggaacaatcggattatccttatgggaccagtaaggcatcaaaggtgaaccctcaccatacatgttgttcacattatactgtgtagccgaccaacccatcgctgaggtgatcttaaagtgatccttaagccattgggcctgctcaggattcaccgtaaagccagttaatgatttaggcagatacttccgatattggtctgtatccatgctttcaaacaccgaaggtgatcctaacgaaccagattggtgcagctcattgagtgcattataacgatacatatacaaccactcgttcatctgtgcttcccattcagggagaccaaacagattattcggatacccatccaaaatcccgacttcatcgccatactgatccacatattccaaaacctttttaagctgcggacgatttgattccacaaaaataaatctattttccatggcccacgtcacttttacgttgggaccaaagtgatccatcagcaattgacgtgactgctcaatttgctctatcgtggtcgtactgcccgcatcttttccctgcagcatcatggagatagcaaaatattgctttttccgtgcccctggtactacagttaactcggcatcggatatgaagtgaattccctgagagggtgactcaacctcaatcttgaatggaatgacagagttcaatgcaggtatcagatgcagattggcaatatgtccatcctcgtcaaatatccctctggaatcctcaatccgaagcttcaagtctgacggcaatagaccggacggtatgacctctccctttgcattttgaaatacatagggcatgctccaggcattagggtctagagtcgccccctgtgaaatggagtacgtcgccaagtatacggacctgattacactcggttcctctaccggaggagtcttccctttcacgatcagcttggtctgtgctttaagcacctgatggggtttagcaatgatgacttccatctctacaggaatgtaatcatcagcagcaggtatattttcggaatgcgcaattttcccacgttcatcaaatacacctaatgtatcactaaatgtgtaagtaacacttgtgacgctaacatcgggaatgcttaccaagtgccctttattgtagagatcaaaggacagctgatacgaaggatacgtttctggttgatttaccaactcgggcgccttgattacgacctcatccactagaaaatccgaagaatggtccggtggttctgacggagtcactggtggcgtcactggtggtttgagcccaggatctggtcgtacaactggcggttccgggttcggctctgtaggtgttaccggagacaccggtggatcgggccttggactgtggcttttaggctcttcgatttccggattcgcacgctggtgactaatttctggcgccaagtcgaccacgatcttctttgcatccggtggactggctggctgattcgtcgttgcagttccatttcctaatgactccagcaaacgcttggcacgttctcttagaccgtcgccacctagccatattcgatacgctaccagtgtagcatcctgccgtctcacagactctttgggatggaaataatggttcgtgtccccctcgatcagctccaaacgttccatcagccatacgctcgtttgtgcatagtctgatacatcagactgatccacaaaactggatttattggaagcacgggtatcttcagtgacaccgaaatacctggcaaaccacactgccatatcctgacgagtcatattgtgttttgcaccgaataactgatcactaattcctttggtaatgttctctgcttgcaaggtctgcacatagggtagagcccatggtgacacatcactaaaaggagcaacgcttttgttaaccgaagttcgctttaacgttttagcgaaaatactcgcccactcctgtcgcgaaataaaatgtacaggtcgaaaactaccatcctgataacccgtcacatacccttgagcagccatggcttcaattgcatcagctgcgtaggaatgttcaatatcgttaaaggccctgtttgcaaaaacaggcacagtatgtatacagaacaaccaaacagccagtatagcagcgatgtattgcctaatttgttttaactttttttcatatttcatatttttttggattcttgcacctcctttacaatatagcatcaggttacttgcacctggacttctgtgtgaattttgaaaattatttcttttgttttcaaacggatttcatttcaattaacaccaaactgtatatacttgaattatcggaataatatccctaggattgaataaagacagcaaaaaaagtaattatagattacggttctatccgtaatattgtcattattttaaaggcatatatcccgatcttttgaaatggttttcattaggaattaaatttccagcattttttcattactaaattttctaatgcgagcatcacaataaaaaagataacatcatgtataaagcaccctacacaatgttatctcttcttttgtttttattggctatctccatcatcagttgattctttgttccccgtacccttaaaaacataataataaccttctgaaatcccatcttgcggataagctgtaggatcttcgctggttacttgacctacaagctcccgattgttaaatgtgtgaggaccttcctctattagcgcctcagcagacatcccactgataagtcttacggtactggaccagaatgtaactaaatatatatcattagcattaaattgaaagcgtccttcactgggtgtcccctcataaaacagctcagacaaagaagccgcttctgaccctctcataaaaatttgaatatcactagttccattccatctatgaggaattccgcctctaggatttatatactctacaacctcaggctcttgatcgcgaagaaaatcagtaactgtaaatttgtacacatcatctgttatactctcggttacaactccagttgttttccccgttttatagccgctgaaatctccatacacatttggggtttggcttaaagctgcaaaaaacctttcctgatccatatattcgactcttccaggtactgcagtcaatctatatgtcttgacctcagtgcccttgtacttatcccaagtatattctgtagctgcataggatactccaccgttccagcccacagatgccaccatgagaatacctatcatcaataataatggccattttttcaacaacataccctcaacctctttctccaaatacactcaaatcattattagcattatagcttttcaataattctattaacagttaaatattagaagaagataaatcaaatattaatacttggacatggaaggtatgagtacatcttcgcattctctcttgtagcttagtctgcagtattgctcacagtagcatcatactggcctgtctcgtattccggttgcagattcacctccactttgcttcttgaagtcaccgcatgcgctctttacctattagcgctacacacagtcggacgcttcttcgcttatccagtatcattttccctcctttttttgtatttatttgaagtcccacggtctaacctttaaaatatataatgtactaggcgttatataggaagggggaacttatctatgttcaagaaaatggatatttaccaaatcctcactttaatatttgctgtagttgttatgatctcttcctttttatcactcgcatacccagacacctacgaggacttatacaaagtctcacaattttttttagcgtttatatttttattttctggaattacagagcttaaggctaaccgtaagagtgtagcaataatcaacttctccattttcgttctcactttttttgtatctatatttacacttgtagtgcgaacaggataaccacacggttctatacctcagtaacaacccttccgtagcccctccctcgtcatataaaagaaaagccgagcgaactcaggatcatctgaattgcgctcggcaaatgttacgtatttagcaatcttttagttttcctctaattcttcaattctctgccgctttcctatgccaaagacaaaatatccaataatgacgatcgccataaatgttgccccgacaatcaacgacaagcgtgtgtctggattaaaccacattccaacgatcaccagcaacaaaaagacaatggtgatataattactgatcggaaaaaaacgagacttaaaggtgtgatccttcatttcgtccttccactttttcctgaatttaaattgactgatggctaatgcaaaccacggtaccatgcctggaagaacactggcgctgtaaatatacagaaacagtttggaatcaggcattaaatagttaaataacacccctaccagcagcaaggaaatggtcgttattatactatttctagggacgccgcttggagaaactttcccaaagaacttaggagcttgtccgttcttagccaatgtatataacattctgcccgcactgtaaataccactgttacaaccagacatcgcagctgtaagtacaacaaagttaatgatacccgcagcagccacaattcctaccttggcaaaagtcagaacaaatgggctgccgatctcgcctatttggttccaaggataaatcgtaacaatgacaaagattgcacccacgtagaaaatcaaaatacgccagatgatgtttttaatggcttttcgcagtgtcatcttcggattttcagcttcacctgccgtaatacctaccatctctatcccttgataagccgctgttacaatgcagagtgcaaatagaaaccctttcaaaccacctgcaaagaaacctccctggctgtacagattggatagccctatcggttgtccaccgttaccgagtccaaagaagatcatccccgtaccaactactagcataaagataatggcgacaattttaatcatcgcaaaccaaaactcaaattccccataaaatttcacagccgccaaattggccaatgcaataataattacacctgccaaagccggcaaccattgcgggatatctgggaaccagtagcccacatataccccaatcgcagtgacttctgccatccctacggtaacccataaaaaccaatagctccaggcggtcaagaaaccggctaaagggctgatatatttatgagcaaatgtagcgaatgagcctgtcaccggttcaagaatcagcatttcccccatgatccgcatgacaaaaaacataataatccccgctaagagatatgccaacagcactgagggacctgcccattttatcgtacttgccgaccccataaacaaaccgacgccaatcgtacctccaagcgcaatcaactcaacgtgccgtggctttagccctctcgttaattgtttcgattccaaaagaacgctccccttcgtatatgttcatcatcaaacgctaatgatccggaaaactgtccccaaacattattaatttttcagactgacgtggtcgtgagtgaacgactacaaagtagttccacgattcgtaaatatacaaggaaaccacgtcctatttaccgtccaaaccttactgtttctaagaccgagtccgtagcattagatgcattgtatgacaaaaaacgcctaaatacaactgctaattagtagacatttttaggcatgaaatggaaaggaaggctattcatattttctgaacaatggtcaatttaatgcaatacattagagtgctaaacatacatatttcttcaatgataaatatcacgatattaagcctatttgaaatctgtattcatacagtggaaaacatgaatcccgaatgaaagagcaacatttcaaacattgccttgtgatataactagtgaatatgtatttatttgagattttttataaaatttttttgatccttggtaaacatatagccacgtcgttcgtagaacctgtgagcctgtatccgacttggatgagataacagtttgatcccggaaaatccatgggacttcccccactgttcaaatttccctaacatttttttctttcacttttaaaatgcctccttttttcatcatacgatgcttgatgttgaatcattaatcctcgcaatcatacccgttaaaacacttcagcatctcgatgaacgcttcaagtttagaatcctcccatgttgaaatacgttgataaaactctttttctttttcttttaaagcttccaaggctttttcacgaccattggctgtcagggatatcaacactccccgacgatcctcaggatgagtttcactttttacataattcaagtgtttaagctgagtaacaagacggctgacagagcttcgatccatagcggtggattccgccaaaaatgtagcgcttgccggaccgtatgacaggagacaacgtacaatcagaaaagctgcaggttgtaatgatggatcgaaaagtgccgcagtttttacattgagtgcatgcgacgcgcttataagtgcattaagttgttcaccaagattcagttctaattgctctcttgtagaatctggatgttgagttttattatccatatgtctccaccttatttgaatgagttcgaatatatatttgacatatatcaatcaaaatacatatacttgatatatatcaatcatattttcaactttggtaagtgtcaagcagaagatctacattataaagcatccacaaccgtaaagcgtagacatgaatatggatgtaattggatcgagaatttggaggatgatctatatgtcgacatacccgattattgtaatcactggtgctactaacggtcttggacaatgggtagcaattgaattagccaaacgtggagcacatctagtcttaacagccagaaatgaaaaacgtgctgaaatgactaaaaatattttaaaagatctggcgccaagtacaaaggtagacttttttttcggggacctgtctcttatgaaagatgtcaaacgtatgggagatgaaattaaagctaattatccaaagattgatgtattagtgaacaatgctggattacatggatttgaacaacgcataacctcagagggtttggcagaaatgatagccgtaaactatcttgccccgtggctgttaacgcatacactactcaattcactcatggaacccgcaaatgctaggatcgtcaatgtggcttctgaagcatcacgcaaccatggtgaattaaaattaccggaggatttaacagatacatctgtatttaccgcaagaggttcatctaagatatacggaaagaccaagcttcttaatatcatgtttacagaagaacttggacgtcagctggatggaactgggatcgtagttaacgcacttaatccaggctttaacgttaccggccttggtcgcgagttaggattttcttcgatacttgcaaaaatattgaacgctttgcatatcggagacccacggaaaggagcggacatcattattcgtttagcaacagaatcccaatatcaagaagtgacaggcggatattttaatgttggtactggtaagccgattgtaccgacatatcctggtggggatatcaagatgcaacgcctactttggagtactacaaccgaattattacggcaaaaaggcgttatggaatgaaataggatctgatatcgaacaatgcttctccaacgaatggttcattttgtaaactaaatctctcttttaaccgataaatacatatgttggttctgtgcttaaatatctcctcccatctttacatattcaagtacaaacgcgtatttttcctaaaagggggctttctatgaactatctagacgagcatatacttagcctcaaagctaaaatggtggatcagaagacagctaataacgataatgtgaaatccatcccagctcaaactcagaaatcggaacaggacggttccaggtttgaagaaacaaagctacttcatattgaaaatgattatctcacgttggagcccattacaatactacacggagagattggtttctacatccccaagtcctttactcctatgccaatggagcaagctataatcaaatatccttcagagcatcgaccaaagatcatttatacctcatctgaggagaccatcaacatcacttttaatcctacagataccgctctggaagcggaagaactgcccgattttgtagagcaaatgggggatattctacggtctgtacaaccgatacgcaactggttaggtaccgaaatggtcaccaactgttccggactttcagttggacagattcgttttgtggtggcggggatcgacggtaatctatacaacgaaatgctgctctttatccacaaaggacgagttgtcataggttcctttagctgtctggaagcagatctcgaagtctggttacctgtagcagaatactgggttcaatccctttctgtccttccaccctccgcctattctacaaatgagaaaggaatgattacaccatgagtctgggatacgatcaaattcaaattcacccttatgaacaaattgatttggaggagcttaccttaacgaaaaaagttaacgagcatactcggctttattttacaggtatcatccccgaagacttacaagacagttatgtggaaacgacagaaaaaaataccatcattgaagtcagccaacaagatgaatctggcgcaagcaagccgctatttagtgggattgccctctcggtcgaggtaaaagtcgtgcgaggtgtgtactatctggaggtggaagccatttcccatacgtaccggatggacatgaagcagcgtactcgttcttttcagtatacgaaaatgacgattcctcaaatgctggagcacataggtaaggactatgaagggctggatgtgatcgacggggctactggcggagaagccatcgggcggcttgccattcagtatcaggagacagactgggcttttttaagacgcatagcctcccgttatcatacgagtctgatgcctgtagctcgttttgacagtcccaaattttattttggtattgaggacagccctgcacaggcgatactggatcatacccgttataccgtacgtaagcagttgctaccttttcgttattttcaggagaatgaacagaccaaactgagtgaacacgattttattttttatgaggtagaaacggatgaggtactcgacttgggcgctcagttgaattttcaggggcataacctgtatgtgatggaagcctacaccgctatgagtcaaggactgctgcggcatcagtatgtgttgggttcttaccagggatttcggcaaaaaagctactaccaggataagctggcaggagcctcattaagcggtattgtgctggacgtacgtcaggatcaagtgcgcattcatctggattgtgatgaacaacaggacaccaaccaagcacactggttcaactattctaccgtgtacagtggcggtggtcataccggttggtacgtcatgccagaaaaaggcgattcagtttccctctatttccccggtagtcgggaagaagacggcgtagcaggtagtgcggtgagacgggcagatcgcaagagtacgcataaccatttttccaatccacaaatgaaaatatggcgtaccccgcatggcaaggaaattcgactgggaccggatgaactggtcgttacaggtaaggacggcgccatttatatcaaactggacgataaagaaggcattcatattgcgagcagcaaacaggtgaatattacggcgggaggcaatctcagcctatctgcggggaagacaatgagcctgtccgcaggtagtcagctccgtatggattgtaatggcagtcatatcgaattaagtgggtcggcagacatgaaaggcagcgaagtgaagtcgaattaaggatgattagaaatggaaaagcaaacagatgtgttagatcagcaacaagcggctcttcatcaggcttggtctttcattcgcaaagaatgggcgttgaaatgtaaatcaaaacaaacacaaagattacagcatatagtagaacattttcgcgccttttgtgagctggttcggcaaaaacaactcacaggtcgtaaaggtcatattggttacatcacctactctatgctgcgtaccacatggcttgaacagaaacccgtttatcttgttgaagctacggatgccttatggatgcttgatgctgagcccgttcagttggagtacgatgcaagttggatttttctctattggactcaattacgtgaacagcttggggctgaaactttgaagcaaccagtctccctttccgaacttgaactggaacagatcatgttggaagcagcgggatatcttcatacgatgatcgttagtctggttcgtcaggctatgaagcaagcagtcgacctaccagagtttgagacgttggatcgtgaagaagcttttgagattcgcgtcggagagtatatggatcatagtgtctccgtgtaccgggaagatcgaagacccatggatgcaaacataataaagtcttggctggaggaaaaagaagaatcggcctacagctaccaaaccctgtctcaagttcaactatcggatggagattacagctccttggattttcgctatacagtctttcgccagatcgggatgcaacaaagtcgattgcatcactgtatcctcgtaggcacggtatggcaagaagctcagctagatggaaccgacttttcgcacagcctgcttcacggagccgatttcagtggctgttccctgcaagaggctgtactggacgaagttataagcaatagcgaatatggatcggatgcttggctggattgggaaccgttaggattggatggagtggattttacaagagcgaatttacagggagctagttttcaacatgcacagcttcaaggagctactttccaagatgccgcgctgcaaagagctttatttaacggcgcggatctaacaggtgcctgctttgtaggagctgatgttactgacgcttcgtttataggtgcatgtttagcaaaagctaattttacaggagcaaaactacaccgggcaaactttacagatgaccaactaagccaagctactggccttgctgttgtagaatcgccactggctacacagataacagatacagtgagtaaaggagagtggatgtcatgaggtatttccgactcatggcggacgagcgcgtaaagcatcgggtggagactgctcccctgtctcccttacaagtggaggataccctttcggatcacaccattcaggcggaggacactcccctgtttttagcagtacatacagatccacgaaccgtatatccggattttctggagttccctttgccgctggtttcagactccatgaaagccctgttggaaaaatacatgccagagctggaatggaaggccgctatacttaccgattttcagaaagccaggcaggatgtgtactggatactgcgtccacctgtggtggactgtctttcctcacaaaccgagtggtatcccgaccataccttaaagcaactggtacttaagtacgggaaaatcgaaccatctatatttcggattgccggcttgttggaagcacatgtctatatcaatctcgcggtagcggaaagtctgctgcgtcgtccatttacaggtgttcgtgtgcaaaaagtggagatggccacaaaggaggaataagccgtatggaagaagcaagtgtgcagcctggaacaggtgcgaaaaaaagctatgtcgtggcaggtgcgattttaagctgtagttacggtacacagcctacgcgtttgaagcgcccttttagtcatggggtgtatgtcaaaaataaagcacagatgaatattggagattatgtacctggagtgaacataaaatcttttggaaattgctccagtccgctgaatccggctgtgcaagccagtgaaatggtcgatatttatggggttaaaaaggctccatgtattcctgtccttacgatgccttggttgaacggaaaaagcgacatgcgcatcgaaggccagcctgctcttacgcagaactgtacgcatcaatgtctttattgcggacacatacagatcgaaaatgacggtcaggagctggattaatcagttgcaacctacccctataaaaacaaaatgcgctggtgagagaatggccatcttctccaccaacgcatgatatagattatcttcaaatcgttcgctctgcatcaggtaccacaaaaggttcggtaaggacaggtggattcctcaggcaatgtagagtaaatttcctgttcggtagagtaagcataagggttcgaaagaacttcaagaagcttccccatcacacggtagtcttctcgttccaccgcagcttctagtgcttcttcaacccgatggttgcgcggaatgattgcaggattactgctgcgcatcagctgacgcgaggaggcttgtgattcctgctgtctgcccagcctcgcctgccactgctcgtgccactgggtaaattccgcagtgctgaacagaagcgtatcttccagatggttcaaagttagggtacggaaggtattggtgtagtcggcacgatgcttctgcatgatactcagaagctcctcaataagagattcatcctcctgctcttcgttaaagatccccagcttcgcccgcattcctgcaagccaatgatggtgaaacatttttacaaaatctgaaattgcatcctcagccagtgtgacagcctgctccctgttgtcatgcagcagtggcaagagcgtctcagcaaatctcgcgagattccacgcagcaatatgcggctgattggcataagcatagcgtccctgcctgtcgatggaactgaacaccgtctcaggatcataggtatccatgaaggcgcaaggaccataatcaatggtttctccgctaagggtcatattgtcggtgttcatcaccccatgaataaaaccaaccagctgccatttggcaatcagctcggcttgacgcttaatcacttcctgaagcagtgaaaggtaacggttttcgtcattggcaacttccgggtagtgtctttccaaggtataatcagccagaacacggagatcttgggacgtgccccatgctgagacgtattgaaaggttccgacgcgaagatgactgccagccacacgggtcagaatggctccgggctgctcggtttcccggatgatcgactcacccgtggataccaccgccaagctgcgggtggtagcaatatccagcgcatgcatcgcctcactgatgatgtattcgcgaagcatcggaccaagtgccgcacggccgtcaccaccacgggaatatggcgttctgcctgagcccttgagctgaatatcaacccgttcacccaagggagtgatctgttcgccaagcagcagagcacgcccgtctcctaacatgttaaaatgcccgaattgatgccctgcgtaagcttgagcaagaggtacggctccttctggaacctggtttccagccagctccgctacgccatcattcctttgcagcgctgtaccgttcaaccccagtgatgctgccaacggatgattaagaatgatcagcttgggtgagcggacaggagtcaggttgagctttgtaaacaatgattccggcaaacgagaataactgttgtcgaagttccaccctttttgatctgctatttcttttttctccgtcatagtgtctccttttctgctgcggtatcttaggttttcccattttagtttttacttctgcccatttattatccaattatgaaacatcgaacatgctttttttattataatcgattatcaaacattaattgtatttgaataccgaacgggtcttcaataataccgtaggcttggctaaacacattatttgataaaggcacaataattttcactcgatcatccgtaatcaagctattataaaaatgtttaatttcttctaggtcagcactttgaatacataatgaagtattattccctactgtatattcttcactgggattcattgtatcttctgctatcattacctttgtttttccgattgctaagactgaatgagaaatataatttttattttcatcagtaagctgtatggagctgtcacgttgggccatgtcttgataggtaacaagaaacaattcctctgcgttgaaatgttttttgtaaaaatgtatagcttcttttgcctttccgttcatggataagaaaatagctacttctaatgttgtactcatggtatcaatctccttttatatgtgtagatatcttatgaatttgatctattcccttgaacttattatcatataaaaaggtatcaaaatatgacacctttataaggagatttagatgaagaaatcagaaagattaaatgacatgatcagatacttaaacagtcgagagttttttaatttaaatgacctaatggataaataccatatctcaaaaagtacagctctacgtgatattagttcattggaacaattaggtatgcctattttttcggaacatggcagacatggacgatatggtatcctaaaaaatagattgttatcccccattatttttacgatggatgaagtgtatgctctgtactttgcaatgttaacgttagaagcttatcaatccacaccctttcacttaagtgttaatcaactgaatgaaaagtttgaacactgtctttctaaaatacaaataaaccagattcataaaatgaaaaaggttctacaatttgaaatatatcagcataatcatgttagtcgctatttagataaaattctaacaagcattcttaatgagagtacgtgtaaagttaaatatgtaaaaaataatcagaacaaaagttactatgttcaatttttcaaaatttccgctaagtttggccaatggtatgctactggaatagagttacatacgaataaatatagagttttcagatgtgatcgaatcacctttgtagaagaagaggagaacaattctcgcttttctatagatgaactccttaatcgttcattagaaatgtatcaatctgagaagagcattgactttgaagtagagattgtagaacaagccaaggatattttttataaagaacattatccttcaatgaaaatagaaaatagtgataagacagtcattaagggattttataatcctggagaagaggagtttatcgctcattattttatgagatatggtcattatgtacgatcagtgaagccagaatctttaaaaaggattattaaagatagagttgagcacctcttaaaccactatcaaaaattataagatcatcgaaggtttgttcaaaattttctctacattttagcaaggaaaagaaggctcacgttccttttccttgctaacgatgacatttgaattatggcttccgtttggcgataacagcataggataccgttcttgtgaatccagttggattccatgcagtaaacacccatctgtcttcggccgcggaataattattgagaagaaacccttgttcatttccagagaaagtccatgcaccgctaatcaaattgtaggcgttaccgttaatcgtagtgcttctaaagctattaggagaaatagtgatcggagcgaaagtgaagcgtgcgaatccatctccaagttgagttacacgaatggcttttttaagattcataatcacgtgacttcttttctttagctttcttcccaactttgcttccgcatttttaattttcattaaggttgcctttctcaaagaaatcatctccttaattgttctacttatagttaatgatggagtagatacttttgaatggacaaaatccccggtaaattggcttgattttctggagatgctaaaacaaaaagcccttccttaaaatggaactgacccccgtttgtg

SEQ ID NO: 2650 - DNA, 26223 bp, Unknown
  Kingdom: Bacteria, Phylum: Firmicutes, Class: Bacilli, Order: Bacillales, Family: Paenibacillaceae, Genus: Paenibacillus
atattatacaacattaacgcagtgtcgtcttaaacaaaatcaacataaaaaagctgtcgagactttctcgacagcctgaggagcctttcggctcctacactaattcaatgctacatattttatttttggcctctttgtgctactttcgggtagcacctcattaacactacatttaacccgatgttacctgcgtggcaaagcaccgcgtcccggcttgtcgatggctgctgcaacatgctgtaataacgtatcagcattacgagtaaggctgattgcctcctgcatgctaccgggaaaaagcagcacagtgcttcgatgcccgtccattttcggggtttgacgcatagcttcgtctctcctgtcacccttaggctatccgcctggctaatcaccaatcgggatgacattatggtccctctgaacagctattttattctactcagatcacgccatgaatgtatagttacaaacgttcggtatccataatcagtgtcactgggccccagttcgtcaatgaaacatccatcatagccccaaagattcccgtttctacctccaggcccttggctcgaagctggctgttgaaaaaatcatacagtttcttcgcttcctcaggtttggccgcccccataaagttaggccttcttcctttacgacagtcaccatacaacgtaaattgggagacagacaaaatggctccaccgacatccagaacgctgtcattcattttaccttcagcatcctcaaatatacgtaatcccgctgttttatccgccaaataaacggcatcggctgctgtatctccctgaccaataccaaccagcagcattaatccggttccaatcttgccgaccaccttttgattcaccgttacctgagcgtctttacagcgctgaataatgatcttcatcgcctatccgatatctcctttaaccttcccttttaaaaggtgctcacagccgtattatggctcttttagcaccccatgggtctttctacccaagatgtgttacaaaggctataaacctatctgtacgcttaataaggttattgcataatccgatgcacagtgtatacatccttcacccgtttgatccgttcgactacagaatgcaaatgatccgtgttgcgaatgagaatcgtgatgtgaatcatcgccattttatttttatctgtacgacctgtaacggccgagaagctagttttgttctcagaaatggcctgaagcacttcattcagcaaaccgttgcgatcatgccctgtaatctcaatatcgacgctgtaattgacttccgctgcttcttcccactctacttcaatcacacgtgcctggtcttcgcccgtacccgaaggaatattcgggcaatccgtccggtgaacggatacgccgcgtccacgtgttacatagccaatgatgtcatctcccggtacgggattacaacatcgtgcaaaacggacgagtaaattatcgacgcctctgacgctgacaccgttggtcggtgtttttttccgttcgccctgcggcttgtactccttgacctcggtcgtcaattcgatcaaccgtgcctcttcttgttccttacgcagcttctctgtcaaacgtgtacagacctgcgctgcggttataccaccaaagccaatcgcagacagcatatcttcggaatcgttaaaagagaacttctgtgccacttcctgaagcttgtcgtcgctcatccacaccgatggctcgatatcacgttttctcagttcacgttccagattttcgcggcctttttcaacattctcctcacgtttttctttcttgaaccattgtttgattttactgcgcgcgtgagaggactgagcaattttgagccagtcctgactaggtccataagaatgcttggacgtcataatttcgacaatatcaccggttttaagccgataatccaaaggtacgattcttccatttaccttagagccaatcgttcgattgccaacttcggtatgaatacggaaagcaaagtccagcggaacggatccggccggcaactcaatgacctctcccttaggagtaaacacaaacacaaggtctgagaaaaagtccattttgagcgattccacaaattccgacgcatccttcgcttcattttgcagctccagaatttctcgaaaaaaggtgattttatcctcaaagttagtgttgtttgctccgttgccttctttataggcccaatgggccgcaatcccgaattcagcggtacggtgcatatccactgtgcgaatttgtacctcggtaggctccccattgggacctactactgtcgtatgaagggactgatacatattggccttaggcatagcgatataatccttaaaccgccccggcatcggcttccacaacgtatggataatccccagtgtggcgtaacagtctttaatgttatccacaataattcgaatcgccagcaaatcatatatttcattgaattgcttgttcttcgtcgtcatttttttaaacacactgtaaatatgtttagggcgtccggacaggtcagcctgaatacccatctcttccagcttttctctgatacgctgtatgacattatcaataaactgctcccgctctgcccgctttttatgcatcaaattagcgatgcgataatactgctgaggattcagatagcgtaaagcaatatcttccatttcccatttaatggccgaaatacccagtcggtttgcaaccggacagaaaatctctaacgtttcataagcaatccgacgctggctttcctctgactgatatttcaaagtacgcatgttatgcagacgatctgctaacttaatgacgatgacacgaatgtcctgcgccatagcaataaacatttttctataattttcgttctgttgttcttccttggaacggaactgaatacgctccagcttcgtcagaccatcgacaagcatcgcacatgtatcgccaaaatgctcgcgaatctgcgccaaagacaccgtcgtatcctccacaacgtcatgtaaaagagcggcgataatggagatggtatccatctgcatattaacgacgatatcagcaaccgcaagcggatgcagaatataaggttcaccggacttacgagtctggccggaatgggcctgctcggcaaaatcataggcgtccctgatgcggataagatctgcttctctggtataggccccggcctttttaagtaattgctctatccccattctgctctattccgtgtcctttctatgcaaaatggaacccgccgatcaatgtcgcgcaaaggttcccttttaaaagtgatttcctacaattatgacggttagcacgtcacacgtcaactattacaggtttggcattgtcgcattattctgtcacacatggtaagtaaaatcaggattgttgacgaaatgaaacgaattatattgaaaaaattacgaaaagtaattaatgtatataagaataattgaaagaactaaggagtgaactgcgttgcaacgcgaaattcaagttaatgaaaagcttccggcaggacctgggttcctgctcagcgtacagcatttgtttgccatgtttggcagcactgtgctggtgccgaatattttcggcgtcgatcccggcatgattttgctaatgaacggtattggcacattgttgtacatatggatctgccgcggcaaaattcccgcctatctcggctccagcttcgcttttatcgctcccgtcagtcttgtgcttaaaaacaatcccggcggcaacggctatgctatggccctcggtgctttcatcgttacaggtattattttctgcctcgtcgcactggtgatcaaatatgccggaacccgttggctggacgtcgtttttcctccagctgttatgggctccatcgtagccttaatcggtctggaactggttccggttgcagcaggtatggcaggcattatcaatgccgatcctactaaggcctggactccagatcccaaaacgattactctttcgctcgttacactcggggtcactgttctgggtgcggtattgtttcgcggctttgccaaaatcattcatattctgatcggtatcgtagtgggctatgtacttgcttattttatgggcatggtcaatacacaagccattgcagacgctccttttttcggacatcctgcaattaccactcccgtttttaatacctctgctatgctgacgattcttcctgttgctctggtcgtcatcgtagagcatattggtcacttgcttgtgactagcaacattgtcgggcgcgaactgtccaaagatcctggtctccatcgctctctgctaggtaacggtatttccaccgtcatttccggttttgtgggttctacacctaatacgacttatggtgaaaatattggtgtcatggcattaactaaagtgtactctgtatgggtcattggcggagcggctgtcattgccatcctattgtccttctcaggcacgttctcagcgattgtttctaatattccagctccagttatgggtggcgtatccttactattattcggtgtcatcgctgcctccggtctaagaatcttcgttgagcaaaaggttgatttcgccaagccaaccaacatgctgcttgcgaccatcgtgcttgttgtcggaatcagcggtactacgctcacttggggcgctgtaaccttgaaaggtatggcattggctacaatcatcggcatcatcctcagcttgttctttaagctgattgacgtgctcggctggtccaacgataaatcgcaggaacctttaaccgagaaaacaccagattgatgtctttttttcaactttaaaacgccgctccatgttagttatgggtcaacacgctcagaatgtatagacaagcgtgtaaagatccatatctcatggagcggcgtttttttatgcacggccttttttctaaagatatcacacacgaaagcgagatacgacctgattaagcgtatcagagacacctgtaagcgtcttgacagagctgtccataccttccagatccttaagctgccgttcggatcgttccgcggcttgccctgtacgtttagctgaagctttcgcaatgtctgcaagatatccaatagaggctgcaacttcctctgaacctgccgacatttcttctgaggcagatgaaacttcctgcacttctatcgccacctgctgaatatcttgattcatcgcaataaaacgttcttccacctcaagtaaaatagatactccttcatccatctccagagcaccctgctgcattccttccaaagctaatttggtttcttcctgcatggatcggattcgactcgtaatttgttccgcagactcgctcacgtttacagccagcttaccgatttctgaagccaccacagcgaaccctcggccatgctcccctgcacgtgcagcttcaatggaagcattcagtgatagcaacttggtctgcccactaatttcctgaatcattccaattatgctgccaatttgggcggaccgctcattcaatgagcttactaccctgcctacctcatccatagacattttcgctttatgcattccttggttgaccacggtcaaccgttcatttccttgttgtgccttatgttcaatctcagtggtagcctcggatacatgctgtatagattcagcaatacgctgtattccaacagccatctcctccattgcagtcgcactctctgctgcggcggccaactgaagctcggccccttccttcaccttagttagttctcctgcattgtgctgtgcatctttagtcgccccagaaatctcttgcgaaatttttatagatacgcctgagataacatctgactcttcgcttaaacgtgatgccattcctctggttgccgcaattaccttattgatcccgtcagccatttggccaaattcatccttacgttgatgtgttagttcaacgctataatctccaagagccatacgattggttatctgcataatttttttaatctctttgatcatacctgaattgttaattaataatgctcccataattagcaagatgcctataacactaacaataagaagaagtttaagcatttcgttcgcagagcgattcaaatcggattctggcagtaatacgccaattttccatccggtttgtgggagtgtttcgtacatcacccggtagtcctcactatcaatgactacggatacttgaccagacgtattattttgtatagtttgtgctgcttccgcattcatcgtttttgttaatgactcgcctgctttcaagaacgggagaccggatgatagaatggctccattcttatctattaagatcgcactgccttgagtaccaaacttcattttttcaatatacgtttggatattcgtcatgtttagatcgcctgtaatgacacctaaaagcttcccctccctgtcataaaatgctttcccagcagtaatcatattgattttcagtctgctatcgtaaaaaggctccgtaaaatttatatcttttccacgttcaatggcttctgtataccaaggctgtgttaagtagtcatattgtggatcatcatattcaatcgtttgcttcactagctggccatctctatgcacatatatagaacggtatgtcactcctggatcatacgcagcattagcaaaatatatccctaacccataggtcatatcatttaatgccagctcttgttcaaaaaaacgtccataaccctcaatgttcattcctgctcccagttgttccgcactcttagtcagcatcgaaacaagtaaagcatgacgatctacgttagctgcaatatctgctttaaccctcgataaggaatgcgcagcattttggcttatttccgtatccagcttttgcttggcaaaaaaatatgacaaaaagctgattaaaatcagcgttataagtacaagcggaaccaaggtagaaaatgtccgtgctcgtaaactcttaaatcgaaataaacccattatgaccacctctgctcctttttaattgtttatcgacatttattctaaattttttataaccatttccaataaaaagagtggtaatttgagccaatcaaacaaagtcacacctaaaacactgcttaaacaaaatagtccgatggagcaactctttagataaagagatgttccatcggactatttaggtgatccgttcataattatttcccgggaaacccggtttcgaaatacttaatacgtaatcagagtgaatacatctacatcaggcagtttcgcccgaccgtttagatcagacagctcgataaggaaagcagcccctgccacattgccaccaagctggcgtaccaagttcacggatgtagcaatagttccacctgtagcaagcaggtcatcagcaatcagaacattttggcctggctctatagcatccttatgcatcgccagtgtatctttaccatactccaaaccgtatgcttcctcaatggtttccccagggagcttgccacttttacggatgggaataaaaccaacaccaagcgcataagccaaaggagcaccaacaacgaacccacgtgcttctggccctgcaatcaaatcaattttcaaatccgataccagttccttcatatcgttgatagccttgcggtacagttcaccatttttcatcagggtcgtaatgtccttaaaactaatccctggttgtggaaaatcggaaatcacccgaatatattctttgtagtccaacttagttcctcctactgtaacttcaaattagtatatacattttacaacataaattgcgaaatagtatctcaagacgcacccttcataagcgacataatccagctcgtcatctgggtagtgtccgcatccagcaaatacttctccatttcagccatattatacaattcctgatagcgtggagaagcggttaaatcccgcttaggcggattggatacaaaacggaattgaccatctgtacgcgtcataaactcaagctcttcgaagatgtccaatactttggataacatgcgtactgaacaggaacactgtcggctaagagcaggcagcattgctttttcatcaataggctgtgtccccattcgagaaagcacaacgtaaatgcgcttgaacagctctctgtcagggcttacgagtcgaccgccacgctcactgaccgaatgaaggagaaatacgttctctacattctcaaaggtagaccataatgcctgaaactgaaccggtgtatccggcggctccagtacgaacagcgactttacagagtgctgtgcatctctttgaccatcactgggaataacgctaccgtctttatcgtataaccataaggattcagcgtccacggagctcgatggacgaagcctggatgacggatgaatcaacaccgcaacgtctttctttctttcctcaatacgtggatgaaaaatcttcagtccccgctctaattcggcaaaagggtccgacactccacgataatcaaaaatttgtggcgcctgcactcgaatgtcctgaatcattagctgaagagaccgtttaccgttccattcgttaattgacaattcacccagcagatctatctctgtttgttgctgtaaaaaatcagccaattcgccacgacggaaggcaatcgcgtccagcgataaaccgttctgctccagcaggagcttcacatgatttttctcacgtcccattttacgagcctcgcgcaattgcagaccctggaatacgaatcgtggagaaggattccccataccaaaaggctgaagcaactccagttcttcaaccacttgtaaagacacctcgtccagacgacagaccatatcggcctcagctacaggaatgagatcttctggtgtcagaatggaacccgcatagcggttcagctgctcttcaaacaatttcagattgtcacgggacagcgtcatacccgcagccgaaggatgaccaccaaaatgctccataagctcatgactgtccgtaagagcactgtagatatccaatgcaggaatagaccgggcagaacctttgcacgtgcctgtctcagcatctataccaagaataatggtcggtcgataatagcgatccaatagcttggatgccacaattccgacaacgccgacattccagccttcaccagccaacacaataactgacggtagcttgcctccattcagtttggaggccaattgttgctcggcatgctccacaatacgttcgaccacctgttgacgctcacgattgagcaggtccagcgcatgcgcaagttggtctgcttcttcctctttttctgtcgtcagcagagaaactgctcgtcccgcatgatccaggcgcccgctggcattaatccgcggagccaatgcaaatgcgatattgactgaagtcactgtagatatatccacgcccgctacatggagcaacgcacgaatacccggaaatgcagagtttctcatggattgaatccctctgcgtaccatcgtccgattttcaccatgtagtggcatcagatcggctaccgtgccgatagcggcgatttcaaaccattcctctggcacctcacccaacagcgcctgagcgagcttcagggcaacaccaacacctgcaagacctttaaatgggtatgggcaaccgggtagcttcggattaatcaaagtatatgcctcgggaagtacagcaggcggctcatgatgatccgtcactataacatctatccccaaggaagttgcataagcaatttgctcgactgcactaattcccgtatctaccgtaatgaccagcgtaactccctgctgatgagcccaatcaagagcatggttatgcagaccatatccctcattagaacgatggggaatataaatatcataagaagccttgagaaaacgcatgagctgaatcatcaatgatgtactggacacgccgtccgcatcataatcgccatagattaatatatgctcgccacgttccagagcctggcgaattctcggtacagcctctttcataccaagaagcaaaaaagggtcgtgtacatcgtccacacttccgtacaaaaagcggtttgcttccccggcggtagtgacgccccggttcactaaaagccgggacaacaatggtgaaatccccagctcttctgtcaacagctgagccgcttctaggttagcctctggggtcttccatctgtactgcgaatgaagcaatcctgttcacctttctttcatagtcatcctgctctattgaagcaacgacgacacatcattatctggcagttcatgattggatttgtaaggatacccggcttgataaggaatgaactgcatttgtacatgggtcacctgtggaaaacgggctaacagtagatttttggctcgatcggcgatttcctgcgcttcctgtaccgtaatccgcgggttcacacttatcgttacatccactgttatgaaatggcccgtttcctgggcatgtaagtgctcaaccgttacaataccatacacccgttgaatcgtctccataaagcggcgggagtcttcctcctgcaagggctgtgcaggaacctggtaagcggtattcattaccatcaaatatcctttgcgaagcaccagacaggctaccagcaaagctgcggttggatcaagatataataatgcaggccattccattgcttcgccagtcattgcaccgatcatgccgatcaatgcaatcaacgatgcatacagcgagtaacgttcatggttagcgtaccgatctgcttccgctttatgaccatgtttaatcgaatagcgatattgaaactgaaataacgcctctctcaacaccaacgcaataaatacggtagttaatgcatacagactgggagcctgcggttccgaactgcttaatgaacgaaccgccgagatagctagctgaagaccactcatcagcactaaaatagccagcactacagatatgaccgtcctaactttttcaccgttccgcaaccgtgccagcattccgtgccctgtagcacccttggaaaacagaagctcctgcaaacgggaagcactatccgcagccgtgtgcagtgcatcccccaacaacgccttgctgtttgccgcataaccgacggttccctttagaacagccagcgcgagattacctacaatcccgctcaacgccgcagtttccaatgatcggctgcgttcgctattcacaacgtttccccctcaatcctgaactaaccttttcccaataaagctccattctaaaataaccgaatttctaaaaccaaaaaccattcacattaagtttccactattgtgccttacttaaggtaaatctcaaaaccttagaaaaccgcgcccaggcagacgcggctttctctttaatttatactactggtatttacgtaacttaagactttgcagttttggccgcgcccccgccagctgtcggagatttttgttttcctttcatagctacccacagcggactggcaatgaaaatggaggaataagcaccaaacaacaaaccaatgaccatcgcaagtgagaacatacggatcgattcgccgccaaatatgaacaaacataaggaggcaataaataccgtaaacacggttgcaagtgaacgagtcattgtctgggcaatactgtgatcaactacctgctctaagtcgtccctagacttcttcttcgcaaatcgtagattttcccgtatacggtcaaaaataacgacagtgtcattaatggagaaaccgacaatcgtcagaattgccgtaataaaggtcaaatccacctcaagccggaaaatcgagaaaatactgatgacgaggaaggcatcatgcaacaacgaaacaattgctgcaacggcaaaccgccattcaaaacggattgagatataaatagcgatagccacagaagccaataaaatcgcccataacgcatttcgttctagttcttgcgccatttccgtatccactgtattgacctcaaaggaggccttcggatccagctctttattaaaagaagtcttaaagttattcacttgctgatccgtcaaaacctgcgagaagcgaataccgaagcgttccttaccctgcgtataatcgacctctttgccgatcccctgcttgttcagcaaagtctggatctgttcttgtgtaactactttagtcagattgacatccacattggaaccggaacggaaatccaccccgtaattcagaccaaatatcgataagctcagaataccaagcagtgtgataataatcgagaacgtgtaaaaccacttgctcatcttaatatatttcaagttccaattaaagcgcactgatatcactctccttcacaccaaaatacttggccttcttcacaacatccgctttaaccagcagattgagtaagaagcgggagaagaagatattcgtcaaaatactggtgacaatatcaacgatgagcaccaaagcgaatcctcgaacggagcctgttcccagaccaaacataaccgctgccgctataattgtcgtaacattggcatccataacggtacggaacgaagccttactacctgcaatgacagaagaacgaatcgttttgcctgacttgatttcttctttaatccgttcatacgtaatgatatttgcatctaccgccatcccaatcccgagcacgaaggctgcaatacccggaagcgtaagcacgaatccacccaaataaaagatggcaagcaccacccaggtatgaacgatgagacagaaactagcgactaatcccggtacacggaacatcgcaatcataaataccagaataatgatcgagccgatcaacccagcacgaatcgtctgatctagtgacaattggcccagcgtagcacctacactctgagaatatttttccgtcagtttgagcggaagggcacccagattaatcgtatcggccagtttattcgcttcatcacgagtgtaactacctgtgattgacgcgctaccgtccgttaattccccacgtactgtaggtgcagacagcaattcctgatcgaggaaaatagccaattctttattcagaagtcgctttgtgatttctgcaaatttagctttatccttcactttgatactaatctcaggttggttcagctgatcatagccgacaacagcgccattctccacaaaatcattaccgcggagctcaattttgctgtattggcctggctttttagcatccgctgccgttgcactgcggaaggtcaactcggcaggctttttgagcatagagcggacttctgcttcattagatacaccagcaagccgcacacgaatacggttgataccctccgttgttacttccggctcagttgtaccaagcgcgtttatccgtctctccagactttgagctgtttgtataagagactggctggttacactctgcccggcttccaaaggctgggcttcatataaaatttcaaagcctccctttaaatcgaggcctaattttaaactgttcagtaggcccgggcttgtcccgatcataacaccagtagttatgagcacgaccacgatgaaacttagaattctcttcattccgtcccatgttcccctttcattctcaatattcctattatagctacccctcaaaaagcagtcaatttgaacgcaaaaaaaagacccccttctattcgaaagtggagccccgtaatgcggacatcgtcaaatagttcataaagctcgtcgctttaagggaaagtatatcattaacgagcttgtgcagcggaggaataccctccttttcatatttatggctgacgcaattccacacgtccttacttgtgacatgctcatagcctacgagaatcaactcgtccgccttactttgacagagcatctcaattgcgtcatcccaatcctgctcattcagctcttccatacccacgatggccgttcctcctcccagcgactaccggttccagatcagcaattagcgggttattgactgctttgtagaacatttctgtcctgatcctggaaaacccttcttttcgttgaaaatagccttaaatcaacaatatatgcattcatttcgctcgtcaatagcagaattcaccactcccccctcttgttgtctaaatcactttgtttctgaacggaaaagcttgtcatgaacatggacaggtccagcatatcttctaaagtaatgcatagacgcagaattacattttggggaagagggagttgcgattgaaaaagcagactttcatccatggagcaatcattttattggcagcgggaattattaaccggatacttggttttattccccgaatcgcactcccgcgtatcatcggccccgaaggagttggcttgtaccaacaggggtatcccttttttatcgttctggtgacgcttattacaggggggattcctcttgcggtagccaagcttgtagccgaagctgaaacggctggacagcccgaaatatcgcggcgtattttgcacaccagcctgcgcttcaccattacactcagtctgatcgccatggtgctctgtcttgtgttcgcgcccttgatcacaagccatctcctgaccgacagtcgcgtgtattatacatttgtgagcatgagcccaatgattgtcattgtagctgtttcttcagcttataggggctattttcagggaaagcaaaatatgatcccttccgccagctcctccattgcggagaccgttatacgcattttttgcgtcatttggtttgcttacttgttacttccccatggggtagactacgctgctgcaggtgccatgctcggtgctctggcgggcgaattcattggcatgattgtactgctatggcaatacgtgtgtaaccagcgaaaagatcgcatccttcagccaaagtcgcctgtcccctcctctgaagttcatcccgagcaatcatccgttttgtcacgtcttatgtctatatccgttcccgttactgctggaaggcttgtcggttccttatcctatttgctcgaatctatcttgtgcatgcgcagccttgccgtagcaggcatcgcaactggcgtggcaaccgcacaatatggagccatgcagggcatggtcattcctgtgttattactacctggggttctaaccagttcgctagcagtttcactcgttccttcgttatccgaagcagcagctaaggggcatattacagccattcacaaacgtctacatcaatcgcttcggctcgctttggttgcaggagccccatttgccgttatcatgtatgtattggcagaacctctgtgtctgctactctacaataatggcgatattgcaggcatgcttaagctcatggcaccttttgctctttttatgtacattcaggccccgcttcaggcagcacttcaggcattagaccgtcctggaagtgccttattaaatacctttatcggagccgttatcaaaattgtactgatcgtctggcttgcttcccaacctcagtatggtatctatggagctgtcatcgccatttgtattaatagtgccattgttactctccttcacggattcagtgtcagcagactgcttcgcttccgcgtacgtttgctcgatttctggaagaccgggataggcatgatcatcatggcagcagcagtattatatacctacagacatctaacgatgttcaaccaaatgtggcttcagtttatttttgccgcaggattgggaattatactgtaccttttcctaatgaccttgatcaaaatgattgattgggacaaccttacacgcattccaatcctgagaagatggtttaaagcataaaaaacctaatctgaagatttcccataggccggtggtgtaatgtacacatcacctctatggttaaccgagcataaaaaaacatccttaaaatctttgtgtcccttcgcttgaatttgatttttaagccaaaaacggttcatatccatccgttccaaatttctatccagcactttgccatccatgattaatggaataggcagtccctcatatctaaactttccaccgatttgtggagaaggatggactttattcacctgttgctctttggttgtcaaatctgttccgtttaattcctgcttcattttttcgtgttccactccatcattatcatccttacctataaccgttagcttacctgtcgtttccaaaataacatattcaacttcgtccagactttctatattttgttcgcgaagttgtaacagcaagtcatctaaattataacgttgttttaccatttcatccttgtttaattgtccattagagtacaatacactgggcctaccatcaaatagtaagcgcaatcgccgacttttcagactgaaaaatgaaatacctatttgcaaaaataacagcactcctaaaggaattaacccttcataaagtggacgttttatatcctccaggctgaatacagcaatttctgcaatcataatggatatgacgagatcgaaaacagacaatttgccgatctcccttttacccatcaagcgcatcaccagatatacaataaaatacatgagcagcgtccgaaaaatatgagcaaaaatatcgtgactcaatatgttcgcctcctcccctgtacttgcaataagacatgagtcgttcattgtacacgtattctgaccgttcctcacttggctcatacaaaaaacaaaaggctaaattattgaaataaagagaaagactgcttgcgacttggtactaagccgggaggcttggccatagaatgataatagttcaaaccttggtacaggaggaattatcaatggagctcattcgccgctggtgttcgtttcgtctggcccatcccattttatccggtttattttatgcttttgcatggatgctgcttggcgcattgattctttcattactcttgtggctgacacagatgcaggaacaggacttatcattgtatacgtacatcgtccatgcattcgccatgctatctggcggcttcgtcgccggtaaaagatccacaaacaaaggctggtatcaaggcggtattacaggcatcctgtatgggctaatcgttcttctggtcggttttctggcattggatgcgggcatgaacggcaaggacctgttacacttaggtttcgcgtttgtcataggcgcaggtggtgggatgtttggcattaatctcaacaagtaatcaaattgtttgtatccatgtaataaaacaacacaaaaaaaccgagcctccttaaaggctcggtttttgcataacggtcaccagcattttacgatttggaaacaacttcctcagatgccgtgtcttttgcaatcgcgttgctgattgcactgcggtcaaaggtcagcttcgtgacatcattcacacgcaaaactactacatcatccgtaatctccataattgtaccgtgaagacctccgattgtaattactttatctccctttttcaaagcttgaagcatcgtttgacgctgcttttgttttttctgattcgggcgaatcagcaagaaatagaagattacaaacatcagagccagtggccagatcatttggaaaagtccgccagttccaccgggtgcagtagcggctgtagcaaaatgaaacatgttaaatccccctttcgtatactctccctaaaacttaaaagcctttatcattatcatgaagaccgtactgctcaaaaaattcatctcggaaatcaagcagcctgtcatccataatcgcttgtctgacattacgcatcaattgtattaagaaatgcaagttatgatacgttgtcagtcggagcccgaaggtttcatccgctttaatcaaatgtcgcaagtaagcacgtgaataattgcgacaggtataacaatcacaagcaggatcgagcgggccaaaatcacttgcatattgggcattgcgaacgacaagacgaccttggctggtcatcgttgtcccgttgcgagcaattcgggttggaagtacacaatcgaacatatccacaccacggatagagccttcaatcaaagcatcaggcgaacccacgcccatcaaataacgtggcttgttggtgggaagcagcggaaccgtataatcgagcacttcatacatcaaatgtttcggttcacctacgctcagtccaccaatagcataccccgggaaatccatggaagtcaaatccgcagcgctttgcttgcgcagatcttcatgcatgcctccctgaacaatggcaaacagaccttgatcatgaggacgcgcgtgtgcctctagacaacgctcagcccaacgggtggtgcgttccagtgactttttcacatactcatattcagccggaaacggcgggcattcatcgaaggccatcataatatctgagccaagcgagttttgaatttccatcgccacttctggtgaaagaaacttcttatcaccatttaaatgagagcgaaaatgaacaccctcctctgaaattttacgcatttcacttaaagaaaacacctggaatccgccgctgtctgttaaaatagggcgatcccaattcataaacttgtgcagtccacccgcttcacgaataatatcgtggccgggacgaagaaacaaatggtacgtgttactcaaaataatttgagcatccatcgctttcagttcctcaggactcatcgttttaacagtcgcttgagttcccaccggcataaaggttggtgtctcaataactccgtgaggtgtgtgtacacgcccaagacgagctcccgattgcttgcaggttttaatatgttcgtatcttattgctggtgccatattttctctaccatccttaattaataaatgaacattgcgtccccgaagctgaagaaccgatattgtcggtcaatcgcctcctggtaagcatgcataatattctccctgcctgccagtgcgctgaccagcataaccaaagtggatttaggcaaatggaaattcgtaatcatcgcatccaccacacggaattcgtagcctggataaataaaaatctgtgtccagccactgctggcctgcagcactccatctgcgaatatattgcccaccgtctccagcgttcgacaactggttgttcccactgccacgattctcccaccgcgcgccttggttgcattaagtacatctgccgtttcctgtgataatgaataatactcttcgtgcatgacatgctcttcaatcgtatccacagacatcggtctgaacgtccctaagccaacatgaagtgtgataaaggcaacggtaacgcccttctttttaatctggtccagcaattcttctgtaaaatgcagccctgccgttggagccgcagccgaaccttcatgtcgagcataaacggtctgataacgctcgcggtcatccagttgttccttgatatacggcggaagcggcatctgccccagacggtccaagatctcctgaaaaataccgtcatatgaaaatgaaagcacccttccgcccatatctccttcttcctcaattactgctttcagctcatcaccgaaaacaataacagcacccttttttagctttttaccgggtttcaccaatgcttcccatcgatccccttgcagttgcttaagcaacaaaacctcagccttagctcccgtgtcttccttgatgccaaacaagcgtgcaggaatcactctcgtatcgtttaataccagcgtatcccctggttggagatactgcacaatatccgaaaacgtatgatgacccacttcaccgttatttttgtttaacgtcagtaatctggaagcgctccgatcaagcaaaggtgtctgtgcaattaatgtttcaggcagttcaaaatcgtagtcgtttacattcatatattggtcagtccttaactatatccacatttttgtaatagtgttgcaaaattttcttgtaatcatacccctgctcggccaaaccgttggcaccccattgggataagcccaaaccatgaccatttcctttacctgtaaaaataaagctttgtgttttgtcaatgactcgtgcatgacgatcttcattcatgacgatcaccccgttaccacttgaagtactgctgccagatgcggacaggatttgagtgccttgtgtaccacttacatgagaagtagccccatcagcgcctaatacagtataacttccggtactcgcaatatcaaacagtgtgctcgggagtccgcccattgctgagcgaaacatatccggatatttcactttcaaaggggttccgttcgcttcaacctccaacactcgccctgatggaccacgtttggtgacatcgaggtgattaatagaggaaggcactgtgcccgttactttcccttgcagggatttagcaagctgagctgacgtaaagggcccacgcacccatgcatagtctccggactgaggcaccttttctaatacaatgatctcttcgcccggctgcgccttagctattggtgtaaccgtcgattgaatttggggaataggacgcacatttgtattttccgcagtgacggtgattttgtctaaccccgcttctgtaacaccctccagttccttagcattatcctcacgaatataccctgtcttgccactggagagaagtacatgataccactcctgtgctcctttttgcgccgaagtatctcccgagctgtctacgctggcaaaggcttcgccaccactgttccacacctcggaagcatctgctgtcacaccgcccgcattagatgaaaatacagcttcgaccactttgccgccacttttaatgacttcaccagctgttgcatctacagcctcattgacattggcatgttccgagctcttaccgttgtaagcctggcttaacgtgccatctactacattgccgatctgaaaccgattgccttgggcaagcgcgtagctacgagccgctaccgcttgagccttgagcgcttcatctggccatgaggaatagacctctgctcctaccacggaatacaaatactgctccagagaaacttcattcacaagcgccagctggcctgacgtcatggcaatctccatctcgccgcgatatgtacgctgtgatctctccatcacttgtattccatcattaccgccgttgacaattaccttgctatgatcagaaccacttagcatgtaatgagacatcacctgcgagccagtcgtgactcctgcttcctgtcttataatgaggccggtttgagtagcattaactttagacagcgtgagtctcggctgcttgctctccagctctgttttcaaagccgacagcttgctgtcattactttcttctccaacccatacagcatactggcctcttgattgaattacagtaaaagcatcaaagcctgccgcagcaattgtcgttcgaacgagattagcttcctgctcgcttccgtagcttcctgtggaccaatgcttgtttcccttaacttcggcctgcgctccggttgcggaggaaatccgctgtacagcagcctgcgcagactgctcactagcatatattcccgcgtacacttgatacactgagctaccattttttgaaccgataaaaaccgtaggtttatcattagtcttttgcagggcttgggccgcttttattgccgctgcttcatttccttcaagtaccttcacccgatagctgtctacactaaaacgagccgtactgtctggtagtcccatccaagtttgaaaactgcccccactgttctgtccaacactcagacctcctgatgatttcaaggttacagcggggactgtcgctttatatttgctacctagatccgcaaaaatcactacacgaatatcctcttgggcgggagcagcgtgaacgcccgaataccaaggtatgcacactgtagctaataccataatcgctgctgctcgtttggcccggcccatccatgcaccgaaaatactttttcggttaaatgcttctccactcatttctggttcccccaatctagctgtctagcacttatattgcataatttatcgagatctcgacccttgtctatccctttaaatacatcggcggaataaaccgaaatatgaatccgctcgaatcttacttacactctcacttccctcaatcatccgtcagccgatatcgtattctccatacttgcgtgtaaccatgcaatgattttttgaaaagtgcatcatgtttcctactcaccgtggatccgttggcattgggattccaaggtggccatatgccgccggagtcactgttcgtccccgaggtgttctttgtaaaagcccaatttgtaacaaatagggctcgtacacatcctcaattgtctgactctcctcaccaatggttgcagcaatggtgtccaatcctacaggcccgccccggaatgaatgaatcatggccttaagcattttatgatcaatttcatccagcccgagtggatctatttgaagtctctttagcgcctctgcagccaactcagaatgaataataccgtctcccgcaacctgggcaaaatcacgcaccctttttaacagtcggttagcaatacgcggggtcccccgtgaacgcaatgcgatttcctccgccgcatccccaacaatctcaatctccataatatccgcattcctggacacgatgtaagccagctcgtctgtcgtataaaactctaatcgactaataacaccaaaccggtcacgcaatggcgcagagagcagcccagcgcgcgtagtagcccctataagggtaaagggtggcaaatccagacggaccgaacgtgcactcgggcctttgccaatcataatgtccagcgcaaaatcctccatcgccggatacataacttcttccaccgtgcgatgaaggcgatgaatctcatcaatgaacaaaacatcaccctcttgaagattggtcagcaatgctgccaaatctcccggtctttcaattgcaggacctgaagtcgtacgcaaattaacccccaactcattggcgataatgttagcaagagttgttttacccaacccaggcggtccgtacaacagtacatggtccaacgcttctttacgcaatttggccgcttcaatatataccttcagattttccttaacctgattttgcccgatatattcatttagataacgggggcgaaggcttagctccgccgtctggtcttccatcatcaaattggcggaaataatccggtcatccatgttccatcgctcctcttttcaccagacatttgttagcggacatcatcgtcctatccggcaaacaacagttgcaaagcccgcttcatcaaaatatcggcagattcatcaggtttcgcatctttcttcattctgctccataccttatccaactcagcatcagtgtaaccgagcgccttgagcgcctcacgggcctcgccccaatatgaaccttcgccttcttctacgacaggctcagcaaacaatccggttgccatccccaacgagccaataccgtccagcttgtctttcaaatccagaatcatacgttgtgcagtctttttaccgatccccggtaacttggtgagaaatgtgatattctcctgataaatcgccgttaccacatgagcaggcgtaccgcctcctaaaataccaagcgcaacacgcggtccaataccagatacatcgatcagtttacggaaaagctgctgctcctcacgggtcgcaaaaccgaacagtaaaatagcatcttcccttacatgatggtgaatgtaaataaccactggaccttcagttttggcgaacgcgtaaggattcggacaaaataccctataccctacaccctgcacatctaaaacaacatattcattttccaaatgggccacagaaccacgcaagaaatctatcattttcgcaatacctcatttaattttgaatttagtccataggagtgcgcatgacaaatagccaccgccaaagcatccgctacatcgtccggtttgggcacagcttgaagctttaggaacattctaaccatttcttgtacctgtttcttctcagccttaccataccctacaatagcctgctttacctgcatcggcgtgtattcacctataggcaaattacgttgttttgcagctagtaccagcaccccacgtgcctgacttacagacatagcggttgtaacgttgcgattaaaaaagagcttttccagtgctaccgcatcaggcttatatttatctattaattgcaacatgccttcatacacatgaagcagcctttcttcttccggtgtatgagcctcagtctggatacagccatactgcacaggaactactttactgccaatcttgtctacaaacccgaagcccacaatggcaatacccggatcaattcctaaaaaacgcaaaaaaatctctcccctatcgctcaaacatggcgtacctaaccaaaagccagcgttatcctgaatataatcatggccaaataccatataaagcgaacatatgtgtcgttcttttcattataacaaaactttgtatctaatagaggaaaaaatttaaacgtgagtaaaaacataaaaagagacgcttcaagcctcaccacatgggcaatgcctaacgtctcgtagttgtaatcaatagtgctgctttaataccctttgtgttcgctccagggcaaagtcactaaaagtggagattacactgttatactcatttatatcctgtacacgtattccctgctgaagttgtttatataccccttctggcaaggccgtctccatggaacccacatccaattgaaaaaaagtgcggataactttttcctttttaggtagcccttcatacaatgtaagctgcccgtcagtgctcaaccccatgtatccatgctctttgcatgactctgacaagtcttccaccctgcgctccagccacacctctcctttggtattaagtcgtcccttccaatcgggatgttgcttcagtaaggtctctagctgctgtgaacttagcgttcccaaggaaagtgtttccgtaccacacacgtaggtggttagcagacgggtcttcctgcttataccggaagcacgaatactttgcaataattgcatctgtgaggagtgatcttcaattggactcagatgtgaagcttcctccatgctctcctctgccatgacggtagtagcgagtggctgtgacaacatagcctgcaaataattcgaaaacagaatacccaaccctgccagcaaacaagccgcaccaaaaatgctacatgcccacactgttcttctccactgtttccagcgccgtttcatctgttttttccaacttaatcgcttcacagtaatcccttccgtcccactttttgtgttagtgtgacctgaggattactgatttatacaaaaagatatgaatataaaaaaagccgctgcttccagcgactttccttttgaatcgggatgacacgatttgaacatgcgaccccctggtcccaaaccaggtgctctaccaagctgagctacatcccgaaatacatgccggtgagaggactcgaacctccacggtttccctcacgattttgagtcgcgcgcgtctgccaattccgccacaccggcttatgaagttaatggcgcgccctgagagattcgaactcccggccttttgattcgtagtcaaacgctctatccagctgagctaagggcgcaaatatggagcggacgacgggaatcgaacccgcgaccctcgccttggcaaggcgatgctctaccgctgagccacgtccgcaatatcattatatccatgacatataagttcatgaatggtgagccatgaaggactcgaaccttcgacaccctgattaaaagtcaggtgctctaccaactgagctaatggctcccaacagggtaatataactttgtaaaaatggcggaactgacgggattcgaacccgcgatctcctgcgtgacaggcaggcatgttaggcctctacaccacagttccatagcagtttacattcaaaagttaattggttgcgggggcaggatttgaacctgcgaccttcgggttatgagcccgacgagctaccgaactgctccaccccgcgataatattaggtactgcttttcaaataaatggtggaggctgaggggctcgaacccccgaccctctgcttgtaaggcagatgctctcccagctgagctaagcctccatactacttatgacccgtaggggattcgaacccctgttacctccgtgaaagggaggtgtcttaaccccttgaccaacgggccatgcaataaaataattctggcggagagagagggatt

SEQ ID NO: 2651 - DNA, 3639 bp, Unknown
  Kingdom: Bacteria, Phylum: Firmicutes, Class: Bacilli, Order: Bacillales, Family: Paenibacillaceae, Genus: Paenibacillus
catccactcttgatgggctttgctttgctgccataccgcataatccttgtactgtattcgcaatggcgaaagctcttcaccgtcgtataagcggacaaattcatcggtcagtactcccatggacacaccatccgagacgatatggtgcatatcgagcatgagcaaatgctgcggttcctgctcggttccttgtacacccaaatctaccaagcctacccgcagcagcggagcggcttgcagatcgaacggacgtacaaactgctgcacccgttcttgtgcttcctggctgaccatcgtatccgcagtcgcaccctctacctgtaccttcgtatactccacctcaaacggcacggtgtcctcaatccattgcaccggctcactgtccaccagctcaaagcaggtacgcaacgttgcatggcgggcgatcagttgacggaacacgtcctccactcgcttcacgtccaacggaccactcacttgcagcactgacggcatgttgtagttcacatcattcgggtcgaactgatgcagcacaaacagtcgtttttgcgccgaggaaagcgggtagaagctgcgttcttccgtcaccggaatggacgcatacgccacttgatccaaaccttccatgaccgctgccagttcttcaatcgttggagcttcaaaaatactgcgcagtggaagcggcttgttcagctccttgtgaattttcgaggccagcgtcgtcgcccgcagcgagtgtccgccaatctcaaagaagttttccttcacaccgacctgcgccagacccagcacatcctgccaaatttgcgccagcttcacttccacccatgtccgcggtgctacataatcggctccgctttgcaggttaccttccggtgttggcagtgccttgcggtcgattttaccattcggtgtcaacggcatctgctccagctgcaccaaatacgaaggcaccatgtagtttggaagctcctcgcccagtaagctgcgcagctcaccagcgctcacttcccgttcagcaacatagtacgccaccagttggttttgcccctgttcgtccgcttgtgccagtacgatgacctcttgtacgtcctccaccttcaaaatttgtgcctcgacctcgcccagctcgatccgatagccccggattttcacctgatggtcgatccggcccaaatattcgatgttgccgtctggcatccatctcgccaagtcacccgtacggtacattcgttcatagccggcttcgccagccgcaaacgggttcggtacaaatttctcagccgtcagctctgggcgatccagataaccccgggccagacccggaccggacacgcacagctcacccgctacgcctaccggagccaaatgtccatgcacatccaccatgtacacccgatgattcggcatagggcgtccgatggaaatgagttgtccggctctctcatcctcggataccggccagatggacgtcgccaccgagttttcggttggaccgtagccgttgtagtacgccacctgatccttccacttgtataccaattctgttgaggatgctgaacccgcagtgaacagaatacgcaggtttggcatccgtcccggctccagatacaccgcataggtcggtggcaacgtcgccaccgtaatctgatgttctgtcatataatgttcgaatctctcatagtccaaaatcgtctctgacgttggcacatacaacgtggctccgcagaacagcgcctggaagatttcccagcaagccgcatcaaacgaatagctagcgaacagcaacgtatgatccgacgtgcggatcttgagcgtctgatcaaaatacgttttcagattgcatagaccgcgatgctccaacataacacccttcggctgccccgtcgtacccgacgtataaatgacataggccagatcgttcggaccagacaacgattccaaattggaactatcctcgtgatacacgccctgtgccccattcagcaccagcacgttaccgtcgaaagccactttatccaccagatggctttgcgttaataacagcttcgcacccgagtcgtccagcatgtagcggatacgctcctctggatacgtcggatcgatggggacatatgcacccccggcttttaaaatcccgaagatgcccacgatcatgtctaccgaacgctcggtcatcagacccaccagtcgatccttcgtcacgccttgactgcgtaaggtacgagccagacgattcgcacgttcattcagctcgcgataggtcaactgctctccttcgaagaacaacgctggctgttccggtgtctgcgccgtttgtgtctcgaacaagccatggatcgtttgcccgctcggatactcggcagctgtatctccccatacgctgagaatttgcttgcgctcctgcgtggttaccatatccagctcatacacgcgaatgtccggcttcgccaccacctgctccaacagctgtatcagatggccctgagtccgttcaacggcttcccgatcatataacttcgcattgtattcaaatcggattttcatcgcttcctgcggcatgacaaccagattgaaatcatagttggtttgttcaatcatgcctgcattgcgaatttcaaaatccgactctgcaccttcgccaagttgctcgacctgctcctccaccggatagttttcaaacacgataatgtggttgatcagatcttgcttttgctcgctcaaggcttgaatttcatatagcggatacgtttcataatcttgagaagtcagcgcctgctgctgattcgttctgatcatgtcagcaaaggtgtcctcagccccactgcggatacgtattggaatggtgttaatgaacaagcccaccatattttcgatccccgtaatatccgctggacgaccagacactacaccgccaaaaacagcgtcgtcactaccgttgtacttttggagcagcaatccccaggctgtttgcagcaatgtattcggggtcacgtgatgctgcttggccaccatttccatacgtctggtcaagtccttgcccagatcgcacaggatatgctcaaattgtgcatcgtccgctttcacgcctacttttccggtcggaatcgaagtttgctgatcatagccgagcaaataatccttccagtacgcagctgccgcctctacatcctgtgcttcaagccactcaatatactgactgtatggagtcacgagggcaagcttcggctgtctatgctccacggctgcaaaataagcctcaaacacctcatccgtgactaacgccacacaccagccatccatcaagatgtgatgagagctccacacaaaataataatcctcgtcgcctgttcgtaaaatcgccacgcgcatcaacgcatcccgggacaaatcgaacccggctgccttgtccttgcgaataaattccttcacatacgcgtcacgctcctgctcattcagatgacgcaaatcttcacatctgaaaccaacatccttacggcggaaaatgacctgcacaggctcatcctgccaaccactgatgaaattagctctaaatatttcatgccgctgcgccaaatgattcaagctatcttggaaaatatccgcttggaagcgtccatgcaaatcaaaggtcgtttg

SEQ ID NO: 2652 - DNA, 4670 bp, Unknown
  Kingdom: Bacteria, Phylum: Firmicutes, Class: Bacilli, Order: Bacillales, Family: Paenibacillaceae, Genus: Paenibacillus
gtgaaggccgtcttttgcaggatcgtatcttccgcactcaagccgtaccgatcatgcatccacaaaatccggttcagcacggaatgatgctccaccatcacgcccttcggttttcccgtggagccggaggtatagatgacataggctacatggtgtggcccagccagtggctccagattcgaatcgtcttcgtggtaaatgtcttggccatcctgctcatgacgatccagcaccagcacctggccgtcgaaactccgtgacgcttgctcggccaaatgcgattgcgtcagtatcagcttcgcacccgaatcctccagcataaagcggatgcgatccgccggatattctggatcaatgggtacgtaggctccgcctgctttgaggatcgcataaatgccgacgatcatgtccagcgaacggtgaaccaaaatgcctaccggctgatccggttcaacaccttccgcacgcagcgtccgagccaaacggttcgcgcgctcattcaactccgcgtaggtcaacgattccgatccgcacaacacggccacctggtccggtgtatccgcggcctgctgctcaaacaatgcgcttagcgtttgatcctgcggatagactgccgccgtatccccccagacctgaacgatctgcgcctgttcttccggtgttaccaattccagctcattcacacggatatgcggattatccacgatttgctcgatgacatgcagcacatgtccctgcatccgctctatcgtagaccgctcgtatacattggcattgtatctgaacatgatgcggaaggtttcatcgggcatcacaatcaagtccagatcataattcgtttgctcaacaacctctacattcgtaatttcaaaagcggatggacgaacttcactaagctgctcgacttgctcctctaccggataattctcaaataccataatgtggttaatcaagttctgcttctgctcggtcaatgcctgaatttcatacagcgggaagctgtcataggctcccgaggccagtgcctgttcctgcgttttccgcatcacttccacaaaagtggcatttcgttcactttgaatccgcaccgggatcgtattaatgaacaaaccgatcatatgctctacgccggcaatatccgttggacgtccagatacgacactaccgaaaataacatcctcattattgttatatttctgcaaaataaggccccacacgctctgcatcagcgtattaatcgtgacctgctgctgcttcgcaatccggtgtatggcttcgctccacgttggatccagatctaccgttattttttcagaaatatactcgctggtttcacttgctgtagtggataccgtatgatccctgctatctgccgcttggtctttcgataaagtatccgatccaggtaacaacgtctgctgttcaaagccggccaaatagctgctccaatattcttttgctgcacgctcatcctgacgccccagccattcgatatattggccatatggtgtgataggagcaagctccggctgcttctgctccagcagcgcaaagtacgtaccaaacacttcacccgtaacgagcgataagcaccagccatccatgacaatatgatggaagctccagaccaaatgatacgtttcttcatgggtctgcaatacctgtacgcgcataagtgcatccgtaccaagattaaagcccctagcctggtcctcttgcttaaacgcctggatatatgcctgttgctccgcttcctgcatttcccgtatatcctggaaagaaaggtcgctatctttgtgacggaatacgatctgcaatggctcctgactgtgccctgtctcaaacatatggaaattcgttcgcagtgcttcatgacgctgtgtcagtacatccagactcttgcggaaaagttcaacatcaaagctgcctttttgatcaaacgacgcttgctggaagtaggcgcctgactgcggctccatcaagctatggaacagcatccccttctgcataggcgaaagagcatatacattttccagctcgcctacagaagaagtttgctccgtcaattgttccagctgaccaagcgtcaagcctttgaacaatacatcacttggtgttagctcactccgctctttggaggcacaatgagcgatcacttcctgcaggctttcctgcagcaactgcgcaaatttttctacattttgctgatgatataccttactgtcatagcgaatttccagtgtcagcgcgcccgctgtaatcattccgttcacattcaaaggatgctccagtacggtatggtcactcatcggctctccacctgaatgtgaagacagcgtaatatccccattttccaagtcctgatcaaattgtcccaaatagttaaagctaatttcaggctgcagggtccatgaagaattagcatcttcctgagacatatatttcaaaatgccgtagccaatacccttatgcggtacatggcgcaggtcttccttcacccgcttgattcgctgcccgactgctgcctttccgtccacatccagcagcaccggatattggcttgtaaaccagcccacggtacgggtgatgtcgatatctggaacaatggcttcccggccatgtccctccagattgaccagcacacgctcctgaccgctccagttatataccgctgtgccgagtgcggttaacagcagatcattaacctcggtgtggtacgcacgatgtgcttcctgaagcagcagtcgtgtttcctgttcactccaagccacggtcaccgtcgcagtgtctctgattagagaatgttgtccctccgctctctcttgatccttaggcaacgatgcgacttccatttgagcgagatgctgccaatattcacgttcattttcgatcgccggactattcgcatattgtgataagcgctctgcccaagcggagaaagagtccgttttataaggcaggcgaatcgcttctccccgcacggcctgctcatatcccgtggcaaaatcctcaaacacaattcgccacgaaatcccgtctatgaccaaatggtgaatggcaatcagtaaatgatctccatccatgcagcggaaaagtcccagcttcaccagcggtccttcgtccagacgaatggaactttggatggcattggctttcatttcaatggccatcaccacatctgccgcgtcttcgacgcccatcagatctacaacatccagactatacagctggccttcgttcagaccgcgattccatgcttcatagccctgttcggtctgacggaagatcatacgtagcgcatcatgatgctcagttaccttggccaccgtttgatgcaatgcgacttcatcgaagccttgtgctctatacagcatcaccgactggttgaaataatgtggctctgctgaggattgtccaaagaaccattgctgaatcggggtcaatctaactgcccccgaaaccacccgctgatcggctgtacggctgaccttgtgtacatgaccgctcagcagcgaaatggaaggatattggaacaaatccttcatgtccagcttgtagcccgcttgcagcaaacgggaggatacctggattgccttgatcgaatcgccgcccagatcaaagaaattatccaaaattccgactctctttgctcctaatacagcctgccaaatggacactaacgtctgctccagcgctgtgcgcggctctacataatccgctccgctttgcaggctgccttctggtgccggcagggccttgcggtcgattttaccgttcggcgtcagtggcatttgttctagctggatgaaatacgaaggcaccatgtagtttggtagctcctcgcccagtaagctgcgtagctcaccagcgcttacttcccgttcagcaacatagtacgccaccagttggttttgtccctgctcgtccgcctgggccagtacgatgacctcttgtacgtcctccactttcaaaatttgtgcctcgacctctcccagctcgatccggtagccccggattttcacctgatggtcgatccggcccaaatattcgatgttgccgtctggcatccatctcgccaagtcacccgtacggtacattcgttcatagccggcttcaccagccgcaaacgggttcggtacaaatttctcagccgtcagctccggacgatctagataaccccgagccagacccggaccggacacgcacagttcacccgctacgcctaccggagccaaatgtccatgcacatccagcatgtatacccgatggttcggcacagggcgtccgatggaaatcagttgtccggctctctcatcctcggatacgggccagatcgacgtcgccaccgagttttcggtgggaccgtagccgttgtagtacgccacttgatccttccacttgtataccaattctgttgaggatgctgaacccgcagtgaacagaatacgcaggtttggcatccgttctggctccagatacaccgcataggtcggcggcaaagcggccacggtgatctgatgatccgccatatattgctcaaaccgctcgtagttcaaaatcgtctctgacgttggtacatacagtgtggctccgcagaacagtgcctggaagatttcccagcaagccgcatcaaacgaatagctggcgaacagcaacgcatgatccgacgt

SEQ ID NO: 2653 - DNA, 2411 bp, Unknown
  Kingdom: Bacteria, Phylum: Firmicutes, Class: Bacilli, Order: Bacillales, Family: Paenibacillaceae, Genus: Paenibacillus
agcaacgcatgatccgacgtacggatcttgagcgtctgatcaaaatacgttttcagattgcacagcccgtggtgctccagcatcacgcccttcggctgcccggttgtacccgacgtatagatcacataggctagatcgttcggaccggaccacggctccagattggaaccatcctcgtggtacaccgtttgctctccatccagcaccagcacgtgaccgtcgatagcggctttgtccaccagatggctttgtgtcaacagcaacttcgcacctgagtcgtccagcatgtagcggatacgctcctctggatacgacggatcgatggggacatatgcacctccagcttttaaaatcccgaagatacccacgatcatgtccaccgagcgctcggtcatcagacccaccagacgatctttcgtcacgccttgactacgcaaggtacgagccaaacgattggcgcgtgcattcagctcgcgataggtcagcgcttctccttcaaagaacaatgctgtctgctccggcgtccgcgcggtttgcgcctcgaacaagccatggatcgtttgctcgcttggatatgctgccgcagtattaccccaagcctcaacgatttgctcacgttcccgcgtggttaccatatccagctcatgtacgcgaatgtccggcttcgctgtcacctgctccagcagctgtaccagatgacctcgaatttgctctacactttcccgttcaaaggccagtgcattatacccaaaactcatatgaatggtgttccccggcagtaccaccaggttaaagtcatagttggtctgctcgacagactcggctccggtgatgctgaagctggactcatcaccgttgcctaattgctccaattgttcctctaccggatagttctcaaaaataagaatatgattgatcaaatcctgcttaagctccgacagcccctgaatttcatacaacgggtacgtatcataggcatgggaagcaatcgattgctcttgggtttgcttcatcacgtctgagaataagctgtccacttgactgcggatacgcacaggaatggtattgataaacagaccaatgatgtgctccacattcggaatgtctgctggacgtccagataccacgctgccaaacaccacatcatctgtaccattatatttttgcagcaaaaggccccaaacggtctgcatcaacgtattgatcgttacctgataacgcttggctacgcgctgaatgcctgccgttagatccgcgcccaagtcaaaatccagacgctccgcctgatattccgttatgccctgcattttagcctgtggcaggcgggactgttcctcatatccttccagaaccttgctccagtaacctgatgcggcctgacgatcctgctgttccagccattcgatatattgactgtacggcgttacaggtgccagttcaggctgcttatgagccagtatcgcaaaataactcgcaaacacttcgcctgtcaccagcgacaagcaccagccgtccatcacgatatgatggaagctccatacaaaacggtacgcatcctcacctgtgcgcaaaacagccacacgcatcaaagcatcttgcgccagatcaaagcctctttgcttgtctttgcgcgtatattcgaggatgtattcgttttgccgctcttgctccatatcccgcaggtcttcaacatataattcactgcgcttattccgatacacgacctgcagcggttcatctttccagccactgtagaagttcgtgcgcagtgccgtatgacgctgcaccaatacatccaaacttgccgcaaatgcagcgatattaaaatgtccctgcagatcaaaggaggcctgttcaaagtaagctcctgattgcgagtccatcagattgtaaaagagcatgcccttttgcatcggcgtcagcgcgtatacattttccagctcaccggtatgtgccgcctgttccgcgatttgttccagttctccagtcgtcagacctttgaaggacacatcacttggcgtcagctccggctgttcctgagcgacacaatgcgtaatcacctcttgcaaagcggattgcagcagtcctgccacacgttccagcgtttcttggcgatactgcttacggctgtaagcgatcgtcaagcgcagcgtgccttccgagatcattgcattcaaatccagcgtatattgcagcggtgaatgggcatcctctgtctcccctgcgctataggatgaccatgtgattccactgttttgcacatcctgatcgacctgtcccaggtagttaaagctgatttccggttcttctgcactcgcctgcgcttcacctgatgcagacgcaggagataagtagcgccatgtgccataggtcagccctttatgcggaatgcggcgcagaccttccttcgt

SEQ ID NO: 2654 - DNA, 3642 bp, Unknown
  Kingdom: Bacteria, Phylum: Firmicutes, Class: Bacilli, Order: Bacillales, Family: Paenibacillaceae, Genus: Paenibacillus
caaacgacctttgatttgcacggacgcttccaagcggatattttccaagatagcttgaatcatttggcacagcggcatgaaatatttagagctaatttcatcagcggttggcaggatgagcctgtgcaggttattttccgccgcaaggatgttggttttaaatgtgaagatttgcgtcatctgaatgagcaggagcgtgacgcgtatgtgaaggaatttattcgcaaggacaaggcagccgggttcgatttgtcccgggatgcgttgatgcgcgtggcgattttacgaacaggtgatgaggattattattttgtgtggagctctcatcacatcttgatggatggctggtgtgtggcgttagtcacggatgaggtgtttgaggcttattttgcagcggtggagcatagacagccgaagcttgcccccgtgactccatacagtcagtatattgagtggcttgaagcacaggatgtagaagcagcagctgcctactggaaggattatttgctcggctatgatcagcaaacttcgattccgaccggaaaagtaggcgtgaaagcggacggtgcacaatttgagcatatcctgtgcgatctgggcaaggatttgaccggacgtatggaaatggtggctaagcagcaccacgtgaccccgaatacattgctgcaaacagcctggggattgctgctccaaaagtacaacggtagtgacgacgctgtttttggcggtgtagtgtctggtcgtccggctgatattccggggatcgaaaatatggtgggcttgttcattaacaccattccaatacgtatccgcagtggggctgaggacacctttgctgacatgatcagaacgaatcagcagcaggcgctgacttctcaaaattatgaaacgtatccgctatatgaaattcaagccttgagcgagcaaaagcaagatctgatcaaccacattatcgtgtttgaaaactatccggtggaggagcaggtcgagcaacttggcgaaggtgcagagtcggattttgaaattcgcaatgccggcatgattgaacaaaccaactatgatttcaatctggttgtcatgccgcaggaagcgatgaaaatccgatttgaatacaatgcgaagttatatgatcgggaagccgttgaacggactcagggccatctggtacagctgttggagcaggtggtggcgaagccggacattcgcgtgtatgagctggatatggtaagtgagcaggagcgtaagcagatcgttgaggtctggggcaatacagcggcagtctatccaagtaagcaaacgattcatggcttgttcgagacacaaacggcgcagacaccggaacagccagcgttgttcttcgaaggagagcagctgacctatcgcgagctgaatgaacgtgcgaatcgtctggcgcgcaccttgcgtagtcaacgcgtgacgaaggatcgactggtgggtctgatgaccgaacgttcggtagacttgatcgtggggatcttaggcattttgaaagccgggggtgcatatgtccccatcgatccgacgtatccagaggagcgtatccgctacatgctggacgactcgggggcagagctattgttaacgcaaagccatctggtggataaagtggctttcgacggtaacgtgctggtgctgaatggggcacagggcgtgtatcacgaggatagttccaatctggaatcgttgtctagtccgaacgatctggcgtatgtcatttatacgtcgggtacgacggggcagccgaagggcgttatggtggagcatcgtaatgtcgtacgtttggtgaaaaatacaaactacgcgcaattagatgccgacacgcgcattttacagacaggggctgttgttttcgacgcatccaccttcgaaatttggggggcgctattgaatggtggacagctggtgctagtgagccaggatgtcattttggacgcccctaagcttaaggaggctgtgcgtagccacggcattaccacgatgtttctgactacaccgctctttaatcagctgtcccagcaggatctggcgctgttcgagggggtacgggagctgctggtcggcggtgatgtgatgtccgtaccacatatgaaccgggtgctggaggctcatccatccttgcggatcagtaacatctatggcccgacagaaaatacgaccttttccacagtgcatgcgatcactggtatgcaatcggaatcggtgccaattggcagaccgatccataattcgacagcgtatgtcgtggaccgttcgatgcggcttcagcccgtcggggtatggggtgagctgatcgtcggcggtgacggggtggcacgtggataccgcaaccgtccggacctgacgtccgaaaagttcatcgacagcccgttccgcagcggagaacgctgctatcgcacaggcgacctggtacgcttgaatgtggacgggacgctggaatataagggacggatcgacgcacaggtgaaaattcggggctaccggatcgaactgggcgaggtagaaacgcagctgttgaagctggaagcggtgcaagaaactgtggtcatcgcgcgtgaagatgagcaagggcagaagcagctctgcgcttatgtggtcgccgatggggaagttgtggcaagtgaactgcgcagcgctttgagccagaagctaccgggttacatggtcccttcctatctggtacagctggagcagatgccgttaactccgaatggcaaaatcgaccgcaaggcactgccagcaccggaaggcagcctgcaaagcggagctgattatgttgcaccgcggacatgggtggaagtgaagctggcgcaaatttggcaggatgtgctgggtctggcgcaggtcggtgtgaaggaaaacttctttgagattggcggacactcgctgcgggcgacgacgctggcctcgaaaattcacaaggagctgaacaagccgcttccactgcgcagtatttttgaagctccaacgattgaagaactggcagcggtcatggaaggtctggatcaagtaacatatgcgtccattccggtaacggaagaacgcaacttctacccattatcttcggcgcaaaaacgactgtacgtgctgcatcagttcgacccgaatgatgtgaactacaacatgccgtcggtactgcaagtgagcggaccgctggatgtgaaacgggtagaagccgcgttccgtcaattaattgcccgtcatgccaccttgcgtacccgctttgcactggtggacagtgagccggtgcaatggattgaggacaccgtgccatttgaggtggaatatacaaaggtacaggcagaagatacaaccacggatacggacacgatggtcagccaggaagcacaagaacgtgtgcagcagtttgtacgtccattcgatctgcaagccgctccgctgctgcgggtaggcttggtagatttgggtgtacaaggaaccgagcaggaatcgcagcatttgctcatgctcgatatgcaccatatcgtctcggatggtgtgtccatgggggtactgaccgatgaatttgtccgcttgtacgacggtgaagagctttcgccattgcgaatacagtacaaggattatgcggtatggcagcaaagcgaagcccatcaagagtggatg

SEQ ID NO: 2655 - DNA, 2396 bp, Unknown
  Kingdom: Bacteria, Phylum: Firmicutes, Class: Bacilli, Order: Bacillales, Family: Paenibacillaceae, Genus: Paenibacillus
acgaaggaaggtctgcgccggattccgcataaagggctgacgtatggaacttggcgctacttgtcccctgcgtcccatccgattgcagcagaaccggaaatcagctttaactacttgggacaggtcgatcaggatgtgcaaaacagtggaatcacattgtcatcctatagcgcaggggagacagaggatgcccattcaccgctgcaatatgcgctggatttgaatgcaatgatctcggaaggcacgctgcgcttgatgatcgcttacagccgtaagcagtatcgccaagaaacgctggaacgtgtggcaggactgctgcaatccgctttgcaagaggtgattgcgcattgtgtcgctcaggaacagccagagctgacgccgagtgatgtgtccttcaaaggtctgacgactggagaactggaacaaatcgcggaacaggcggcacatataggtgagctggaaaatgtatacgcgctgacgccgatgcaaaagggcatgctcttttacaatctgatggactcgcaatcaggagcttactttgaacaggcctcctttgatctgcagggacattttaatatcgctgcatttgcggcaagtttggatgtattggtgcagcggcatacggtactgcgcacgaacttctacagtggatggaaagatgaaccgctgcaggtcgtgtatcggaataagcgcagtgaattatatgttgaggacctacgggatgtggaggaagagaagcaaaacgaatacatccttgaatatacgcgcaaagacaagcaaagaggctttgatctggcgcaagatgctttgatgcgtgtggccgttttgcgcacaggtgaggatgcgtaccgttttgtatggagcttccatcatatcgtgatggacggctggtgcttgtcgctggtgacaggcgaagtgtttgcgagttattttgcgatactggctcataagcagcctgaactggcccctgtaacgccgtacagtcaatatatcgaatggttggaacagcaggatcgtcaggccgcatcaagttactggagcaaggttctggaaggatatgaggaacagtcccgcctgccacaggctaaaattcagggcaaaacggaatatcaggcagagcgtttggatttcgacttgggcacggatctaacggctggcattcagcgcgtagccaagcgttatcaggtaacgatcaatacgttgatgcagaccgtttggggcctgttgctgcaaaaatataatggcacagatgatgtggtgtttggcagcgtggtatctggacgtccggcagacattccgaatgtggagcacatcattggtctgtttatcaataccattcctgtgcgtatccgcagtcaagtggacagcttattctcagacgtgatgaagcaaacccaagagcaatcgattgcttcccatgcctatgatacgtatccgttgtatgaaattcaggggctgtcggagcttaagcaggatttgatcaatcatattcttatttttgagaactatccggtagaggaacaattggagcaattaggcaacggtgatgagtccagcttcagcatcaccggagccgagtctgtcgagcagaccaactatgactttaacctggtggtgctgccagggaacaccattcacatgagctttgggtataatgcactggcctttgaacgggaaagtgtagagcaaattcgaggtcatctggtacagctgctggaacaggtaacagcgaagccggacattcgggtgcatgagctggatatggtaaccgcgcaggagcgtgagcaaatcgttgaggcttggggaaatacagtggtagcatatccaaacgagcaaacgattcacggcttgttcgaggcgcaaaccgcgcggacgccggagcagacagcattgttcttcgaaggagagcaattaacctatcgcgagctgaatgcacgcgccaatcgtttggctcgtaccttgcgtagtcaaggcgtgacgaaagatcgtctggtgggtctgatgaccgagcgttcggtagacatgatcgtgggcatcttcgggattttaaaagccgggggtgcatatgtccccatcgatccgacgtatccagaggagcgtatccgctacatgctggacgactcaggagcgaagctgctgttgacgcaaagccatctggtagacaaagccgctatcgacggtcatgcgctggtgctggatggggagcaaacggtgtaccacgaggatgattccaatttggagccgtggtccggtccgaacgatttggcgtatgtgatttatacgtcaggtacaaccgggcagccgaagggcgtgatgctggagcatcatgggctgtgtaatctgaaaacatattttgatcagacgcttcggatgagcacgtcggatcatgcgttgct

SEQ ID NO: 2656 - DNA, 70533 bp, Unknown
  Kingdom: Bacteria, Phylum: Firmicutes, Class: Bacilli, Order: Bacillales, Family: Paenibacillaceae, Genus: Paenibacillus
aacaaatggggtgcagttcataaactggctgtcgttttatcaactaacgtgcagtatagcataacaaagtatagcttctgttatactgagaataacaattatctgaggagcttatgtatgattaccatatccaaagaacaattaattgaatgctttaaatctgttcttcagcaaagattttgaaaaccaagtcaacatggcggaacacgccgcattactggtttgggttcatctgatccgttggatatagatgatactatgtggaaaaaaaccgaactaagatcttagattaaagctctcgttacaaaagatgtaaaatatcgtcatattccaaggaattaacatgatactgtagatttaaattgtagaattaaaaagaggacaatttctaaataattaatggggatcagaaatgagatacttttttgtttttcagaataaaacttatcgtgaagagcatcagttaaaaaaggagacatcatcttactttacaaggtaagaagtatgccccatataatttaaccgggagaggtaacaccggctatttatttcagatagctgatgtaattattggtgatttagtacaaactcgtgttggacaagacaagtttaaagttatgtatattataagaggtgtcggcgatgaaattagttacggcggccattattcacaatgatggcgaatttttaatcaccagacgaggccccgacaacaaacatgctggtaagtgggaatttcctggtggaaagcttgaaatcgatgaaacacttgaagaatgtattaaacgtgagatcaaagaagaacttggaattgatattgaggttggtcaacaatttggagagtctgtttattcatatggtcatggttcaataaaattaattgcattttggacaacgtgggtatctggtgaaattcaattaatagatcatgatcaattacgttgggtcaacaaagaaacaatactccaatatgatttcttacctgcagatttaccatttgtgatgcagcttagtaagggcgataaacctcgacaataaattcacgttaacaaatatgttagcaaattataatcgccccttataaatgctacttccctccattttctaaccctctataaacaacaaaaaaacccttgctacgcaagggttttgaggaaatgggccctgagggactcgaacccccgaccaatcggttatgagccgaccgctctaaccaactgagctaagggccctcaaaaaaatttgtatattcacgttacacattcataacagcaacgttaattaatatacaacattttcttgtgtttcgtcaatagtctttcgaatattttcttttataaaattatttttatggacttacggaataaatcggacaccataacgacctttgcgcgagcggtacacctccactgcgcggggatcattgtagccatacatccagccgtcgtgctccaacctttttgccagacatcctgcctggaatttagtcgtgtacagtctgccatagtaaatccaatacatccgagctccctcttttcacatgatggtaggagtagtgtaaccggatcgaattcgatttacacggcccgagccataacaatctacaatagttagcaacgagtacgaatcgttctaatcattagctctgttgtcccctatagctcatcttatttgccaaaggaagccgggtcctgacgccaagaacgcagcagttccatctcttcttcctgaatggttccttcacgcaaggcaacattcatcagagctgtataattggacaagctttgcagctccacacctgcttcttcaaaagcttgagtcgctttgtctagctggtagctgaaaatagctagtaccgctaacggctgagcgcctgcttgtgctacagcctgcgctgctttaatggagctgcctcctgtagaaatgagatcctcgatgaccataaccttttgtcctgcgctgatgcggccttcaatttggttctctttcccatgtcctttggctttgtcccttacataggccattggcagatttagcttttgcgccacccaggccgcatgaggaatccctgctgtagctgtccctgcaatgacttcggtttcgggatattgctcacgaatgagggcagcaaatgagtctgcgatcagctcgcgcacctccgggtaggacatagtcaggcgattgtcgcagtaaattggcgatttaatgccggatgtccatgtaaaaggctgctgcgggcgcaatgccaccgcctggatacgtaacagatgggatgcaatttgctcgggtatattattaaatgtggtcatacttgtatcatctccttaataatgtgttccgctgcggcgcgtgggtctgctgctgcggtgataggacgtccaacgacaatgtagctgctgccttgggcaatggcttgtccaggtgtaagcacacgcgattgatcgcctgtagcactacctgccgggcgtatgccaggggttatcgtcttaaattctgatccacatacagcacgaatggcaggcacttccaaaggggatgctaccacaccatccaatcccgcctcacgggtcagttgtgcgtaacgaaccactgcatcctgtaccgtaccaggaatacctaactccttattcatagtcgtctgatccgtgctggtcagctgtgtgactgcaataatgagcggcatggaaagcgagctgtctgcggaaatagctgcttctgcaccagctttagcggctgacatcatattaacgcccccagcagcatgtacgttgaacatatccacacctaggcgggtaatgctctctgcccctccccgcaccgtgttagggatatcatgcattttcaaatccagaaatacggagtatcctctggactttagctgttctacaaaagctggccctgcactataaaacagttgcatacctacttttatataacagggaatcccctctagctgccgaattaactgctcagcctgttgtgcattgggataatctaatgcaaccatcagccgtcctgccatctgctgaaatgctccattcaccgttctacatccccttttcgcgtcaattcgggtacatttgcccgtgataaaggacatccgtcagccgaagctgatgaatgtccttccctgtgctacttatttcctcacatctattcgtaacgcattatttgctcaggactggcatggattcggatgtgaaattgatcgtttccagcattcttagcaaagcgcgtactgtatccaatgaggtcatgcagacgatgccattctcaactgcttcacggcggatacggaatccatcacgctctggcgttttgcctttggtcagcgtattgaagacaaagttggcttcacccgtacggatcatatccaggatgtttgggttcccttcgctcagcttgttgatcgtgttcactggaatgttggcctgcttcatagcagccgccgttccacctgttgcaataattttatagcccagtctgtaaaagccctgcatcaactcgacagcttcttccttgtccttatccgccactgtaatgatgatcgccccagtggatggaattttcataccagcccccacaagtcctttgtacagggctttggcatactgaatgtcgcgtcccataacttcacctgtggatttcatttccgggcccagcgtcggctctacacggcgtagtttggcaaaggagaataccggaaccttaaccgagacataattactttcaggccatagaccttctgaataacctgcatctttaagcttaccgcccaaaatagcctgtgtagccagattcgccattgggatatttgttactttactcaagaaaggaactgtccgcgaggagcgaggattaacctcgatcacgtacacctcgtcttgatgaataacaaactggatatttaccagaccgatcgttttcaattccttagcgatgctgattgtaatttccacaattttttgtttcaactcggcagacaagtgctgtggtggatacaccgcgatagagtcacctgagtgaaccccggcccgttctacatgctccataatgcctggtaccaatactgtctcgccgtcgcagatggcgtcgacctcaacttctttacccagcatataacggtcgatgagcaccggatgctctggattgattttaaccgcttcttccatgtaccgcagcaattccgtatctgagtacacgatttccatagcgcgcccgcccaaaacgtaggatggtcgtaccaggaccggatagcctagcgcctgtgcggttcctactgcttcatctaccgatgtgaccgtgttgcctttaggctgtgcgatagccagacgagacaaaagttgctcgaactttttccggtcttccgcttcatcaatactttccagactcgtacccaaaatattcacgcctgccgcactcagcggagctgcgagattaatggccgtttgaccaccgaactggacgataaccccaatcggtttttcctgctcgatgacattcatgacatcttcgaagaagagcggttcaaagtagaggcggtcggatgtgttaaagtccgtagataccgtctccgggttgttattgataatcactgcttcgtagcccgctttttgaatagcccataccgcatgtacggtggagtaatcaaattcaatcccttgcccgatccgaatcggtccagagccgagtacgataactttctctttgctagatggaattacttcattttccacctcgtaagaggagtagtagtacggagttgtggcttcaaactcggctgcgcacgtatctaccattttgtagaccggacgcaggttttgagctagacggaattcacgtacctcacgctcggttatcatactgtcgttttggcccatactgcgaatctcggcgatcgagcggtcagtaaaacctttacgtttggcctgatagagtgtttcggaggtcagctcagactctccagcgatgatggcttcgaacttgacgattccctctaccttatcgaggaaccaccagtcaattttcgtcaaatcttgaatctcctgctgctgccagccgcgacggaacgcctcggctaccaagaacaaccgctcatcatctgctttaatcaggcgatcctggagtacgtcatcagacagctgttcggctcccttaagatgcagacggtgtacaccgatttccaacgaccgtaccgctttatggatggattcctcgaatgtgcgtccgatggccatgacttcacccgttgctttcatttgcgtgcccagcttgcggttggcagaaatgaatttgtcaaatggccagcgtggtattttgctcacgatgtaatccagtgttggctcaaagcaagcatacgtttgtcccgttaccggattcacaatttcatccaacgtgtagcccagtgcgattttggcagccattttagcaatcggatatccggttgccttggaagccagtgccgaggagcgacttacgcgcgggtttacttcaattacatagtattgatagctgtgcggatcaagcgcaaactgtacattacagccgccttcgatattgagggcgcggataattttcagagaagcggagcgcagcatctggtattcgcgatctgacagcgtctgactcggagctacgacgatactgtcgccagtatgcacgccgactggatcaaagttctccatattacagacaacgatgcagttatcattgccgtcacgcatgacctcatattcgacttccttcatacctgcgatactcttttccaccaaacattgtccgattggactgtatcttaagccagagctgacggtttcacgcagttcttcttctgtggaacagataccaccgcctgttccccctagcgtataagccgggcgaacgataattggataaccgatttcgttggcaaattctaacgattcttccaaggttgttacaattacactctccggtacaggttgttccaactcgcgcatcaaatcacggaacagatcacgatcttcggctttttctatcgaattcagttgagttcccagtagcttgacgttttcacgctccagcactccggcgcgagccagttccactgccatattcagacctgtctgtcctcccagcgtaggaagcagcccatctggacgctcttgacggataatctgtgttacaaaatcaagtgtaatcggctcgatgtatactttgtctgccatgttggtgtctgtcatgatggttgccggattactgttgatcagtactacctcgacgccttcttctttgagcgcttgacaagcttgtgtaccagcgtaatcaaattctgctgcctgaccaatgacgataggaccggaaccgatcacaagtatttttttaagttctgtatttttcggcatattagcgctctcctctcactgcggcggcgatagcagcctgacgcggttgctttggatgatttcttttgtgctcacggatcatgtccagaaagcggtcaaacaggtagccattatcgtaaggtcctggtgcagcctctggatgatattgcaccgaaaacgcgggatacttggtatgtttaagaccttcaatcgttttatcgttgttattaatatgtgtcacttcaagctcagtaccttggatcgaatcctcattcaccgtgtagccgtgattttgtgatgtgataaagcagcgtccgctctccagttctttcaccggatggttaccaccgcgatgtccgaatttcagcttttccgtatccgctcccgaagctaaagcgaacaactggtgtcccaagcaaattccgaaaatcggatattcccctaacagttcagctaccgtacgaacggcatggggtacgtcttttggatctccagggccgttagacagctggataccgtccgggtccaagcgacgaatttcctcagccgtcgtatcatgtggaacgacaactacatcgcagtcccgtttgttcagttcgcgcaaaatgccgcttttggcaccgtagtcaatcaatacgatccgctctccgttgccaggactgctgtacggatgaggtgtggaagtcataggaacctgattgcgcagttcttcaatggtcaagtcagacatcatttctttcagttcttccagcggctgggaaccagtcgtcaaaatgcccttcatcgtgccgtgatggcgaataatccgggtaagcatgcgggtgtcgatgtcgctaatgccaatgatgccatattccttcagcaaatcgcccacgctgtattgagcacgccagttacttggcgctggctcgtaatgtctaacagcaaagccatggacataaggccgtaccgattcaaagtcatcacgagtaattccatagttgccaatcagcgggtaagtcatcgttacgatttgtccgcagtaagagggatcagtaagcacctcttgatagcctgtaatccctgtgttgaaaacgacctcgcctgttttatcaccttccgcaccaaatgatgtgcctgtaaacagcgtgccgtcctgaagtaacaatcttgcctgcatcccgtctcactcctctatattgtttcctgctataaggttctattttttttagtggtttctatttattttgcttcgtcagcagaccataccagtttgccatctacccaagttttcacaggccagcctttgagcttccagcctgtaaaaggagtgttgcgtcctttgctggcaaacgtttgcggatcaactgcctgctcctgctccagatcaatcatggtcaggtcggctggagctccttcttccaggcgtcccgtatccaggcggaagacacgcgctggatcagcagtcatacgacgcaccagaaagtccagcgtccactgtccggtagctacgaatttcgtgtacaacagcgggaaggccgtctcaaatccaacgatcccgaatggcgccagctccatccctcttgccttctcttcctcactgtgcgctgcatggtcggttacgacgatgtcaatcgtaccgtcttccagcccctcgatgcatgcctgcacatcacgtggggagcggagcggaggattcattttccaattcgcatccagcccagggatgtcctcatctgacaataccaagtggtgtgggcatacctcagccgttaccttgataccaaaagatttcgcgtggcggattaaccgcactgactgctctgtgctgacatggcatacatgatagtgtgccccggttgcctcggataacaaaatgtcacgtccgacgtgaatggcttcggattcgttcggaatgcctttaagtccgtggcgcttggcaaattcgccgtccgtcactgccgctccttcaacaagcgtgttatcttcgcagtgtgcaataaccggcatatccagcgctttagcccgcgccatggcgtccttcatcatttgcgcgctctgcaccccgacaccatcgtcagtaaagccgattgcacctgctgctttgagcgcttcaaaatctgtcagctcacgacccagttcgtttttcgtaatggctgcgtaaggaagaaccttggcaagcccggcttcctgtccctttttcaataccagctgaactgtgtcgacattgtccgtcactggacgtgtgtttggcatgcaggcaatcgtggtaaatccgcctttcaccgccgcgcggctgcccgtttcaatcgtttctttatattcaaagccaggttctctcagatgcacatgcatgtcgattaaaccggggatgaccagttttccctgggcgtcgaacttttcgatttcgcgctcctgcctagatgccccttcttccataagtaggctgactccggcatccgcatttgcaatagccaaaatctttccgtcggcgattaggatggatttcaattcaggctcgccctgctcgttcaatacgcttgcattcataattaattgtttcatctgaaatattcctccgctcagttttctgcaacttttcctacgatcctactgacagcttctacagcttcattgcccgttccataaccgccatgcggatcggaaccccgtttgccatttgtggaaaaattcgcgattgttcgctttccacaactgcactatcaatttccacattccgattcactggagctggatgcatgataattgatccgggcttcaggttcgctgctcttttctctgtcaaaccgtactgctctcggtactcatccgctgaccgcaacatcccttcggcatgccgttccagctgtacccgaagcatcatgaccacgtccgcctgtagtgcctcttgcatcggaacataaggcgcgtacgccgcaagatcaggtgcttgcatattatcaggagcgcagaagctaaccttggctccgaatttttgcaaggcccacagattcgagcgagcgacacggctgtgcagaatgtctcctatgatggatactctcaagcctttaagctcaccgaaagttttgcgcatggtgtacaggtccagcagagcctgcgttggatgctcattgttgccgtcccctgcattaaccagtggaacactgaccttctcagcgagctcttgcagcaccccggctggctttaaccggatgactcctgcatcaatgcccatggattcgagcgtacgtactgtatcgtaaatggactcccctttttccacactggaagccgcagcggaaaagttcaaaacctgagcgcccagccgcttctctgccatttcaaaagaaaagcgggtgcgagtgctgttttcaaaaaacatgttggccgcaaagcgtgattgcagtactgggaccagtttttctggttgagattcccaataatgagcgcgatccagaatggactcgatttcatttcggctaagttcctttaacccgagcaggctacgttctttaagttgactggctgttgtgatcatagctgttccccccggttctgaatgattgtcacttcgtccttaccgtccgtctcttgaagggctactacgatttcctcagatttggaggtcgggatgttcttgccgatgtaatcgggacgaatcggaagctcacggtgtccgcgatccgctagcactgccagctgaatcatttgcggtcgtccgcagtgcatcaatgcatccatcgccgcgcggatggtgcggcctgtgtacagcacatcgtcaaagagaatgactttcttatcatgaaccgatacgtcagcaggattcatcaaaagctcttttccatttcctttagcttcggctacgctgctccggtcatcccggtaggctgtgacatccagctctccccatggaattggtgcgccttcaatctcagcaattttttcagccaagcgctgcgccagatgaactccgcgtgttcgaatacctactagcacacaatcgtcaatacctttgtttttctccaaaatttcatgtgcaatccgtgtcaatgcccgacgaatcgcaatttcatccattagtacatgtgtttcataactcatgcttccagcctcctcaggtgatgttcccttcagacctggtcccgtgttcggatacaaaaaagactccttgcccaagtttggcaaggagtctcgtgtgaacagtcttccactgttctccgatctctcggacacactgaagacataccgccgcagcggatgcactgatcagtgatccattcacgttaccttgccagcctcacgggactgatttaaaggtgctattcaggatttcctttgtcctgcttctcatagtgtgagatggttagccatctcttggacaaagttcatcgcaactacaagaagtatgacagattgaaaatcgtgtgtcaacacccgttcaaccggaaccaccggaagcactctaataattatacaacttcattgtataattatccatagttgtttttacccataccttatcccacaataaaaaaaccgccatttaggcggtttaacttaataatttattcaggtttgtgaataggaatgcaaattgtcattgttttagcgactacgcaaggatgctaagacatcctccatatcaggagggatcggtctgttgaattccatgtactctccagtggatggatgcttaaagcccagtaccgccgcatgcagcgcctgaccatccatacgaacccctttgctgcgcccatacatagggtcgccaaccaatgggtgtccaataaatttcatgtgaacacgaatttggtgtgtgcgtcctgtttccaattgaagttcaagcaggctataatctcccaaccgttcaatgacgagaaaatgggtgactgcgtgcttgctgttacgttccgtcactgtgaacaatttgcgatcaccggaatcgcggccaatcggagcatctaccgttccctgatcgtggctcaaatgaccgtgaactaaggctatatatttccgagtcacactatggtccttaagctgtgctgcaagtgatgcgtgagcctgatcatttttagccgccatcagcagtcctgatgtatccttatcaatacggtgaacaataccaggacgtaattccccgttgatgccggaaagatcgtgacagtggtacatcagtgcgttaaccaatgttcccgaagagtgtcccggtgcaggatgcacgaccagaccacgttgcttgttaataacaataacgtccgagtcctcgtaaacgacatccaacggaatattttccggtacaatatctacactttctggctccggtaccgataatacaatccgatctccttcagccagcttgtagttcgccttgatcgccgtaccgttcaccagcacgcgaccatttccgatccacagctgtatctgagaacgagacacttccttcatttcttcggcgatatatttgtctatacgcgttttggcatccccggaatcggccgtccattccagagattcaccctccaattcgtcctcataagacagacctgcactttcgccgttttcattcacttcgctcatgctatgacttcccttcaatgctatcattgccatttcccttttcccgacgcgattccagcaatgtatccaaaataatcagtgctacaccgatgacaattgccgaatctgccacattaaaaatggggaacgtatagcttccaaaattaaattgtgcaaaatcaactacttcccctgaaatagctcgatccaaaaagttaccgactgctccccccagcaccaaacttagcgcaacaggaagtagcttttgtccagccttgactgtttttcgcaggtaccagacgataccaatcaccactacaattgtaatcacgataaaaagccaacgttgaccttccaaaatcccaaaagcggctccacgatttcgatgggaggtgattaaaaagaaattgccgatgactggtatttgttcgtacaattccatccgcgtagccaccaaatatttgactccctgatcaatcaaaaaaataattagcgcaataccaaaataaatcacagtccttcgtcactccgatccgcttatatccgttgttgaacccatttattgtagcataagcattctcagatcgtccacgaatcccgcaagcttcaaatacagatcatccataaaatgaactccttcgcatttgattagaatttcctatgtaaaagaggtcttcccggtgcaaactacatggagcatactcgacacaacgcatgcgcatgtaaacctagaacaaggagaggattccatgtccccattgacggagcaacaattgcagggcttgcgtaacgaactgctggaacgcaaaaaagaaattgagcatcgtttgcaagacaacgaccattacggactcggcgattcccaacgcgaccaaaccggagagctttctcccatcgataaccacccaggagatctggccaccgaaacctacgagcgagccaaggatatttccttactggaacacgacgaattccaattagaacgcatcgaatcagctctgatggctatggaaaaggggacgtatggcatttgtgccgccagcggtaaacccattccctatgagcgcctactggctgttccctataccatttactgtaaagagtacagtcccgaaacagaagtgtctaaccgccgcccagtagaggaagaatttctcgctccctcgttcggcagaacgagtctggatgagcgtgatgatcaaaacggcttcgacggtgaagatgcttggcagatcgtcgaaaattggggtacctctaacacaccagccatggccgaaagtggagaaatccacagttatgatgatatggaaattgaagcaggcgatgataatatgggcttcgtagagccatacgaaagctttattgctactgacatttatggacaaaatgtatctgttattcgcagctccatttatcagcgttatttagaagatggcgagggcgaaggtctactggagccggatacgcacgaagacgaatcgtgaacttcaaagtggagatcgctgcctaataggtggtaagctccaattgtcgctgtacgatccgtacaatatcagcgatataatcaccgataatcggcaaattcaacgctccgagcacttgcagcacataaataatggtagcggcaaaaaaagtaaaacctagcgcgatgccgattccccgggaaacgcctgatattagatttagccagagtaatcgccaaggcttattcagcagcaaagcgtaatctgcaatacgtgtccgttccatctgctctgacacagcacgtatcagcttttcaacacgacttaattgctctgcctgattacctgttttgcttttatctgcggctatgacagccccttctccgttcacccctcggagactccttccctgtctacgccttgatcgtgccgtcatatgcacaatcccccttttcccatggctgccctgaacgcagcaaacgagccgaagcacgtaacggagaaaacccgtttccgatgcttaggctcgtttttatatgctgcctgttattgtattatgggacagggggcttgtaattattccccaatatgaacgccgatggttttaccgttcacttccacatgttctgccggttcggcttgaccaaatgtcacagtagtaaccagtacgttctcacgcaacacagagtcgaagctttcgatggccagacgcagctcattatccacatccaacgtcaacgccacatacttttcaatcggcagatccagttttttacgataatcctgtaccgcacgaaccacttcacgtacccagccctcttgctccagctccggtgtaatgtctgtgttcaacgctaccgttaagccataaccggaagcagaagcgaagccttctttcgcttttttctccaccagcaattcttcggccgtaacttgcagttcttcaccttctggagaagcgacgtttaacactcctttttctacaacagaacgggtatcctcagcagacattcctttgaaaaagttttgtaggaaaccgacatttttgccgtatttcttgcctgctactttcaaattcagtttcagtgtaaaatctacaaagccgctatcgtccgtctccacatgaatatgcttcacgttaatctcatctttgatgatttcctcatagccactcagttcaaagtcctgatccatggacagaatcaactcggacaacggttgacgcgttttcaaacccgtttcgttgcggacgttacgcgccaattcaacgacacggcgtgccgtttccatatctcgttccagttccagatcgatcaaggactcattggcagtcggataatcatccagatgaacactttccccgttgcttaggttgaggtaaatatcctctgcaagcagtggtgtaaatggcgcaagcagtttggcagtcgttaacagcacctcagtcagtgtacggtatgcatccagcttatcttctgtaagaccattgccccagaatcggtcgcgtgaacgacggatataccagttgctcagctcatccacaaacgattcaattgctttagatgagttcaggaagtcatttacagccagcgctttgtccactaccaaaatgaggctgttcagacgggacaaaatccaacgatccaacttatgggccgatggtttgaacggatgctgtgccggatcaaatccgtcgatatctgcatacaaggtcagaaaagcgtgtgtattgacaagcgtatcgacgagcttcgatttagcttcgcctacaatgcctttggagaaacgtttgctattccatggtgcactatcggacagcaatgcccaacggaaagcatctgtaccgtactcgtcaatcacttcccacggatcaataacattacccttggatttagacattttctgcccttgctcatccagtacatggcctgtcgccatgacagctttataaggagctttgccagtcagcatagtcgaaaccgcaagcaagctatagaaccatccacgagtctggtcaattccttcacagatcatatctgccggaaattgctgctcaaacgtttcattattctcaaaaggataatgatgctgcgcaaacggcatggagccgctatcaaaccatacgtcgattacttccggtgtacgagtcatttcgtatttaccgcattggctacgaaccttgatatcatctacatatggtttgtgcagctcgatatccgctggtacgtcgccgatcgcacgttccctcaactcagcaatactatgcggagcgaactgttctccagtttcctcacaaacccagatgttcagtggtgtaccccaataacgatcgcgactgatgttccaatccaccagttcttccaagaacttgccgaaacgtccttcacgtatatgacccgggtaccattcgacttcgctgttgttagcaatcagttgatccttaatcgcagttgttttgataaaccagctgtccatagcatagtacaataatggagtgtcgcagcgccagcagaacggatagctatgctcgtatttttccttgctgtacagcaagcctttttcggacagcattttaacaatatctacatcacagtctttaacaaaacggcctgcaaaatcagtgatttcctctacatagttaccttgaagatccaccacgttgataaattcaacaccattttcacggcatacccggtaatcatcctcaccatgcgccggagccatatgaacgatacctgtaccgctggagtctgttacgaacttcgcacccagaatctgattacccttttcaacctgaaaatacgtaaatggcggggtatacgtttggccaaccagttctgaaccggatagcgtgccaatcacttcatgttcgcctttaatgacgtcctcaaccagatttttagcaacgatgtatacaccgtcttcctgcttcacacgtgcatattccagttcagggttgacggcgagcgccacgtgactcggcaaggtccaaggcgttgtcgtccaagccagtacatattcaccactgctatgcagcttgaatttagccgtggcgctcagatccttcacatctttgtagccctgcgctacttcatgagaacttagcgtcgtttgacaatccgggcaatacggactcacacgatgaccacgatacagcagatctttttcatgaatcgtcgacaaaatgttccatacactctcgatatagttattatccaatgtaatgtacgggttatcgaggtctgtccagtaaccgatcgcttcggttagatcacgccattgttgctcgtactcaaacacgctcgccttacattttttaataaacttttcaacaccgtattcttcaatttcaggtttgtgggagattcccagctgcttttgtacacccaattctaccggcaagccatgcgtgtcccagcctgccttacgtacgacgcggtatcccttcattgtctgatagcgaccgacgaaatccttaattacacggcccagcacgtgaccgatatgcggtttaccgttagctgttggtgggccttcataaaacacaaaatttggctttccttcacgatttgtgatggatttacggaatgtgtcctcctgcttccatttgctcaggatgcgtaggtcacgagaccgtgctttttctttaacatccactctgttcataccgtcatactccctctctgctcatcattgatttctctagcatttcctaaaaaaagcaacaaaaaaagccccatccctgtaaagggacgagactgtgctcgcgttaccaccctgattccgtaaaaacagaccattaaaaatacagtctcatcacggctctctgagccccactcaactacagcagggcgccattataacgcatggcaaacggtgattgcttacacacgccataaatcttaagcgcttcagctcacttctccgggaggatcttcggtcatgttctgaacgttggcttgcaccggaaggccaactctctgagggacaaatcatgacgtactcgttcccatcaacgaattaaacatgttaaattcatcgaaatcagcaacatcgttgccttgaataacaatcatcagccgacagacggataatcattgaattcagtatagtatttacagttatagcctgtttaaagataaaagtcaaccctaacaaagcctgataaaagcttgtcagaaatgaaattagtaaatttctttcatctcacgctcgcgctccagtacttcgcgttcccggttttcaagtgcttcccagccgtcttggcttaacaagtcaagctgtgcttccaccagtgtacgaaaccgtgctcggtaaatcgatgcctgcttcttcagttcttcaacctccaacgcgatcttgcgggatttggacaatgcttcgttcacaatacgatccgcatttttttccgcttccttcacgatcagttgggattctttcttagcgttgttacgaacttcatcagccgcttcctgcgctacgataatcgtcttactcagcgtatcctcaatcgtcgcgaaatgatcgagcttctcctgtacgtttaacaactcggtgctcagttctttattttcacgaataacgccctcgtaatctttgatcacctgatccaaaaattcattaacctgatcctcatcataaccgcgaagccggcgggcaaattccttgttatgtatatccaatggcgttaatggcatgccgtccacctcctataagattgacaaaaaatacattttccgcgtcacgacgctcactatcatctatcggtcatcataccccgttttgtgaatactgtacagagcaaaatcgttccagttcttcgctatagcttaattctttcgacagaaagctcgtgattcctgcctacagctatacaaacttaccaattttgacacggaatcttcccttttttgtcatcccgtctgtttcaagcactttgaaacgcccaaaaccctgcatggaaataacgtcccccgctttaagcggagtggatggattctcctccaccttccaatttacccggcaccgccccgcccgaatcggtgttaatattttacttcggcttagcttgtacacgtcgctggcaataccgtccaggcgcaaggaagcgaccgtcagatctagcgcatctaatgcaacttccttcgttcgcagactcgcgacaggcaacagttctgtccatacatgaacacgatgtacctgctgtaaatgcatcgtcataaaatcaccaatctctgaagctaccaatacatggcacccatcatccagtacatgaatgtccccgattttcccacgtttgattccaagccccagtagggcacctagataatcaccgtgctcaagggtacctattttatgatcgtcagatgtgatggaaaggacctgaatccccatctcctcaccgtccaaatacgaataatcgggcgcaatcagcgcccgctttcgttccgaagccatgtatccgccatctaccctaatcgtgaccttgtcttccttcgaagcaagtgtctccaatatgtactgttggcgcgggtccaaaaaatcagtcagcttctgctcatgataagctcccgcatgactgatccattcggaagcacgatccacatagtcccgttcatccgggtgaaaatgctcataaatctcagtttgcataactcctcctagacgaaattaccaattaaagaaatcaaaccgtacgacgcaaaacgcagagcaatcagcgcaacgatgggcgaaatatcaatcatcccgaagattggcggtataaatctgcgaaaaggagacaaatacggctccacaaacttggcaagtaaatcaccaattacactctctctggcattaggaagccaagacagcagaacatatgcaatgatcatgtacgaataaatctgaaatagccagtaaattacctcgatcaagaaaagttcacctcattctgttaagttcttgttcagtgtcagccagtatttccgtaatagagccttgaatctcaaccgtatctggtgtacacagaaaaatattattcccgaccttggaaataccaccacccagtgcatacacagtaccactcaaaaaatcaataatgcgcagcgcctgatccttgcgaattcgttgcaaattaactacgacggtgcgatgggaacggatatggtcggcaatttcctgtgcttcatcataagaacgcggctcatacaggacaactttcacatttttctgtgaatggatgctgacaacattagtgcccttctggttcttacgtttatcaaagcttggggtttcaatttcttgatcttccggcgtattcataacctctcgctctataacttcctcttcttcctgaagccccagaaagttcatgaacttattcattacgcccaatggaaatcctcctctcgtccgaccagtacggaaccaagccgcagccaggtcgctccctcttcaactgccacttcaaaatcattggacatccccattgacaagtgaacgatgggttctctggtcaaggcttgtccatttaacgtatcccgtaattcacgcaatccccgaaacacaggccgagttttttccgggtcttcttcatgaggagccatcgtcatcaagccaatcacgtccacatgctctaactcgcgaatttgttccaagaagggggcaaccgcctcagaggacaagccatatttggacatttctccagaaatattgacttgcacaaaagctttaactcgcaatcccagagcggctgctttcttgtccaattcctgagcgagcgataagcggtcaagcgaatgtataaatttaaattttccaatcacatctttaaccttattcgtttggagatggccaataaaatgccacgttccccggtcacccaacttgctccatttatcagcagcatcctgccagcgattttcgcccacatgctccaagttgctatccaatacagatgtcattgtcgccgccgaaacatatttcgtgacagcgatcacattaacttcatcacgcgaacgcccgcttcgggcacatgccgcttctacacgggcattcacttctttaattcgttcctccaaagacacgggaggactcacctctcttccagaccaatccaactcgccattcttcctgtgatgccgccttctttgcgatatgaaaaaaacaaatcgctacggctactcgtgcataaggtagtacattcgatatggctcggcaatattcctgctttcatcataatgtgtcgattgcattgtttcaagtcaagtagtgtttttccgtcggttaaggggaagtaaacagaaccttcccatttatcattacccgggcaatcatgctccaaaacctgaatttgactcatcacgtactcatccacctcataggattcagaaccaatagaaggaccaatagctgctagtatatcagacggctgagatccatattcgttctgcatggtctgtaccattttcaatgcaatttccgcaacggttcccttccagcctgcatgcgccaacccaatcacacggcgcactggatcacaaaaatataatggtacacagtctgcataaaaggatgtcagcaaaatgccaggtacattcgtcaaaagtccatctgtgtcctgaaaagcggatgcacgatccctaaagccccgcccgcgatcagcagccttgacgacagcaacatgatgaccatgaacctgctcaccgcacgtccatgcttcagcagcaaaaccaagctgctcagcaatgagctgccgattacgaatgactttctcggggtcatcccctacatgaaacgcacagttcagactagcgtagggcacctcactgacaccgccatgacgacctgtaaaacccgctgttaatccctgaacctgtcgctcccaagattgaatatataacaactccggtacgggacgtccaccatcttgcattggctttgcccccgtagcctcggtattcactacaaatggttccattcattctcacctctactgcccagtgtaccaaaaagccgccgccgtgtcttcacaacacactaaaatacgtagatctgcaagttcagaagccccttcgatcactccgctcttgacgttcgatatacaacttttcttccccttcacccggcggctcttccaatccttccagtcgtacaagcacaacatccgaaccaattttcacaatgttgcgccacggaatgaccaactcgcttccgcctccaaaccagcccataaaacgactgctgcctggaaccacaatggcttcaattttcccctgccgcacgtcaatctccaaatcactgatttgtccgaggcgtcgtccatctacaatgttaatgacatccttggtttgaaactcggaaattttcattgctcttactgacgtttccggtgcactcacacgcatcacatcctttatttcactatatgagcggaagagcccaaaaaatgtcctgtaaacgcaaaaacgatccgagtaggatcgtttttatcgctggatcattcaagcattcatttcattaggactttacatgtttttgcatttgctgtatagccgacttctctaatcttgaaacctgggcttgagagataccgatttcgtcggcaacctccatttgcgtctttccttcataaaaacgcatagacaatatcatcttttcacgctggcccaggcgatgcatcgcttcccgcagagcgatttcctcaatccatgagacgtctttatttctgtcatcactgatctgatccatcacatagattgggtcgcccccgtcgtgatatatcggctcgaacagcgaaaccggatcctgaatcgcatccaacgcgaacacaacgtcttctttaggcacattcagtgcctctgaaatttcaaaaatcgttggttcccgcgagttcagattcgtcagactgtcccgcacctgaagcgccttatatgcaatatcccgtaacgaacgagacacacggatcggattgttatcccgcaaataacggcggatctctccgataatcatcggcaccgcataagtggagaactttacgttttgcgaaaggtcaaaattatcaatcgccttcattaggccgatacatcctacctgaaacaaatcgtccacaaactctccccgattgttaaatcgttgaatcacactcaggacgagccggagattgccgttgaccaatttttctctggctgatcgttcattattttgctgaagtgatgtgaacaactcgcgcatttctgcattggttaataccggcagtttggcggtatccacaccgcaaatttccactttatttcgggtcatcgtgtcttacctcccaaggagcaacattaatgtacattatctcctgagggcatttttttattcgccgtttccatcgcttccggatatacccatgcactataccattttattaaattcttttcgtaagcgctttataatccgcttttccagacgcgaaatatacgattgcgagatacccaacaggtcagcaacatccttctgtgtcttctcctctccgtcttgtaagccgaagcgcaactccataatcaaacgctctcgatccgtcaatttatccagtgccttatgcaataatttacggtccacctgctcctcaatattacggtaaatggtatcattttccgtgcccatcacatcagaaagcaacaactcattaccatcccaatctatattcagaggctcatcaaaagaaacttccgttcttgttttactattgcgacgcaaatacatcagaatctcattctcaatgcatcgagaggcgtatgtggcaagtttgattttcttctccggatcaaaagtgttaaccgctttgattagtccaatagcaccgatggatacgagatcctcaatgttgatgcccgtattctcaaatttacgggcaatatatacgactaaccgcaaatttctttcgattagcatcgaccgtactgccgcatctccagaagaaagttttcccagcaaatattcttcttcgtctctcgtcagcggtggggggagcgcctcgctgccgccaatataataaatttcttcacttttcagtccaaataaaaataaaatacgataatattgcaattgcaatgctaacctaattttcatcttcaatttcatctgttcccgcatatcattctcccccttttgaaaatagtgcaattccagctgtgctccgcccatttcaccattggatatttctcgtcgccttcaaacatcattttgtgtttatgctctgtcatcctgattctgtaaaatgctcaccaaaatgtgcatctcgtttctggttggtatcagcactgccctcttcttgtgccgtcacatccgggtggatgatggcgcgatacttaccctctgccgacaatgttcccccatccaagccaatcaacactcgatgatgtacaaaatgaaccccattcatcgccacctctacccggtctggtttaagggccagcataaaggaatgattgcggttaattccacgataggggacgagacgaacacgatcctgccaactaaacgattcgtcccccagttccatcaccagttggtcagcattaccctcagaacattttcggagccaggaggcgggcaaatgcgattcccacaaggccgcctccatgaccatcacgggggttcgggtcaaaggatcatagagctgattacctgtatccaacaagcctgtacactcaatatgatcctgcccaatccatacctgcacttgtcccaaaaacccactcatcctttctgtgcgctgctttgaggactgcacaatacgaaagaaaagcatcactccgccaaatgcgcataaaataaaccagaatgcgattttgagttcaaaggacattccacccgaagcggtgtaccagatgccgttaaacaattcccccgtattttggagaaaataatgcatccccaaaatgccacctgcagctacaaaattgatcatgtaaaaagcacccattgtacgaagatacttttgcatgctgccaaatccaaaagccaccagcagcattatgaccgataatgccagtttgatcaggaacgtaaataaaaaggacaattccggcacaaacatcatgacgacatacattgcgccgattccagctgaagtcatcaacctccaccacactggacggatttttctcatccaagcggtgaccatcagcaacacagcatcaatgaacaaattggccaaaaaaatcaagtcgatataaacaaccaaggcttcacccgcccagcgtttgcaggataggattaagtatagtagtcatgctgttcaaagtctgtctaacggtggggacggtgaccgactaattttgtcggaaagaggagaagcgcctgaactgcaggacacggaaaacagaaagaagcccgcatctccagggagaatgcgggcaatccgaattgaaactagttatcgttattattattgcgcgaacggttacgtaagaatgtaggaatgtctaattggtcactgctttgagtgttaccaaatggacgcaagttaggagagcctttttccgccgattcggaagtagccgggttggctgccggtttacgtcccggtgctggttgacttggcttgccttcaaagccagtggcaatgacggtaaccttgatctcttctttcaactcttcgtcaatgatagcaccgaaaatcatgtttacttctggatcggaagccgatgttacaatttcagcagcctcattaacctcatacaaagacaggttgttgccgccagtgatgttcataatcacaccacgagcaccttcaatggatgtctccaacaacgggctcatgatagccttgcgtgctgcttcagccgcacgattttcaccagttgcttcgccaatccccatcaaagcggagccacgctccgtcatgatcgtcttaacgtcagcaaagtcgaggttgattagacccggtacagcgatcaaatctgaaataccttgaaccgcctgacgcagaacattgtctgcttcacggaatgcttccaacattggggttttcttgtccacaatttcaagcaaacggtcattcgggattacaatcaaagtgtctactttttcttttaatccttcaataccaagttcagcttgatttgaacgcttacgcccttcaaacgtgaatggtcgggttaccacgcctacagtcagcgcgccgcattccttggcaatttcagcaatgacaggagccgctccggttccagtaccgccacccattcccgccgttacgaataccatatccgcacctttgagcgtattcataatgagctcacgcgactcttcagccgcttttttacccacatcggggttagcgccggcacccagaccgcgggtcagcttatccccaatttgaagcttatgctcagactttgctaaatgaagtgcctgggcatctgtattgactgtaatgaactccacaccctgaacaccattttcgatcattcggttaaccgcattgctgccgccgcctccgacgccgatcactttaatttgagccaagctctccatttcaaaatcaaattccaacatactattccatctccccctcaatgtgcatggatggcccgtccatgattggcataattagcaatgaacgttatataaattcactgaacatattttttaagcgttcaatcaacccctgcttttgctcgccttccgcagcgggactactgctacttttggttcggttagtcggcttcttggtacttccgccactgttgctaacgctagtcgatcttccgcgatagtaacgaatagcattatgcaagattccaactccgctcgtgtagcccggatcccttacaccgataaaatcaggtacggcgatccttacggaagcggccagttcgctttgtgccacctgaagtacaccaggcatggagacggtgcctccggtaagtatataacctcccggaagctctgtgtaacccaagcgcttaacttccgcctgaatgagttgaaaaatttcctgcactctcggctcaataatagcagccaaatcctgctggttgaattccttatccacattactgccgatacgcgtcactttaaagacgacatcggctgccgcatcatcataccatgcgcagccgtatttaagctttactttttcggcttgatcggtaagggttctcagtccgtaggcaatatcattggttacaaattctccaccaatcggaagtgttgatgtggcaacaatcgttccttcctggaaaatggcaacattcgtagatcctgcaccaatatccaccagcactgaacccatcaccttttcatccttcgaaagagacaattgtccggctccaagaggcagcaagaccagatctttaatcctcaagccggctttctcaacgcagcgcaacagattatgtatcggggtcttgcctccagtaacaatcgtagcctctacttcgagacgaactccaatcataccgcgagggtcctgaatgccttcaaggccatccacgacatactgcttggctaccacgtcaataatttctctctccggtggtacggcaataacctcagctgccttcagtacacgctcaatgtcctcctcaccgatttcacggtcctcgttggacacggctactacgccatgactattttgcaggccaatatgattgcctgaaatccccacatacacttctgttatttgaataccaaccatgcgttctgcgtgatccacggcgttacggattgattgcacggtttgatcaatgtctacaattgcacctttgcgaatcccttccgagtcggcagatccaactccaataatattaaaggttccattattcatttccccaataatagcccgaactttggatgtaccgatgtccaaactaacaatgatgtcattgttgctcaagtctgtggcacctcctgactccaaaatgaatttcgttctttaaacacactctgtacatattcaacaaactccatgctttccctcttttttctacaaattttttagaagccaatttatggttgcagtcacataaaaatttgaagaaaaaagaaggaggcaagtctattacccataaaatcaattctagcattttttcacatcactgagtagtatctttttcttggccctcttcactcgtatccggtttgaacggaacgtaggaatccgcctccaacatggtgatcaaacctggatcttctgtttctagcacctggttcaaatagctgattttagaattcagtagagaaacagttgtaataacctcaaactgggaacgtgtgtacattttgatgcgatccggaaaagaaggaatcggtgcgggaatgatttccgaaatatcggctgtccattcccccggaatgcgcgataaagcatcacacagcttcgctttgtacggatcatcagatttccatttagtcaaaataggcttctcaacagctattccgctacttcccacgctcacgcttgtcccattcgctagaatagcacgaaggctcccatcactctgcaactcgtaagcgaccgtagcaaactctttaatgtgaatagcaataatacccggaaactgcttgtccactgtgacttgctgtatcgattgaatttcccgcagcttctcagagatgtcggatgaactgactccgaaatactggtctccaacagccagaccgcttcgattaagaagctgatctcgggtcgaaaatacattaccatcaaaacgaatttcagaaacccgactcaacgaagaacggaaaaagagaacagcgagcagtacgataaacaacaaaatgagaagaatagcaatcttccggcttgttctttttttcgttctgttctttttaagaacaggtatttgagcatttggcatagcttctctccacaaaagccttttgtccccccgttaacggagggacattacaggcattaatttacgaaatccaggtgctccggcaccggagactgacggctcattcgggcacccagtccctggaaaagacgttcgatccggtcataccctctgtcaatatgatgaacctgctcgacaatagtacgtccttgagccgctagacccgctatgaccagcgctgcccctgcccgcagatcggtagcctctaccgtagccccgtacagacgagaaactcctcttataaaagcagcatttgcatcaaccgtaatatcagcacccattacatttagttcatccacatgtttgaatcggctttcgaagacggtctctttcatgacactaaatccgtccgccaaagaaagcagaaccatgacctgagattgcaaatctgtcggaaaagacgggtaaggggaggtaacgatcctctccactgctttgggacgactcatacaacttacggtcattatatcattcaagatgccgatttgaacaccagcccgcctgaggacgtgaatcagagcagacaagtgggatggattgcagtgggtcagcgacacacttcctcgtgtagctgcagctgcaatcataaccgttccagctactatgcggtcaggaatgacctcatacgtacacggattgaggcggctgacccccgtgattgtaatcgtgtcggttccagcaccaataatacgggctcccatggcattcaagaagttttgcagatcctgaatctccggttccctcgctgcattggtgatcgttgttcgtccttcagccaacgcagcggccatcataatattttccgttgcacctacactcgggaaatccatgtggatgtccgagccgattagcttgtgggctcgaaacgtaatttgctcgtctttttcctctatctctgcgccaagagcttttaagccctctaggtgaagatcaattttgcgctcgcctatggcgcagcctccgggctggtaaatggaaacttctccatatctggcgagcagcggtcccatcagaaagatagatgagcgcatttgcttcatcaaatcttccggaatttggaacgttcggacggacgacgtatccacgtataccgtttcctcttcatgtcggcatgtacagccgagtctttcaaggatgcgcagcatgaccttaatgtctaaaagatggggcacattccgaatttctaccttaccttgtgcaagtaagctcgctgcaagaataggtagtgccgcattttttgccccatggatacgtatggtgcctgacaggggacggcctccctcaatcaccaatttgtccaatgtatcacctccgagtttaccgctcacccactacgaaaacctccggaactagcttgatgccggtttgagatgatattgtactttgaatatgcttcattagggtaagcacgtcctctgctgtcgcttgaccggtatttacaatgaaattggcatgctgtacagatacctcagcgcctcccgccttcaagcccttgagacctgcgctctcaataagacgagcagcatagtcacctggaggattacggaacacgcttcctgcacaagctaactgtagcggctgggtcagccgacggcggtctttaaaagccgcaagcgctgatgaaatttcctcccgatcgccccgcttcatccgaaacactgcctctgtcaccattccacgttgctcatgcaacacggagtgacgatagctgaaatgcatattgtcagcatcgtacacagccaattcccctgtatccagcacaatctcagcggactggaatatttgtgacacatcagacccatgggcaccggcgttcatgtagacagccccaccgactgatcctgggataccaccagcaaattcaagaccggacaggccctgcttgctggccataacgcacagtttgaccagtgaaacgcctcctccagcaacgatctgttcatcctcaaaatgaacataatcaaagcctggccccagcttgatcacaagtccccgtatccctttgtcagagacgagcatgttggagccccgccccaactgcatccagggaattccgtgctcgctagccagcttcaaaactcttgccagctgctctttggtatccgggatgacaagtgcatccgcagggcctccaatcttccatgtcgtatatttggacagcggctcatgctccagcacttttccgatatcatgctccgctaataatggcatccattgctgcattgtactgaaacctccttgttgcttgccccgcatggttgtaaggctctcacctgacaaccggcagcctgagtgatggtcacaatctatagggtatcctatgtaaataccatccggtgtgtgacaaccgcccaattctgcgctgcagactaccttttatgggcaagacgttccatttcttttactaaaatatctgctgagtcaggcttgccgagcgcagacgccgactctgccatgcgacttcgccgtgcctcatccttcataattcccgctatagattgaaacagagccggaccactcagttccttttctacaatcatgacggatgcgcctgccttttcaagtgtacgagcattagcctcctgatggttattcgtcacattaggtgatgggatcagaatggacggaatgcccaacgatgtgatctctgccaagaaggaagcacctgcgcgattaacaattaatgaggtacaagccagcacctctggcatattgtgaatatagggaagcacatgtagatgattgggcaatgagccgatctgattccgtatgctatccagcgtttgctcataataagattcaccggttacatatacaaaatggacgtctttcagttgtgaaagttgcggagccattgcaatcatggcgtcattaatggccttcgctcccctgctgccaccgaccacaaggacgaccgaactgttcatcggaaccccaattgtagcaaatccccgatcccggttagccaaacgaactgttgtagcacgcgggttcccagtgtacagtacatttttagctttggggaaagctccttctgagccttcaaagctaacagccactgtatccacatagcgactcagaaatgtattagtcaaccctggaattgcattttgctcatgaataatgctgggaattcccaacttggaagctgcataaacgacgggtccgcatacatatcccccagtgccaataacgacatctggcttaaatttctttaataatgctttggatctgcgaacccctttgaaaaagcgcatgatcgtttttatattttccacagacaagctgcggcgaaatcctgtgatatcaatagcctcaaatggaattttttcctgaggaaccaacttgctttcgagtcctcgttgaccgccaatgtataaaaattcagcgtccggatcaatctcttcgcactgtctggctacggccagcgccggataaatatgccctccggtaccgccgccgctcaacacgacgcgcataaacgttcacctcgcataacgtgataaatttagtaaaatgcccagagctgttagcattaaggtcagagaagaacctccatagctgattaagggcagtgttattcctgtcaccggcattaaaccgataacgacaccaatattaatgacgacctgtacggcgaccattgcgacaatacccaccgcaagcaaactgccataggtatccggaatagttatagcgacacgcattcctctccatacgaggaccaaaaagagccccagcaccgtcattccaccgataaagccaagctcctccgccaaaatggaaaaaataaaatcagtttgcggctcaggaacgtagctatatttttgtcgactcatgccgagtcccaagcccgccagcccgccaggaccaatcgcatatagcgattgaataatttgatagcctgcgccaagcggatcggaccaagggtccagaaaagcggtgatgcgctggagtcgataaggcgcagctgcaatcagtgcagcaaaccctgctgctcccgacaaagccagcagaccgagatgcttcatacgcgcgcctgccgtaaatacgatgagcatggacgctcccatcattaccgtgcctgtgcccaaatcgggctggagcataataagcccaaaagccagtcccatgagtccaagcgggggcaacaggccgcgcgtaaaagagctaatatcatagtcaggacgactgagccaacgagcgagaaaaagaatcatacccagcttcataaactcggaaggctgaatgccgaaagagctaataccgagccagcttcgtgccccgcctcttactacaccaatgccgggaattaatacggcaaccagtagcgctagacagatcaacaacacgaccttggcatatttctgccagatccggtagtccgttctggcagtaaagtacatcgctacaaggccgagccctgcaaacagcaattgccgctttacaaaatagtaggagtccccgtactcgtgaaaagcgaggacggcgcccgcactgtataccataaccatgccgatggctaataagcttacaatacaaacgaaaagccatagatccggcgctggacgagattgcttcatcaggaggccaccccttgcataaaagtaggggcttatccaacccccctacttacaatttatgcgccgcctctttaaaaatacgtccacgctcttcataggatcggaacatatcccagcttgcacaggcgggtgagagtaatactacatctcccgtctcagcaaattcagcagccttgttcacagcctccacgagcgtagcggcggcatcctccccattatcgacgaccttgacatgctctattccagcctgatgggcccgctgagccagcttatgccgtgtctcacccaagagcacaacggctttcacaccttcctgcaaggaaggtacgagctctgtataatcagagccgcgatccaatcctccggcaatgagtacaatcggttgcttaaaggaagataaggccatcattgttgctttcgaattggttgctttggaattattgtaataagctacaccagcgtgttctaaaacatattcgagccgatgttcgacgccgcgaaaagtacttaatggttccgccaaattcgttggttctgcgcctgcagcaatggcgattgcgcaagcagcaagagcattttctacgttaaaacgacccggaagtccaatctcagctacgcctataatgggatgcagcacaccatttccatcgcggtatacgatgctacgttcaatatcatccgtcacatccggtatgtatggcgggtcagcgaacaacccttcctgcaaacgttctgtcatagagaacggaagcagcttcgcttttatatagggtacgagctcccggcagacggggtcatcccagttcaccaccgcagtatccgctgccgtttgattggcaaatagacgcgccttggatgcaacgtagtcctccatgcctccgtggtagtccaaatgggtctcagctacattgagcaggcaggccacagtgggcttgaaatcttttgttccttttaactgaaagctgctcagctccacaaccatccactcgtccgacttggcatccacagccgcctcacatacgggcgtaccgatattaccagccacgattggattcatgccggatgcttccaacagcttgcctacccaagtggtcgtggtcgtctttccgttggagccagtaattccgatgatcggagctttacatagatggtaggcgacctcaacctcggtcacgacctcaatgccgagctcgacagctttctgtacgggaggggccgtataaggaatccctggatttttgacaaccagcttcactccaggatgaattagcccctctgggtgacccccgcataaaacggaaattcccaaagcctctaattcagaagcttcgggacattgttccctatcttttttatcattgactgtcagcttggctccggcctggtgcagcaccttggcaacttgcacgccgcttttagccagaccgataatgacgacttcctgatctctgtatgcgtctggatggttcatttgtctacaaccccttgttgagataaagtccgagtcctgccaacagcagtcctacagcccagaatgtaataactacgcgccattcggaccagccggacagctcgaaatgatgatgaatcgggctcattttgaaaatacgcttgccacgtgttttaaaggaagctacttgcaagactacggacagcatttcaattacgaatacaccaccgataatgaggaacaaaatttcgcttttcgtaacgatggcaatggcacctatggcgccgccgattcccagcgagcctgtgtcacccataaacaccttggcaggatgagcattatatacaagaaatccgagtacagcgccaatcatagccgctgagcatactgctgccggaagcgaggttgcctgaatcgcgacaatggcataagcagcaaaggcaatggcacttgtaccggacagcagcccgtccagcccatccgtgaaattgacagcattgctaatcgccagcatcatgataatgatgaacggataataaaaccagccgccccaatcaaatgaccatgatgttccagggatgccaatagcggtactatgatcattgctaagcagaagccagcacataattgctccaaacaataattgcccaaacagcttttgacgcgccgtcagacctaacgagcgtttgaatacaattttgatatagtcgtccaaaaagccgatcagcccaaaaccgagcgtagcaaccagcagaacgtaaaagtccgtatttttgatagctgaaaacttaagaaaggtcagcgtaaaagccaccagaatcacgataccgcccattgtaggcgtacctatctttttaagatggctttgtggcccgtcatcccggacctgctggccgaatttcattcgccgcagcagcggaatgagcagtggagcggcaatgaccgccagtataaacgatacgacgatcgtcagcagtaataattgaatatccatgggagtctccctctcgtcaacatcagttctgtagcggaccgtttttcagcgcatccacaatttcttctagtcgcatccctctggatgccttaaccagcacaatatcattggcgtggagatgaacctgcaaatgctggatcagctcttgcttatctgtataagggtgcacgttagcagttggcatcaacccttgcgcaccctgcgcaatcgaagtgcctaacgcaccgtaggtatacagtacctctacgtcgtgctttgccgcaaaaattccaatttcctcatggaattgcttttcctcaggtcccagttccagcatgtcaccaagtacggcgactttacgtccgtccgttttatacgcagacagcgtctgaattgcagccttcattgaagccggactggcattataagcgtcgtttagcacggtaagtccattaggacagttcacgacctcaatgcgcatgcccgtcagttttaaagacgacaaccctttacgtatatggtctgcatcgacattgaaatgacgcgctaccgccagtgctgccaaaccatttacaacattgtgctgtccaagcaagggaagccggaaagcctctttgccagattgggctgttatgaataagctaccttctccatccgaagtgatttcagtcggatagtcatcgttgcctgtagctagcccgaacgtaaacaattttaaaccttcaggcttgaccgtttcagactccgccaacacttgtgaaagcagtggttcatccccattgtagatcagcaaaccaccaggcttaaggccacttgtgatctccaactttgcacgagcgatttccgttcgagaaccaagctgcagtaagtgcgattcgcctatgttcgttatgatagctacatctggttgggcgatattagccagcagacgaatctctccgcgcccactcatgcccatctccagaatgagaatatctgtatcctgcggcatggaaagtacagttaaaggcaaaccgatatgattgttataattcccttcggttttgtgtactttaaaagtcgtgcccagcagagcgtttacgatgtctttcgttgtcgtcttgccgttgcttcccgtgatcccaacgacagaaacgccaatttcgcgtaagtatgcagctgctagatgctgaagggcttctagcgtatcctctacctcaatagcgttctcagccggaggtgctccatgatccttttgccataaaaatgcagctgcacctgcctcgcttacgatctgctgcacataattatgtccatcaaaccgttcgcccacgagtggaacaaacaacccttggctctgcggcctgcgagaatctgtaaaaacgccttcgaccatctgtttggcgtccgcttctccatgaagtgttcctccacacatagatgcaatctgaccgattgttcttttcatcacttggataaaccccttatcgcttctttggctacgatgcggtcatcgaattcatgcaccgtttttccgatcaactggtaagtctcatgaccttttcccgcaatcaatactacatcgtcagggcttgccatttcaacagctttatgaattgcagttctgcgatccacgatcaattcatatcgttctgcgggtacaccttcgtcaatcagcccttgttcgatgtctttcaaaatcactttcgggtcctctgttcgcggattatcggaagtaataaacgaatgatcgctgtaacgcgcagcaattttccccatcaacggacgtttcgtacgatcccggtcaccgccgcatccaaatacacaccatactttaccaaccgcaaattcctttatggttcgaaggacattttccaatccgtccggtgtatgggcataatctacaataacagcaaagggctgacccgcatctacaggctctacccgcccatctacgcctgcgatagactctagactgcgcttgatatccactagcgagattccttccagcaaagcagcggtaatggccgccagtgcgttgtacacattgaacttgcccaccattcgaagctcaatatcggtatttcctttaaaagtagacacatggaaggaggttcccttggaacctatagtgatacgagatgcctgcacatcagactccttttctacgccgtatgtaatcacttgggccgcagtttgagcctgcaaataggaagaagccggatcgtctgcattcagaacagcatatttactatctgatgcatcccgcgagaaagcatttcccaacctagagaacaaaagtccttttgcagcacggtactcctccattgtgttgtggtagtccaggtggtcctgcgtcaggtttgtaaatatagcagtgcgaaaatcagttcctttgacgcggccctgctccaacgcatgtgaggatacttccatgacacagcattgaaccccctgctctgccatatttccgagataacgttgcagttccaccgcttcgggcgtagtaccagacattgggtaagactgacccccgtaacgcatttgaatcgtaccaatcagtccggtgttcaccccggcatccttcatgatcttttcaatcagataagttatcgttgttttaccgttagttccggttatgccgatcatgcgcatgcgtcggctcggtgaatcaaacatataatccgccaaaaccgccatggcatgtcgtgcatccttaactacaagctgcggaacaggtacatccagttcccgttcaacgaccaaagctgccgccccggacgcaattgcctgctcagcatagtcatgtccgtccactgtaaaacctggcaaacatagaaataaatctccctgttgcactcgacgtgaatccgccccgattcctcggcaatccactgtaccgtcacccaccacacgggagacggccagcagtgaagccaattgttgaagctgcatctttcattcctccattgctctctcgttattcatagtatggtataaaatgaacctatcaatcccccatgtaaatacggatcgttgatccccgctccaatctggagcccggcttcggcgcctgactcacgaccgtcttgcctgacccagatttcacgagcataaagttcatattcatatcttcgtacaaatcagctgcagtagcacctaccagatcaggtaccgtttcgatcggattttctccatacttgtactctttggcaatttgattggtgcgaggcggtattttcaaggcaatcagcgcgtcctttaaaatattttgcacgattggcgcagcaaccaccccgccgaattgaatgcccttcgggttatcgacagcggtatagacgacgatttgcggatcatccgccggtgcaaaaccaataaaggatacaatatgctccgaggaagaataacgcccgttaatcaccttttgtgctgtccccgttttacctcccacccggtagccttcaatgaaagcaggacgacctgtacctttagcaacgacgctttccagcgcttcccttacctgtcgggaggtttcctctgaaataaccctacgtatcagttctggctctactttttccagcacttttccggttcccggctgaacccaaccttttgtaatgtgaggcttataaagattaccgccattaattgccgctgatacagccgtaacctgctggatcggagtaacagacaccccttgaccaaaagcggttgtcgccagttctacaggaccgacctgaggtagtttgaacaaaataccgttgccctcaccaatcatgtcgatccccgttttgctgccgaagccaaaattgcgaatgtatttgaacagtgtttctttacctaatcgctgccctaatgttacaaaaccggggttgcaagaattctccaccacttgaaggaaagtttggcttccatgtccgcctttcttccagcaacgcaggcgtgctccaccgacttcaatatatcccggatcaaaaaaacggtcatttttgagattgaccttcttttcttccaaggcagccgccagtgtaataattttgaaagtagacccaggttcatatgtcatccagataggcagatttcgattatagatttcaggcgcatattgcttgtattgcgctggctcatagcttggtcgtccagccatgcctaatatttcacccgtcttagggttcatagctatagacaatgcggacttcgcctgaaatttgaccatggcttggtcaagctcccgttccataatggactgcacagacttatcaatggttaattgtaaattcagtccatccttcggttcaatgtatttttcagaagaaccaggcattagacgaccacctgcatccgataaatacgcaatgcttccgtcgattccccgaagcttactgttttgctgcttctctacgcctgtcagcccttgattatcaattcctgtaaacccaagaatatgagccgctagatcaccataaggataataacgtttgttgtcttcagcaacaacgatacccggcagcttcaaatcacgaatttgctgcgctttctccatcgtaatttttcgtccgccgggctgaagtttttggcttgctgttcgtttggtaatcagcttgagtactttatcctcactcatatccagcaagggcgctagcctgcgtgccgtttcttccggcttcttaatttgtactggtatcgccatgactgtcggcgaactgacattataggtgagcgccgtaccctgcctatccaaaatttcgccacgcttggcggcaaatggaatattgcggcgccacgaatcctcagccttggccgagagctcgcctcctttacccaattgaacataggcgagccggatcgacaaggccgcaaacagtacaaataatcccattagcccccataccagcctccgccgcatggtcacgttagattttttcaaacgcgctccctccgttcctcaaatactcatgacatgtcttacctcatgaatattcaaaagaacggacattagaacaagctatcagttatcctcgcctttaatcgcagcagcactttcctcatctgcaacagcagatattcctcccttaggagctcccgagtctgttccagcatcagcagtagtaccggaatcggttttagtatcgacctccgtttttgttgcactgccggtctggttagctgcaactccattggtcgagtcctgtgtttcctccggtttcactccggtcaccgtttctttggccggctgaagcgtcacgctgacgatccgctttccatttaccatttgcgccttttgagagacaacataaccttcgccgcttacctgcacaccaaccttcataagggtcagaacttgaagtgtgtcacgcaacgatacacctgtaaaatcaggaatagtcatgttggcactatcctcagtcagcaagtaaatgcgttgtccgggtttcattttgacgcctgcttcaggatactggcgaacaattttggagcctttgcctaccgtttcataggcaattccctgtttgagcaatgcattttgcgcatccttcttcacctgaccagttaatgttggtaccgttggcaaattcactgtttttacaacagcggcacctgatttattcgttttagttcccgtttttggaacccccatatattgcaacgattgggatacaatttttttaaatacaggtgctgctgctgtaccgccgcctaccgatttgttaggttcgtccataacaaccaaaacagctattttcggatcatttaccggtgcaaaacctataaaggacacgacatccttcgaatggtcatatacttttccgacgaccttcgtcgccgtacctgttttaccagctacacgatatccgtcaatataagcaaggcgtcccgtaccaatttcttggtcagatacgacctgctctagatagctgcttgtctggactgccgattcccgagtaatcacttggcgtacttccttcggttgaatcgtctgaacttcgcctgtatctgggttgatgatttccttcaccagatgaggctgcatcagcttccccccgttagcaattgccgagatggcagctacctgctggattggcgtcacctgaacacgtccgtgtccatatgaagcggttgcgacctcggatttgtactgggtatggaatgtaatagctccggtagactcactcggaagatcaatgcccgttttcacgccgaatccaaagttattaatatatttcttcagtctctcgccacccaacttatccagtcccagatggacgaaaccaacgttacttgagcgcttgactccctgaagataggttaacgttccccagttgcggcttacatcacgaatatcccagcctccgacccgaatcataccagattggtaagattcatttggattgaacaccttttcttgaaccgcagctgccaaggttacaatcttaaacgtggagccaggctcgtagatagattgagtagcattattacggaaatattccaagggtgtactcccatatgtattgggattaaaattcggataagttgccataccaagaacatccatcgtctggggatcagcagctactacagtcatcgttttagggttgtattttgcaatagcttcctgcatggcatcctctatataatactgaattgtatcgtcaatcgtcagctttaaatttttaccattttgtgccggctcatagacactttccgatccttgaagaggaactcccttccgatcccgctgatacagaagctttccagccgtccccgagagctctttattataataagcttccaaccccatacctgctgtgccatcttttctttgatagccaagaacatgggaagccagcttattttccggataatagcgtttggattcttgaacagtgtccacagctccaattacttcatacttatccttcaaatactctttgaacgtatccacttgtgccttgatctcagggtctaccttccagcccccattacgaatctcgcgattttttaagtagttcccctttttatcctttgcagaaagatgtcctctcagctcatcctcaggcgttttgagtaactggtgcagcttagctacaacctcattctccaaatcatactcctgaatgatgctaggattgacaactaccgtataagccggtgcatccgtagccaatacgtttcctttacggtccgtaatggttccacgcttgggctgaatgacctgatctctttcaacttgattaactaccaggttatgccagtactccccgctcacaacttgaatccaaaataccttaagtagcagaacaagaaaaaagagggtaatacatccccctattagcagtgtgcgaagctttattcttttgaccatagctcaaacctctctgcaaaaaaatgtacgtcagagcatagcttgatgctatgcccttaactatttggcagcctgcttttccacacgaatgggctctcttgttggttcgatatatccctgttgctttgcagtcggcacgatctgattttccagacgctccttttgcatcttcagttgggcgatattggtctgtaatttggaaatgtccttgcttgccgtattaatcgaataattgatttgataaatgtgagcgtacctgctaatcaacataccagcaatgacaatgcacgctacaagtgtcaatagatacagcagcttttctcgaatcggcagctctctgcggcgtgtaacgactttggtggtctcacgataccgttgttgctgaacctgttcctgacgggctctttcttttacagccaaattaccgcgtgtataagccatgtcgcctctccttctccattaaatttacaatttctcggcaactctcagcttcgctgaccgggaccgaggattaagctccagttcctgctctgacgccacaatcggcttacggttcaccagcttcagatcgccttccattttgtcttccaaaataggcaaatcagatggatagatgcttttcgccaaatactccttgaaaatatgcttgcatatccgatcctccagagaatggaatgtaatgaccgaaattctgcctcctggagccagacatcttactgcctgatgcaaagtatcttccagtgcacccaactcatcattcacagcaatccgcaaagcctggaaactgcgtttagccggatgtcccccggttctgcgtgccgcagccggaattccttctttgataatatcgacaagttccccagttgtgtgaataggcttgttcaatcgacgttcaatcatgatctttgcgatccgccgtgaaaacttctcttctccgtaatgaaacaaaatacgcgcaatctctgcttccgaccattcattgacaatttcgtaagccgtaagcgagctactctgatccatccgcatatcaagcggcgcatcatgattgtagctaaatccccgttccccctcatcgaactggggcgaggacacacccagatcgaacaaaataccctggacctgcgggacgccgtctttctcgggcaatcccaattcggtcagcttgtcctgcaagtggcggaagttggatttcactaatgaaatcttgccttcataggctgacagcttctctcgcgcattgttcaatgcccagtcgtcctgatcaaaggcaatgagccttccctcagggccaagctgtgatgcaatgacggaactgtgtcctgcccctcccaacgtgcagtccacataaatcccgtcctgcctgatgtttagtgcctgtgttgcttcttctttgagtacggtaatgtggtgaaacaaacggctgacctcctaaattacaattcaaagttgaaatcaaccaatttctcagcaatgtcgttaaatgcttcttctgattggttgaaatattgctcccaagtgtgcttgctccaaatctctaaacgggtggacactcccaatacgacgcactctttagtgagcttggcgtattcgcacaaattccccggtaaatttaccctgccctgtttgtccaattcgcattcagtcgcccccgagaaaaaaaaacgggtaaacgcccgcgcatcggccttcatcagaggcagtgctttaagttttttctccatgacagcccactcatccatgggatacacgaagaggcattggtccaacccgcgggtaaccacgaacgaggcaccgagaagttcacgaaacttggccggtacagtaagccgacccttctcatcaatgctatgttggaactcccccataaacattggtttcgtcaccccttaccccattctcccactttggcccactttccaccacctaagcataatagattcgctttaaaaaatcaaagacctctttttcattaccaaaaagtgatagaagccggatccataccattatgtctgttattgtagccccgcgtcacaagatgcaaaaaagccccttatcccatgaagccggcccccgacaatatgcatcaggtttcgaaacaacacggaataaagggcttactctctgtccattatgtcaacctaaacaaatacttgcattaaaaacgcaacactttgcagcgaaaatcgtgatggaaaatccgattacgcgttccagctgtccaaatagatcttttggtcttcagttaacgtgtcaatttggattcccagactatcaagcttgaatcgagctacctgctcatcaatttcataaggtacattaataacggctttgcctagctcattgtaacgatcattcacatatttcaagccaagcgcctgaagcgcaaatgtcgtatccataatttccgcaggatgtccatcagcagcagccagattcacgaggcgtccttctgccagcaaatacattttacgtccatctttaaagcgatattcctcgatattgcgacgcaccgtacgaatggattcggaacgtttagcaagctcaggcttactaacctccacatcaaaatgccctgcgttacacagcacagctccatccttcatcacatcaaagtgttctcctgtaattacagccttgtttccagttactgtaataaagaagtcgcccagtttggcagcctctaccatcggcaagacatggaaaccatccatatgggcttctactgccttgatcggatcaacttcggttacaacaacgttggctcccagccctttcgcacgcattgcaactcctttgccacaccagccataacctaccacaaccactgtacttcctgctacaaccagattagtcgtacgaataatgccgtcgaaagctgactgtcctgtaccatagcggttatcaaacaaatatttgcagtaagcatcattaacagccaccatcggaaagtgaagttgcccttctttttccaaagccttcaaacgaataatgccagtagttgtctcctctgctcccccacggatcgtagaaatcagatcaggccgttcggattgcaacagagtaaccaagtcaccaccatcatctataatgagatccggctttgtttccagtgccttaatttgcaaattcttgaattcttctgggtctggattgtatttagctaataccgtaacgccatcttcaactaatgcggcacaaacatcatcttgtgtagacaatggattactccccgtaatagttacctgcgctccacctgcttgtaccactttagccaggtaagccgttttggcctccaaatgtagacagatggttaccttcagaccagcaaaaggctgctcttgctcgaattgttgacgtatacggttcaataccggcatatgggcttctacccaatcaattttcaaatgaccttcaggggccaatttaagatcgtgaactatgctattttgtagagaatgggaagtcatactttgtttcctccttcatattggttgaatttgcaccatgataaatcctatataaaataacaatcatacataaataacacgatgcgtacctgtcagatccaatggtacattcataatcgtatcaatcaagctgagaccatgacggtttagaaaatgatagatcgtatacgcccgctcctgcggctgtccaaatggaaaaagcgaccattcaatacgatcccactggcgaagtgctgtttcattttgccgaagcaacgcttcctgaacttttgcctccagataggcgatctgtgccagaattttctcgcggttggtttctccgagctgtagcaaacctttttcaatcaaacctgtctgctgcacaagtggttcgtacatgcggacaaaagcttccttagccccggaaaactgatcctgcattccaagctgatcttgagtggcaatccattgctttttccgttcctcaagtccgtctctaacttgaccaaaacttaattcatacttaagcatatgcttctctacacctggctctaccaacgtaaaagacattcgtggcagcagtatcggcatctgcatctccaacaccccgaaagcatcccgtgtaatcgcccagtaagcaatctctcctagacccagcacagatgccagcaccggaaacagtgaatcctgcattagaggacgagttagcacattgttactaaaacgttcgggatgtctatctatctcttcgagcagttcatccacagtaaacgccaccagaccgtgtcgatccgtgaatagtccagcttttttgaaaagcaacaggcgttcatcttcatggatataaaagagattcgcgccaccttcatgcacatcggcttgtaaatgatatccataatctacgatccgtgtggcagccgtccgataagcctgctccaactcatcattgtgctgaaccagccgcttaaaaacggatgcttccagcttgcgtagcgaaggatctgctgaatccaagagtactaatccataggtgccgaacaaaaggcccagcaacttggcaaaggcttcactcagtccatatgaattcgttatcccgttctcaatcatgcgcattatatcagccttatgttctgaatctggcaagctttgctctatatccgctatcgcttgcttccattcaaaagcgtcaactttaatggcactaaccgaagaacggcgttcaggttgcttattcagcttgattttgacggcttgtgggtcatttgccattacgtatgtatgattgacctcgtcccagtcatgatcttcgccagcaatccagaagatgggaataaccggacgtccaagacgttcctcagcttctctcgccgccttaattagggtagcagctttgtaaatgaccagcatcggacctgttaacagtccgctttgctgcccgccagctactactaaggcatctggactttccagacggtccaatgaagcacgaaccgcctcatacgaattgtatttctcattgtatatacgaagacatactacgacatccttacggtttaatcgcagatgctccgtcttatccagccacttcgcccgttgggcataagcatcggcgtgcagcacattatattcatacaagtcgcttgcgcgtcctgtaccctgtatataatcttctgccaaagccgaccctccgcgaagcgtttccggaattattttcatgggtctgcctcctgtctccaccaaaaccttactgcttgattgtaccgaaagcctatgtccacgtcaaagcttcctacaaaaaaaaccgccgaataactcggcggttggtgcataaaacaagatcaggcgtaaggctcagctacaaaatgtcctttagacacttcgatgagcgtggcattttccaggttataagcccctgtcttactgccagatgcatcatgaatcgggcctgcttggtcgcctgacataataatccgttttttgttggcttctacttctggatcaggaagtgggatcgccgacaaaagcattttcgtataaggatggatcggatttgcatataactcagcactttctgcaagctcaaccattctacccatatacattacagctacccgatcactgatgtgcttgaccatcgacagatcatgcgcaatgaataggtatgtcagacccaaacgttcttgaagctcttttaacaggttgacaacctgagcctgaatagatacgtcaagagctgaaatcggctcatcacaaatgatgaatttaggattaacagccagtgcacgtgcaataccgatccgttgacgttgaccaccagaaaactcatgcggatagcgtgttgcatggtcagggttcaaaccaaccagatcaagtaactcttcaatccgtttcttgcgttctgcacggctacccgccatattgtgaatatccagtgcctcaccaataatatcagaaacggtaaaacgcgggttcaatgatgcatacggatcttgaaagatcatctgcatatcacggcgcattgctttcattttacttggtgataatttgtaaatatccgtaccgttaaaacgaacgctacctgctgtaggttcatacaaacgcaaaatcgtacgacccgctgtagacttaccacagccggattcgccaaccatacccagcgtttcaccctcgcgaatatagaaattcaggttgtccaccgctttgagcacacggtttttgccaacattaaaatactttttaagaccttcaacctcaattaaattgttgctactcaccatgatctcacctcctatttcttcaacttcggatcaagcgcatcacgcaagccgtcgccaaaaaggttgaacgcaagcataatcaaactgatcaaacctgctgggaaaagcatccgccacgggtaatacatccacccagtcagagctgattcaatcattgaacccagcgacgcctgaggagcctgtacccctaatccaaggaaactcaggaatgcctcagagaaaatagcacttggaactgtcaaagtcagtgtgacaatgatcggtcctaccgcattaggcaacaagtgacggaacagcaaacgaccagcacctgcacccattgaacgggaagcgagtacgaattctcggtttttaagttgtaacatctcaccacgtacaatccacgacatgttaatccaccctgttacacagagcgcaataataattgtagtgatacttggctccagtacaaccagcaacaggatcgtaacaagcaagtaaggaatggagtacaagatttcagaaaatttattcatgatttcatcaacgcggccaccaaagtaacccataattccaccataaataactccaatcatcaagtcaatcattgcagcagccaaaccaataatcaaggaaatccgagcgcccatccaagtacgtacaaacatatcacgccccagatcatctgttccgaaccaatgttccgccgaaggaggaagattggtgctcaacaaatcattcgtgcggtcatcgtatggggacagcatcggaccaacgattgaagcaagcacaatgagaaccaaaacacttaagcttgtcatagccagtttgtttttacgaagtcgctcccaagcatctcgccaagcggataagctttcgcgctgaataacttcagactgcttttcatccgccccgaccttctggaaatcttccggtttcacctgaagcttatccaagttcacagcattatctttaacagacataaagttatccctccttcccgccagtaagcttaatccgcggatcaataaatccatatgcaatatctgtaataaaacgcgccaccatcagcaaaataccgtaaaaaatagtaactcccataatcatggtataatcgcgggttgtaatactatctacgaataccttaccaataccgccaatcccgaagatacgttcaataacaactgaacccgtaataatattggccgtcattggtcccacataggtaacaaccggcagaatagcattacgaacaacgtgtttgaacataatagtaatggatttcaagcctttagccttggcagtcttaatgtaatctgcatgaagcacttccagcatactagaacgcgttagtcgagcgataaacgcaataggggaagcagatagagctgcaacaggcagaacgtagtccatcggaccgtcaaagcccataacattaaaccaacctaactgttgagcgaagaaaaattgaatcaacgatgccagaacgaagctgggaaccgcaatccccatgatagctaataccattgcaacgttatctattagcctacgatgatacaaagctgctagcatacctagcaagagaccgacaattatcgacacgattatggcaacaaaaccaagtttaagggaaaccgtaaacgtttgtccgataatgtcagttacactttgattcagctttttcatagaaataccaaaatcacctgaagcaatatcacctaagtatttaaaatattggacatatacaggcttatccagcccatattgctccattaaccgggcttgaatctcaggagaagtcgctttttcactcatgaaggggttacccggaattgctttcatgagaaaaaacgtcgcagagatcagaatgaacaaagatagcagcatgtagaaaaatttactgatcaaataacgcgtcattgcccgtttacaccccccataaatttttttcgacaccattcgattttatcgaaatagaattggactgtccaatctacttatttgcatggttacatgatgatggaaaagaccatgacacacaaaaaaaacgggatatatatggttctatccacatatatatcccgaagtaactatgaaacttcagaatcgagctttagttactgtgtaatatacgctcttgtgaaatcaactgctccactaaagtcaagcccaatgtcttttacattcggttttgttaaagaaacatttgagtagtagtagatcggaagcattaccatatcatcttgaaccagaattttctccgctttcgcaaaatcttccatgcgttttgctggatcagtttctttcttagctgcttcaattaaagcatcatatgccgggttagcataacctgcattgttgttgccattgcctgttgtccacatatccaggaatgtcattggatcattatagtcagcagaccatccaccacgagcgatttggaaattcagcttgttacgtgtttggataaatacgccccactcttggttttgggttttgatgtcaacgccaaggtttttcttccacatatcagcaactgccaaagcaatcttttggtgactctcactggagttatacagcaatgttaccggaggaagtgtagttacgccttcttccttcataccttcttgaagcaattttttcgcttcagtgaagtcttctttgaagtaatcatctttattctcagtgcggaattcttgagatactcctttgatacctggaggtacaaagccgtatgcaggaatttgaccgcccaatgttactctttcaacgattggttggcgttgaatagccattgcaaacgctttacggattttaacattgttaaatggtttttcagttacattaaacagatagtagtacgtacttgcaatcccttttgccttaaattcgttaggcagttcttttttcacagccggaatttggtcggtaggaatttcaccgtttggcatacctgcgtaatcgagttgtccacttctataagaagccagctctgttgcaccgctatttacaagggacatcgtaattttgttcagcttgatatcatctttaccccaatagttttcactcttggttacttcgatcttttgaccgctgtcccaagtcgttaatgtgaaaggtccgttagtgatcatgctatctttcttaacagcccacttatcattacctttaacagaaggatttacaggatagaaagtgtagaaagaagtcaatcccaagaagtaaggagttgggtgctccaactctacttgcaatgtatgatcgtcaacagctttaacacctacatctttaaagtctgtaactttagtgcctttaaaagatttcgaagtgctcaggttgtaaccctcagcatttttgatatagtacaattggtaagcatatggaggtgcaggagccgtggaaggatccaatacccgttgccaagcaaatacgaagtcgcttgctttgactgggtcgccattactccattttgcagtatcacgaagcttgaacgtataggttttgccgtcatcggaaattttccaagattcagctacgccagggatttctttgccgtcaggacccatacgtacgagaccttcatacaaagttttcagaaccgtgttagtttgactatcctgagcttgtgccggatcgaacgttggcggctcggatgcaaggttaatgcgcaaaatttgcttgtcggccgcagccggcgtagtcgaggtgttttcttgtgcgcccttaccattggtatcgttcttgccgccgcaacctgcgagcagtgcgccaactgcaagaatgagtgtcaaaaggactaaaaagcttttccttttcatctagcgttttccccctagttctaaagtggtatatgtttatagattatacaaccagcggtcaaaaaaatctacattacatttcttcaaattgagcttttttttcaaaaaaacatgattaattcatatttttttaccttttcatgtcaccttatatcacatggagttgaatatattcttaaatataccaactacagttaacaaaatatacgccaatgtcatcgccataaaagttaatctccagaccgctctacataatcttttaccatcaaccttcccttttattcgattttgagctcctccaattaaacccaaagccagtaataggagcagtagaatcaaataaaaaccgaatcgagatgtaaaaatgacgttaaagagtgctgcgacggaaaatatcagaaaaaacgtggtaatatccatagaagtaagtaacgatttctttttttccattttaagaatgtagcgacaaaccgcaaacacgatcaaaaacggaaaaaagggaagaatactgaaagtgataatagtaccttgtataagactcaactgatcacccctcttttagccgcatgccttcaattaattgccacaataactcatgagttggtgcagtaactccagcccgatctgccatctgcaccagttgtccgttaatcgaagcaacttccgtcatggactgtgcaagtacatcagctagcatggacgagtgattctctgccgttgcccggcatacattcataatttgctcccaccatgcgttttcccagtggataccatgagcttcatacacttgaatgccttcatcgtacagcctgcgcatcatatgtattcgaatagggtccgaaagcagctcgccattacgaactcgccataacgccgtcagcggattgatcacagcattgatcaacaacttgcgatacataccgttctcgatttctttcgacaagcaagcgtcaaatcctgctgcaaccagccgatttagcacacattgattaaaattattgttcttcggctcctcctcttcctccgaacatcctatttcagtaacacccgatcctgcatgtataatagatgctactccctgcctcttggctccttcagtcgtcacagcagggtatattacagctttaggccaagcctttctaatgcgttctatatggccgattccattctgcaagcaaacaattcctgtatctctatccatttgagctgcaggctggatctgttttaacacttcctcaatcgccccctgtttggtcataagcattatccatcgtgccggagcctgtgaatttaaccgttgccaatctgccaatggcgctaccttcaatttattcccggacacatgtactgccgtctgtccctccttatcaaacacagtaatcccttcacgagcaatgatgcgtgcctgctcaagtgtacgcgtccacagccttacttttgtacctgaggcagacaacctcccggcaaacaacaatcccagcgaacccgctccaataatatcaatcacctttgtatcgtctcgcttccatctttttttctactatatcatatgcactctagagaaatacaaaaaacgccaactacagcaaagcgctagttgacgttttatttcaatattgcagaagtaatcttgttactcaatgcgctccagattcccattggcgtccattttgaatctggatttaagctcttcctcatcatcagtgattaaagccaagcgccgagcccggtccataatctgaatcagagctttataatcatcattcacaacacgatagtcggtttgcacctcattcacttctttggacagccggtcattaatggagcgaagttgattcaattcttcttccttatcccgtaaatctttctccagcatcttaatctgccgattcgtttcctggatggatcccttccattgacgcaagaagcgaattactgcatcaatagataacgtatcctcactcgtaccatccgttctgtacccaccttcgactgtatcaagtgaggcaaaagccgcaacctgtgatacacctaccgggttctgcttacggatataactgcgcttctggcgctgtgctttggcaatgctaatcgcttcatcataacgtttgcgcacgcagctgttccaacgaaagccgcatgctgcagaggttcttccgattttttgaccaacctcctcaaacgcagcgagctgcgtcccgccttcacggatatgccgcaatgtcacctccgccaatatcaagtcatcttccacactccatgcatcttgtcttattgcagtcatgcctctagccctcctaacaacatcctgaaataaccgtcttcatgaaccgatcttgccggtatttgaatagggtataaaagctgtttattcattcctatgcctctcgtagagttcatagaatctatttgatactaaattgtatttccatttctgcaagaactcatacgtgaacgtaaacagtttcgggtttcaagcatgctcagactgctgtacaataaaatgaatggttaaagaaacagaaaggatcatatacattaccattagttttttcggaaatacataaaaggggaaaccaaatgaacaaacgaataaaaatcacaatcagcaccctgctgaccactatcatgatgctaactttcatatatgtacgtcctactctggccgctccctctcatgaagaaaatcagattttacaagatagcctgtcgattgtagagatagaccatgaaattgagcgaatcagtcaagagcagcagactcttttgcagcgtcagcgggaattgcgaagtaatctcaccgttcagcaagagcaaatgaccgtacaacggaagcgtgcaggttctgtgctgcgatcgtattatatgggagaaagggacaagctgttgagtgtagtgctaggggcgaaaagtataaggcaacttctctctctgtacgattactacttattattaattagtcacgatcaggatgtgcttcaagaatacgaatccaattatcaatctatgcgaaaaacagaacaacaagtcacccaagcctcaatggaattggagacagtcaaaacaaacttactggcacaacgcaaacgcattatcctgcttcagtcgcgtgtaaatgacggcgttaacgccagtaatgacccggataccctacgcaagcttattggcgaaatgacagcttattgggagaatgtaggtgtctacgaggtaaataagcactttaaagcattagctcaagctatgcaggatttaccgcaattcattcaacaacaacaaggtgctatggttacaaatggaaaagtgattacgataagcattcgcgaagaggactttaaccgttttttaaagtcagaaaatgaattgtttaatcacttcaactttacatttgcacaggatcgaattatggtagaaggtcagcagggaacgatgaaattaagagtagaaggtcactacacggtagaaaatgaaccgaaaaatgcaattttatttcatgtagatcgattggtatttaatggtctggaactacctgatacgacccgcaacaagctggaaaaagattttgatctaggtttctacccacagcagcttatttcctatgtcaaagccacagaagtacgcactttagcaggaatgcttaaagttaagctcgaattaaactttaaataagcttttgctcactttcattgttctgaatttttacgtgtacaaaacaagagaccccgggatattcccgaggtctttattattgtcataacgatagggattttatagcagatcggctgccaactgcgcaagcttggagcgttctcctttttccaacataatatgcccgctaatcccttcttgcttaaaccgctccactacataggttaaaccgttgctggctgcatccagatatgggtgatcaatctgctccgggtctcccatcaaaataatcttgcttccctcacccacccgggacacaatcgttttgatctcatgtcgggataagttttgcgcctcatcgactataataaattgcccaggtatcgaacgcccgcgaatataagtaagtgcctccacctgaatactgcccaagcccatcaaaattttgtcgatatcacctgattttttggcatcaaacagatactctagattgtcgtagattggttgcatccacgggcgaagtttttcatccttttctcccggtaaataaccaatatccttacccataggaacaacaggccgagcaatcagcagtttcttgaagcgatgttcatcctctaccttaagcaagcctgccgccagcgccagcagcgttttgcccgtacccgcttttcctgtaatggtcacgagagggatatcgtcattaagcaaaagctccaatgccatccgctgttgagcattacgcgcgctgattccccataccgattcgttacttaagtacagcggctctaatcgctctgcctcctgatttactttcagcaaagctgattttccagttcccatttcatctttcagaatgacaaattcatgtggatacagcgtataaggtagttccagtggcttgattggtaaaaaacggttagagtaaaattcatctatgatggacgggtgcacctgtattgccgagtatccgggatatagctcacttagatcgcctgttctatcggataggtagtcttcggtcagcagtcccaatacatctgccttgatcctgaccagcacatctttactgaccaaaacgaccgaacgtggttcaggctgctcttgctcttccagatgataattcaaggcaaccgccaaaatccggttatcgttcgaaacctccccgaacatctcctgaacttttaaaaaacttcggtggtttaactcaaccttaagccttccaccttggggaagtggaacgccactatgcagatgacccacttctctcaacccgtccaacaatcgcgatacattgcgggcattccgtccaatctcatccgcgttgcgttttttggagtcgatttcttccagaactacagctggaataacaacttcatgttctttgaaggtaaatatggctttcggatcatgcagcagcacattcgtatccagcacaaaaattttcttcattaaatcccctccaaagcggcgtggacaatctcgtgtttcatacctatacctattcaccgggtacctaatacttgctgattccctgaaaaaagaaccccaaagcagcataaaacaacgaaaagttgtaagtgaagatagcctctgagcctgtccatttgaaattagacacaaaaggcccagtgattgctcactggacctagacttggttcactataactttagacatacctcaacccccttatgttatataagagctttactcgctgcgagtataacataagtgggaagaaagatacatactcaggaattggaagaagctgcggtattgtcgcttgcttttttagctaattcctcttgtagcgcttgcttggccaaatcgagctgttgctcatcaatgtacacatacgggctacgccacgttcctgctaccggattgtatttcacattttgcttggaaatattccaataggtttgtacgatatttttcatttgctgtgactcgatatctgtcatcatattcttatcaaccgatttaataattgtactaaacttggtcaaagcgttaaaggattgcatttggtcaattagggaatgaagcacctgattttgtcgacgattacgatcaaaatcgtcagattcagctgttctcggacggcaattcgatttgcggtagcgaacaaaatcaagagcctgatcaccgttcaaatgcttggctccaactgtcaggttaatatcggtaccatctgcacggtcacgataacacatgtttttatcaaccgtcacatctacgccacccaaattatctactacatctctaaagccctggaagttaataaccgtcacataatcaatatcaatgtttaaatatttgccaatcatcttcttcatttgttcttcagcaacttcgccagattctttctctctagccttaaacaccggataatactcattcaacttgcgaggtttatatccatccatttctagacgcgtatcgcgcggtaaggacacgatggtagacgatttagtattggggttcaatgtagctaccataataacgtcggacaaataagtcggatgatcagggcggtaatcggttcctagcaataagatagtcaaaggcttagcttctgccaattgtgttttgggtacttccttgttgatccccgtatccaaaacttcctctacctgattgtaaatatagtaggtataaccacctgctgccaaaatacctataataagcagaaacaagacaaacttcataaacgatctgaaaaagctttttttctttttcgtttttttcggtttggcggactttttcccgctttgtgtccggggaggcaatccgttcgaaagattactcatgcttcaacaccttttcctgcgttttgagaaatatagctttctccaagtttacaatcctaaaacacacacagcggcgcatcccgttcccgggcgtcgccgctgtggccaaagaccaatccaatcaattacatatttgcttgtgctgttttacgttgtttctccgcacgctcgcgttcacctttgttcaagatctttttacgcaaacggatagcgttaggtgtaatttcgcaatactcatcatcattcagatattcgagcgcctgctccaaagagaaaataacaggtgttttcagtttaactgtatcgtcttttgttgctgaacgaacgtttgtcaattgtttttctttacaaatgttaacgacaatgtcgttatcacgtgtgtgctccccaacgatcataccctcatagatttcagtacctggctccaggaacaaaataccgcgatcttccacgcccagcataccataaaatgtagagctgccgttttccgttgacacgagtacaccctgatgacgtccacctacttgaccgccaacaaatggtccatagctgtcaaacgcatggttcattacgccataaccacgagtcaaagtcaggaagtttgtagtgtagccgatcagaccacgtgcagggatcaagaattccaagcgaacctgtccggtgccgttattaatcatgttaaccatttcggctttacgggagcccaaactttccataaccgcgcccatgctttcttccggaatatcaataaggagacgttcgattggctccattttcttaccgtcaatttccttgacgataacttccggtttggacacttgcagttcgtaaccttcacgacgcatgttttcaatcaggatacccagatgcaactcaccacgtccggatacaataaaggcgtccgggctatcagtttcatcaacacgtaagctgacatccgtttcgagttctttcagaagacgctcacgcaatttacgggatgttacccacttaccatcgcgacctgcgaatgggctgttgttaaccaggaaggtcatttgcagtgttggttcatcaatcttcagtacaggcaatgcttcaggatgatttggatcagcaatggtttcaccgatgttgatatctttaattcccgcaatcgccacaatgtcaccagcgcccgcttggtcagtttcaatacgtttcagaccttggaagccaaacagcttctcaatacgcgctgatttactactaccatcacgctgcataactgtgactgcttgcccctgcttgatgataccgcggtttacacgacctactgcaattcggccaaggtattcgttatagtccatcagtgttacgaggaattgaagaggctcatctactttctcagttggagccggaatgtgctctacaactgtttcgtacaatgcttgcatgttatcgtcttgcttttcagcatccatgctggatgttccgttcagcgccgaagcgtacacaacagggaattccaattgctcgtcattcgcacccagctcgatgaacagatccagtacttcgtcaataacttctgccggacgagctgccggacggtcaattttgtttactacaacgattggcgtcagattttgctccagcgctttacgcagtacgaatttcgtttgcggcatgcaaccttcgtaagcatcaacgacgagcaaaacaccgtcaaccattttcataatccgttccacttcgccaccaaagtcggcgtgtcctggtgtatctacaatgttaatcagataatctttgtaagtgatagctgtatttttagccaaaatcgtaataccgcgttcacgctccagatcgttggagtccatggcgcgctcctgaacagcctcgtgttctctaaatgttccggactgttgaagcagcttgtcgacaagcgtcgtttttccgtggtcgacgtgggcaataatcgcaatattgcgaatgttttctctagcatgcatggtttgtatccatatcctttccgtatatcaaaatagtgtctctatcctgaagcagtgctgattcaaggctaacaatcgttctttaggcccactccctgccagccctctatatgtttcaggctttgtacagacagcttctctctccgattcgcgtgaaaaccttaaaataagcgtcagaaatcattccgacgctcttatcatatccattatattatagttgaaatatgtcataaagcaagacattattgcctgttccgtaatttaccgccataaaatctcacagcttgtcggtttaccttttgcgtttgccacggttgtttaggaccaaccagattccagcgccaatcagtaaaactgcaataacatatatgatacccgttcttagggaggtaataaccaataaaagcaccgataccaagcccaatattacgccccctgtatatacattgcgagaaagcgaaatatcgttaatggcgtactcccataatccaatcgccacacctagaagtaacaaaggccataaataggccattaaatgccagccccaaatattgcagagcaaaaataagaagccataaaccgacaaaatccctgccggcagcaacataaagggtgaaactttacgcttcatgtacattgcatgcagtacgattccaggtattaaaaacagcaaaggccaaaagtttcgtcccaaaaaggagaacgctcccagtttccccaacaaaataatcagtcctacggcaacaatgcccactccgatcatacgctcttttccggaattcatcgtggtctcctttgtttgctgaatttgtttttaggtctcttaatgtgattgtttttaagtatatttttgtgaatatagagcctttacaaaaaccgagtaaacctggcattcacaaaaactctatgtctattttagccgatgttttccaaaaaaactacgttcaaatatggcgagctcgtaactgacgatatatacctgcaacgacaactgctgttgccaagagtcccggtaaccatgcatgtataagctctcccgtacctgctaaccatacacccaatcggggatcacgcagtagcatttctcctgccgtaaaagccaggattgcagatccgagcaaaacaagtacagggaaccgatgaagccagatcgcaatcacgttgctgccccagacgacaatcggaatactaatcgcaatcccaatgacaataatggcgatatccccatctgctagggctgcaatagctaacacgttatctagactcatcacaaagtccgctaccagaatcacctgtatagccttccatatggttgtttctgctcttactcccacatgatcctcattctcataaagcagcttaaacgcaatccataacagaagtagaccgcctgccgcctgaataaagggtatgcccagcaaaatgacagctacaaaagtcaaaacacagcgcaggaggactgcaccgactgccccccaccatatagcttgactccgctgccttgcaggcaagtttttgctcgccatggctataacaactgcattatcaccgcttaacaccaaattaatcattaatattttcaacagcaaaatgatatgctccatgtgtacaaacacccccatcctacttgtatgcgaaataggacgaggctatgcttataagccttgacaaataagtcatcatttattaaaaattgatgtcaaatttgttgagcaaagaccttgaaatcaataacaaacagcaatataatgaatcgtatttccgaaaaacgggtattaaaataaacaacatacaatgattttaggatgtttaatcagggagatgagaacgattgatatgtccggacttcagttcttttggctactgcttaatgtgatatttattgaccttctgctcgcaggagataatgcgattgtaattggacttgccgccagaaagctgcctcctgcaacgcaaaaaaaagcgatactgtacggtaccggtggtgccctgctcattcgcatagcagccaccattgtggtactctggctgcttcaagtaccatggttgttactcatcgggggtgtcatgttagtctggatcgcgtataagttgctcgtagaccaggaggaccataccgaagtcaaagcgggaacaacgttatggggtgctatccgcacgattgttgttgccgatgcggctatgggtctggacaacgtgattgctgttgctggcgcggcccagcagcatttgctccttgtagtgctgggactattaatcagcgtgccgatcgttgtatggggaagcactctttttatcaagttgatcaataaattcccttggattatttatttaggatcggctgtgcttggttatacagcctctaatatgattactgaagaacgtaagctggaaccctactttactgagcaccctgcactgcgtatcttgtttattaccgcagtcatggcaggtattttgctcacaggatatcttcaaaatcgcagagcagtgtccagtcgagaaaaagccgtctaaaatgattcaaaaactgttttaattaaaataaaaaggcagacccaaaatagctggcgggtctgcctttttgtttaaaaccaatcttcctgtataacttcctctttgcgcccctctatagctccgcctgcctccaggacaagcgtctctgttgtagccacagcctgttcaatcaacacatttaaatcccgaatagaggcttcaatcttttgaacaacccacaaatttggattggtcgttggggatttaggaacaaacaatgtgcagcaatcctcataggggagtatcgatagatcgtaggtgccaatctgctttgcgatttccgtgatctcctgtttatccatcattacgagaggtcgcagcaatggtaattctgtcgagcggccaatcacattcatgctggataacgtttgactagcgacttgccccagactgtcgcctgtcacgagtgccagtgctccttcacgctcagccagcatcgttgcaattcgcagcatagaccgtctcattagcgtaataatcagattatcctgtccagtgcgcgtaaaggccgtctgcacctctgtaaacggtacaaggtggattttgatccgacccgcatagcctgctaatacccttgccaaatcaataaccttttctttcgcacgttcacttgtaaatggatagctataaaaatgtacacattcgatttccaatcctctacgcatggaagaccatcctgctaccgggctgtcaattccaccagacagcagcagcatagctttaccgttcgttcctaacggaaagccccctacagccataataacatcgctgaatatataggccgcctgctctctaacctccacacgtaactcaatatctggctgatgtacatcgaccctcaacgcttgaaactctcgcaatataggagaaccaattaaatgattcatctcttgtgaggaatgagcaaactccttccatactctgcgggcatttaccttgaacgtcgttccctcggtcacattcagctcacgcatcaaagctacagcggtctcaatgatagcacccagctcgacaggagccattttgacaggacttattgtcgtgatgccaaacactttttgtaacacctgaatgatctgttcataaggctctcctccaagaaccacataaatccgtccaaattccttccgcaaagaagcaccgggaaagggtttgagcagcagcttcacgtgattcagtactgccttttcaaaacgagtccgattctttccttttaatgtaaattcaccaaagcgaagtaacagcatatcatagtgcattttaacgtttccacctttcaagggattccagcttggctacagcctttcgcagtgcaagtataagctcatcgatatcctgttccgtatgttcatcaccgaagctgatacgaatgccgccagacgcttctgcctcattgcatcccatcgccagcagcacccgactgggttcagccaatttcgaagagcaagccgatttggtggatactaccacacccagttgctctagcgtatgcagcattacctcggctttcatgcccggatacgaaaagtggacaatatgcggcgcttcttccccgctgttcagccgcagttgagggagtgtcttcacttctgcgaccacccgttctctccactcggtcatacggcgtgctgtctctacttgccgttcgcccgccaaccgtatcgccttagacataccaacaagcaccggtacattttccgtacctgcacgaaaaccctgctcctgagagccgccactatgcagtgggaaaagctctacaccttcccgaacgaatagtagtccagcacctttgggtccacgcaacttatgcgcagagagactgtacagatcagcctgccatccccggatatcaaccggtagctttccaaacccctgtacaccgtcaatatgaaatagaacgcgagggaactgtttcttcagcgcaactccgatatcatgcaacggttgcacccttcccgtctcattattgacatgcataatactgactaaaatcgtatctttacggacagcggcacaaacctgttcggcgctcacatgcccttctgcatcgacaggtaaaaatgtaacctcaaatcccagatttgtcagttgtctgcaagcttcatacaccgacgggtgctctgtcgatacagtaacaatatgcttgcctctggtctgatactgcaaagctgctcccttgatagcaagattgttgctttccgttgccccagatgtgaagacaagctctgatggatacactgccaaagccgcagcacatacttcgcgcgaacgcttaagcaacttatccgcatcctctccatatcgatgcattgaggatggattcccgtagtggcgtctcatgacctcggcaactgttgtaatcacctcttcaaaaggcggagttgtcgcggcataatcaaaatatttcattgcactccccttttccgctctataactgctgcaacaaaaaaagaccaaaacagggaaaggccgctacattatagcgacaccctttccccatattgatcctgtctgcggacctaatctaattgaaattacgcacttttttcgttgtaagctatagggcttagatcgtatatttttcacgtgcattttgaattttggtaatatatctttgcgtttccaccggaagcttgtccagtacagccattaactgttcatcactacttacaccaagccgctgcacccgtccgggacctgcattatatgcagccagcgccatattttcttgtccgttaaatcgtttaatctggtaggacaaataacgaacaccggcatcaatattttgaacaggatcatatgggtcgctgactcccaggccttgagccgtagcatccataagctgcataagccctttggctccggccgaagaagtgaccgacggattaaacgaagattccgtatcaataaccgctttaatcaacgctactggaacgccgtatttctggctagcctcgttaatcaaatcatcatatgctgtaggtgttgtgggtccgtctgttgctgtgctggaaggagcggggtacaatgacgaagccgttcccctcgaaggtcccaattgaagccatagcaaaccgttttcgtctctggtaacatcacttgaattttctcgtgtcacagcaccatcggtttccaactgacctacttgttccagtaatccggaaaaagcgtccgttgtacccgtctgggttgtagcactcatattatttaacagctgcatgtctaacatggacttggacacgcgcggatcaatttgcatgtggtgttcccaactttctatagttgttatatcccaaatagcttgtcattactgctatgatacaactttttactatgtacttccataccttttaatgaaaaaaagctccgtttctgtcgaaaagacagcggagctttatagatcagctttaatgtaattatatcactaagatgattttctcggatatacaaaagaaaactgagcttgttcttcagtagggtcaacgaacgaacgggataaaagcaaaataactcaatgtcgccagcgccccaagaccaatagaccaaatgccggtcgttttgctgccattcacataagcaaaaaaacctaaaactgcagcaataggccccagcacaattgaccacataaacaatgaggcaattcctgcagctagcccaatatagccagaaatacgaccactattgtttataacctgctcttgacccttaacctcatgtcgagtcacagctgagccgggagcaacctctgctgcatattcctcacgatcattacggcgcttggcagatcgttcatgaatgtgacgggggtaatctacacgttcgcggctaacatgctctttactctgatgcttgtcattttcatgatcttccataataaactgcacctccaaatgcgaaatgaatcgcgcaataaaatttacacggacttcggcttaaaagtgtggcaacaggttgcggctgacgtggcagccttatcacgttcttctgaactgaagctttctcccgcatattcttctttaaatttcttaccggcatgaccatcaacttcaatcatgatcaaatctgccttgcaaaagttgttttctccccaataatggcaattggctacgctacacttaacgattggcttggcctcttggctcatgattatcacctcggatacattgtccccccgctaccctgcacctatgcgttcatggtatatggcagttggtgacatacgaaaaaagccgcttccttcacctcctccaaaatggcaggaagcaagtagaaaacggcttgcttgtcttgttttagtttttgattagaaatgatcttccccattgaatgctttaggcatgagtacgtcgagtctgcatccggcgctgagtcaaatagtcactttcataataagtcagatcatcacgcaattcttcaaaatttttcgtaatgtccatgatcacttcgcgagcggctggcactggcgttttacggaagcgaatagcatcttgtcctgtatacgcatagcgtccatcctctgcgtaagattcatttttgggataaaaaaagctgttcacgcagtcatggtaaacgttatacaatgccttttccgcaaaatcgacgtcaaaattggcacggcgtaaagccacacccagcttttcataagatacttcggaaaaaacaaggacatgacggagatccgacaaaaggcctttgtaaaaaagcacggactcctcattgccatctgcagcaagttgtggcagagcatgctcattgaggaatgtttccacccgtttcacggcagttttcagtctctcctgcgccgactcacataatttttgtacgttgactgctgacatcaaggcagctcccccttatttgttgcttgttcatcaatttgattacccgaaaatagtcccttctaaccgaaagagctgtaattttcagtatttatcctaccacaaatgagcattgaaaggtataaaaacatgccaacctcctcacgctaaaccataaatttatgaatactcaaggaggacggtcccatgtctcggcgaaaatggttaaaacccctgctcggagcagctgccggggtgcttctcatcacactgatgctgccttcccgtgatcaccgccatacaccgcagcccgaatatacggccaagatggtgccacagcaagagaagcagctcaaaaaaggaatgttggctttggacctgtccgctacggataccctcacacgcatggatgcaaggcaggatattcaatacgtgatgcgggagcttgatggtaaaactgctgatcagaaaaggcagtttacccgcacgctccagcaatcgcacagtcatcttcatacgttactgtggattcacacacgcgacgggaacacgagcacctatacgggcggtaaatcacaagctcgtctgctgagtcatcctcaaattaaaagcagtttggccgcggctcgccgttccgttatgcaaaataaatcctacgaatctgctgcatttcaggctgaaggcggtaaatattttgtcatggcagaaccatcggctgacggaacatgtggcgttgctgccctggtcagtcagcaagtattgcgagacgtggagaagcatcagcagaagaatttgcgtttgattccctatccaaaagaaggcagctacaaaatcgaatccgtacatcccgacacattgcacgatattactgtcaagacgggccatgacaatgaaaatgcaagccattatttcgaaaacgaaattgtcgttcgcttccgtcataatcctgattcccgacaactgcaggaaattgcagcagatttacactgtgcgccaggccgcaagcttggttatacctatgtatttcattcggataagatgaacttcaaggagctcaaggaatatttttcgagaaagtggaatccgctttatactgagcctcactatatgtatctaaccaatgagaaaacacctatccaagcggacagctctatccccaatgatctgctcttttcccgctatcaatggaatctgccggctacggaaaccaaccggggttggaaattaagcaaaggcagcaaggacgtaattgttgctgtcatagatacgggagtagatttggatcaccctgacctaaaaggtcaaatcctttcaggtcataacgtggtaaacccgtctgaaaaaccttatgatgacgtcggtcacggaacgcacgtcgctggcatcatttctgccctcgtgaataatggtgagggggtcgctggcatgacatggtacaacaaagtcatgccgattaaggttcttgaccaatctggctccggtacgacttactcggttgcagaaggtattatatgggcagctgatcatggggccaaggtcatcaatttgagtctgggcaattacgcacaagctgaatttttgcatgatgcgatcaaatacgcctatgataaagatgtcgtattagttgcagctacaggtaatgacaatacggaacgacctggctatccagcagcgtatccagaagtatttgccgtttccgctacagattcttctatgcaccgtgcatccttttctaactatggagattatgtagacgtcatggctccaggtgcaagtatcgccagtacgtacccaggaaatcaatatgctgcactgtcaggcacttccatggccagtccccatgtatcagcgcttgctgcactgattcgatccattaaccccgatctgaccaacaaagaggtaatggaattaatgagaagcagcgtaattgacttgggcacaccagggcatgacaaatatttcgggtatggtcaaattgacgtgtataaagcgttgaaagcagcacaacgtccatatgttcctttgcaattctatccacagcatttaagtgacaagttaaaatctatattaaagaaactggaaacgtaagattcctattagaaaaaagcagccatgttgtgaagtgacccctta

SEQ ID NO: 2657 - DNA, 32609 bp, Unknown
  Kingdom: Bacteria, Phylum: Firmicutes, Class: Bacilli, Order: Bacillales, Family: Paenibacillaceae, Genus: Paenibacillus
gcagcggcgcatccgtgctgctgccgagcaggaggcagcagctgcagcgctgacgcaggcacgcagcaagcgcgaggcatgcaccacgcgcagcgaggggctgcgcgccgaatgggcggcgcagctgccggatgtcgctccgagcgaagccgcggagcgttaccgtgtcatgcaggagcgcgacgggcgtgcggaagaactgcggtcccggctggagacgagtgtgaccttcctcgaaggaaaggcggcgcgtgttcaacagatacagcagagtatcatcgaggaggacaaaatcattattgcccgtcgtacagggctccaaagcaaagatgattcgcttcgtgaaaagctagcacagctccgaaaatgggttggagatggccaagcggcttcattgttggaagaagcgacctcgcgactgttgggactgaaaaacggagccgaagccgcggcacgccgccgtaccgaagcggaagaacgcaagcagcaagccgttcatgcttcactgattgcccggcaggcctccgactcggcagaagaaagacgtcagatggcagagtcccgttggggcagccgtctggaagcctcctcttttgctacggaagcagaggttatggaatgttgcttgggaccggaagaagtcgcacgttatgaacgtgaagtgagtttgcatcgagaacgagaaaaagagctgtcttcccgcttaaagcatgtcgaagagcagctgaatggagcaacggtaacaaaggaacagtgggaaacgaccactgcgcagctgcgcgattgccgtacacgcgacgaagaggcgcttcagaatcgcgccaaggctgagcgtgatttagaggacttgcagcatcgacacgtccgctggatgaagctggagtccaatcgtatacatttgcgtagcgaagcggaaaaaatgtccaagctccagtctgtttttcgtggcaatgcctttgttgaatatattgccgaggagcagctcatgcaggttagccagtcggcttcacgccgcctgcgttttctgaccaagcaacgttacgcgctagaggtagattccagcggtggttttgtcattagtgacgatgccaacggtggggtcaaacgtccagtatcgaccttgtccggtggcgaaacgttcctgacctccttgtcgcttgcgcttgcgctgtcggctcaaattcaattgcggggccaataccctctgcaatttttctttctggatgaaggctttggaacgttagaccctgagctgcttgacacagtgatcacttcactggaaaagctgcaccacgatcaattgtctgttggtgtgattagtcatgtgcctgaactacgggcccgtctgccacgcaagctagttgttcttccagcagagcaggctggaggcggctcacgtgtggttatggaaactttttgaagtaatgtgatacaggtcacagatacagtttcaaactattgttataatacagccaagccgacaagttaatcatacagcaccccggcggacgtatgctgcggaagaaatcttcccgtcatacgtccgttcagaggggctctgccaagagctcccggggtgcttcttttttttgcaagccggaattcgcccaatttgatgtagcaaatagcccgtttttgaataacatacggtatacatgcaagagcctaggaggaaacaaccatggaaaaaagcatgacaaccgaaaaagttacagcaccggaacagacggatgctaaaacactatgtcaaaagcatatgcatcgttatgtatgcgtatgggtgaaggacgggacaatgtatgatggcattgtagagcatgtggatgatgaaaagatatacttagccgttcctatgggtggagaagagatggagaaagtcaatattaatctcccatatccacctaacaattgtggctgcggctcccgtgcttatggtggctatgcgtcttatcctccgtatccgtacccgtacccgtatccagtacccgcttatgcatatgggttcccatacggacgccgtcgttttaatcgtttgattctgccacttgcagcgttgacagcgattagcttgctgccttattactaatcctgattccttagtcgccagatatagtgaattctctgctctctcccgcctacagttcttgtacagtacaagtgactttaaggcgcatccatacatcatcaccatgcaaggctgtttcttccattatgaagaaacagcctcttttttacgtaaaccatccccaatatgatccgataattgaaactgtatcagtacagttcaatgaaatgaggtatcctgtttatccataaaccatggtaacatctagcgtgtaaagaaacataagacggaataagcatgtaatgaattgagcatgtaatgagtatgtaaagagcaggtgggaggatattgtgaaaaaatacgtttcaattttattggaaatagaacttaaaattcgcgagggacaatataaatcaggttacaagctgccgtcggtccgtgaggcttctgaattatacaggtgcagcaaaagcactattctgcgggcatatgctgaacttgaaaagaaacacgccatctattccataccgcaaagtggatactatgtagtggaaaattcgggcgatttacaccatagccatatgcaagacttcgttgattttgcttcggcctcccccgatttgaatgtattcccttatctggatttccaacattgtttgaatcaggctattgacacctacaaatatcatctgttcacctatggtgattcgcaaggactggaaacactgcgtcatacattggtttcccatttagccgatactcaggtgtttgcaaaaatggatcggattatcgttacttcgggtgttcagcaggcattggagatactcgctaaaatgccgtttcccaatggcaaagaaaaggttttggtcgagcagccaagttacgatatatatttgcgttttctggaggaagagaacatacccgtcagtaccatcgtccggacagcggaaggtatggattttcacgaattggagaaccaatttaagaacgagagcatcaagtttttttataccatgtcaagatatcataatccattaggagtctcttacaacacagaggagcgaaaagcgatagctgccttagccgccaaatatgatgtgtacattgtagaagatgactatatggcagatttggggaccgatcatctttttgatcccatttatgcatacgaccagacgaaccatgttatttatttgaaaagcttctcgaaaatcattttccccggcttacgattaggagttgcggtattgccagaatccctattgaagacgtttaatacctataaaagatatgtcgacacatctattttgtctcaggcggcgcttgatatttatattaaaaatggaatgtatgaacgccacaagcacacgatatgtaaactgtattcggagcgcgttcgtgctcttaacaaggctgtggaacgatacaatcagggcggatacgttcagacttcagctgtaacctcaggagtttatatgcagtttaaactgcctcggacggtgaatttggaacgtttggtacagtgtctttccgcgaggaacatccaggttgtagctgggaaaggcttttatttgtcaggctatagggaacaagagaagtttttgcgcataagtatttcgcgctcgcagttggatcaaattgatgcaggggtgaaagctattatagaggaagttagtaagggaaactggtattaagaccctttttccgttatgatacatatagaaacataagtataaccaaacatggctgtatatgtttctattcagtgcgggaaatacataactttgaatgccgagagcaagggcagtttttgcctatttacttatgatcggctcactgccaaaggagggttttgaatggacgatctgtttttgaaaattgtggatggaaccatccccagcaaaaaggtgttggaaaccgacaatgtgctcgcatttcatgacatccagcctgcggcgccagtacacgtgctcattattcccaaaaaatatattccttcgatgaacgctgtgacggaggaggatcttcctcttatcgcggagattcatcgtgttgcggttgaggttgcgaaaaagttaggaatcgctgagtctggctatcggttgattaacaactgtggcccagatagtggacaagcggtggggcatctgcattatcacttactgggcggcgccaaattgggtgccttgacaggtatttcggactcacattcttaaaaaatgacagagcttgtcttttcagtaatacggaagtgaatggagaaaaatggccctttatgtattcattttttcttataggttgacacctggtttccgtttcacctataataaaatttgatgaaccgtgttattgctcttggacggtctggtcggagggagggaaaactggtgtctgaaactaaagttcgcaaaaacgagacaattgatgctgcacttcgtcgctttaaacgttccattgctaaggatggcgtattggctgaggtgaagaaacgcaagcattatgaaaagccaagcgtaaagcgcaagaaaaagtccgaggctgctcgtaagagaaagttctaggaggatctaagcaatcatgaatttgagcgaacgattgaacgaagatatgaagcaagcaatgaagagtaaggacaagttcaaactctccaccattcgaatggttcgttctacgattaaaaatcttgaaatagatttgaaacgggatttggacgacaacgaagtgcttgatattctgagtcgtgagatcaaacagcgaaaagatgccctccatgaatttgaaaaagccggtcgtgatgaacttgcgacaagcactaaagcagaaatagagatcatcgctcagtaccttcccgaacaactttctgaggaagaaattaaagttattgtacagcagaccatccaggaaaccggtgcttcttcgaaagccgagatggggaaagtaatgacggccttgatgcctaaggtaaaaggccgcgctgacggtaagctcgtgaaccaagcggttcagcaatttctgcaataaacctgcgacaaacaggaaaacacaacaccctctgtttacagagggtgttatttctatatatgcaatgcccaccatagaatgtaatgatgagaagattcttatatgtaagcgttagcgctaattgtgtgaaacgtgatgtctgttgggtgcgtaaagtatctgacagccgtcaggattagcaatatacccaataatttcacattaaatcctgaaaactgtatagtttgtctaacaaagtttggtatgctgtaacatagaaagatcgaaaggggggagagaaatgcatagagaacatcaccactccagtcgcaaattgatctttttaacgttgtggattatggtatccgttttgctgttacccttagttcattccgaatcagcggcggcccaaactaaaggtggagcagtgtttgttataccagttgatcaggaaattgagcaaggtctgggcaaatttatggaacgtggatttgcagaagcagcagatttcaaagcaggtctgattttactggatattaacactcccggtggacgggtagatacagcggagaagctgggcaaactgattaaagacagtccaattccgaccgtagcctatataaggggcgaagcggcctcagcgggtagctatattgcgttgagcgcaaacaagattgttatgaaaccggggagtattatcggagcagcagcgttagtagacggcagggggcaggctatcacagatccaaaaacgatagcttggtggaagagtagcatggcatctgccgcagaagctggaggacgtaatccggatattgccagaggtatggttgactctaaaacgaccatatctattccagagatgaactttaataaggaaaatggtcagatcatttctttaaccagtgaggaagcgctgaagttgggttatgcagatcacatcgcgtcttccgaacaagaagttatccagtggatgggttacagcacggatgatgtaattcatgtggagcaaacatgggctgaaaaagcagccgagatattgaccaacccaattgtgcagacgttgcttttatttatcggtatcgcgggtgtcgttattgagctgctcgtacccggttttggtgtaccgggaattttgggcatactcgggtttgggttgtattttttcggcaattatatcgctggttttgcaggttcggagacgtggttgttgtttattatcggtctggctctgcttatccttgaaatgttcatcccaagctttggtattttgggcattttgggttcagtcagccttgtcgtcggagttgttcgcgcagcatacaacatgcagcacgcgtttatatctttgggcattgcctttgcagctgcggttgccgtggtggcgatcatcgcggttgtattcaaggaccgagggatatggaaccgttttatacttaaagaaagtttaacagctgaacaaggtttttcttcagttgtgaaccgggaaatgctattaggtcaaaggggtgtcagtctgacaccacttcgtccagccggaacggtgctgatcgctgatgagcgagtcgatgttgtaacgaacggcgagtttattgctacagatatgccgattatagtatccaaagtagaaggtgggcgtattgtggtcaaggcagacactagcgtctaaacaagtaaacaacaaagaattagattaatggaggatgatgcgagtgttcgaatcaggtattgtcagcgttttgctgattgccgttgtagtgattattgtattgagcgtatttttcagtttcttcccggtgatgctgtggatttcagcattggcttcgggtgtgcgcattggtatcattacgctggtagctatgcggttacggcgcgtcacgccaagccgaattgtcaatccgctcattaaggcaaccaaggcgggtctgggcttgaacatcaaccagctggaaagccattttctcgcaggagggaatgtagaccgagtgatcaatgcgttgattgctgcgcagcgagctaacattccgcttgagtttgaacgtgcggcagcgattgaccttgcgggacgggatgttctgcaagcggtccaaatgagcgttaatccgcgtgttattgagacacctattgtggctgcggtagccaaggatggtatcgaagtaaaggttaaagctcgtgttacggtgcgtgccaacattgatcgacttgttgggggtgccggagaagaaacgattattgcacgggtcggtgaaggtattgttacaaccgtaggttccagtaactcgcataaggacgtattggagaatccagattcaatttcaagaactgtattgtccaaaggtttggatgccgggacagcatttgaaatcttgtccattgatattgcggacgttgatgtaggtaaaaacatcggtgcttttctacaaacagagcaggcggaagcggacaaacgtattgcgcaggcaaaagcggaagagcggcgtgcgatggctgtagcgcaggagcaggaaatgaaggcacgtgttgtagaaatgagagcacgcgtggtggaatccgagtccgaagtgccgctggcaatggctgaagcgctgcgtggcgggaagcttggcgtcatggactatatgaatttgaaaaatattgaggcagatacgcaaatgcgtagctccttaggcaaaccgaatgagaactcggggaatgacaacaagaaccgggattaataacgggacatagccgatgaatgacggcagctaggtggtgagtaatgaactttatcagctggatctttgaacatttgtatatcctgatcgtgattggctttgctttggtgtccttcttggggaaaagcatccaaggtacagggcggaaatcaccgccgcgaaaaggtatgcctacctttgggggggatcagggttctcgcgagctctcgacgtcatccagacccttcacaacggaacatgggcaagagcagcgccagcaggatgttgctggtgagttgcaacgtcaatttcctaatgaacgacgggcggttatggaagctcgtcgtatagaagaagtgggcgatcggtcggaaacggaagaacggatgaaccgggattcattagataacggttcgactctagaggatcggatccgtgctatggaagaagaacgtagattggttttagcccgtctcgatcgtatatccaacgcgagggagtcaggtgaaattacagatgcgccagagatagcttcgcaagaccgtaatgcggtgggtacggctgatctgcgcagaggtgtgatttgggcagagatattaggtcctccgcgttctaagcgctacatgggtggaggaagacgttaaaatgatagtggatccgtcacggctttggctgtggcggatctttttttgtgatgctttaggaatacataagcatgctcagaataaaaagtgaattaacgaaaaatgctctaattacctgacaacgaatgtgataatctcttgtgtgccctaggtttctaacatttgctgtcatctaaaatggtggcattttgtctaatttagggcctcatttatgaaaatatattcgtgagaaatgatcaaatgtaacaatatgaatgaagctttccgaaagcagttttcattttttcttttttatatataatgttctcaatgatagatacttatgaaatttactccatatttagctaaaatttgatttaaattgaggtgataaacaaggttataaaaatgaaaaattaatttttaggaggatggaatggatggggaatagcttgttcagaaagaagagcattgatcagttgattgctgctacgcggggggaaaaagcactcaaaagggaactgggtgtgtttgatttaacgatgcttggaattggagccattattggaacggggatttttgtgttgacaggtacgggagcagttacagctggtccaggcttggttctttcttttgtgattgcgggactcgcctgtttgttcgcagcattggcttatgcggagtttgcatccactgttccagtatccggttctgtttacacttttacatatgcaacgatgggggaactattggcctttattattggatgggatttgattttggaatacatgctggcagccagcgccgtttccgcaggttggtcgggttactttgtatcatttttgaatggaattggccttcacattccgcttgaattcactgctgcacctggggctttaaaagaccaaatgacttattttaatctcccagcttttttaattttgatgggtatcacgttcttgctttattttgggataaaagaatcaaaacggataaacaacatcatggtaatcgtaaaaattgttgttattttattgtttatcatcgttgcttttaaatatgtgaagccagataactggacaccgtttataccgtttgggttcagtggggtgtttggagccgcagctcttgtgttttttgcttttattggttttgatgctgtttcttcagcggctgaagaaaccaaaaatcccgctcgtgatttaccgcgaggcattattttctcacttgttgtttgtacatttttgtatgtcgttgttagcgcgattatgactggtatagtaccgtttatgcaatttgaaggtatctctcaccctgtgtcattggtattgcaggttgcaggtcagaactgggttgcaggtattatagatataggagctatcttaggaatgacaacggtcatgctggttatgctctatggtcaaactcgcattatgtttgctatgtcacgtgacggcttagtccccaaagtattatccaaggttcattccaaatataaaacgccctacattaacacgttgtttttcggtactttatctgcattaatgggtgggctgatcccgctagatgagttagctagtttggtgaacattggaaccctgtcagcatttattctgatttcgatcgccgtcatcgttatgagaaaaacaaaacctgatttgccaagggccttccgatgtcctggagttccgtatattccaatcctggctatcgtttcatgtggggtgctcattcttaatttgaatggtcagacatttattcgctttatgatttggcttgtcattggtatggctgtttacttctcatactctagaaaaaactctcttttgaatcgagatactgagaaataaccgtgtcatataatgaaaatcaaaaaagctaaccttattttcgatatgaaaacgaggttggcttttttggtgtgaattttgaaagaacccatcttttgcctctgcaatatagtagcagctacgaattgtaagtttagcctcataaatgcggggactggatcataaaatgtacagaacagatatctgtggcgctgctgtaatggtgttcactgataataagaatatacgatgaaaagccagcagcgtagctgccatgaaacatctatgggtccgaatggcaataacagaagatgaaaaaatagtagcgtgctgtcatcaaaacaactatgagccattggataacagatgttttgatgacgggaaaggagatttcgccgtatgagcaggatgagccgcaaactgcgaaagtgggccagcgagacgctggagcttccgcaggacattctatttgacttgccgcggttaaccctcatcggcagccgccagctttatgtggagaatcaccggggcgtggtggatttcacgccggatcagctcgtacttgcacttgcgcaaggcaggctgagggtgtccggccatgatctagttattacgtctattctgccagagcaggtaagtgtggagggacatataacggatatccaaatggaaggaacggaggaaggctcgtgaaacatcctgctttagcaaagctgcatggcacggttacccttgctgtcaagggcgaaagtgtggaagatttcattaatttactcaccgatcaacatatacctgtttggaacgtgcggccgatgggtactagacatgcagaaatgaaccttctgctgccgcacgtcttcctcctacgcccgcttttgagaaggacaggctgtaaaatgcatgttctgaagcggcaagggcttccctttattgttatacgacttgccaaacgtaaattttttctggctggattggctttgttctgggtaggtctcctgctgatgtcttcgcttatctgggacattgaagtgaaggggaatgataagctctcgacggaatccgttctcaaagccgcccgacaggaggggctgtatccgtttcaatggagctttcgtctttccagtcaagacaagctttcccgtgcgctcatgcagaagcttccagaggcatcctggatcggtgtggaaaaacagggtactttggtgacgattcaggttgttgaagcttcacagcctacccctgcgccgctctacagcccacgtcatatcatcagtaaggcagacgcggtagtcactgaaatttttgccgagcagggtcgtcctgtcgtgcataaaaatacgcgtgtcaaaaaaggagccattctcatctcgggaacgcttggagatgaggagaatcagcagcaggtcgtagccaaaggagaggttaagggtcttgtatggcatgaatacgaaattagcagtcccacggtgcaacgcagcagcacgtatacaggtaccagtcacgaccgcttgtatctggtgttaggcaaccgtgcgatacaattgtggggatatgggaaaataccttattctacacataaaacaacagttgaacatgatccgctaacctggcgttcctacaaacttccaatgggttggatgaccgaaagtgtgagggagacaaagatacaagagcagaagcttacggaagcagaagcgaaaatgtcaggaatagaaggcgcgcgagctgatattttagctaaatacggcaaaggaacgaaaataataagccaaaaaattttgcatgagaagagagagaatggtaaagtttatatgaaagtgctttttgaagtggagcaggatattgcggaagaacttccgttagttcataaccaaggagaatgaggctatttggcagaacaacaacgcagcatacaaattgcattgaacaatgcgggagaaggacaggcgttatttggcccgcaggattcctttttaaaattaatcgaagccgctattccagcaaaaatagcatctcgtgaggcagaagttaatgtttttggtaatgcacacgaggtggaagtgctcgaacaattgttcgatgtattactccagttaattcgcaatgggtatatactgaccgaaagggacgtccattatgcgattgaattggccaaagatttgcgcgctgatcagctgctcgatttgttcaagggtgaaattacgacgacgttccggggtaaaccgattcgcgtcaaaacgattggacaaaagcactatgtaaccacgattaagaaacgcgatattgtatttggaattggcccggcgggtactggtaaaacctatctggctgtagtgctagccgtagctgccctgaaggaaggttcagtcaagcgcattgtactgactcgccctgcggtggaagcaggtgaaaatttaggttttttaccaggggatttacaggaaaaggttgatccgtatttacgcccattgtatgatgccctatacgatgtgatgggcccagagcagactgcaaaggcactggagcgcgggttaatagaaattgcacctttggcttatatgcggggacgtacgctggatgattcattcattattttggacgaagcgcaaaacaccacacccgagcaaatgaaaatgtttttgactcgacttggcttcggctccaaaatggtcattaccggcgatgtcacgcaaattgatttgcctcgtggcaaaaaatccggtctgattgaagcgaatgcgattttacaagggattgaggaaataggctttgtccagtttgcagaagaggatgttgtccgtcattccctcgttcaaaaaatcattgttgcttatgaccgtgttgccgagaatcaaggatagccattcaagtacgagtatggtgtgtactatcagaaaaagtaataaaatcagcagtgtagctgccttagaaaaagatgatggagagggattgttttagatgacctcgaaggaattatctaaagggaaaacgttccagcatagaatgaatggatggaagtatagcgtggcgacacgctatcttctgtttttatttttggtggttcttttttatgtaggctttgcgtctaagctccttcccgagcgttatgatattcgggtaaatcaaccgagtgaaaaggaaattgtcgccccgatgcagcttcctaacagtaaggcgactttgaaggctcaagaggaatcagctgaacgtgtgcagcccatgtataccattgtgcccgttcgcaacgataacctgattactggtattttggatcgaattgaacggctcaatcaggatgatcaggtttccagagcagataagatttcgatttataaggatgagattccgcaacgtgcacgggaatttgtgcaaaattttgtgaataacagccgtaatgcggatgcctacccagataagctgctggatgaagtgctggaaaaaacgaaagagcaaacgtaccgaattccagaggagacattcattaaaattccgcgccttacatctgaggatattgctgaaatgcggcctgttgcccgtgagattgtgacagggttgatgaatgatcaaattacggatgctcagacagcccgagcgaaagtagctgagcgggttagtacaagctcgcttactaagcgtacttcacgggaggttgttcaggaacttgcaaggcttgtgattaccgccaacaagttttatgatgatacagctacgaaggacgccaaggtacaggctcgtgaagatacaccgacagtttacattaaacagggtgaagtactcgtcaagaagggtgagattattacccaggaaatctatacactgcttgatgaaaatgaattgctcaaggataaaatcaattattggccacaatttgggctgctgatgttgtctatgatgctggcattgggtctgtttatgtatattcgtcaatttcaatcacgaacacgaaacttcaagtataataatgcgcagttgctcatgctagtattaatctttgtgattacagtgggagcaatgatgttaatttccatactgcagaacagtgaacgttcctatctcggctatctggcgcctatcgcgcttggagctatgctcgtaacgctgttgcttgatatgtcgttggctttcgtatgtgccgttatattcagtatattggcaagtgttattttgaatgtccgtcagggacaaatttttgactttaattttgggttttttgctattgtggtctgtctggcagcgattttctctacccatcgagccagccagcgttcaacactgttcaaaggggcgattatggtatgcctgttcggtgccctgtctgttttttctttggcactgattgaccaaggaaattggactcaaacgacgacgctctatggggtagcttttgcttttgcaggcggtctgataacagcaatacttgttattgggctaatgccattttttgagtctacttttggtatcttgtcggcactgaagcttgttgagctgtcgaatcccaaccatccattgctccgtaagctgcttacggaaacacctggaacgtatcatcatagtgtaatggtgggtaatctgtcagaggccgcagcggaggctataggagcaaacggcttgttgtgccgggttggttcgtattatcatgatattggtaaaaccaagaggccttcgtacttcattgaaaatcaaaatgggttggaaaatccacatgattcaatagagcccaagcttagcaaatccatcattatcgcccatgctcgtgacggcgtggaaatgcaattggattacaagctacccaagccaattcgcgatattgccgagcagcaccacggaacgacattcttacactatttttatcacaaggcgttgcgtgaggctgaagagcggggggtggagcctgacttcacggaggatgatttccgttatccgggaccgaaggctcagtctaaagagtctgctgtggtgggaattgctgatagtgtggaggcagcagttcgttccttacggaagccgacggtggaacaggttgaatccatgattgagaaaattattaagagccgtcttgatgatcaccaatttaacgactgcgagctgaccatgcgggagcttgatatcgtggctcaaaccctcaaggaaacagtaatggggattttccattcccgtattgagtatccagaggaaaggcccaagtctgaaaacggaaaagcttaatataacttgtgcatgaagcacgggtagagcactagaattaaaaggagcggttggcatgggccttcaattagcttggaataatgaacaaaacgatatggtaattaacgaatctttaattacgctgctgaacaccttattagaggaggcaggcagagtggagggagtcatagacggtgaggtcgcccttaccttcgttaatgatgagcaaattcatgatttgaacagggactatcggggaattgatcgtcccaccgatgtgttgtcttttgctatgaaggagacactggatgaagagcttgaaattatttacgaaccgaatgaagaaaattcattgaatgatgtaccagatgttctgggggatattataatctctgtacagacagcgcaagctcagagcgaagaatacggacattccattgagcgtgaaatcggttttttgtttgttcacgggtttctgcatctgttaggctatgatcatcaggatgatgtgagtgaagctgaaatgatgggcaaacaggaagctgtactggctcaagcggggttgacaaggtaatgagacgtcagccttggagaatgacctttcgctatgcggcagaaggcgtgatgtatgctctgcgtacgcaagtaaatatgcggatacatgtggccgtggcgttccttgtcattgtagcaggcttaactctgcacatctcccggctcgactggttcttcgtctgcgtggctatcgctatagtcattgtagccgaactgttcaacaccgctgttgaagcagcggtggatctcatctcacctgatattcatccgctggccaaagcggctaaagacaccgccgccggagccgtgctcctggcagcggtttttgctgtaattattggtatatttgtgttttataggcctatgttgacgttaattagttcgctgttttaatggaaaaaccaaaataaaataggtgcttaatcgcgctggaggaaatgaaatggctaagaaacactttaaatcaggctttgtcgcaattgttggcagacccaatgtcggaaaatcaacactgatgaaccacgtcattgggcagaagatcgccattatgtcagacaagccacaaactacacgcaacaaaattcacggcgtatttactacagaggacacgcaaattgtatttttggatacacccgggattcataagcgccagtcaaaattaggcgattacatgaatcagactgcttttaatacgttgggtgaagtagaagcggtactttttcttattgacgctgctgaaggtctaggcggtggcgaccgttttattgcggaacagcttaaacaagtaaaaacgccagttatcttggtgctgaataaaattgatcgcattgagccggaagcgttgttacccctgattgagcagtatcgcaagttgtacgactttgctgaaatcgtaccgatctcggccaaaatgggcaacaatgtaaacaccctgctggagcaggtgcaaaaatacttgccagaaggtccgcaatattatccggatgatcaaattaccgatcatccagaacagtttgttattgccgagctggttcgggaaaaaattctgcatatgacacgtgaggaagtaccccattctattgccgttatgattgaagacatgaaagtgcaggataatggggtagtgcatattatggctgttatttttgtagagcgtgactcccagaaggggatcattatcggcaaacagggagccatgctcaaagaggtgggcaaacaggcccgccaggatatccaaaacctgctaggctccaagattttcctggaactttgggttaaggtcaaaaaagactggcgcaaccaggaccgcgtccttcgtgaccttggcttccatcgcgacgcttaaaaacagaattcgattctacgttactttagttcaagggtttattgaggctaaaaaaattgatattaaataaatatgtatagttgttgtaagcatcataaaaaagccgtccgatctctatgactgagataagtaacagtcttctggtcattcaaagcgccgcgcatatgcggcgcttaactcttgctcttttttacccttttcttccagtgatgaaataacgaacgttttaaaaaaggttatctgtatgcacgttgtagcggagcgaaggatttgaatctaaagaagcgatagcgttcgcctttacccccgaatttaaccctttgtatgttggtatattcaaataaattcgggggtaacagcgatcgtaagatcaaatcatttgcgaagcggcattccaatctacatacagcagccttttttaacgcaatccatttatttcatcgcatacttctcctctcttcgcatcatcctatttttgagatgcaaacgtcatttccgaaggaaggatgaatacaattgcgagatttttcgtggaagtattttgcgatgactggagatgtcggtgcgtatctgttatatcgggagagcgccgtgacaagggagcaagacacggatgagggagagtcggacgagcatgaagaagcccgtgaatagtacaagccactggcttcttcgcgaatgtttgggggaagaggcatgctttacagggtggaaggaatcgtcatccgcagcatggattacggtgaggggaacaaaattattacgctttgcaccgaaagcggaggcaaagcaggcgtgctggtcagaggtgcaaaaaagtccaaaagccgtcacgctgctttaacgcagccgtttacgtacggtgaattcgttttttttcgaaacacaggcttaggcacgttgaatgccggtgaaatcatccaatcccaccatacattacgcgaggatattactaaggctgcttacgcatcttatgcttgtgaattactcgatcgggtgttacaggatgaggaaacaggtgcgttctggtttaagcagctaaaagcatgtttggaggcgctggagagtggcaaagatccgctgatcgtcatgagtatttatgaatttaaaatattgcaggcggccggatatgctcctcagctggatgcatgtatttcaagtggtcaacaatgtgctgatgaagatatgtttgtcagtccgaggctaggcggagttttgtgtcggagctacaagcattttgatccagctgcattgagcgtgactccacgtacattgaagttgctgcgcttgttcgccagaatggatttgaatcggctcggcaacattgacgtgaaggactccactaagctggagatcaaacatgtcatgcgtcagttcatggatatgcagttggaggtcaagctgaaatcccgcaatttcttggatcagctcgacaagtacgatatgtgaaacgccctattctcttgactgtattgctgaaaacgtgtaatatcctactatatatctccttcgggagcagatgcattgaacgagaaagtagcgggatgtattctctgtaattagcgagttggggacggtgtaagcccagcgggaattcttcgtgaacaaggcactcgggagcatctgaatggacacggaaaagaggattgcgatctgattggtgatgtaggatcgcaatcaagtagggtggaaccgcgggagtcagctctcgtccctacgtctgtacaggcgtagaggcgggggctttttgctgtctctagcaaggcttttgggataaaatagccctgtacatacgagcttaatgagaagaaatcaccaacatttgagggaagtagaaagggagcgtgtactaatgaattttcagcagatgattttaacgctgcaacaattttgggcagaacacaactgtattattgtacagccgtatgacacggaaaaaggggcaggcacgatgaacccaatgacgtatttacgttcgatcggacctgagccgtggaatgtagcttatgttgagccttctcgtcgtccgtcagacggacgttatggtgagaacccgaatcgcctgtatcagcatcatcagttccaagtagttttgaagccttcaccggataacattcaggaattgtatttggagagtttgagccgtttgggcattaaccctctggagcatgatattcgtttcgttgaagacaactgggaagcaccgacgttgggagcgtggggcttaggttgggaagtatggctggacggtatggaaattacccaattcacctatttccagcaagtgggcggtattgatgccagtccggttgccgtagaaatcacgtatggtatggagcgtcttgcttcctacatccaggacaaggagaatgtgttcgatttggagtgggtcaatggaatcacgtacggtgatgttttccaccagcctgaatttgagcattccaagtatacgttcgaagtatctgacgtcaaaatgctctttactctttttaatatgtacgaagaagaggcaaataaagcgatggcgcagcatcttgtatttccagcctatgattatgtgctgaaatgttctcatgcgttcaacttgctggacgctcgcggagcgatcagcgtgacggaacggactgggtttattatacgagtacgtaatttggcgcgtcaggtggctgcgacctatctggaggagcgcgagaagctgggcttcccgctgttgaagaaaggaggtgcggcaaatgtctaaggatttattgtttgagatcgggttggaagaagtccctgcacgttttatcccgaatgcgattcagcagttgaagcagcgtatgacggcgtggcttgacagctcgcgtattgcttatggtgctgtagaggcttatgctacacctcgccgtttggcggtacttgtcaaggaagtagcggagaagcaagaagatattaacgaagaagttaaaggtccttcccgcaaaatcgcactcgacgaagctggtaactggagcaaggctgcactaggctttgctcgcagccaaggtgttgatcctgaacagttcacattcaaggagcttggaggcgtggaatatatttacgccactaagagcagcataggtgtaccaacagcggatgtactatccgaaggtttattgcacattttacatgccatgacattccctaaattcatgcgctgggcaagttatgactttaaatttgttcgtccgatccgctggttgattgccttgtttggtaacgatattgttaatttggagattgctggcgtgaagtcagtaaatgtgacaagagggcatcgtttcctgggacaggatgccgttgtagcaagtccagctgactatgttgaagtacttcgcaagcagcatgtcattgtggacattgaggaacgtcaaacgcttattgtaaagcaaattgaagcgctggctgccgaaaaagattggacgattgcggtcaaggatgatctgctggaagaagtgctgtatttggtggaaaccccaacagtactgttcggaggttttgatcctgcgttcctgaacattccgaaggatgtactcattacttccatgcgtgaacatcaacgctatttcccagtgctggatcgcacaggagagctactgccatactttgttacggtacgtaacggaggaagtcaatcgctggaagtcattgctaaagggaatgaaaaagtattgcgtgcgcggctgtctgatgccaaattcttttatgaagaggatcagaagctggaaattaaagatgcactctccaaactggaaagtatcgttttccacgaagagctgggaacggttggagacaaagtgcgccggattcgccgtattgctgatgctctggcagagaaacttcacgtttcctcagatacacaggaatcggttagtcgagcagcggatatttgtaaatttgacctggtaacacaaatggtatatgagttccctgaactgcaaggtgtgatgggtgaggattatgctcgtaaggctggagagaaggaagaagtggcgagagcggtgtttgagcattaccaaccgcgttatgcaggagaaacggttccttcaacgaatgctggagcgattgtaagtatcgcagacaagatagataccattacaggatgcttctccatcggtattattccaacaggttcacaggacccttacgcgcttcgtcgtcaggcagcaggtattgtgcagatcttgttgtatcgtaagctttcggctacgttgtctgatgtgttcaatatcgcgctcgatgtgcacggcaaccttggaaatatgaaacgttccgcggatgaaatacgtaaagaattacatgagttttttggattacgggtgaagaaactattgtctgagacccttcgctatgacgttgtggatgctgtgcttgcagctggatatgacgatgttgcttccgttgttaaccgcggaactgcattaatgactgccgtacaaacaggtgaggtattcaaagcaacagttgaatcctttaatcgtgtaggcaatttggctgctaaagcagtgcataagttagttaatacgagtgagtttacggagcaaggcgaaaaaacgctttacgaagcatggtctagcgcttatgaatcttatagcgtagctttacaggaaggtgatgcgacacgagcgttagcgcttgcttcatccattacccctgcggtgacggcattctttgattccgttatggttatggctgaggatgatgctgttcgtaataatcgtttggcattgctggctgctattgactcagaactgaagcgttttgccgatttttccaagcttgtagtttaaacatcagttgtggtagtatgaacaacttgaaaaaatgggtataaatatacggaacggtgtaagagtaatcttgcagccgttccgtattttactcgaatgcggatggagatgggggatgctcatggagggaaccggaactttactggatgtgcggatcgttgttgacggggacgcttgtcctgttaaaagtgaaattgcggagatagcttcccgttttcatattgaggttattatggtatcttcatatgatcatctcattcagggcagcaaaggcgtaaacgtcgttaaagtagaccgaagcgaccaaagtgccgatctctatattgccaatcatatccgccgcggagatattgtaaccaccaatgattatggtcttgctgcacttgccttggcaaaaggttgtgaagtgatgtcttttcgcggagctatgtatcgaaacgattcgatagatttcatgcttgaccgacgccatacttctgccaaagaacggaaaaaaggacgttatggaaaaggccctaaaccgtttacattagaggatcgtgaagtttttcaacataaactgacaaaacttttacttcgcttgcaggagaatgagtaacggtatcgaattatatttacgtgctaaagagatgaaggtggttaatatgagtgccggacaaggcaacataccggacgatatcattgagtcggttttacaacatcatgatattgtagatacggtaagcaagtacgtgcatttgaccaagcaggggaaatatatgaaaggcctctgtccttttcattccgaaaaaaccccttcattcaccgtgacaccggatcgtcagattttttactgctacggctgcggcgcgggaggcaatgccatcaaatttatgatggaaatcgaaggactatcctttcccgaagctgtcaggacaatggcagaagaaagtcatatcccgctcggcgaatggcagggacgtgattcatcgcatcagcatcctgagttggacaggctgttgcaagcgtatgagttaacttctaagatgtaccattttttgcttaaaaatacggagcacggcaaaccagccatggaatacttgcgctcacggggattcagtgacaagatcattgatcaatttcaaattggctatgcacccaaccgatgggatacgatcgttcagtttctggagaagcgttcttttgatcccgtggagatggaaaagggagggcttatttctccccggcatgagggtgatggatatgtggatcgattcagagatcgtatcatgtttcccatttggaatcgcaacggaaaagttattgcctttgcaggccgtatacttggtgagggacagccgaagtatttgaattcaccggagaccaagctattcaacaagagccgaacgctgtacaatctccatcatgctaaaacctcaattcgcaagctacgccaaagtgttctttttgaaggctatggtgatgttatctcggcgtgggaagctggcgtacaaaatggggtggctgccatgggcactgctctaacggagcaccatgctacgatgttaaaaggactgtgcgacgaggttattatttgttatgatggtgaccgggcaggacaagctgctgcgcttaaaaattttccgctgttggaaaatgcggggcttcacgtaaaagtagcgctagtcagtgacggtatggacccggatgattttatccggcaatacggcggcgaacgattccagcgccaaattatcgaaagtgctgtttcaacggtgaaatttaagcttatatatctgaaaaaaaaccatatactgcaagaggaagaaggaagaatcgcgtattcccgcgaagcattaaatgtcattgcacctctgtcatccccgaccgagcgggaagtgtatctgcgcgaagtatcatccgaagtcaaggtggattttgaaaccttgaagcaagaatgcaatttactccgtcaatccctgcaaaaaaaacagaactttggggataataacgaaaatgggtggaataatggtaggcataaaaaagggcaggtctccacacctaatctgttgccagcttaccatgtggctgaacgcaggctgcttcactggatgatgcaggatttagaagctgcagagtatgtagaaaagcatctgggcgacgcctttaatattgaggatcatgcagcaattgctgcttatctatatgcctattacgcgcaagggaagttaccggatacaagccgttttatttcatctttgcaagacgaccgactggagaagaacgtaagttcgatcatgatgatggatgctccaggcgtatgggcaccgcacattttggatgattatattcatcaagtgcgaaaatttccattgcaggagcaactggatttgaaaagggaagaaatgagagccgctgagcgcttaggtgactttttgcgcgcagcacaaattgcaagtgagattatagccctagagagacaatgaacacacagaggtcggatgtttctagggaggagggagtcgaaagatggcgaatgatcagcatactgaactggagacggaactaacactggatcaggttaaagatcaactgattgagttgggtaaaaaaagttcctctctgaactacaaagatatcatggaaaaactgtcgccgtttgatcaggaccccgagcaaatggatgagttttatgagcagctgggtgacttggggattgaggttgtgaatgacaacgacgaagaagttaccagattgcgtcaaaatgacgacccggaaaacaatgatggggatgattttaatttcgatgacgatctgagcctgcctcccggtattaaaattaatgacccggtccggatgtacttgaaggaaatcggtcgtgtaccgttgctttctgctgatgatgaggtggagcttgccaaacggatcaataacggcgatgaagaagctaagcgtcggttggcagaagcgaacttgcgtctggttgtaagtattgccaaacgttatgttggtcgcggaatgcttttcctggatctgattcaggaaggtaatatgggtttgattaaagcagtagaaaaatttgattacgaaaaaggctttaaattcagtacgtatgcaacctggtggattcgtcaggccattacgcgcgcaatagccgatcaggcgagaacgatccgtattccggtgcatatggtggaaacgatcaacaagctgattcgcgtatcgcgtcaacttttgcaagagctggggcgcgaacctacgccggaagaagtggctgccgagatggagctgagcgtggaaaaagtacgggagattatgaaaattgcccaagaaccggtttcattggaaacaccaattggtgaagaggatgactcacatctgggggatttcattgaggatcaggaagcattggcgcctgcagatgcggctgcctatgaacttctgaaggaacagcttgaggatgtactggatacgttgaccgaacgggaagagaatgttttgcgtctccgctttggtttggacgacggaagaaccagaactcttgaagaagtgggtaaagtgttcggtgttacacgtgaacgtattcgtcagattgaggccaaagcgctgcgtaagttgcgccatccaagccgcagtaagcgactgaaggatttcctcgaatagaagcgtaacattgcggaccttctgcggcttgaagcgcgcagggggtctttttttatctcatggcagccttggtggaggggaagaagcttggaccaggagaaaaaacgggcaatactgttacatgaaattgagcattggcggcgaagtcggctgctccctgagcaatattgcgattttttgtctaacctgtatcgggaggacgaagagccgtcgcagagccagaaccgtaacaacaccgggctgcttacatatcttagacacgggcatgggatcgcctggcttcttggttttgtcattatttcctgcatttgtttgatcggtttttattttaccgcttttccgttggcaatgcaaatattctcggcaagtgcagttactacgatttgctatggagtggccgcattttggcggtcttccgaaaagagtatgagtgcgatgttgagcactttaggcagtgcgattatgctgggttcgggtgtgtggatcattcagctccatcaaggtgaagctaaggtttggtttctttttctcgtaggcctatgcggtgtagtatggtgtcttgtgggattaactttgcggatcagcttacttcattactgtggtcttgctgggctgcttttagtgtacgcggtccttataggccgctactggcctacagcaactttagtgatgcttgaggcattttggattttgcacgcagtattgttgatctggttaagctggtgggtacatcgccgctttccgcgtctcgctttggtttatttcgctttaggcatgacactagcattcatggctgaagcagacatgattatcctgcgccatcaagcagcgggagatgtggtgttttacagcatactgaagttggcatttgttgtagggattttattttggactcgaaaaaaatggattacgtgggtgacgtcatgaaactttctcaacgattacaatatattatggaacaaattcctgccgggagcagacttgcggatattggctcggatcatggactactccctgtggctgcagtgcgtagtggcagagtaccgcaagccgtggcgggtgaagtcaacgatgggccgttgcgtgcggctcaaaagcaggtggccgaagcaggtcttactgatcgcattgcggttagaaagggagacggcttggctgtaattaaggccaatgaagttgatgttattacaatagccggcatgggtggtgccttgatcgcttccattctagagcaagggaaagacaagcttgtttccgtaaaacaacttgttctacagcctaacgtaggcgaggatattttacgccgatggctcattgaacatcaatgggtactaacaagtgaacatattatggaagaagacggaaaaatatatgagattctgacggcagtacctgattcggtaagcccactgaaacaggttgatctgtatcaaccatggaaacttcccgatagttcgctggtactgacacaggatttgttgatgcaacttggaccgctattggttaaagcaccgaatgaaatctttttttataaatggaaattggagattcgcaagcttcaggatgtgctggcacaagtggcacggtcagatcaggaatccgcacagcataagcgggaacaattgcgcaagcaaattgaacagctagaggaggtacttgcatgtttgccaaaggacagacagtaattagctacatggagcagctggctccaaaatacttggcagttccagacgatagaatcgggcttcagctgggtagtctgcaaaaggaaatcaaaagcatattagtagctctggatgttaatgatgaggttgtcgaagaggcaatccgcataaaagctgacctcattattgcgcatcatgcgattatattccgccctcttaaagctttgaacacggatcagcctgcgggcagattgtatgaaaaactgatcaagaatgatattgctgtctacatcagtcatacgaatctggatacggctgaggacggcatgaatgactggatggcggaagcactgggtattcaaagtgaaggtacgctggaggatgttcacaccgagcaattgttcaagcttgtcgttttcgtacccaaaacacatcatcaacgggtactggatgccgtactgggagcgggagctggacatattggcaactacagccattgcagctttaacattgatggctacggaacttttgtgccgggtgaaggcacacagccgtttttgggtgagccgggtaaaatggaacgtagtgaagaggttcgtattgagaccattgtaccgcagggtgtacgcaataaagttgttcaagcgatgctgaaggctcatccttatgaagaggtggcttatgacctgtaccatatggatttgcaaggccgtagctttggtttgggtcgggtcggcaagcttaaggaagcctgcacgttacgcgagtttgtcgatgttgtgaaaaacggtctcaacgtcgagcatgtacgtgtggtgggcgacttagatcgtacgatcaaaaaggcagccgtgcttgggggctctggcagccgttatgtgaacaagtcgctttttaagggggctgatgtattagtcacgggggatattgactatcacacggctcaggatgcccttatggcggggattgctattattgaccctggacataacgctgaaaagattatgaagcctaaaactgcagagtggatgcgtaaacgcttggcagaaggtcgatactcaacggaagtacatgtatctcaggtggaaaccgaaccttttcaatttttgtaaaacctcaacgtctatgagaaaataaaggtgctttctactttttacaatattttcagggttgtaacgtgcgcgcgttccctgtatactatgtaatgttgttcggaaagtttgacagacaatcgctggcggcgtaagccgcgagaggaaagtccgggctccatagggcaggatgctggataacgtccagtcagcgcgagttgaaggatagtgccacagaaatggaccgccgatggccgcttgcggcacaggcaaggatggaaccgaggtgtaagagaccccgaggaacgctggtgacttcgttcctggtaaaccccatctggagcaagacctaatgggacacagcttcttcgcgaagcagccttagcccgaggcgtgtctaggttggtcgctggagctggatagcaatgttcggcctagatagatgattgtcgcttgtagtgggagggtagttcccgtctgtaccacgaatagcacagaacccggcttacggaaaactttccccactgcaacaccttaaaatgtatgaatttaacttttgtaaatgacctgtttgcatgaaagcttttaatccaaatgtatttattaaattaaaaagggtgtgtcatattcctgtgggaatcatgacacaccctttttaacataccgtatttgcgcagaaatagtgcatttttagaatgaagcccccaagcataattactggaggctttcattttaatttttactccctctaccgtaaaaacgtgcgaggaagaggcacgtagtcagcgtagcaacgcatttgaatctgtagaagcgaggcgtgcggcttttgtcccagattccactactattcaaaatccaaacgaatcagggataacagcgatcgtaaaaacaacgtgaagcgggcctcacgtacgtgttctgccaactccatcagcgtacgctttttaccacactttcctctgtgtacatcttcagtgctcgatccaatcggtcaactgcttttggaagcagggaaggatcggtatgcgtgaagttgattcgcatatggttgctgccgctcaggtcagcatagaagacttgtccaggcacaaatgcgactccttcctgaattgcgagttgcagcaaccggtcagaacggaagccctcagggagggtaacccacataaacataccgccaagtgcatcattccatgtgattccttcccattggcgttctttcatcagcgatgtgagacgtagcatacgagtgtggtactcggcggacacggtacgaatatgtccgtccaagtcaaaaaagtccagtaactcattcaaagcacgttgatcaatactgctggagtgcagatcggcagattgtttggcattcgcgactttaacgacgatagcttgatcggccaccaaccatccagagcgaacacctggagcgacagttttagagaatgtagaagtgtacattacatgactgtctccacctaactgttgatcaattgagaaaagggatggaaagttaaggttttcgtcaaatttaagacgtccgtaaggatcatcttcaaaaatcaaagtgctgtatttacggcatagttcaacaacgcctgttctgcgttccatactccaaacacttcctgccgggttggagaaggtgggaatgacatacacgaatttaggctgatgttttttgatcttggcttcaagatcatctaattgcataccgttagagtctgtatctacacttacaatgttggcaccataggaattaaatacctgaagagcggccaaataagtaggggactccaccaatacagtatcctgcggatcgagcaacacacgcgaaaccagatcaatggtctgctgtgagcccgtcgtcataatgatattatctctggtgacggagatgccttgggatgacatgattgctgcaagacgttcccgtagaggaatgtagccctcggttaggccgtattgaagagcggtagtaccgccgaggcgaaatacccgctcataggctttagcaacagcttcgatggggaaaaaggcatcggcaggaaggccgcctgccagagataacacatctgttccctgtgtcagctttaaaatgtcccttaccatggacgagccctgagtacgagccatacccgaaaatttgtgttccaatccaatcatctcctgtgttctatactgtactatgaaatttgttgtattatatcgataatgaagtataacagtaaacgtctaaatgtaacagttgattttttggggggacagttccgatgcatattgatctcagccgcaatagcagtgtcaaattatatttacagattgccaaaacattagcagatcgcatccagtctggattgctgcctcagggcacaaagcttccgtctgtccgtcatctgtccagcctacttgcggtaagtcccgtaactgtaagcaaggcgtatgctgagctggagtctattcatttggtaacctgtacacagggaaaaggttgctatgtagcggagccttcggtagctgttcaaggtgagggagcgcaggatttgtcatggcaaatgtcgctgatcgattatttgccgcgcgcacagctatggagaaactttaaccatagcagacaggttccctattcttttcatatagcagcaattcaaccggagcttcttcctacacgcgaaatcattgctgatactcaacgtctatcctctggaaatcccgatgcaatggcagcatatgggacttttgaaggtgatttagcgctgagggaagtgtttgtagatcacttgaacgaacgcagtatatgcacagtggcagaacagctactcgtaaccagtggtgcccaacaggggattgacttggtggcacgtacttttgttggttctggagatgttgtctacatggaggctcctacatataccggggccattgatgtgtttaccagtcgtggtgccaaagtaattatgattccgatggatgagcagggcatgcggatcgatatcctcacacgtctttgcgacactcatcccccaaaactgatctacacgatacccacttttcataatcctaccggagtaactttaacgatggccagacgcacacaattactggatctagctcaaagttatcattgtctcattgttgaagatgatccattttccgacctttattataaaacaaagccgccactctctatcaaggcgcatgatcagtccggacatgtgatatatatcaaaagctttagcaaaaccgttgctcccggctgccgtatagcttgtgtagcggccacgggcagtgtaatggatcgtttggtggctgccaagtctactacggatttggggagccctctattaacgcaaaaagcgctactgccctttatcaagaaccgacttgatcagcaccttgtttggttgcgggaacaaatgcgggatcggttgacagtcgcattgcacacgctccagcgctatgctccgccagaggtcagctggtatgctcccgaaggcggcttaaatgtgtggattaagcttcctcctaatgttgatattccagaattggagcggctggctgaccgagaaggcgtttcctttttacctggggcagtatgctatgcaggtggtatgaacagtaatcatatccgtatttctttttcgtatgcggacaaggaagcacttaaaacaggtcttcacaaactgtgccgtttgttgggtgaactgcttgatcgttcggtcattgttgaacggaagcctattttataagggatatttgtattagggggtaaacatccaagcacagcacctgccttcttaatatgctgtactaattcaccgaaaggagttgcacattatgagtcattgcccttacgacccgatcgtgtgcccaccgatccaatttgtaaatcatcaatttttcccacaagtcgtgcctgtggttcatccgattgaaattgtaaatcagacgcacattgtacctgtgcctcatcacgtatttccggtgagtataaaggatcctggagaaccttgctgtcatactcgcagccatggcaagcgtcctgttcgcagcagttccaagcgttaataaagcccaaaaaagcagccatgggagcaactgaactgcacccca

SEQ ID NO: 2658 - DNA, 2967 bp, Unknown
  Kingdom: Bacteria, Phylum: Firmicutes, Class: Bacilli, Order: Bacillales, Family: Paenibacillaceae, Genus: Paenibacillus
taaccttgaaggtagaatttgcacagcaaattcatgtttggtggcgatagcggaggggttccacacgtacccatcccgaacacgaccgttaagccctccagcgccgatggtacttggaccgcagggtcctgggagagtaggacgtcgccaagcaaataaaagtatgacctctacataaaaaaccgcgattattgcggttttttttgttaccaacaaagatatgattgtcaaaaatgaagtatgaatcccttaagtcaagacaagtaagacaaaaaataacacagttttgtttttgaaataaccatgttaaacttttctcataaaaataaatgtactttctgaggtgagttgaagtgctggaacgttctatggagaatacaagggaatttcgcaaaggaaagggagtgattaaaaaaagaaaaggagattataaatgagcacttatcaagcagttattagtgatggatttgagctgaaatatgctataagaggtaacggaagaccgatactggtgatcggcagtagtgtatattatcctcgtttattttcagaccatttatataaaaagtttcagtttatttttctggatcatagagggtttgcaaaaccgactcgagttttaaaaccagaagactatactttggataaagttattaatgatatagaaacagcaagacaatgccttcatctaaatgaatttatcatattaggacattccgggcatgcttttatggctttagaatatgctaaacaatacccggactatgttcaaaaagtggtacttttaaattcagcacctacaaacagccaagaaagacaacggcaaagcttttctttctttaatgaaacggccagttcagaaagaaaggaacgttttgaaaaggacattgttttattagaggaagatatcaaaagagaccctgatagaagatttgttcacatgtgtatacgtatgggagctcaaagcttttatgattatgcctatgatgcggcttacacgtggaatgatgtatatacgaacatgcctatcattgattatttatggggagaagtattcggaaacatgaatttgatacaatccttagcggatatccataaatccgtatttattggtttgggaaggtatgattatttggttgcgccagtttctttatgggatagggtcgatgacacctacgataacgtgaaaaaagtgatttttgaatatagtgggcataacccgatgtttgaagaacctcattgttttgatcaaacactagctaaatggattaatgaagatcactagattcttgctatatcatctcctagatgctcagtggcccgtaaaatgagatcaccttcattttacgggcattcttattgagcgttatttaccttttgcaccgatgacaaaatactatgactttgttattagtgacttgacggcttaactaggttctgtataataaccgaaaggtaataatgtattgttagttttttgttgtacttctatctggaacagctcaaaggatcaaggagactgaacaatttagtaaagcaatgatatggaggccgttatgaaatacgaaattattttgtttgatgttgatgacacgctgtttgattttaaaatggcagagagtcatgtgctacataatacgtttgcccaatttggattgccgcaaggggccacggagtataaatccagctatgatgaaatcaacagttcgttgtggcgagaggcagaggaaggacatattacctcggcacagctacgggtcgagaggtttaagcgattatttactgttcatggtctagacttcaatccagatgcttttagtactgcttatttacgttatttgggtgaaggtgcttttttgatggacggagcgattgaattatgtaatgtactatccgactgtcgtttggcgatcattacgaatggaatcaaagaggtgcaaacctccagaattcagctttcgccgctgcgtgatgtgtttgagcaggtaattatttcagaggaagtgggttgtcaaaagccgcaagctggtattttcgattacgcatttaccaagttggccatctctaataaaagtaaggttctcatggtcggcgattctttaacttctgatattcaaggagggaacaaatatggaattgatacctgttggttcaacccttccagaaaaacaaatacgtctggcattcaacccacttatgaaataacaagtttgatggagctgccgaatagtgtactttcaaagcgtctcgtactgaatcgtacatcagctgaaattagataaataatgtcgaaatcagaaggccggaaattaaggacatcgaaaagttaaatgaattgtttagagttgtgattacagacacgtttgctaaagaaggcattggtcatatgctggaagacatagaggaggaaattgatactaagaggttatatttggaaagtgacttggagagtcacggtgagcagcgatatttcttaatcgctgtagatgggaatcaaataatgggttctattgaatatggaccagtaagtcaactaataagtaaatctaccagtgatacatttaaaaagttatgcgaggtaggaactgtatttgttcaccctgactaccagaagactggggtagggaatttattgttgaaatcaatgtatttggcgctgaagaatagaggagtagaagaattttgtttagatagtggatatcgtattgcgcagaaaatatggaaaaagaaatttggaactcctgattatttattaaaagattattggggagcaggctctgatcatatgatatggagaatcaaagtcaaggatgctattaaatgatcaatggcttggcaatctcttattgtgtctttaatctacagggaccaaagttataaaacaaggcaggccggaaaattgaactgcaccccatttgttagacacgactaacaatggaggtgcagtttttttgcctaaattcagtt

SEQ ID NO: 2659 - DNA, 1363 bp, Unknown
  Kingdom: Bacteria, Phylum: Firmicutes, Class: Bacilli, Order: Bacillales, Family: Paenibacillaceae, Genus: Paenibacillus
tgaactgcaccccatttgttagacacgactaacaatggaggtgcagttttttgcctaaattcagtttagatgagaaattggaggccattcgtaggtatcagcgtggtactgagggagtcaaaagcattgcacaatcattagggatgaatcatgaagctttacgtatgtggattaggcaatacgaatctcacggggtaaaagcttttgaaaaaacctatacagcttactcctcggcatataaactagacgtacttaactacatgaacgagaatgggacgtctccgaatgaagcagctgtcattttcaaaatatcctcacctggagtcattaggaaatggcgtagtcaattcaatgaacatggagtagacgccctgaattcaaagaaaaaggggcgtccacgcatgacagataagaataaaaacatcacaaagaagcaagaacctgccaaggattcaatggaggctctacaagctgaattagaacgtttacgtatggaaaacgcctatttaaaaaagttgaatgccttagttcaaaacaaggaaaaatcaccaaacaagacaaagcgcaagtcgtctatgaattaaggcatgagttcccggtggttgcattactaaagctcgcagaaatcaaacgtagcaccttttattattgggtcaaacagttgggtaagccagatccagacgcgggtctgaaactccttatccaatctatttacgaggaacatcaggggcgctatggctatcgtcgtatccgtgacgaactatttaatcgggggcgccgagttaatcataagaaagtgcagcgtattatggtcgaattaggcttgaaatcggtagtgcgtatgaagaaatatcgttcctataagggatcagtgggtaaagttgcacccaatgtactcgatcgtaattttcattcaggcaagccaaacgagaaatgggttaccgatattacggaatttaagttgtttggagaaaagctttatgtatcccctgttttagacttgtttaacggtgaaataatcacctacacagtaggggctcgccccacttattccttagtctccgagatgctgaatgaggcatttaaacgcttatccgaaaaggataaactgctcctgcattcggatcaaggttggcactaccagatgaagcagtatcaacacgctttaaagaaacaaggaattacccagagcatgtctcgtaaaggaaattgttacgataacgctgtaatggaaaacttctttggcatcatgaagtcggagtttctttatctaaataagtttgaaagtgtagatcacttcaagcaagaactagagcagtacattaattactacaatcacaagcgcatcaagtcaaaattaaaa

SEQ ID NO: 2660 - DNA, 41574 bp, Unknown
  Kingdom: Bacteria, Phylum: Firmicutes, Class: Bacilli, Order: Bacillales, Family: Paenibacillaceae, Genus: Paenibacillus
cacccgtccgccgctaggttgtttagaagcaagcttctaaacaacctcgctcgacttgcatgtattaggcacgccgccagcgttcgtcctgagccaggatcaaactctccattaaagaccaaccaaagttggtttatagaaagagcgataagctcattttgaaactgacgagataaaaatatctcttgtttgattttgcgaacaaaatcgtttcactcactcgttgttcagttttcaaagatcaaacctgcattatgtcttactttgtttcaccaccgcatctcagcggcgacttgattaatataacacacattcgggatttaagtcaacacttttttaaaatattttttaatttcatttaattgttgttctcacaaaaaaattcccgggctttaagggccgagaattaatgtatcacatttttgaattcgccgtcaactatattttaaaaatagaaacaataacatttaagttttcatatagcctgtccgaataatactattttcaatcccagtaaaaggacaatcccaggcaagcctaatatcgttaccgcccccattgtcactggattgatcgggatgtacacctgcgtaatccaccctgaataattgataacatacaatgcgatggctgccaggcccatatgtgccccgaatactacaagccagctgatacccaaacgtttttttaagattagaaatagtaacatcccgacacaggcaatcaaaacaagccagaccgcccctttcattcagctctccgcttgtgaacacgatccgtatcattggcataccccggttcatctgcaggcagatggaaacgatgcaggccttgctgtttcgcactttttaaatgtatctgatatttacgttctgcagcttctagaacaaatatagcgtagtcgatctcatctttacccgttgcttcatgaaataaacgatgcgctcttaaccattccgcatgcgaagcccgaatctgggcaaacaactcctgccgatactccgcttctgatttgccattctcctgacgacggaaattttgtttcatccgttcccacatccgttcatcctcctcacaagctgaattatgtgcacagtctgcaagattaccttattcatacttattgaacaaaggacaaacttagaaccaggaacgatctatactgccatctatcaccgcaaataaaaaaggagccatagcggctcccccaagtgagtcgagaataccctaaggacattccctccctatttataacgtataaatacacctattaattgagctctctacggccttctaacgctttggacaaggtaacctcgtcagcatactccaaatctccacccactggcaatccgtgagcaatacgagtaaccctgatttcaaaaggacgcactagccgagaaatgtacatggccgtggcctctccttcaatattcgggttcgtagctaaaatcagctccttgacgcgttcatcactgagcctgttcagcaattccttgagtttgatatcctcaggaccaattccctccataggagatatcgccccgtgaagcacatggtaaaaaccattaaactccttggtacgctccatagccaccaaatccttggaatcctgaacaacacaaatgacggaagcatccctcgtcttatcctgacagatccgacaagggtccgtatccgtaatgttgccgcagactgaacagaagtgcagattgcgttttacattgaccagcgctttggcaaagtcaatcacatcatcttccttcattttcagtacgtgaaaggccaaccgggcagccgtcttcggccctactcccggcaggcgcgtaaaagcatcaattagctttgcaatcggctccggataatacaatagcgcgtttctcctttatgcagcagactagaacaagcccggaattttcatgccgcctgtaaatttacccatatcatcattagccagttcatctgctttggacaaagcatcattgactgcagtcagtacaagatcttgcagcatttctacatcatcaggatctacggcttccggtttgatcgtgatggacaacacttttttatgtccatttacctccaccgtcacaacaccgccaccagaagtaccttcgattacttttccgccaagttcctcttgggctttcagcatttgttcctgcatttttttcacttgcttcatcatttggttcatattgttcatttcaatcatctcctttaatgaagtatacatctagacacttgatttaatctttaatgactaccagatcttccccgaaaagttgaatagcttcatcaatccagggctccttggactttcccggcgtatcatgctccggctccagttgcaattcttcggcaggctggtcggaaactccttcaatcgcagcattccaatccttttgcatcatcgttactaaacgataaggatggcccaactgctcatgcaatactttctcgatgacctgcttattggcaggcttttcggtagtttcacgatgaatattgttcttaaatgcgaccagcacactgtcctctaacacagaaactggctcaccgtccataaaccaggcatgaaccgtaactttcgcctcttttaccccttgtaaaatctgactccacttacgccccgctgctgcgaatgcttcgctcgacttctcagcgatatagcgatccaactgagaaggaagtttggctggcgctgaaatccgcggagcaggggcacgacccccggaagcctgacgaccacccgacgatgcttcctgtcccgctccagcgcccaatccaccttgcagcgcgcgctccagtttcttttccaactcagcaagctggcgcttcaacattaccacatcttcctgctcagctgcagcacctgagcgctgtgcggccgactgaacaacagctcctgcttcccccggaatactgcatagtttcaacagagctacctcaaacaaagtttgaggctgaacggcatatttcatctcgctctgataacgattaagggtgtcaatcatcgcaaagagttgctccttggtaaaagcatctgccacttccttaaatcgctctggatctagcactcgctccgtcattttggttgcctgaggcaccatcttgatcattagcaggtctcggaaatagtacagaagattctccatgcacttatccgcacttttaccttcctgcataaagttctcgatcatttggagcaccgtgcccacatcttctttcagcaacgccaaggcaagcttaccgaattgctcggacgcaatacctcccgtcatatccagcacctgctgataagtaacccgaccatctgtaaacgaggatatctggtccaaaacgctaactgcatcccgcatcccgccatctgaaagacgcgcaatgtactgcagtgcatctaaatcagcctgtatgttctcctgttgacatatcaggtcaagccgctctgtctgttcttccagcgatacccgccggaagtcaaaccgctggcaacgcgaaataattgtcgccggaatccgatgtggttcagtcgtagccaatatgaacatcacgtgtggcggcggctcttctagtgtcttgagcagcgcattgaacgcttccgtcgtcagcatgtgcacttcatcaatgatataaaccttgtgccgcacttctgtgggcgcatatttgactttatcgcgcaaatcacgaatctcttcaacgccccggttggaggctgcatcaatctcctgtacatccatgaccgctccggccgtgatccgtttacaggcttcgcattcgttgcaaggttccggcgcaggtccatgctcacagttgatagccttggccaaaattttggccgcactcgtcttacctgttcctcgtggaccgctgaacaggtaggcatgggacgtgcgattttcgcggatggcattctgcaatgtctggataatatgctgttgtcctaccatgtccttgaaagcctgcggccgccaagcacggtacaacgctatatgttccaatgcgcgttaccctctttcccattcactttcatgaccattcatggtcacttcattatactatactcccgtccgaatctaaaccagacaccttccaatttataaaacacaaaaaaacatcttcgcaatgattgccaagatgttctaatcactaatatataccgtgcacctgttattgatcgttgtgatccgagcggcaaccctgaacaacaactcgggctaggcaaccctccggcacaagagtgggcttgcttatggctgcttccttccggacctgaccaggttcacaagtactcattgcggaggacccagccgtcaacattgtgcgcagggaccagcctcacatcaacaacacctctaacaggaattcaacctcgctatagcggattgcgagttacagggcaccgctacctccccatctagcacggtgaaaataagtatatcttaaggccgcataaaaagcaaatacacattattacaaaaagagccctctgcagttgcagaaggctctaataactttataacctgcggtaatccattagataccgtatttctttttgaaacgatctacgcgtccaccagcatcaataaatttctgcttgcctgtgaagaatgggtggcaggcggagcaaatctccacacgcagagatcctttcacagaaccagtttcaaacgaatttccgcaagcacaagtgacattagttacgttaaattttggttgaatagcttgttgcattgaactttcacctctttccgccctgaacgtcctatcagtccagagttgtatgaacacatgttcacattatagcacttgaatatgagcgtttcaacaactcttttccgcattcaaagatggcgtaaaataggtgagtttcaagttgctattgaccgttttaggccttggcaaatttgggacgtgccagcccttgtgggggtacatgagtgtaagaaccgatgactacatcaggcagttcctcacgataaatctcaagcatttgcttcatgccaaggatctcaccttgagcaggtggaatcaactccagatagctttcaggatcgatattcaagttacgcatttgaatcagcttgagcttagtacgtttggcaaattcaatcattgcctcaatttcttcctctcggtctgttacacccggaaaaatcaaatagttaatcgacgtatatactccctgctcagaagcataacgaagtgatttttctacattatccaacgtgtagccgcgcggcttgtaatacgcattgtagtgatcgtccagtgcactaatggtactaacgcgcatcagatcaagacccgcatccacgattccccggatatgatcactcaatcccgcattcgtattgatattggtgtatcccatatcagtaatggagcgcacctctttgatcgaatcaataatcagtttggcttgtgtggaaggctcgccttcgcaaccttggccaaaactgatgatggactccggtgtcttcaaatgttccagcataacttctacaatttcttcaacacggggacggaagttcattcttgtctgcggagatacaaagccactgtcatccggctgttcagatatacagccaaagcaacccgcattacacgaataggataccggaactcctccttcccagcgattcaggaatgtgttcgaggaagtaagacattcgtagcccagcgcacagttagacaaatgttggtacagccgattttcgggatattgctccgtcatccgctgaacacccagtttaacttgatgacggtcacagttttccggattccacttggatggactgtcactctgctctgccgttacataaaatgccccgtctttccagactacggccgaataaccgaacaagggaagtttgtactccttatcggtcttcacatatcccggcaggcacaagcgcgtaaaaccttgcggcaataaagcccctactgcttgcatatctccgggaagagaaaccatttcccctgtttcagggttcataccgaccgggcgagtgctgggcaggcttaccaatgtagctccttccggtaacggaataagctcatcctccatgatctcaacaatcatgtctgcactacgggcaagcccatacaaagaagcatgatcatatacattgcctttttcgtcggcatacaccaaatacattatggagctcctttcgctccgttaagcctacgccattaacaaatgaatggtaacgactgtgtacttacggaacagataaaatacatgaatgggttttagttggttgtggccgggactgacgctgtggtagaacgcgcagttctccgttgttgcccaccagaactgctttgcgagctactggaagaaggtgccgtcaaatcaaacgaagccaaaaactcagcattagttttgctattacgcagctttttgaggaagccttccacaaaatcatggctttccgtcatgtttttacgaatggcccagatggtatccaattcttccttgttcaacaacacttcctcacggcgtgtgccggaacgacgaatatcaatcgcaggaaagatacgacgttctgctagcttgcggtccaaatgcaactccatgttgcctgtacctttaaactcttcataaatgatatcatccatgcgtgatcccgtatcaatcagcgctgtagcaagaatcgtcaagctaccgccttcctccacattccgagccgcaccaaaaaagcgttttggacggtgaaatgccgccggatcaatacccccgctcaaagtacgaccagaaggagggataacgagattgtacgcacgagccaaacgtgtgatgctatccaacaggatgacaacatcctttttatgttctacgagacgcagcgcacgctccaacacgagttctgccactttaatgtgattttcaggaagttcgtcaaatgtagaggccacaacttcacctttaacagaacgctgcatgtcggtcacttcttcggggcgttcatcaatcaacaagacaaaaagctcgatctcgggattgttagtagaaatgctattggcaatttctttgaggagaagcgtcttcccagctttgggaggtgctacaatgagtccgcgctgtccaagtccgacaggggccagtacatccataattctcgtagacaaatggttgggggaagtttcaaggactaatttggtttgcggatacagtggagtcagtgcaggaaaatgtagccgctcagcagcttgctcaggacttcttccattgacggcgttaacttgaagcaatccaaaatatcgttcattctcttttggcgttcggcatttaccggaaacaagatcgcctgttctcaagtcaaacttgcggatttgtgaagcagagatgtaaatatcttcggtactcgggagataattaatcggcctcagaaagccgtaaccttcgggaaggatttccagaaccccctgcataaacatcaatccgctcttctcagcttgtgcgcgcaggatcgcgaatattaattctttctttttgagcgttccgtagtacgggatctggtattgcttggccagcttgtacaggtcggtcagcttcatttcttccagatcggaaatttgcagatccatataataaccacctattcaattattaagtccattcatacatctaaatgatagacaatgatatcataaacaccattaacataattttaaccaaaacaaataaagttatgcagccatctgcctgaattataccgaattattccggttttccgataaaagattgttagatatgaaccacaatcttgtatcaagcagcggctgcataggtgttgcccgttctattgctttcgttccgagagttcgaaaaaatggcatggtttaattattcagtctgccgccatacatccgcgcccaaaagacgcaggttggaaacaaggtgatcataaccacggtcaatgtactcaacacccgtcacctcagttacaccttcgcttactgtaagtccagcaatgacaagggccgctccggcgcgcagatctgccgcttttactttagctgcattcagctgaccaccctctataatagcagaccgaccctctacgcgaattttagcccccatacgcaccagctcagggacgtgcttaaaacgattgctgtacacaaaatcgctcaatacactgacaccctgcgcttgggtaagcaagctggtcatgggagattgtaaatctgtggcgaatccggggtatatcaaggctttaacgtcgacatgttcataggaaggtgcacctagtacgcgaatactttcatcatattcctcgatgccgatgcccatttcctgcatttttgcagtgagagcctccatatgtttggggattacattgtcaatcaatacatttccacgggttgccgcagcagcaatcatatatgtgcccgcttgtatacggtcaggtatgatggaatgacggcagccatgcagctccgacacaccttcaattcgaatcgtttccgtaccggcacctttaataatagcccccatcgagtttaaaagagttgctacatctataatctcaggctctttagccgcattttcgataattgtggcgcctttggcacgtgcagccgccagcataatattaatggtagcgcctacgctgctaacatccaaataaatcttagttccgcgcagttctttggcgtgcaaatgaatagcgccgtgctcgttcgttaccgtggcacccagcgcttcgaaacctttgatatgctgatcaatgggccggggttcgaaattgcaccctcctggcaaaccgatgatcgcttccttgaatctgcccagcatggctcccatcatataataagaggctcgtaatttcttaacaggcccattcggcataggaatggatttaatggaggaaggatctattttcatctggctaccttcccaggtaaccgttgcaccaagttcctccagtatttcggaatacaccgccacatcactcaacagtggcaaattgtccaaaatgacttccgactctgccagaatggctgcgggaatcaaggcgatggcactgtttttggcaccgctgatggaaactgtaccttgaagcggccgtccaccggtgatcatcaatttttccataagcttgagggtccccctacgtgttttgcagtcggtcaaacaataatctcaaatcataaatcttttaacttttttagtggtgaaaatggaaagacaccggctaagcggtgtgctttccataccaaactattcaactgtacagatttaaatattttgtgcagcagaactacagctacaactaaaaaatacatctagcccgtgcagacgcacgaccagtttgattcattattacgctttgttgttggaaccgaactcacgaattttaccgataacggtttgtttaatcgcttcacgacctggagcgatgaatgtacgtgggtcataagcatccggtttctcagcaagcacttcacgaaccactttcgcaaatacgatttggttctcagtgtttacattgattttggaagttcccagagagattgcttttttaatgtcatgtgttgggataccagtaccaccgtgcagaacgagtggaagtttgattgcattgcagatctcttccatttctttgaatccgaggtttggctcgcctttgtaaggtccgtgtacggaacccagtgcaggtgccagtgtatcgatacctgtttcgttaacgatacgcagacagtcgtccagcttagcgtacattacgtcgccgacaacatcatcctcttgaccaccaaccattccaacttcagcttcaacagaaacgcctttggaatgagcatattcaaccacttttttcgttgtagcaatgtttgtgtcgatcgggctgtgggaatcgtcaatcataacggatgtgaaaccagcgtcgatagcttctttacatttttcaaagctggaaccgtggtccaaatggatcgcaactggaacggtgattttcatgtcatgaataagaccttctaccattttaacaacagtgtagaatccgcccatgtgacgtgctgcgccttcagaaacgcccaagattactggggatttttcttcttcagcagcgcccaaaatagcttgagtccactccaggttattaatgttgtattgacctactgcatattttccttcgagtgctttgttcaacatgtctttcatagataccaatggcatggttacagtcctcctaaaggtgtttgggtttgtctatattttagccgacatcacatacgggcttattataccacaacccatgttaaatactaaacaagcttttgcatatcaacacatacaaaaatcacgttaggacgccgttttttcatagaattgtataaggagaggatttactttcagtatttcccataatcacaaacaaaaaaccctgttgtgttaacagagttctcaaccatagtgactcacctaatcacctctgagttgtttgttcacagcgatccgcatttcgtcaatatcaaagggcttggtaaaatgcatgagcgcacctagctccgtcgcctctttaatcatgtccagttctccatatgctgtcatcataataaccttgatatcaggattcatggtttttagatgcttcagaatttcgagtccgtccatacctgggattttcatatcgagcagaaccagatcaggtggttccttctcaacaatttcaagtgcaattttcccgttcgccgcctgaaaggtctcataaccctcacttccgaacacttccattagtaaaatccgtattccattctggtcatcgacgattaatactttcttcttttccaatgttttaacctcctaagatcttaaaacgaggatcatgcagctattgccataacagcgtccgatgacgtacaatatccgtcccatacctaaaactatattcgctcctgcaaaaagaaaatcctgctcttatacataattgtggaatattctttcataatcaggaagcatgggataaaaaaagacctccctgaggaggtcttacaagccatagcattaaccttgaagctgcaatgctgcctttacaaattcacggaacaaaggctgtggacgattcggacgggaagtaaattctggatggaattgtaccgccaggaaccacggatgctcagggagctccacaatttccaccaagcgtccatctggtgaagtaccggaaatacgaagaccagctttttcaataacttcacgatattcgttattgaattcgtaccgatgacggtgtctttcgtacaccagctcgtcgttgtagcaagccgaagccagggaaccttccaccagtttgcatggatacaagccaagacgcatcgtaccgcccaaatcttcgatgtctttttggtcaggaagcaaatcgatgacaggataatcagtagccgggttaatttccgagctgttggctccttcgagaccagccagggaacgggcaacctcaatgacagatacctgcatacccagacaaatgccgaagaacggaattttttgctcccgtgcataacgaatggtactaattttgccttcaattccgcgatcgccgaagccacccggtacgagaatgccgccaatgccgcccagcatgtcagctacgttctcgtccgtcacttcttcagcgttcacccaacgaatttttacgtctgcattcgcatcaaatccagcgtgggaaagcgattcaaccacacttaagtacgcatcatgtaacgcaacatatttaccaacaatggcaatctcaaccgttttatccagcttgctgattcgatcaactaacccttcccattcggtcatatctggtgcaggtgttgtcagcttgaggtggttaactacgatttcgtccaagccttcttcacgcaggttcaacggaacctcgtagagggttgaagcatcgcggcattctaccactgcattcgcatcaatatcgcagaacaatgcaattttagccttcatatcggaggacagttcatgctctgtacggcaaacaatgacattcggttgtataccgatactgcgcagttcttttacactgtgctgagttggtttggttttaacctcaccagcagctttaatataaggaatgagcgttacgtgaatgtacatcacattctcgcgcccaacttcgcttttgagctgacgaatagcttccaaaaatggcaagctttcaatatcgcccaccgtaccgccgatttctgtaataattacgtccgaacctgcttcacggcctgcacggtacacgcgttccttgatttcgttcgtaatatgagggataacctgcaccgtaccgcccaaatattctccgcgacgctctttgctgattacgctggaatataccttgcctgttgtgacattgctgttcttggacagattaatatcaataaagcgctcatagtgtcccaagtcaaggtccgtttccgcaccatcatccgttacaaatacttcaccgtgctggtaaggactcatcgtacccggatcgacattcaggtaaggatcaaatttttggatcgttaccttcagtcccctgttcttcaaaagcctccccagtgaagctgccgtaatccctttgcccaaggaagacacaaccccgcctgtcacaaaaatatactttgtcactgttcaaaaccctcctagataagatgcaaaattcaggcgacattatgatgttatcgtaacccgtttgcacggattatcatccatgaagaaggcagcggaatcattttccatgtccgccgcccttagccctctttcatgagtgaaaacacccctataaaaaacaaaaaagcactcccgtagtacggggcacttttatacaaaaagcaaacatataagtgaatcaatcataagcccaagcaatagtttaccccgtgtccaatccgctgtcaaggaagttatccgtgttaatttgtccattgaaccagattggagagaatccacctgaaagctttaaatcagaaggggttttcaagaaaacggtcatgaaaaaggggagaacgcatctccccttgcagccttttcctaacgaagcgaatcgtcgtcttccgtcgactcatcatcattttcatcttctgaatcttcctcatcactgaggtcttcatcgtctataaccacgtcttcatcactatcatcatcatcttcttctccgtcgaacagctcatcttcgccatcctcgtcttcgctatctgcatcgaagtcgtcatcagagttgtatgtttcttcttcctcatgatagtcatcttcgtcgtcatcgtcttcgtcgttaataatacgaggacgcttggcgcctgtcagggcatcttcggatttatctaccggataccaacgtttcaagccccacagattcgtaccgacacaggcaaaacgcccgtcaatgttgatttcagtatatagctgagcaataacgtcattaatttcttcgtcggaaaagccacgcaatttggcgacttccttcatcaggtcacggtaataatacggagtattggctgctttcaataccataaatgccaaatccaccattggagtctcgtggactttctccgggtcaatcttcaagttgagtggggtactcacctagggacacttcctctcacacgtaattcacaagaacatgtttcagagcatacacgatacatgcaatactaacatatccattatcaaaactaagtaaaacctatttggaagcaaattgcaagttaaagatgggtatcgtcataatttccaggaatatccctctaaacaagacggcatacataaaaagacggggtcccccccgtcttcgactgtacccgctccgggagaaccccccaaagttgttgcacaagagcttatgccctccatgtatcgtatgtgtccacggccactttgacacgacaagcaggcctatttccataaaaaaggggcaggtttcccatgccgcagttgacgcttgctcatacaatacctcagcatggctcatcggagggggaccgtctcaaatggactatccggattttttgcagcgtctgcatgagggtatttcggagccgtccggcagtggacggaacaaacagatcatcacgttcgataagcctcaccaataccgggaatgcctgtcctatctcaggaagctgaaacccgagcttgcgggattacggcaagtacaaccggcccgactaatccgtgctttaatcgctccgctttcagggggagacaggctgggcaaatatcacaacggtgttaccgttgaagaagatacccgcatgaaggtccacgctgaaactgctcatataccaaaagcagaaaagaacctttccatgccatggggagtcaaacaggtacgtgcatacaaggcttggccttcctcgacagggaatcgggtcagaatcggtgtgatcgacacaggagcggattttcaacatcctgatcttcgtcattctctcgccagaggtattaatttgcttaaccgaaccatgctaccctatgacgataacggccatggtactcatattgctggaactatcgcagcgtccaactatgacgaaggtatggtcggcgtagcaccacgggctttaattcatcccgtaaaagcttttgatcataatggagccgcctacgtctccgatatcatccttggtatcgactggtgtgtattaaatcgtgtcgatatcatcaatatgagctttggtatgaagtcgcgcagcaaggcactacttgatatggtgaataaagcatatcataacggcattgtgattgtagcgtcctcgggaaatgagggtaagcgccgaagtattgactatccagcccgctattctcagacgatttcagtgggggctaccgacaaatacagacgcatcgcgcctttcagcaaccgggggcaatttgtagacgtgtacgcacctggcgaaaagatcacatcctcctggatccatggcaagcatcacgaaatgagcggtacctctatggctacttcccatgtgaccggaagcatcgcacttctcctttcactgagaccggaactggagcctggagaaatcaaggcgttgcttaagcgtaccgccacaccgctccgtctgcgtaaaagcgccggacgtagctctatctcgaccaaacttggagaagtcgatgccttccgattgatgcaggagggcacaaagtgaatgatattgtgatactaaacctctagtgtagcgcccggctccagagagtgaacttttctggcaggaccttcacatccaccatttccttctcttatcaactcatctcgtaccaggtcggtctgcagcttcggcgcatgaacgagtacaacctgtttgctaggcagctccttcagcatttgccgcacatctgataatccctgatgcaccttataaatcaaatgccgagctacacagttgttattttcatccgcacgttccaacagatgtttgccaaaagaaccctgtggagcatgtccggtcaatataacactgttgctaatgctttctccgctatcttcaccctcccccatgttgcggttatccgaaagatactgatagtaccaacgcgcctgtggggaatccatcatgccgtctcttgttatgataataaccgttgggttctgttccagcagactcactcgttccgcagcatcacgaggcacgaagaccctgtcactgtttagcacatgttttattcgcgccggggcttctggacgcagccattctttccagcggtttaactgtttcaatccctgccatatgtcgtgctctacaatcattgcctgttcagggaattgctcgctagcccatacgatcatgtcctgtcctctaccaaaggcaggcaccggcaacaacacatgacctccagaccctaatgtccgctccatctcgaccctcagccgctccagcttaacaggctgcgggtctatatccatgccataggcattgtccataatggatatgtccgctagattgggctctgacttccattcaggtaggtcatgcagcccctctccaacacccaagtctggcgcatcggcagcaagaagttcagattcgcggctgtaatctccagaaaaaaacaaccgcttcccttccatttctaccacataccacactgcaccagccaaatgtccactgcgtccccacataattctcacacccggacaagcctcaagccattctcctgctggcgattcatcttctagatagcgataagcaatggattggatatcctgttcgtcgtatggcaagtcggctcctctcgattcaacataagtatgccaggagcgaaaataggagcctaactgctcagcggtggccttggtcgtccagaccactccccggtatccatacttgtacagtaaggggagcgccatggaatgatcttcatgtgcatgagacagcaatacagtagtcagtccctccgccttttgcggcggaaaaaccggatattgtccggttccttcctttttcacgccacaatcgagcatgacgcgatgctgcgttccttcaaaaacatagcaggagcggccatgttcgcctgctcctccccaaatcctaagcttggtcatgatcatttccactttctttgcgagtttaagctttcgattaagatcagcagcagtgtggtcattccgaccgatatgacggccatcgccatcccaagtgacacctgtccctgctcaaattgtgcaaatatgtaggttgcagacgtctgaacggatggcggcaaaatcagcaacgatcctaccagctcgcgtgaagcgatcgtaaatgtcatcatccaaccagcgagcattcccggtacaatcagcggcagtacaatccggcggaatatgtaagacggtcgtccgccaaatacctgtcccgcctgaaaaagacccgtgtccacctgtgtaaaggcgcttttgacatactgcaccgtataaggaacaaacaagataacatacgtcagaatgaccatgccgtatgtgttatacaaagggatcggcatccacggcgagttccaccacaaaatcaggccgaccaccataacaattcccggaaccgtattcggaagcaagctaaatgcatcaaccgtccgttggattctcgtgcgtgagccgccaatgacaagcgcaaaccaagtgcccagcaccacagcaagcgtcgaagcgcccaaagagagaaatacactgttcaggagcgcctccatgctctctgatccccaagacagcagttccttgtaagagtcgagcgtcaaattatcccaggcaaggcccattcctctcagcttcatcgtcgaggctgaaagaattgaaaaataaggaatgccaatggacgcaatgagcaacaatagaataaatgcaacactcagccccgtagtccagccggatatacggagacgggacggacgcgaacctttaccacctaccagcctgtacgtaaactttcggttgatcaccgactgcgcataccacatgagcaggcaggcggttaacagcaccgaggccattgacgtcgctttgccaaaatctatgggccagctggagatatatttgtgaatttccgaagtcatgacctcatacccgatacgtcgcccaaaggtagcgggggtaccaaactcggcaatcgttttaacgaaaatgagcaacgcgcccattccgtaagctgatagcagtagcggtaaaataattcgacggaacctgtacagaaagccgccgcccattacggcacccgcctcttccaggctcccgccaatcctcaccagcgccccgcgcagcaacaggtacaggaatggaaacagatgcaggctcatgatcatcaccatgccaccaaggctgaagaaggacgacgttaagaaatgcaggtccgggaacaactgctccagatatccgtttttttgcataaacagaatccagcccatggacccgatatagggcggggtcataaacggaatcagcaacacgacatccaaccagcgccagtgtgcaagacgagtgttggacatgatccaggctagcggaagtgcaagtaccgtcgttcctgcaatcacacagatgcctagccaaatcgagctaaatagcacgcctgcaaatggtgaagcagctaacgttcgaaaaggcgcatcccattgaaatttttcatcaacatatacactttggataaagatttgcagcaacggcatcacaatcaggaaaagaagcgcgattagagccagcgtcagacaccacgctctgatgtgtttaacggataagcctcccatcggcttacttgaacatttgcgtgaacttctccgtcacgtctgatccgtgctcacccatccactcccaattggttttcaacaatggaatctcgtccaggttggcacgcttgtcggctttgacatccgtgcggcccgggagtaaggaggcatctgctactagtttctgtgcctcttccgacaacagatagtcaataaatgccttggcattctgctcatgctgcgttgacttgagaattgcggcaggacgtgggctgatgactgttccctctgtcggataggcgatatcaatcggctcacctttggctttagccttgtaggtcatgtaatcgaccgcagcgacgactacacctttagctccggtaatcacggggtccagcgcttcctgattggcaccagccatagcaacaccgttagccttgtactgctcgaacaacgtccagcctccatcgcccttggcgctcagatagcctgtcataaaatccaacgctgagccggacagggatggatcgggaatattaacctgatccttgtactcaggcttcgccaaatcagcccacgaagttggtggtgttttcaccagcttcgtgttatacgcaatgcccagagcagaagcactggtactgaagtagttgccttccttatcggaccagtctggatttagcttgtctgcattcttggcatccgggtaaggcagcgtgagtccttcctttttcaggccttgtacagacggaagcgatgccagcacaaccacgtccgctaccggattcgtcttctcggcttccatgcgggccaaaattttccctgtcgttccctggaacaactctaccttaactccgctctgcgcctcataccctgctaccaactttttcgccagtccatccgggcctgcgctgtagaccaccagcttctgatcggtggatgccgtctccgcttgtcctgctgatccagtagcttgtgccccatccttggatgttgtagctgttccgcaacccgccacagcgagtccaaaagtcaaggttaatgcgagcatcgtcccttttttccatcctgtacgaaaaacatgcctattcatcatcttgtatataccccttttccctatgcttcaagttggtggatgtgttgcggtgatacccaaacgtgcatttgttgacctatgggcaagcggctggaatgatatgcagtccattgctcgccgttctcggctagtatacgaatttcataacgatcgccgacatagctgacatgcaggatctctactgtaaaagcatgctgatctgcttgctcctgttcccaacgcacatgttcaggacgaaatagtgtccgttccgactccagccagttggatttgccaataaacctcgccacctctggatgagctgggcaaccgtagatcacctctggtgttccggtctgcaaaatatgtccacttttcataacaaccacttcatcagacatggacatggcctcgatctgatcatgggtgacatatagggcggtcagccccagatcgcgcacaagcgatatcatctcaatgcgcatctcctcccgtagcaccgcatccagcgcactgagtggctcgtcgaacaacacaagtcgaggccggatagcaaccgctcttgcaaaggcaacccgctgctgctggccaccggacagctgatgaggataccgatcctccatccctgacaatctgaccatgtcgagcgcctccagcaccactgtccgcagttccttgtctcgagcgctggcgaaccctttccctcgcttgcccgcacgcaggccgaaggccacattttcaaacaccgtcatatgcggccataacgcgaaatcctgaaagaccatgccaaagtggcggagatgggcgggaatatcctttttgcgttctgccgaaaaaagaatttcctctcccatcgtgattgtgccggtatccggtgtctccagaccagcaatcaagcgcaagagcgttgttttcccacagccggacggtccgagcagtgttgtgaatttgccccgtcgtactatcaggttcgtctcatgcagcgcggttatttggctgaaggttttacttaatccgtgaatatatagatcctgatccatcgcattacctgcctgttcttctgactgaccccagtgtaaaacttgaattcgcaacctgtgttattggaaagttaaaacaaaattaattatttcaatgaattgtgttaacactcatagatttaatctatatagaggggattgatgctgctacccatagaaataggcatgattgttcgattaacctgaaagcgaggcattctaagtgaacttaagccttctaaagttacatattgtagagctgctaaataagcaccataaaattaccacggtcgccgagcttcttggcctgaagcaacccaccgttacttttcatatgaaaaatctggagcgtgaattcggagtaaagctgtttgacacacgtatgggcaaaatcatcctgacggatgccggaaatgcactgctgcactatgccagcaaaattaatgcactggctgctgaagctgagcgagtcgtccgcgagttcgatacgctccagcggggaagtatacgtattggcgcaagctatgtacccgctacctacttgcttcctgctgtgctgcaccgctttgcccgtgagcatccgggcattcacatcgccttgtctgtgaaaacagcgcccgtgatcaaggacatgctcgctcgccacgaaattgacctcggcatcatttcggcagagccgtttcaatccccaacgctactctcagaatccttgggcgaagatgaactgatactcatctgctcacccactcatccgctcgccaacgaaaccgatttgacgcctgagcttatcgcttcttcctccttcgtattacatggcaaggagtccagcacacgccatgtgaccgacaaatggctggaacgtgggagtcggcgacttccttcctatctggagctggattcactggaagccatcaaacaggcggttatgctgggagaacacatctcttttgtctctcgcattgccgttcagtcagaggttgagcggggcttactggttgtaagacctatcccggggcagtctgttgagcggtacatctatatggtcagcaacaaagaccgtcatcgctcggcgctcattcacagattcactgaatatttatcatggaaccaagattaaatcttacctgtcatatagaaattatataattttttaaccggagtcccctcttgctttgacatacgactgacaatacacccgtaaagtgtagcgtgtaacctattcggacgaacaggagaggatgaaatgaaaacaggccttcgtatcaccaaattgatgtcggtagtaactctgagtgcagtactgctcgtaacaggatggaaaggagcagaaccggtacaagccgccgccaatgccacaccaagctatgaggtgaagctactactggatacggctcaggtcctcaatgcggatggctcattaaaaagtggcatcgtgaacgagtttcaaattagcaacgatgcacaacgattgagcgtcgagtattttgatacaaactcattgcaattaaatgacgagggctggaacgtgagatttcgcaaaaaagaggacaaaaaaaattatgaattaacctacaaaaagcgatatacggtcacaaatggaaatatcgacgcggcgctcacccaagcgaataaagaagggttcagcgcatctgatgataattatgaggctgaggtggattggggatacagcaagcaaacactaagcttctccaatgataaaaaaacaaacgcctccaaaggattggctctgccttccccagatcaagcattaaagcaactgcaggataatcttccgggcaagctgcaaaactggaaaaacagcaattggggcaaacaaaccttggcagactccagagtacgcggtcctgtacaggtcagtaaatacgagggtagctttcagggattggataccgacgttgaaatatggcctattcgcagcgcaaacggatcaggtacagagcatattatcgaaatctccttcaaaacctcggattacagtgttgccgccagcaaccgcaccaagttgatgaacctgctgcaatccaaaggatggctggttcccgccgattccctgaaaacgaacttggtactggaacgctactaagctaatccaacataaaaaggaaccgaagcgccaccctgttgagggtgatacgaacggttccttttattattaattatatgactacaaggtcattacgttaagttgtttgcttacatacgttctggtgcagacacgcccaccagcttcagtacgttggcaatggtcgtgcgcaccgcaccaaacaacgccaagcgtgcctgcgtttgagcggcatcctctgtgatgacgcgctctgccttatagtagctgtggaacaatgaagccagctcgtagacatagcgaatcatacggtgtggtgcaaagtttgcagccgctaccgatacttcttccggcagctcgccgattttgcgtaacagatcgtattcatgctcagccgtcagcttggacaagtcaacttctgccaacggcaggacagcaataccttgctcttcggcttgccgatatacgctgcatgcacgtgcgtgcgcatattgtacgtagaatactggattctcattggaagtggaaatcgccaaatccatgtcaaaatccaggtgcgaatccatgctacgcatagtgaagaagtaacggatcgcgtctacacctacttcttccatcagatcttccatcgtcacggccttgccggtacgtttggacatttttactttttccccattttggaacaagctgaccatttgggcaatcagcactttaagcttatctggatcattgcccagtgcttccattgctgccttcatccgtggaatgtagccgtggtgatccgctccccaaatgttgatgatcgtgtcataaccacgagcatatttatcgcgatggtaagcgatatctggggttaggtacgtatatgtaccgtcatttttgatcaagacacggtctttatcgtcaccgtacttggtcgtattcagccatgtagctccgtccttctcgtaaatctcctcacggtcacgcaactcattcagcgctttaagcacttcaccgttttcatacagcgacgtttcgctgaaccaggagtcaaaaggtacacggaacagttccagatcgcgcttgatcttgttcagttccttttccagaccgtagtcacggaaataagctgcgcgatctcccggttccatggacaacagagaatcgcccttttcggccaccagttccttggcaaatccgatgatatcctcaccatggtaaccatcctccggcatctccgcaggctgtcccagctcctgcaaataacgcgcttcaatagagcggctcatgttgtaaatctggttgcccgcatcattaatgtagtattcacgagttactttgtatccggcaaaatcaagcacgttgcagagagcatcccctacggctgcaccacgtgcatgacctaagtgaaggctacctgtcggattggcgctgacaaactcgatttgtacctttttgcctgcaccttcctgtatacgcccgtaatctgccccctgctcctgcacttgtccaatgactgcatacaggtagctcttgttcaggcgaaagttaataaagcccggtccagcgatttccgcactttcaatagaagcggaagctaaatccatattcgcgatcaaatcttcagcgatttgccgtgggttcttcttcgcaatgcgggtgagctgcatcgcagcgttggtagccaaatcaccgtgtgacttgtcctttggcacctccagcgtaatggtcggcagctcttcgcggctcacgattccggtagccagcactgccgcttcgattgctgaagtcaccttttgattaataagttccagtggattgcttgtcatgattattgctcctcctgtatatgcaaactgatggcaaaatgccccgagaaatcctcaaatacgtacagatcataggtccagctcacatgtccggtgaaaccatccatccgaatatcgagcttctgcgtatgcgcagacatgttcaggtttaaataaggcgagcggtaaaatccaggcaacctgcgtcccagcgcaaacgactgctctgattgtacctcaccgtgacgaatcagctttagctcatccgatccgattttgactgtgttccgtgtcgtaccgccctcaggactttcttgcggctcatcgtaccttatatatagatgcttcccacgcacgatcgcttctccgggaagttcctgtaccacatcttctccgtcatgatgactatgaagacggattcggacctttgcattatgtggcatgtattcaaactccattctattgctatcctactgtactactatatccagttcccgattgcaattcaaatgagtttttacaaaaagatgctttcatccaaaaaattcagctaccttaagtcagctccatcggatgcttggctaaaactttcgatgaatcgagaggctagagaagacatgtatttatccttcagccagacagccgccacacgcgtatgcaattcctcacacataatttccttaacgattaactggttattgcttccgagtgacaacgcagaccgcgaaatcataccgatccccagcccttcattagcccagtgaagcgtggtgcgagcatcatcgtttttgcaaaagaaatttggctcaaagccatgcttcatacaggtatcgtggatcaattgttcaaagcggcgatatacgatgagcggcctgttcttcaactcagacaatgaaatggtcttctgttcggggttccagtcatattcttctgtcatcacagctatcatcggctcagtggacgcatatctacaccctaaatcggtagtattaaaaggggttctgacgataccgacctcgacaattcctttgttcaaaagatcgagaatcatgaacgtatttccctcatgaatttcaaattttacacccgcataggttttatgaaattcggaaagcctgtctttcatcagcgttgccccagaggaggagaccgttccaatggtgagcgtacctttcatccccatggcaaaatcgtttatctctcttgtcgtggcatctgtcagctccaaaatctgcttggccctgttctgtaaaataatgccggcctccgtcaactggatgcttcgtgagcctcgatgcacgagctttacgccaagctcttcctctagctgcatgagctgctgacttaagggaggctgtgcaattttcagctttttggctgccgctgtaatctgtccggcctctgcaatcgccaaaaaatacttgagatgtctcaattccatcattatggacctccggtactgatatatgtaaaacctatacctctaatatatattaaatattattcatatggttggggatatgccataatcaaactcagttatgctattgcggcatgaagctagatacattatttaggttaggtgatggtttaattgctgaaatttgctgtttttttgaaaccctataaaaaggaaacgattcttggacctctgtttaaactaattgaggccatcctggaactattgctgcctacgatggttgctttaatgatcaatcatggtgtaggtaaaggagacacccattatgtttggcagatgggtcttttgatgttactcatgactatactgggctttggcagttcattagtttgtcagttttacgcagctcgtgcctctcaaggattcggaactacgctacgcaatagaatgtttaagcatatttcttcgttttcttatgctgatctcgataaattcggtacaccctcgcttatcaaccggattacgaatgatgtcaatcagctgcaaacagctgtagcgatgttgattcgtttggtcattcgcgctccttttatttgtatcggggcgattatcatgtccatgattctggacttccgccttgctttggtgctgttggcggctacaccgattctggctttgattctgtatgtagtcattacgaaggcttctcccctgtaccggctataccagaaaaaactcgataaaatcgctctggtacttagcgaaaatcttacaggcgtacgggtcatacgtgcatttgctaaaagaggagctgaacgaggaaagttcaatgccacctcagatgacctgacccagactgctattcgtgtcggacgtatttctgctttgctaagccccgccaccttgttggtggtgaacggagctattattgctatcctgtggatcggcggtatccatatccaatatggatctcttacacaaggggagattattgcctttattaattacattacgcaaattttactggctctgattgtggtaaccaatttaattattttgttcaccaaagctgccacttcagcagcgcgtattcaggaggtcctagacacgcaagcttcgatttccgacactgctgctacttctacatctatagacagggagggagcaagtgagcatggcgctgtaccagccatctcttttgatcatgtttcctttagatacaataagacaggacaactggcactgagcgatatagtggtaaacatctatcccggtgaaacggtcggcatcatcggaggaacaggttctgggaaatccacctttgtgaatcttattccccgcttctatgatgcggtagagggtcgtgtgcaggttgatggcatcgacgttcggcaatataagctcgagcaattgcggcagaaaatcggaattgtccctcagaaggcactgctgttcactggtactatagcggataatatccgttgggggcatgaacacgccaccgatgaggaagtcgctcaagcagcagcaatcgcgcaagcggatgagttcatttccaacctgccggagaaattcgatgctccgatcacccgaggggggcttaatttgtcaggaggacaaaagcagcgacttaccattgcccgagctattgtcggcaatccgcaaatcctcattttggatgactcttcaagcgcactcgattttgcaaccgacgccgccctccgtaaatcgctacgggaaaatagcaccagcatgaccgtcctgttggtctcgcaacgagtaagcagcgtacagcatgctgataaaataattgtgtttgatgagggacggattgttggtatcggcacacatgaacagttgatgagcagctcagatgtatatcaggaaattaatcattcccagctctcaacgcaggaggtagaccaatgagtggcaaggaaacctggagaagattgttaacctatgtgggtcaatataaaacaacaacatgttgggtcatcgtcagtgcagttctcagcgtgcttgccagtctgatcggaccctacatgattggtcaggctatcgaccatatggtggataagggagtagtagattttaaaggtattgcgcagattctagctggattaggcattgtatatgttgtaggcagtctatttagctggctgctcacgtatttgacgaaccgtattgcttatcagaccgtaaatgatatgcggcgggagttatttgatcattttaatatccttccattaagctttcatgacactcatccacaaggagacagcattagccgttttgtgaacgatatggatgctgtgtcggatggattactacagggcttttccacattgattaccgggattattacgattataggctccattgtactcatgctgtatatcagtccgatcatgacgttggtcgtattggtgtctgccccgatcacatatggcgtagcacggttcattaccacaagatcgcagcgtatgttccgcgaacaggccaaaattttaggaagcctgaacggttatgtggaagaaatgatcggcgggcaacgggtagttaccgcttttcattatgaaaaccgctcgctcgaggaattttcggccagaaacgaacaattgtatcaagccggagtgaaatcgcagttttacggatcactgtccaacccctctacccgattggtgaacaacatgactttttcagtcaccgccatgattggctgtatctccattattttgggtgggatctcggtaggcggattgtcgagctttctgatttataccaatttgttcgccaagccttttaatgaaattacgggtgtgctgacccagttccaggcagctacggcttctgctcagcgcatatttgctattttggactcaccgccagagcagcccgaaaaatcgaacgccgtacagctggagcacagcaaaggcacgattctttttgatcatgtcaaattctcctataacccggaacgtacgctcattacgaactttagtttggaggtaaagccaggcactcgtgtggccattgtcgggcagactggagctggcaaaaccacactcgtcaatctgctcatgcgattttacgatgtggacagcggctcgatatccatcgatggggtgaatatcaacgacatgagccgggacaacctacggactaactttggtatggtgcttcaagatacatggctgttcagcgggaccattcgggacaatatcgcttacgggaagccagaggccacggatgaagaagtcatcgcggctgcaacagctgccaatgcgcatagcttcatcaagcgactgcctcatggctacgatacggtcatcagcgggtcaggcgacagcctgtcgcaaggccaaaaacagctgctcaccatcgcgagggtgattctcgtcgatccacctatgctaatcctggatgaagccaccagcagcatagataccctgacagaagcgcgtatccaaaaagcatttatgaaaatgattgccggacgcaccagctttgtgatcgcccacagactatcaaccatccgcgaagcggatttgattttatacatgaaaaacggcgatgtcgtggaaagcggtacccatgagggactgcttgccagcggcggccattatgcctcgctctataacagccagttcactacagcctaacactgcgggttaaggggaaaagtcggttgctcttatgcaatcggctttttttgttgtgacacaggaagaaacaaagctcaaatgcctgcccccgtagcggttggatgatccatttgctcactttcctgaaaatccctgcggtacaaccagccgatcaagatagcaatggtcgtcataatcgcagccaacaaatacacctgcaccataccgaaacgatctgcataccagcccatgaataacaaggacagaccgaaagcgagatttgtaatcacatcaattcctgccatcactttgggcaactgggctgccggtgcactggtttgcagcaaggtgcggcgaataatccctgccatttgaacaggtaagcctgatacagcaaaaagaataagtgcagcaacggggattgtattcagcgcaaatacaattgtaatcagtacatacaccagcaacgctccgagcatgtataaaaagctgttcttttgcaagcgcttgaccaaaccaacgacaatcaatccacccaaaattgtgcccgagaaaaaggacgcattcataaagccccaccagcttgcatcccgatgcagcacttggctgacgtacgccaaaataaatacgccgagccaggagactcccccaatactatccacactatcgacgatcatcagagaacgaatacgacggttgtgccaaatgattttccagccttccccaagctctttccaatgggagcctttttcctttccctttgcaggttctactagatttgttgaggaatccgaagcttcaagacttaattccttctgatccagcggatcacggatgaaggacgtgacagttacagccacaagataacaacaggatgcgatcacaagcgtattcagggaacccagccaagccacaataattccgctcaacgcccagcctgcacacttgaccacctgatcactgaccgctaccatgccgttggcccgcattagtccttcacccgtagccaaacggggtacaagcgcattacgcgcgggatttgtccagccatccagaaaagacataccaaacaccatcacaaaaataaatagaaatgacctctgctcaggtacaatccacaaataaagcagcagcagtgtaaaaatgacaaactgaccaaactgggaaaatagcaacacgcttgttagccgaaatcggccaaggacgattggtgcaacgagcccactaagcacttgggcagacaatcggaacagcgggattaaaatagtcgtcattaaggaattacttgaactgaacaccaataccactacactcaacatgtagatgatatctgctacattggagatcgtctgagacccccacaggtaataaaaagagcgtctgatcaaaaaagtttccccctctttggtacatcgccgattgatgtatttccataaccaaaccgtccctgttgacattacaaatctgttaaatgtctggttttttgtatattctacgtacacccttaaatttccttcttttatcttaaaaggaaatccggtgtccagtatgcttttataccctttttcaaatcttatccaacacaaaaaagcgcctatagcgctctttcccacccaaaaacaggcaataaagaccactaaggcgctttttaaaatgtttacttcgttaaatcttctacaaacttaggtagcacaaacgccgctttgtgtagacgcggactgtaatatcgggtgtccatttctggaatctgagtctcgtctacttcgagcggatcatacttcttactccccaacgtgaatgtccaaagaccactcggataggtcggaatgttcgcaccatacacacgcacaattgggaaaatttccttcacatctttgttgaccttctgaatcagttctgccttgaaccacgggttatccgtttgcgcaacgaaaatgccgtcttccttcaacgcctcaaaaataccttggtaaaacccgcgctcgaacagaggggctgccggacctaccggctccgtcgaatcgaccataatgacgtcgtattcatttttgtgttcaataatgtgcatgtatccgtcattgactagcacttctacattaggctcgtccagctttcctgcgatttcaggcaaatattttttggaatattcaatcaccttaccatcgatctcaaccaataccgccttttctacttcagggtgcttaatgacctcacgaataacgccgccatcgccaccgcccacaaccaaaactttcttcggattcggatgtgtattcaaggccggatgtgctaccatttcgtgatacacaaattcatccttaaccgttgtcatcaccatgccatccagaacaagcatattgccgaattcctcagtctcgatcatagccagatcctgaaaatctgttttctcagagacgtaggtttgtttgatttttgctgtaatgccgaaagagggagtctgcttctccgtaaaccacaagtccatcattccaaccttctttctgatcaaagtatgtgtccggcaatccggtagcataaacgttgactttccttatatcagcaacacgcaaacgccgagtttgctatatttattgtaccaaacgcattggaatttcacacttttgcattatatgtgatacctgaatggactgcaaaagcaatttgaagatttaatcttgtttaaaatagacacgtgtgtgtatctgatgaatagacgctttcggattgactatactgagaacatcaactatggaaggaggtggcatgatgaccgatacgaccgggcgatcccccaagcgtaaaccgctgtggcttcgatgctttcaaggactgatgtctctcactattctgacggtcatcgccgcctgcatcctgctcgcctatttgtacacgaccagccttccgctcgcggatacggatcggaattcacgtctactcgatagtcaggggcaagtcatcgccactttctctgctggaggcaaagaatccattccggtccagcttgatcacatttcacccgatttgattgcagctaccctggctgtggaagatcggaagttttacgatcattttggctttgatttcaaaggtctgggccgggcggtaatcgttaatctgacccgctgggatatgtcgcaaggggccagcacgctgactcagcagcttgcacgtaatctgtacttatctcatgagaaaacgtggacgcgcaaagccaaggaggccatttataccgcacagcttgaaatgaagtacaccaagaatgagctgctgcaaatgtatttgaatgaaatttactatggtcacggcgcctatggcattgaagcagcttcgcaaatgtatttcggtaaatccgcaaaggatctcgatttggccgaaagtgccctgttggcgggtattccgaaaggaccgacctactattcaccgtataatcatatgaaaaatgcaaaggatcggcagaaaattgtactggactccatggctctcattggcaagattactccggccgaagccaccaaggcctatgaggaaatgctggccctgcggcccgagagccagcgccggacagtggaaaccgctccctggttccgcgattacgtccgccaactggcgactcatcaacttgggattagcgaaggggtgcttgagcatggcggcctgagcatttataccacgctggacatgcacatgcagcaggcagccgaggcggctgtaaacgaaggcatgaagaacagcaacggactggaaaccgcgttaatctccatggacccgcgcaacggacatgtcaaggccatggtcggcggaacgaactatgtcgggaatcaatataatcatgcgctggccacaacccggcagccgggctcagccttcaagccgattatgtatctgagcgcgctggattccggcgaattgacgagtacgtccaagttcgaaagccgaccgacattgttccactacgataacaaccgcaagacctataaacccaaaaattttggagacaaatatttgggcgaaattgatcttcggcgcgcaattgcggcgtccgataatatttatgccgttagcaccattttgaaggtgggaacggacgaggtcatggacctcgccagcaaaatgggcattacaagcgagctcaagcccgtaccctcgctggcgctgggtgtgtcacccgtcagcccgttcgagatggcctccgccttctcggtcatcggcagcggcgggcaaaaggtggctccggtagcagtgctgcgcatcaccgatgcggccgggcggtcgctgtacgaagcgccccaagccgcgcccgtgcaggtggtgaagcccgcctccgcctatgtcctcacacgcctcatggaaggcgtgttcgaagaaggcggcaccggcaaccgggtcgcgaagctgatcaagcgcccggttgccggcaagagcggcacgaccaacaccgatgcgtggatggtcggctttacccccgaactatccaccgctgtctgggttggctatgacaagggcaaggacatcagcacacaggatgcccgaagggcggctccaatttttgcgcaatatacggagaaagcgctggagaatgtgccgcccaaaatctttcctatccccgacggcgtagtcagcgcttatattgatccggccagcggcaaactggctgcaccggacagcccggataagcggctggaggtatttgtcagcggcacggagccgaaggagacgctgtcggggcaagataacccaccggcatcaacaccaactgaccaagcggagcgacaagccgaaaagaaatcatggtggggcaattttaaacgttggtggatggaatagcaaaaaagactgagggaacgcgatgagcgctctctcagtctttttattttcgcttcactttacctcatgtgcccatttacctctcttgacagtgccatcagccatcatcccgttaagccccgctcttccctaaagctgcgctattaccaataacagctaaacgactcaatacggttagtgtctacaccataataaaaccaaaaacgtccactccaccgaaaacccgctacggatgtcctgcctacaaagacagggtacatccagaaacgctctccgttcgtcagccatacaaacgtgttgcggaacaaacaaccaaagatggctccagggtcaaccgcatacgccgaaaccagcggcttgggtggcgtaaattgcggtggtggggaagttggtgcttgagtttgctgcccaccttgcggaccgaatggcccctgcggcggcggtgagaacggctgtggcgaaaaaggccctgggcctggtggcggacctatcggagatgggaacgaatcctgcatatcaggaaattgtggaatcgaaggacctgacggcgtgaatggacccggagtacccggttgcgttccgaaaggaacttgtggcagtaaagacatgtgtttcactccttgtgttctaggctgatgtatcctatgcgggacatcagcccgcggactgggcgaatccccatatcgccgccaaactccgccatttcgtccttttacatcaaaaattcttatttcctgatacgattaactccctttctgaacatgctccagctcaatttcatgcaccattttaatctcgattcgtttccttagctcataataccgttccagtagtcggtgctcaacccccaactgttcattcatccagcctataatagagtcatcgtgatgttcgttagaccagctaaacaaatcgctatatagctgaccaaatgattcctcattgctgcgagcgaaccggatcggtcgggctgtatagcttagctttagttccaacatctcatgtagcacgtccaaacggtattccaatgtctgtacatcttttttggatgtatcgtagctttttatatcctgaacaagctccctaaaggttagtcctacatgctgcatagcaaaataagaccacacacaactgcctgtagccgttccatgagcctcccaaaacggattccacaggatagatcggatcgtctccttctgcccttctccaaacaatgcgattccagcaataattcctgcattacagtctacggaagcatgttgctctccccaatgtaccaatcgcggaatcatatcttcagtcgtgcatttgaagcttaacagaggtaagaattcattaaacaaattctgatccagcgctttttccaattcagccgccagtttctcacgatacatttcgcatggaagatgtaccagtcccaaacaggcatccacagacacagctccatacggtccgttcaccaaagcgacgagatcagcagcaacctccacataacccaaataacctagcgcatacagcacaccgtcaggtatatgttctggggatgcctgatttcggacgtaacgctcgtacatatcctgcgccaaagtaacatccccgcatctcatgatcggctgaaggagcaacccccggatataatgatggggatcttctacaaaaagcctatataattcccacgcatcctccactgtcccatattgggcaaccacatccgtataggcagaaatgatgctggcatccagcttcttagctgagccgaacatatccataagtcttgctgtcgcgtccattatcctgtctttctcctttcacgtgtgtacgtcttcatgaagcacttctctaatgctgaatatttctattaaaaaagaggaaagatgttatcatctacgatacaatctagggagttgatctcatgcatgattccagtccaaaaatcacaacatttttcatgttctccggtcaagcagaagaagccatgcaatattatacctctgtatttaagccgtctggtatcatgagcatttttcatcaggaagatgggaccgtgttacatgccgtattcaacctcaaagggcagacttttatggctatagactataaccatcaggacaaacacccttttaccccagctctatcgctattcgtcacttgtgattcggaagaagaaatccatagcgtgtttgaccagctatctcaggaaggccgagttctaatgccccttgaagcctctcccgtaagccaacaatttgggtgggttgaagataaatacggagtctcatggcaattgaacctggcaaaagactaaatttcttctctaaacgatccagcagactctagaagtctacgaaaaaacaatagaccatgctccatctttttttggtaatattatatttaataggtgccagtaaaaggatgtgtgtttattgtatagtgcaaattgtgaacaatgttttggtttatgctgtgtagccttgccttatgcaaaatcagctgattttgcttttaataaggatggaggaaccccttgtcaaaacctaaatgcggattatcgttgtgatattcataagaatctaagaaacaacggcttgcgaggctgtacggtatatgattgctttggagcaggtcaaaaagtttcccaagttacatacaagggaaaaagctggcgagacgatccggcaatagctgaggaaatgttcaatatatttcccatcatgcaacagcttcatgaaatgctttattacctcaatgaagcccttaacttaaaagaaactcaacccatctatacagacttacaaaaagctatggcgaaaaccgagcagcttacggatcaagatccaaaatccctcataaatcttcatgtaccaacccatagggcgttagtcaatgatttacttttacaaacaagtgagttagtacgagaaaaaggtaagaaaaacgtggagcacaataaatatagtaaaaaaatcaggagtagagaccttatcggggccaatttgagaggcgctaatcttagaggtaccaacctgagaggggttttaatgattgctgctgatctgcgagaggctgatctgagaatgacagacttgatcggtacggattttagagatgctgatttaagtggggctaatctggaaggaagtatctttcttacacaggcgcaattaaattcggctaagggcaattgtaaaaccaaactgcccccttctctaagcattcccggtcattggctgcattagagtttattttatagtactctccaagaaaatacgtaattaagtaatttatatctcaagacgcaatttccttgatgatcatgttcggcatgttcattctggcattacttacctacatgaaaaagaaatagaccgccccgatccaaggtaacggtctattgttggaccctactgccgactgctctttaagcagtggttgtatactggagtcgtgttagcgcacgactcctttactattcttacctcagtatagcccattttataacgtaaatacagcttttatcttcaagaattttactgattactcagctctttaatgtatattgggcaacaaaaagcaccttccattggatcaggttcaaaaatcacgtctttatgactgcatccagatttaaatccccttattcttcttcgtttagaaattcctttaatctctgacttaaggctgcatactgccctgcattggtgtccgaaaaagcttcctcccggttggagtatacatcctgatactgaggaaggcttgaaaattgcgacctcgtaaaatctataatgtcctcaccaatgcggttgtaatagtgccagccactatccagccatgtcctcaaaatatcgccgccaagcctgtcctgaacgacaagcgctgtgacaccacattgtccagccgcaggattatttgctgtccatttagaactagactccaaagaccaagcttgaaacaacgccttttctaattctaaaaaacggtttgcattcaacatgcgcctcccctttcgattccattctgcacttatggtgaacgtgctttatttatttcaacccgtattccacactctgtgaatcttggcttctgcttctttcagctctagcaaatacacgtcgggattcgaaagctttttccagtcctcaaacccaaactgcggatcgtaatgtcgaatgagaagagatagtaaagctccatgagttacaatgataaccgttttttccgcccgctctataagctcctgaacaagctggattcctcgatctactgcttcacgggatgattcccctccctccagcttcaagtcctcgtccaaataggtctgttccagcacgtccagccaatggtccaaatgctcatggctaagtacccgttcttgaagacgtacatcagtatacacctgcaactgtttccgttcagccaagggctgaatggttcgcacggcccgtttccacgggctggacacaatatattccacacctacgttctccataaaatcaactaactgctcagcttgtcgggtaccctcatcggtaagtcgggcatctggttcctgtcctgttgcttgggcatgtctgacaaaataaattttcttcacgtcatcactcctaactgtcacacaaatttaaaattctatgtatttacaaataattatttttgtgatataatataggtttacatatttatttttcatgatacgattcctttgtgttacatcaactcttatgggagggattcgatgcaattagacaagggaatacacatgctccaggtttctgctaacattatgggaagtatagagagtattcaccccactttaatgtgggacgaagataacatgattttagttgatacggtttaccccgggcaactctcacttttgcatgaggctattctaggcaccggattagcaatccataaacttaccttcatattaataacacaccaggatcttgatcatatcggcagtttagcagatataatccgggcttcttcatccccagttcaagtattagccagttctatcgaaaagccctatatacagggagaacaacagcttataaagctgactccagaagcaatagatcaagctgtaagcgccatgcccgaatccgttccggtagagtggagacacgcattccggcgtacacttgaaaatcccccaaaggctattgtaaactccaccatcgttgccggagaggaattacccttttgtggggggatcgtagttatagatactgctggacatacaccaggacacctaagtttctatcataaatccagtcaaaccctgattgcaggagatgctctacgcgtgataagcggcaaattattggctccagacccgcaatactgctgtgatttcaatatggccaaagaatctcttaaaaacctgctgccatatgatattaaaaaagtgatctgctttcatggagggctgtacgaaggcaattgtaatcagcggatatctgaaatatgcgaatcctagcttttgaacacatggtcataccgatccttgaccggtcagtgaattatctaaagaaaagactaaccaggaactcctggttagtcttttctgaatgagaactaggcttttaagtgaactcttaatacgggtacttctgaagaggcggatgtaccttccaatatttccacatggctgatcatctcttgcccgtctggaacgattaccggagtaattacaggcaagccaccctgttgaatcgcgtctagatcaaactccatcagtaattgccctgctttaatgttatctcctgtttgaacgtgagggttaaacccttgtcctttgagggaaactgtattaatcccgacatgtatcaaaatttgtacaccggattcatgctcaatgatcagagcatgcttacttttctccatcacgtgaacgactttacccgcgaaaggagcagtcactttaccttcagtcggatgaatagcgataccttcccccatagccttcgtggagaacgcaggatctggaacctcttcaagggaaaccacttttcctttgattggtgctaccatgtcgaattgttcaatacgaggagccgccttctttttcaaccatttaaacataacgatgccaccttatttagagattacattcataaacagtgaaaaggacttaactacatcttttaaggaaccggttccacaaaatgaataaaaagaagagtggaggcgatttctatctgaattatagtgaacgcctttccaggatgtcaaggcgatcctctccgtttctaaaatcactctatttaaagatacagaaacattttataacgagcatactttacatcatttcaccaagattgcataatgatcagttataaagtatgcacatttatattatatacttacctaaaggagagtgtaacttatgggtgaaacctgtgttccgtctggcgtggtcctaaaagacattggctttggatatacgttgtccttaataagcggtaaatataaaatgatcattatatattggctttctgaaaataaggttatgcggcataacgagctgaaacgaagtatcggcaccatttccttcaaaacactaagcattatgttaaaagagctagaggcagatggccttatcatacgcaaggaatttccccagatacctccaaaagttgaatattcattatctaagcgtggcctttctctcattccattgttaaatatgatgtgcgagtggggagaggaaaatggtttgccagctctggaggacggacagcaataggcattcctattacaggctgtcaataaaactcaaataatctcgtgcgcttttttccaattcgctttcggacaaacctggggcatctgcgccaggctcattttctgtaccataaaacgcaaagaacgaacgataatctgcactgcaatataggaaggttgtttcaaaaggggatagtagatgctcaagtgtatagcgatatcttcccttttcactataatcttcttttttaattccggcagatacagctaaagcaaccttgcgattctttaatttgtctcctccatttgaaccataagcccagccataagcaaaaacatcgtcaagccattttttaaggagaggcggactactaaaccaataaacaggaaactgtaaaataagcttactatgcgattcaattaagtgcttctctttttccacatcaatattcccgtcagggtaaatcgtatgcaattcatgtatagtatacttttctggatattttttgagttctcctacccattgcttatttatcacagatgtttctatgcttgggtgtgttacgataacaagagttttcaaagacttatcctccttgagtattatttattttctgagtataaagcgcgcactacaaatatgtaagtatgcacttttagtacaactacttactaaaaggttagtgtcaaatcagaaaaatattctttctataccatcaccacgatcatacgttcatgctgaaagctatttcgcaataaaaaaaagcagcccacagattgaagtgaccccttaaagt

SEQ ID NO: 2661 - DNA, 1257 bp, Unknown
  Kingdom: Bacteria, Phylum: Firmicutes, Class: Bacilli, Order: Bacillales, Family: Paenibacillaceae, Genus: Paenibacillus
gcgagcagcttggacggaagtgcttcgcccccgaccataatggccttcacgccttgcagcgcgcgcgagcctgcttcatgacccagcagcatttgtagccgggatggtgtcatttgcaacatctcaatatgatgatgagtaatcaattcacccagtgcctgaggattgacctgatgctggctgtcgccaagcaccaccgtcattccacccaacaggggcaagatggtttccaagacgaaaatatcgaatgaaatggtcgtgagtgacaaaatcgtttggctcgcttcaaagtcaatgacttcgcgcatccctgtaataaagttgaggaccgagcgatgctggagcataactcctttcggatttccagtcgaacccgacgtatagatgacataagccaaatgctctgggcgggcaatcgtctccaggttgccgctctctccctgatacaaggctgcatcctcaagaaatagggtattggcatggcaatgatgctcttccaacagatcacgactggtcagaagcactgcggcctcgctgtcttccagcatgtatgcaatacgagaggacggaaattcgggatcaatcggcacataagcaccacctgctttgagaacagccaggagacctacaatcatttccacggagcgctgtaccatcagtccgaccagcttgtcaggtcctactccttgtgcttgaagcattcgggccaatgaattcgcccgttcattcagttctcgataagtcagactctgatgtccaaacaccaatgccacctgatctggcgtatattctacctgctcctcgaacagctgatggatcgtctgatgagacggaaaagcacaagcggtgtcattaaatgccgctgtaatctgctgcttttccgcggctgtgagtagttccagctcttcaacacaaacatgcggattgagcgaaatttgctccagcaggcgtgcaaaatgcccatacagacgctcaatacctgcttgatcaaagctgagcgtgttatacataaaacgaatcttgatgccttcacccggcataacgacgacgttcagatcatagttggttgcctctgtagacaccacgttcgaaatcgtaaatttttcctgtccatcactgcccaactgctctacctgctgctccaccggataattttcaaatatcataatatgattgattaaatcctgtttctgctcggtcagtgcttgaatttcatacagcgggaacgcatcgtaggcattggaagccagcgcctgc

SEQ ID NO: 2662 - DNA, 1257 bp, Unknown
  Kingdom: Bacteria, Phylum: Firmicutes, Class: Bacilli, Order: Bacillales, Family: Paenibacillaceae, Genus: Paenibacillus
gcgagcagcttggacggaagggcttcgcccccgaccataatggccttcacgctttgcagtgtgcgggaacctgcttcatgacccagcagcatttgtaaccgggatggggtcatttgcaacatctcaatcgaatgttgagtaatcaattcacccagcgcctgcggattcacctgatgctggctgtcgccaagcaccaccgtcattccacccaacaagggcaagatggtttccaagacgaaaatatcaaatgaaatagtcgtcagtgacaaaatggtttggctcgcttcaaagtcaatgacttcacgcatcccggtaataaagttgaggaccgagcgatgctggagcataactcctttcggatttccagtcgaacccgacgtatagatgacataagccaaatgctctggccgggcaatcgtctccaggttgccgctctctccctgatacaaggctacatcctcaagaaatagggtattggcatggcaatgatgctcttctgccagctcacgacgggttagaagcactgcggcctcgctatcttccagcatgtatgcaatacgagaggacggaaattcgggatcaatcggcacataagcaccgcctgctttgagaacggccaggagacctacgatcatttccactgagcgctgtaccatcagaccgaccagcttgtcaggtcctactccttgtgcttgaagcattcgggccaatgaattcgcccgttcattcagttcccgataagtcagacgctgatgtccaaacaccaatgccacctgatccggcgtatattctacctgctcctcaaacagctgatggatcgtctgatgagacggaaaagcacaagcggtgtcattaaatgccgctgtaatctgctgcttttccgccgctgtgagtagttccagctcttcaacacgaacatgcggattgagcgaaatttgctccagtaggcgtgcaaaatgcccatacagacgctcaatacctgcttgatcaaagctgagcgtgttatacataaaacgaatcttgatgccttcacccggcataacgacgacgttcagatcatagttggtttcctctgtagacaccacgttcgaaatcgtaaatttttcctgtccatcactgcccaactgctctacctgctgctccaccggataattttcaaatatcataatatgattgattaaatcctgtttctgctcggtcagtgcttgaatttcgtacagcgggaacgcatcataaccattggaagccagcgcctgc

SEQ ID NO: 2663 - DNA, 70364 bp, Unknown
  Kingdom: Bacteria, Phylum: Firmicutes, Class: Bacilli, Order: Bacillales, Family: Paenibacillaceae, Genus: Paenibacillus
gaattctaacgggcagtttagttcaacaagtaatcttaattccgaaaaaacatattaaacagtattttactaatctcatgaatttgatttgtaacaaatctagagattaagataattaacgcaacacgatggtatcataagaataggttgccgtaatatcggctgcctgttgagctaacggacaggatgggttaataacatatcgaattttttaagagtggaagggtatacgaggtgagcgttgcttaactgaagcatgaagtagaggtaatcaaaaaggagatacccagatggaaacaaatcgaattattcgtttagcaatcgaagaatctatacagttccttgaatctactccccatttggggatgactcacggcgagtgcagccgtcgaaaatgggatggagcttggtggcatatggctgctctttatgaaatgggagaggtgaaactaattcccgagtctgctattgtcggagcaaaatatttactcgaaactcaggtctggccgaccttcatcatatccgccgatgaccatccaacaagtgaaagtgataagatgaagatggattgctgccattgtgaacttgccgtatactatatgattctaatggcgtatggctgtgatttggacaaggaactgccttggattcgcgaatggctcttaaagcatcagttacctgatggcgggctgaactgcgaccctgaagcttatactcattctaaaaagagctctattgtttcaacacttcctccgcttgaagctatcttatggcatacagaccgtgaatttactgaacaggaagtcgttttcttagatgaaggcgcacgttatttaattgagcatcgtcttgtatgttctaaacaaaatagaagcgtcatcgatatggaatggctgaagccttgctttccgaggttttttgaatatgatatattacgcggcatgtccttcttggcagaatggtcccgacgtaggaacaaaacgctgccggtcgggctgcttattgaaggattggaacgattgaacatcttcaaggaaataggaggattgcgaatcggtagacaagtctttgatccacgaggcccgtggagtgggcaaccctttcccttgttagaagcagtggctggcattggtgacgtttcgccttatctaaccagacagttggatcaagttatcgaacgattgggaccggagtatacctatgcataaagacttcctttagaagggagctcatgatggaagaggaagtgaccaggatgaggaaaggcttagaggggaaagttgcaaatttcacatatgtaaaagattgtctaaacactgattgaaaccgcaaaacgggaagcaaaagaagaggtctttgttgaggcaactcaataaactaaaccatgaggctgccgtggattgaatggcagccttgttacgctaacgggcaggataacgagaaggaaggaattaactaaaatatgtcgaatacgattgattaagattatgaaagggggatttactatgtggttttacagttacagaaaaccaataagaatccgtcacctccctcaatattaaaaaattgaggaggattacaatgaaaataaatgatgaatatttgaaggaacaattaaagcatgtatattggttaaatggtggttgttgtgcagggaattccacaatgacaaagaaatttgttaaagagttaggatttcaaacactggaagataacgtgatgaagtacagaccattcaccaatccagttgaataccctgccctacagtatcctcattcgggtttagattgggataaatggttcaataaacccaatgatgaacatgttcattggctttttcaaattgtcgaagagatgatggaaagacttaaataaaaatgttttctttggattcaaaatttcggtaataagcttgtttggaaacttcatcagattaaggtttttcgccgtattccttaccgaattcctccatcttctcaaggatcggtagtaatttgattcccttgcctgttaatgaatactctactcgcggaggaacttccggataaacattacgtttaataactccatcgttctccaactctttaagctgctttgtgagagagccttgtgataaacctccaagaaatttttttatatccgtataacggcgtgtttctccttttaaataccataatataaaatatttccaacgtcctgaaagaacattttgggtaaatgctatcgcgtacatatcccttttttcatccataaattctttatcaaatccttcattacagaccctcattgatatcactcctaatcttaaggtacaaaaagttgtactatgttcatttatattgccctctttgcaaatgaacataatgactttatgattgtgtcaacaaaccaaaacaattaattttaattaacctaaaatgcgaaaggataatgttcttgttttcgttttatagtttaatagggtaactaagattgcgtttttatatttagtaagctaaataaatataacacagaaaggagttactgataagtgaatacaggaaatagactacagctttcgattttagacttcgttcatgtctattacggaagtgatgctaagaaaagtctccaaaacattaggacttctgcagctgatggctggaccatgtgagcattgctaaggtccagagaattattggggtaaatgattttccagagcaattagataacctgctttccttttttgactgtaactttaaagaacctcatgaaagggagatcattcaacaatggaaggaagaaagttaaaaataggagggattattgatggcgttggttggaatcacacgggatggagacaccccgctattccagcagatgccagtgaaaatattgattactacgttcaaaaagccaggcaacttgaacagggaaggttcgacctcatctttttagcagacgtaagtcatattggacctggcatgataccacactatctaagcatgtttgagggcgtatctattttgtctgcattgagtatggtgactcattccattggcttgaccgcaacaatagctacttcatatgctgatccatttactgttgctagacaaatagcctcactcgacaagattagcaagggccgagcagggaatgcgatcacctctaatccgggagggttagccaattacagtcggtcccatttaaggaaagcagatctttatcccatgaaaaaggagtttttagagattattgaaggcctctgggattcgtacgaagacgatgcattcatacgtgataagaaaagtggggtattttatgacccgagtaagatgcatccaataaattataccgggaattacttttcagtggagggaccattaaatgttagtcgatctcgacaaggcagaccggtcatctttcaagccggtacttccttggaattcatggatatagctgcacagcatgccgaagtcatcatggctcctggagatcagtttgaatatcttaagagattcactactgaacttaaaagaaaagtgcaaaatcaagggcgttcaccaaacgatctactgattatgccttcacatagccccatcgttggtgaaacggaaaaagaagccttagaaaagctaagagaaatcgaatcatggatgcctaaaggttatagattgccaaaacctcaattgatgggagttgcggagaatgttgcagaaaaaatagaacattggtatcaagaaggcgtcatggatgtcttgctgattagacaagattatccagcaggatttgaggactttattaaattggttgtacccatattgcaagataaaggcatatttcgaaaggaatatgaggaggatacacttcgggggaatttagggctaccttaccctgaaactaggtataagaagtaataataaaaaaatcaattaaacaagaggcgaaatcattgatgaaaaaccgaattacagaactactgggaatagagtatcctattatttcagctgctatgacatgggtcactaccgcggaatttgttgcagcagtttccaatgcaggtggaatgggtgtgttggggccaaatgctggccaaacggaaaaagcaataagtgcagaggatatggcagatcgactaacgaaggaaattcgcaaggttaaagcattaacgaataaaccatttgcagtaaactacattttcccaatgggaggggctacagaagacccctttactaatacagtttttgatgtattggttaaagaaaatgtcaaaaacgttattgccattggacaacatgtggtcgatcgtgaactgaaacgacttaaaaaacatgacattaaggtcgtttacagagacttaagtccgactgtagaaaagcttctagaagctgagaaaacaggagtggatgcccttatcgttacaggttatgaggctggtggtcatatgagtgattataaaattagtacgctttcccttgttccacaaatcacttcacttgtaaaaatccctgttattgctgctggaggaattatagatggtcggggagcgaaagcagcactatctatgggggcagaaggtgtatatatgggaacaaggtttatagtgaccaaagaaaatccagctagtatggaaacaaagaaagccatcattaaggtaaaaagtgaagagtttattgaatttaaatcaggtacaggacatttgagaaccattcctacagaagcgggcaaaaaagcgttagaactcattaatcaaggaaagcctgcagaagcatacaaatattatggagaagggttcaaaataggaatgttagatggcgatctggttaatgggaccgttagtgtatccgaatcagctggtggtattcagcaaattctaacgtgtcaagaagtgattgatgaaattgttaaaaccatcggatgaagatctcaaaaatttttttcctacagtttgccactgatcaaattcggataaatctaattcaaccaggacctatacaaacaaacattgtgactaaagctctaagtgaaaaggcaattgaagaacgggcacaacaagttcccatcaaaagattaggtcagtctcaagaggtagcgaaccttgctttgtttcttgcgagtgatgaagcctcttatattacgggtgctcatcatgaattgatggaggattgtctgtaatgtaacgcaattttgtattgagttagtatatgaggccacctataactaagacctcattgctatttttgctaacacttttatttatgataataacattgaaggagatattcatatgaataatacccttaaattacttcataatcatacgtccattcgttcttacacaaatcaaccactgacacaagaacaacgagaagaaatctttaaggcagctaatcaaacatcatcattcagtcttttgcaggccgtttctattattagaattacagatccagatcttcgaagaaaggtgatgcaactttcggttaatcaaccttatattgaagaagccgcagagttctggattttttgttcagatttccaccggaatcatcaaatcgcccctgaagttgaccttgaatatatagaatttcttttaatcggttcatttgatgccgggcttatggcgcaaaatgctttaaccgcagcagaatctattggacttggtggcgtttttattggtggtgtgagaagtaacattaatgaattatctgaaattttgaatttaccgaagtatgtgattcctttggtgggactatgtattggtagtccatctggaaataaacctgaactcaagccaaggttgcctaaatccatggttttacatgaaaaccagtatcaaacactcgataaaatgaaattagcaacttatgataagaccatgttgaagtattatgaaaatcgacctgtaaaggcccctttctcagcgaaaaaagtaaaaggatggagtgaccacatccatgatcatctgcaaagaagtattcagccacaaatgatggactatctccacaaacagggatatgccaaaaaatgaagcagggaagaaacttttttgaccagaaggaagttcatcataaattaatttgacacatcaaattcgtcgtgatatagttagcccgctaaataacattcgaatcgagggatgatgaattaatgacagatcaagtggattgtgatattcgtcagtcgttagatcgaatctcctcccaaatgcgtcgaaattatagtgaatctctcagggaacttaacctttatgtagggcaagataatttgctgtatcgtctgtggttgggtgatggggtaacacaaatgcaactatgtgaacacttaaaatgcgaaccgcctacggtaacgaacatggttaaatcattggagcagaacggatttatatatcgtaaacgtgatgaacaagatgcaagaataatgcgcattttcctaacggacaaaggcaaagaattagagacaccggttgaggtcaaatggagacaacagcaggaaaaactacttcaatccatttctacggaagatcggctgatattaagacaattaatgcaacaaatggagaataatctatcatgagttctccatcttttttaatatatttagcaagctaaacattgctgatttaataacacaacgagaagggtgcattattattggctgcatccctatgtgtaatcatccgaagaaggggtagtaccagcgtcgctgtcacaagggcaaagtagatggataaatatgttaaatataagttctgggaatttcgctatgattggagaaataccagcgtctcaaacgtatggaataaacctacatttatcttgttgggttgtttacgttaatgtgaaaagacagagctaggctgccgacattgatcggcagcctagtcttagttggaggttgaactatcgtttcccgttagcggaaatacattacattaattcaccgtcttaatctccaggccgtgaccgtgacatttaaagttatagttagggtttttcataacctcttctttctgaagttcatacatggcaattttatagtttatttcttccatgtgtttaaaactttcgtcaattttcttctgaagttccaatttatgctgtatcaacatctcctttctttgcaaaaaggtgctatttcccaattcataaagttccttgtaatccttgattattgaaagaggcattcctgtctctttgagacaacgaataaaagaaatccaatctatttgttgttggttataaactctacggcctttttcgtcacgagatatatttggtaatatcccctgttcttcataaaacctaagtgtttttgcagatacatttaaattctccactacgtatgtcattgaatacaacatctacttgtcccacctttagttacagttactgtaactaaatatatatcataaagagaatgaaagcacaacaattctatatgtaatcatataaaaataaatccttgacctactgtaacggtaaccaattacactgaaacagaaaataaaatatgatagcgaggttaaagaaatgaatcaaaaatatagtaggttatttgaatccttcacattcagaagtggaataacaatgaagaatagaattgttatggcacctatgacaacctggtcaagcaatgacgatcttaccatttcggatgacgaagtaaagtattacaaacaaagagtgaatggagtaggactcgtcattacagggtgtactcatgttacaccgaatggacagggttttacgaatgaattcgccgggtacaatgatgaatttactccaagtttacgaaaattagctgaggcagcgaaaagtggaggctctcctgcgatcctacagatttttcatgctggcaataaagctttgcccgaattggatgcagttagtgcgagtgcattgcaacccgaaattactaatttaggttcaactccagaaacaagagaactatcacatgaggagattttgtcgattgtacgtgcttttggagacacaacaagacgagcgatagaagccggatttgatggcgtcgaaattcatggggcacatggatttttaattcaaaacttctggtcgccagcaacgaatcaacggacggaccaatggggaggatcacttgaaaatcgcttgcgttttccattggcgattattaacgaaatcaaaaatgtcattgaaaaacatgctacaaaaccattcattttaggataccgattttcacctgaagaatcctccaaagtggacggattacgtatgaaagacacgtatgaattaatcgatattcttgttgaacagaatttggattatatacatgcttcattagataatgtgtcttcaaagccagtagatagtcaagatgaaaaaacacggcttgaattaattcttgaaagagcaaacggtaaggtaactgtgatggctgctggttccataataacaccggatgatgctcttaaagctgtggaattaggattgccgctagttgccattgggcatgcgttaattatgaatcctacttgggttgaaatggtcgcaaatggacgagaagccgaggtagattctaagttgaacgtttcaaaactcgaccagcttaatattccagaaaaactctggaatgtaattcaagcaatgcccggttggtttaatattgggaaataaaaagtagtccttaaggctactcagattgacgagaaacccgcgtcttttatgagacttcgggtttcttttgctaattcttaagtgctccgtccatccgtagttcggtagggcaattcttactgtcgcggacacacatactgcgaatgtttcgatcttgaaggggtaccaccagcataacgcagatttacaacgctaaggaattctgagtacaaaaatagccgggtttcacacgttaagggtgtaaccggcttttatgctatccttggttcagcggacgtaatgattctaagatactaggcgttgcatcagccatttttgttaagcctatattggtacccatagccatgagcgatgccagaacaatcggtttttcttcggatttaggttgacgattggttgaagcatgaatgtaataaagatctacaattcgcatcaacttaatctggaataattaagttttaattttatagagcgtgccatacatgtttgtgtcgcctcgaaaagtacattgagtaagtttgtaaaaaaatagaataaaaagcgaataggtgtgattgaatcaggtggcacgaaattcatatgcggggtaggcaatgaaaaaagtcgaaaaaaagcgcttcaaaaaataattgaaacgtttccaacttagtgctattataattcccataagagagatgggggggttaaatgccaagtattagagatgtagctaagatagctggtgttgctgtgggaacggtgtcccgcgttattaataactcgggctctgtaaaaccagatacacgaaggaaagtggagaaagctatacaagaactcaattattttcctaatgaagtcgctcgaaattttaaaatgaggaaatccaagatggtagccttgctgcttccaagtatctggcatccttttttttctgaactagcttattacattgaggatgagttggatcgggaaggctttaagctcatgttatgtaatagcggcggcaagcccgaaaaggaactgtattacctggatatgctacggcaaaacaaagtggctggtattgtcggcattacttacaatgatatagaaaatagcgtaagcaatgacattccgattctaagtattgataggcatttcaacaaaaaaatcacttgtgtaacctccgataattatgagggaggccgtctagctttgagggaacttgttaaagcaggggcccagaaaccggcttttatgggaagtgtaacttccgtttttagtgaaaccatgaatcgaagaaaaggtttcattgatgaggcgaaaaaattaggtgtagactatgttgtatacgagaaaccagatcctattgtggatgacgaagcctattttggcgaatttctatctaagcatcaggatgtggacggcattttcgctattaccgatatgtttgccgccaaatatatagaaagagcaggtaggcaggggattcgtattccagaggatgtaaaggtcatcggttacgacggcattcaggatcatcgttattttcatccgatattgtctacaatcaggcaaccagtggaggagatggcacgtttgacaatcagactactgtatcaaaagatcgatggtataactttagatcagcaagtgtatcgtctccccgttatcttcagacaaggcgaaactacatgattttaattgtaaagatattagctcgtaaagtcggatcacagtctggatatgcaaacttgacttttcttttagaaaattggaaacgtttcattttacaatcagactactctgttaaaagatcgaaggaataagttgaatcagcaaatgtatcatctcccgttatcttaggcaagtttttttacattggaaaaacttcaactcattcggtggatttatggtatggatcaccgactgacgtttttcttataataaattggaaacgtttcaaaaatgaaaatatccttttacaagaaagggagtgtaatggtgaattcaagaactagtgagttggatcattccacgatcaagccaaatcgcaaaatatggaaccaggtcaaacgtgactatgaactgtatctgtttttgctgccaatcattattatttatctcgtatttaagtactatccgatgtatggaatacaaattgcttttaagtatttttcaccaagtcgggggatctggggaagcgagtgggtaggctttaagcactttattgattttttcgattcctataacttctggacgattatgacgaatacacttacactcagtgttctatcgcttgtgtttagcttccctgctccgattattatagcgattatgttgaatcagatgttggccaaaagatacaagaaaattgtacaaactgtaatttacgcaccacactttatttctaccgtagtgctcgtcggtatgcttaatgtttttctgtctccaaacagcggaatcgtgaatcacatcatcaccttgttcggaggagaccccattatgtttttggccgacgaaggttggttccgtcctttgtatattttatcaggggtttggcaagagacaggttttgctaccatcatttaccttgctgcactggcaggggtcaatccagaattgcatgaagccgcgattatggatggagcaagcaaatggaagcgcgtaatgcatgtggatattccaagcattttgccgacgattgtcatcttattgattctcgcactcggtaacattatgggcatcggttttgaaaaggctttccttatgcagaacgatttgaattatgccacttccaatatcattccgacctatgtttatgaaatcgggattcaaaaggcacaatacagcttttctacggcaattggtctgtttaattctgttgtaaatattatcctgataatcaccgtcaaccggatcgccaaaaagttgactgaaaccagcctgtggtaagggggagttcattttgaatcaattattaaagagaaaaagcaagggagacatgtggtttgacattgttaactacttcatgttgaccatagttatgctgcttgtattattcccgttgtattttgtgctgattgcttcacttagtgaccccaatctcatctactcaggagaagtatggttttttccaaagggttttacgctggatggatacgggcggatattcagtgattcatctatatggattggttatgccaactcgattttatatgcgggtttaggaacattaatcggagtagccgtgaccgtatgtgcagcttacccgttagctcgtaaaggactggcgggaaaatcggcgattatgtggtttttactgatctccatgttttttagtggagggctgatcccaacctatttgctgatcaaagatcttcacatgctgaatacgatctgggcacttgttattcctggagcgggaggtgtgtttaatgtcattatcgtaaggactttttttcagtcgaccatcccagatgaaatgtgggaggcagcttcgatcgatggttgttccaataccagatttttttggagcattgtattgcctttgtctaagtccgttatagccgtaatggtactatatcatgttgtcggcttctggaatggtttctttgacgctttgatctacttgaacgacgaaaacaagtatccgttgcaactggttctgcgcaacattcttgtccagaatcaggccaactcgggcatgatgatagacgtggaatcttacgcagcgaagatgcgcgttacagagcttatcaaatatggtgtcatcatggtatccagtctaccgttgctgattttgtatcctttcctgcaaaaatactttgttaaaggcgtgatgatcggctcgatcaaaggctaacattgtcatggtgcctgaaaggggtgatgtgcaacagaaacgataagtccatcatccagacaactatataagaagagcaacgaaattttcagcttgtggaatgatctaacaggaggttgtgtacgatgaaatcgttattcaaaagtgctgggcttctagtgctggccggagtgtttgcgcttagcggatgttcgggaggcggcgagtcaaaaaatcaggcggtaaacccggatcaggatgcgaattttaataaaaccggccttccgattgttaaagaagcggtgacattaaagatggtatccccgaaagctgctttagcgccggattactcgaaaatggaaatttttaagcggctggaaaaacaaacaaacgtaaagattgactgggaaaacattccagacgctgactttgcagagaagaaaaatttgttgttggccagcggagatttgccagacgcattttacggagccggattcacagattacgatctaatcaattatggtaaagacggaaccattattccgctggaggatttaattgataaatatgcgcctaatttgaaagcgcttctcgatcgtcggcctgacattaaactagccatcacagcaccagacggtcacatctatgggctgccgtcgtgggaagagaataagctcgataccaaccccttctttcacgtcatcaataaaaattggctcgataaactgggcttaaaagtacctcaaacgctggacgaatacacgcaggctttgattgcctttaaaacgaaggacccgaacggcaatggcaaggctgatgaaatcccattaagctttatgcacatgcagtggtgtagtgacattgccggcatattcggagctttcggtcttccggataatttggaacatcggattgtccgcgaaggtaaagtgatctttaccgcttcgcaacctcaatataaggaagcattaaaatatattcatgataactggtataaacaggggctgattgaccctgaatcgttcacccaggacgccgctcagtatttagcaaaaggcaaaacaccagatgaaacgctcggctcctacgtttggtgggaagtcgaagaagttgtcggaccggagcgtagtaaggattatgctctgctgcccccgcttaaaggcccaaatggagatcaaatgattggtcgcaacaacggcggaggaccgggacgaggtagcttcgtgattacaaaggagaaccgttatccggcaatgacgatgcgttggatcgatcaacagtatgacccttacatggcggctcaaattcactggggtccgttggatgtcgtattcaagaaggacgaaaaaggaaaattggtgaacctgccgcttcccaaaggagtctccgcaggtgaattccgtcaaaaagtggctccaggcacaggaaatccgggcgtcattactttcgatgacttcggaaaagttgttgatatggaaccccgagctcagaagcgtgctgagtatttggaaaaatattacactccatatatgaaaaaggaaaactatccgagcatcttctttgaaccggatgaactagataaaattaatcggatcgagccagaacttattaaatatgtaaatacccaaagaggcaagttcatcgtcgatggcgaggtagatgaaaagtgggacagctatgtgaagacactcgagaagatggggctgaacgaattaatggagatctatcaaaaagggctggaccgatataatgcaaatttaaaaaataaataatcaaacgataggtggggagaaaactgtgcttgatgtaataaccattggggaagtattgatagactttacgccatcaggtcgtaccgcgagaggcaacgagcagtttgaatgtaatcctggaggggctccggctaacgtagcagctgctctatcccgtttaggaactagagcgacattgattagcaaagttggggatgatcaattcggttccttgctgcacgataccttgatgaacgtcggcatcgacgtgtctgggctttcgtttacagatgaagccaatacaacgctggcatttgtccatctggatgacaacggagaccgatcgttcagcttctaccggaaaccaggagcggatacatacttgcgcacgcaggatgtcccgttcgataggattgaaaactgccatgcactgcactttggttctttgtcgatgacccgtacggcaacaagagcggcagttgtgaaggctaaagaggcaggagtcctgctttcattcgatccaaatatccggtttgctttatgggagagcaaagaggaagcgaaacagaatatcctttggggcatgaagtatgccgacatcctgaaaatatcggaagatgagctccactttataacgggtaaaactgatgtggaaaaaggctcgctagagctgcaacagcaattcggcatcgccgggatcttcgtaactttagcggaaaaaggctgctattaccgattagcgggtcatgacggatatgtgccgggttttcaagtagaggccattgatacgacaggagccggcgacgcttttctgggctgcttgttatataagatactgaaagccggtgtttctttgaatcagctgaccaaacagcaaatcatcggtatgctaacttttgctaatgctggcggtgcattagtaaccacacggaaaggggctcttcaatctatgccgacgacagatgaaattacccagataatcgagacaaataaacagcacgatgatgatagatttaggccgggttttcatttttcacctcactcccattggttgaatgatccgaacggattagtctattacgagggagtctatcatctgttttatcagcaccatccttatagcaatgaatggggaccgatgcactggggtcatgccgtaagccaagacctggttcattgggagcatatgcctatcgctctgttcccggatgagcatggcgctattttctccggttgctgtgtggttgactggaataatagcagcggactgttcgatggttcccatggattgatcgcactcttcactcatgcagacatctgtccggagaccggacaacctcgccagcggcaaagcctggcttacagcagtgataaaggccgaacttggcacaaatatgaggggaacccaatactcgacgagcatgatctggtcgacttccgggaccccaaggtgttctggcattcgccaagtgaatcctggattatggctcttgtcgcgggagaccacgttcggttttatcgttccgacaatttgcgtgaatggtcgttgtcaggcgaattcggaaagattgatgactcgcatgacggagtttgggaatgccctgatctctttgaattgctggttgatgacagcggacattccaaatgggtacttatcataagcatcggagataatcccaactgtccggaaggctcacgtacgcaatactttatcggagagttcgacggaaatacgttcatcaatgacaatccggccggtcatatcctgtggctggattatggccgggacaattatgcgggggtcacttggtcggatatagctgagcaagacggacggcgcgtgatcatcggatggatgagcaactggaaatatgccaaccaaacgcctaccggagcctggagaggcgcaatgactttacctcgcgtcttatcattgaccagccgagacgagggcgtagttttgactcaaatgcctgtccgggaaatagagcagctgcgaaaaggaacgctctgctggaatgaggtcaaggttacgccggcggtgccgtttacgcaaaaaatgaatgatgttctgcttgagattgaagcggatatcgacattcgttccggggatgaggttcatatcaaaataaagtcctctgggcaaagtgagactattatcggatatgaccctgtgcgccaatggctattcatcgaccgttcgaaatcgggcctgactgacttccacccgtcgtttgcgtgcaagcacggtgctagaatggttccggagaatggaaagatcaagctgcatatctggctggatcgcaacgcggttgaagtgtacgcgaatgagggtttggttgcactgacggatcaaatattccctgatgctccgatggatcgtattgagataagtgcgaaatcaggggaagttgtactgaactcgtttcatatgcatgctcttaactccattcatattcccaatggtccaacggagcagacattaaggagggttgaagtatgagccatgcaaccgataatcggggattgatcatgtattgggcgttcaatgaagattccggtacaagcgctctggagagcgtatcccaagtcaaggataatatccagtacgtatttaaccaagcggagtttactaaaccttgccctccacggtggagacagggggtaattggaaatgggcttctgttcgatggttattcgacttacattgcgcattcgttcgatgagggaaatcagaacaccgagccagagtatcgatcagcgctaagcattggagtatgggtagccccacgctcctatgaatggggggatgatggcaaattgtccgccatcgtgaaccgctacaacctggatcgcaagcaaggttatctgcttggcatgttccgacacggttcctggtccttccaagtcgggctggaaggaggggactggaaggaactttggtcgccagatggccatgaactgtccaagaatgaatggtcatacgtgaatgctgtgttcgatgggaaccaaggggaaatcaagctgtatttgaacggcagtgaaatcgcttcagcagccgtgcctcgtggttcccgcctggctgaggcgacggacacggatcttcttatcggcaagaataaccatagcagcctgctggcggaagtgttcagcctgcacatgtttagcggtatcattgatgaactcaagatttataatcgggcgctgagcgcggaagaagtggccgcttcttatcggcatgtgctggatacctttcatgaaggtaaccggcctcaattaaactatgacgagatcaagctggaccgaacgccactgctacttgatcggcacagaccgcaatatcatgttagcccgccggcccattggatgaacgaaccccatgcaccgatctattttgacgggcaatatcatttgttctatcagcataacccgcaggggccgttctttcatcagatccattggggacattgggtaagtcaggatttggtgcattggcgtgatctacccgtggccctggcgcccgaaaaggatcagctcgcaccggacgggatctggtcgggaagcgcaacctatgatgctgacggacttcctgtcttgttctttacggcaggtaatgacagcgcttctccgaatcagagcgtagcgcttgcccgaagcacttatacccttgacggaaacccggatctggttcagtgggtcaaacatccagagccgttgatcgtgcagaagaagggaatgggcgcatttggggatttccgagatccattcgtatggaaggacgatgacggctggtatgctctggtcgggtccggtatcgaaggtggagcagcactggcatttgcgtcacaggatatgctgaattggacgtataaagggccgttttttaaagcagatattcagaagtttccttaccttggacccatctgggagctccctgtgcttcttccccttggcagtgacaagcagggggtgaacaaacatctcctgcttgtcagccctgtggggaagggagcggatgtcgaggtgttctattggatcgggcaacttgacaagcaaaatctttcgttcatgcctgatcaagaagagcctcaattgattgacgtcggggatttccattttaccggaccgagcggaatggttgatccgaagaccggcagaaatatcgtctttacgatagcccaaggcgatcggacgtccgagatggaatataagtcgggctgggctcataacggcggcttgccgttaagcgtgtatttgagggatgacggacgtctgggaatagagccgattcaggagcttcaatcggtacgtggcgccaagcggctatcgcttcgggaccagtcattggctgaaactaatgtacagctcagggatgttcatggtgacatgcttgagattcaattggaattggagcccggcagcgccaaacaatttggaatcaaggtccgttgtacgccggacggggaggaagaaactctgctgtattatgattggaatcaagcgatgctcatggtcgaccggtcgaaaacgacactgcatccgggagaaaagtgcagagggattcagggcggtaagctggagctacttggggagaatctgaagcttcatatttatttggaccgctccatggtcgaagcctatgcaaacggattgaaaagcctgacaacccgggtgtacccgagccgtatggatgctttgggactcgagatttggggagatggagaaccgtttgttaaatccttggatatatgggatatgcagtccatttggtaagacgattgcttaggcgctccttactaatggggtcatgcagcaaatgatcaagtaacttcgcttttctctaattggaaacgtttcatatattttctcctttcttcttgactttcatctttgtactaggagagcatttcgaaatgaagtatcgatgtttgaaagtgcaagaaatttcgaaggaggatctagaatgaaaaaggtaaaaataagaaaatattggatatcgggaatgcttatatgggctatggtgctccagcttgttgttccaggaatctccgcagtagctgaatctagaactgttgctgggaacacgctcattcctaaaaatgacgtaggctcgtcggttacgaatgcggtttatcaaatcaacaatattcctaagaatgacgtgggattgtcagttacggattcggtctatcaaatccggaatcctggatttgaaacaggagatttgacgggatggaccgttgtcaaaggcaatgcgttcggtccgaatagcgtgacagacgaaacgacttggtgggcggaaaaaataccgtataaccaggaaggagcttatcatttaaacggctggaagtatgacgaatctgcgacaggtatacttcgttccagcactttcgtgctgggcggcagcggctggatcagcttcaggcttggcggtgcgaagaacccagacaaggtatttataaatattgtggaagtcgatacgggacaagttattgcccgatacggaaatagcgcattcgccgacgtgggcttcccagatcccgcgctgggcatgcggcttgccaatatggtgcaatacaaggcggatctttccacatatttgggaaagaaactgtatgtggaggtcgtcgataatgcaacctcggattggggagtcatttttgcggacgcattctccatgtaccatgagtcggagccagctgaaggaattgttgcgacagatatcaagccggatttcaagcgctatgaaatcgataatccaagctttgaaaccggaaatctcgatggctggacggttgagggagctgcttttgaagtgactgatgaagctcatgcgagcaaagaagggaacttctatgccaaatcctccctgcaagaaaagggctccatcacttctaatactttcacgcttcagggaaccggaacaattaattttactgttttggatatcctcaaaccggaaaatgcatatgttgcactttacgatgcgaacagcaacacattgcttatgaaaaccgggaatgtcagcgcgaacgagaaaatctcatggaatgtgcaagaacactacaacaagaagctctatgtaaaggttgtcgatcattccaatgaagccagcattgccgttgatcgtttccaagcaagtggtagggggactattttctacttaaaccttgatgaaggcgcaggaaaaaaggcgttggagaaagtacacaatcttaagcacgatgtgaactatgtatttaacaacgccaggtatatggcatcgaaggatccgagatggactccgcgcggaataaaaggcggcgccttattgttcgatggatactcgaattatattgaggtcaatgcaaacgatactgtgcctgtaagcgacgcgttaaccatcgaagcatgggttgcaccgcgtagctatgagtggggagacggaaacaagctatctgcgatcgtaaaccaatccgatcaggataaagcggaaggcttttctcttggtatgtatcggcacggtacatggtcgatgcaagtaggcatcggcggtcagtggattcaggtatgggtaaaggatcacccgttggaaaaatacaagtggaattatgtggccgctacttttagtaaagaagatggaaaaattaagttatatctaaacggtgaggaagtggcttcccaagcaacccccgtcaacgttccgatcacaccatctaccgaaagtctgatcatcgggaaaaataataaacctgtagagttagcaggggtgttctccttcaatatgttcagcgggcttttagatgaagtgaagctgcataataaagcccttacgaaccaggagatacttgctggatatgagagcgtgaaggcgcttcatggaggttcaattccgaaaattccgaatgcggacattgatgaggatccaagtgtgtttgacggagatcagcaccgtccccagtaccacgcgatgcctccgcaaaactggatgaatgaagcacatgcaccgatttactataacggcaaataccatttattttatcaacataacccgcaaggtccattctggcatcaaatccactgggggcattgggtgagtgacgatatggtgaactgggaaaatgtaagacctgctcttgcgcccgaagcgggcaccctagatccggacggcacgtggtcaggcagtgcagcgtatgatcgaaacggcaatcctgttctgttctataccgctggcaatgactccttgtcgccgaaccaaagaacagggttggcatctccggcggatttgtccgatccctatttggaaaaatgggtgaaatatcctaaaccggtaacggagcagaacggaaaaggcatccacaacgagttccgcgatccgtttgtatggtacgacaaagaggtggacaagtggtatcagttagtgacatctggtcttccagacttcagcagcggcacagctttggtgtatgtatccgatgatatgtacaattgggaatataaggggccgttatacgttagtgacagaagccgttatccggagttgggtacggtatgggagctaccagtgttattgccgttaggcacagatagtacgggcaagaaaaaatatattttcatgattaatccccatgaaaagccggagcatgttcctccagcgaacgatgtgcaaagagatgttgaggtcttttactggatcgggacctgggaccgggataactttaaatttattcctgattcggaggcaccctccaaaatggatgtaggtgacggctatttaaccgcagagagcggtctggtcacacccgacggaagaacggtcgtattttccatggtgcaaaatgtaagaacaccgcaagccgaatatcaatctggatgggctcataatttatctttgccggtttccctaagcctcgataagcatgataaattgcatatcgaaccgattaaagaactgcagagccttcgagggaaaaaatgggttgatttttcggacaaaaatttggagagcgccaatcaattgatccaaaatgtcaaaggcgacatgctagagattgtgatggagattgatccgcgtgaggcccagaaattcggtctcaaggtacgccgctcggaaaaaggccaagaagagacgctcatttactacgacaagaagaacgggacgtttaatgtggatcgaaccaagagcagcattgatccggatgtgcgtgtggacggcattcaaggaggatatgtagatcttgaaggagagaacttgaaactccatatctttctcgatcgctcggtcattgaatcctttgcaaattacaagaagaagctgacaactcgtgtctatgtaggcagatacgactccttaggcttacagatctgggccgatggcgatatcaatatcaaatccatgcaagtatgggatatgaatgccttaacgggtaaaccggctgctccggtctatgtacccgataagtgggataattctgtgtataaggatattacagagttgcctaaccatgattttgctacgggcgacttaacaggatggatgacggaaggagacgccttccagaatgtccatgtgaccaatacccagttcttctgggacaacatttacttcaacccgtcgcataaaattccgggcggctaccatttgtggggcttcaacgagcaagccggcggcgacagcttaaccggagcgctaagatctcaaaatttcgtccttggtgggaacggtaagatcaacttccttatcagcggcggccgggatatagatcgtctgtatgttgcgctggttcgggcgtcggacggcaaagagttatttaaagagacagcgaccaattatgaagaatatcaacgaaagatttgggatgcgtcggattatatcggcgaggagctttacattaaagtggttgaccactccaaaggcgggtttggacatattaacgtcgatgatttcaacgtacctgttcaggtaaagaagaagaccaacaactgaccttgtcaatacagaacacccgtgagtcctgcagtcactccaggcaaaccgaatagtcagagcagcttgtcattcgaaatggcaaaggagaacggcaggtacttgtaaaacgaagctgaaccaattttatttggatgggagataaaaatgtatttaatttaatgattcggtgtagcaaaatggatatttcaaaacaagttgctattgtcagcggttcaaatcgaggtttaggcaaacatctagctcttgaactttagcaaaaggagctaaagtatacgctggtgcgaggaacccagaatcagtcgatctgcctggtgctattccactacaactcatattactgctccgaaatctgtggtagctgcagcagagatcgcagtggatgttacccttctaattaacaacgctggttcagcaacgggtgcttctctgctcacaggtgagctggatgatattcatttgtaattcgacactcatgtttctggtacactttcaatgattcgcacgttcgcaccagtgattgagaagaatggagggggttcgattctgaatatcctatccgtattatcttggatcaatatagacgaaggaggggcatattcagctgcaaaatctgctcaatgggaagtaacaaaagcattacgcttagaattagctgctaagaacgttaggggtgccggattgtatgtagcgtttatggacacggacatgacagctggcatccatgcgcctaaatcatctccaaaggacatctctagaaccgcaatcgatgagattgaagccgacctctacgagattgttgactgatgctacaagtcgggaggtacagcagggtcttgccggaggagttccttccctgtacccacatttatttcaataaaaataccctactcgatgcttgtagtgaaagtattggtattgatcgtgtgaaactataataaatgagatttggattttacagtatattaacatattaggaggagtgaaacatgcgttttctcgttcatgtcaaaattcaaccagacgcaccgcaggaagaaattgcggaacagttgcccgcagaacaagcacggttcgcagaattggtggaacaaggggtgatcagtaagagcaaaagcaatgggcggagcaagtggtctgcgtatcggaatgctagagggtaacaaagtggatggtatattactgtcggcacaggtattactccaattaaagagattagaactgtaaaagcagtgattgatgacttaatgcaagattttaattaattgccttgttagacttatcaatatgcaaagaataattttgaaataggattttttccgatgttcttgataagctttgcttttaccttggtaataaattgagttatacactttttaaaagtaaaatgaacgtattctttggccacaacgggcgcgatatactggtttcacttgaagttagcccctaacattaattgttaggggttttaaataacttcattagaagagttggggacaaagaaagaatgcaggacacactagaccatgtctgtcgctttcaaagattttttttattatgctaaaataaagtaaagagggcgaacaaaaaacgccaataggtacaagttcttgtcttttaacggtacaagttcttgtcctaagcaaaggacaagaacttggtccctttgcccacaatggacaagaacatggtactattgcctatttgaccaggttcgatagtttgggcctagccccaaagggtggcttaacttactgttactcgatatgttatgcaattagaagtagtggcaaggccattccttttgaggtggactagaatggctggctgattaggaggtagcctttatccttcatctaattcaggcttctccccatatgctttaccgaattcctccatcttctttaggacaggcagcagtttgtttcctttctctgtcagcgaatattcgacccgtggcggaacttccggatacacatcgcgctgaataattccgtcgtcctccagctccttgagttgcttggtgagcgagccttgcgacaagcctctcaggaaattttttatctcggtaaaccggcgtctttccccttccagataccagataatgaaatattgccatcgccccgaaagtacattttgcgtaaaggctattgcgtacatatttcttttttcatcaataaactctttttcaaatcctttattacataccctcatgatatcgctcccagtctaaaagtacaaaaatatgtactacgttcatttaaattgccttcttagcaaatgaaacgtatggacttatgatagtgccaaggctgctaactaatacaaatattattagcaagctaatgattattgtaacataacccggagagcagaccaattaagctttacagtattatgccaataatggtgctaaagagaggataataattatgaaaaatcgtgtaacagaaattcttggtattgaaaagcccattttacaaggacctatgagttggattacgaatgctaaatttgttgctgccgtgagtaatgcgggtggtttagggattcttggtccgaatgccggtcaaacgacaattacaacctctccagaggaaaccgcagaacgtatgcgccgcgagattcgtaaaacaaaggaactgacggataaaccatttggtacaactttgattactgatgcagatatgaagttcacttggccaattttagaagttgtcattgaagaaggtgttcaagttattcttcttaatggtgttgaaggaacattgactgaaaagatcattaccccattaaaggaagcgggcattaagattgtttatcgtcctttgactccaacgatcgaagatgcaaaggctgctcaagctatgggtgttgacgtttatgttgttactggatttgatgagggtggaacattgccaacaagtatcattggtacgtttacaataactcctatgatcgttgatgtgcttgatattccagttatcgctgctggtggaatcggtgatgctcgcggtgttgccagctcctttgaattgggggcagaaggtgtctttttaggaagccgttttattcctactgttgaaaaccccgcagcacaatcagtaaagcaaatgatagtggattcatctgcagcagatttgttgttgtaccgtactttaccagcttactatcgttcgttgcctacaccgtttgctgaaaaattggtgactatggataaccagggcgcatctcgtgaagaaattgctaaggttgggggtagttcaagtgtaatccgtatcggtatgcttgaaggtaacggcgaaggtggtattatcactgttggtactggaattacaccaattaaaaagatccaaactgtacaagaagtggttgatgagttggcagctggtattaagtaaaaacggagccccatcctttgaataatacgcttgaattacttcaaaatcatatctctgttcgttcttatgcgaataaaccctgacggcggaacaacgggaggccatctttaaggcagctaatcaaacgaatttacctaaatatgtgattccgtgggtggggctatgtatcggtattatgaaggccgtcctattaaagctccgttcaccggtggatacctcaatttcaccatgttatagttagttcgctaaatatactttacaagttgagggtaaatttggtgcacagatcgccagtcgcaaataacgatatgacatggctcacgaatccacccaaattgttcaggcattgtgggggagttgggaaacagacgcttggacgttagatgtaaaaggtggggaatttgccgacatggacaaaattcagcctataaatcttgaagggtagtattatgcatctcggggtcctttgccaatccccccttctgagcaaggtcagcctgttattttccaagcaggcgaaggggaagaaggtttggaattggcggggaggtacgcgtctggtgtctatgcaaacccttatgatatagagtctgcccgtgaacagagacaaactcttcggcaaagtgctgctcgtttcggccgaaatcccgatgacatcaggatatatgaaggctttatgttttccctaggttcaactgaagaagaaggtttggaacggcgaagacggcttatgagttttaatcctgatgagattcctagcagggtacgttaccttggatccatggttggtttaccactatcggtggacagcgtagatattgatcaacctttagcaccctacctgttgaaaaatgcatatgccaacccccgggatccacgttcacacaaagctttagagctgcttaaacaagggctatcgatacgagacgtacttgcctatggagtcattaactatcatccggtagttgcaggaacccccttacaagttgctgacttcttggaagaatggtttttggcagaggcatgtgacggcttctcggttgttccggatatagcctatgatagagttgctgattttgtggaactggttgtcccaattttgcaggaccgcagtttgttccacagagaatatgggagttccctaccaatacggaagtctaaaataaataataataataatttcttactactacccgatcagcgacgtaaaataacttttagaatagggagaaatgaaaatgagatttggaattataggtgcaggacccatcgcgtcgaatatcgcaaaaaaattaattgagaatggacatgatgtcaaaattgcagatgctcgcgggattgaacggctagaaggaaaagaacttgcaggtacaccagtgagtgtagatgaagtaataacaaacattgctgttctagtcatatcgatccccttcaacgcactgccaagcattcgcagcattgtagataaagttggggaggaagtagtcgttgttgacacttcaaattattatccgtatagagacaataaaattgaagaaattgagaatgggttggttgaaagtgtttgggtatcaaatcagttagggagacctatcactaaagctttcaacaatttattagcctatacgttagaatataaaggagctcccgaaggtaccagtggacgacttgccatagcgattgctggtgataaccagtcgcataaacaaataaccatgaacgtagtaaatgagctcggcttcgacccagtagatagcggatctttaagtgattcgtggcgacaacagccaggaacccctgcgtactgcacagaacttaccaaagaggaactaaccgaagcattaaaaaaagcaaataaagaaaaagctccattccaacgcgataaagtgatagagaagctatcggcagctactgggggatattcgcaccaagacattgtgaacctgaatagatatatatataactcctgagttgaatttttttgccttcaatctttatccgtgtgctttaaaaatcttggcagaggcctgtgcaacgaaacggataaggtgcaaaccaagcaagagctaatgtccttcgcatctataacaggcaaaataagaatttcaaaccggacacgtcggccggaaagcgaagtcatgaagaaggcgcatcaagaaggattttctcctcaatcattggttttgcgaccttagttgagtatctaatgaatattaaagatcattagaaatacatttatccatggattatccaaagattttaaacagattaggtacgtgggttcttacaaagaagcatgaaaattaaaaacaactcctggtgagttgtttttttatggcagaacaggggcttggtcgataattaaatttgtttgaacgacaggataacatggtgaaaagctttctcaggaagagcgcgaggaaaagtactggaagcaacttaggaaaacacagtatagaaatgttaagttatagatgcaatggacgatatagaaaattatttagggaaaggaacttaaactgaaataaatccattcattgcagaattatcatttagaagagtgggatactcaagggaattttattagaacagatcaatcagtgaaaatcaacaaatcaaagtttagaaagaacaaggtgagtaaatgcttaatgaaactgatggtgctaaactgatatgttattcagaaataggtgaatatggtgaggttttactagaggatggaagtactgataaaataaaagttttagcaatttgtagttatgatgatccaaaaattcaatctttttgcctgtgacgaaaaatttacgtaagccataaggagtgtaatgattggatatattaacttggttacaagaatggtattatttacactgcgatgaagattgggagcatcaagaacgaataaaaataacaacgcttgataacccaggatggcatattaaaattaatttaaaagaaacagaactagaaacaaaaaatttaatgcgcttataatagagagaagcgatgatgactggattcactgcaatatcgagagcagtttattttctgcagggggcccaggaaatctaggtgaaatgctatctatattctatagatgggtaaagttagattaatactcagtatcgcagagaatgataaaagatgttaagccttagaactttttaacccatgcttaggcgggttttcttaactgtggaaccaagctagctcaagataaagcagaagccaaaagactttgggttgaacgtgtgctgaaaaaaaaacaaaattctcctattcatagggatattccgaattaccatgccataatgttgaatattaaaattacgtaaaatattgttttgacgaatatttatagctaaagtataataatttacggaggttatacatatatggataaacaaatgaaaatgcattacatgaatcgaatcgatgaaaaattgtctgatcttccgtggtttattacggaatttattgatagcagaaaacgaaaactttctcccacaacgcttctgaactattgccatgactatattattttttttgattggttagttgcagaaaattttactgaagatagccgtaaaaacattaaattagctactttggagaaactaacgattcgtgaagtggaaaatttcttatcttttttggagtatcaacttggcaataccaagctaaccattaatcgcaagttgtcctcactgaaatccttatttgattacttacagaacaaagctgaaacaagtgacttaaagccatatattcagcgcaatgttatggccaaaatggatttaaatgtggttaaagaaagccaagaaaccattgccaatcgtattgatgggaaaattcttagggaggacgattttgagtcatttaggcagtttatagctcatgatttcggagaaatcaataaagagaataagcgtattttcaatttccatcaatttaaccgtgaacgagatacagccattgtttccatcattttaggttctggtcttaggctatctgaggtagcaggtattaacattgaagatttggatatgaataaggctttggtgcgtgttatacgaaaaggcaataaagaacaatacgtgtatttcagcaagcaagcgttactagatttagaaaattatctacagattagagaatccagatatatcccagaaaaaaacgaaagctttttgtttattgcagctcccataggtcgtaaaggaaaaagccgacgcttaactcagcgatctatagagaaactgatcgaaaaatatgctacagcttttggaaagccagctttaaccgtgcactctctgaggcattcatttgcaacgcgatatcatctagagaacaatgatgtgctcaggttgagaaaccaattaggtcactcttcaatacaaacgacaatgatctatacacatttaacagatgaggaaatgaggaaggcagtcaataatatggataagtaatgtagagcgcgtcaagtaagtgacacaaagttgcctacctgactgggagaatgacacaaagttacctacttgactgggtgggtgacacaaagttacctacttagcttgataaataaaaaaatgacctcattcgcttggagaaaaagaaataagtcactcaaaagtatgatttaactactaaagtagggaactttgtgtcattttagtagggaattttgtgtcaacgtacatcatccgatgtcgggtgataagaacattagctgcgaaaatcgcggcttttttattttatgggataaagttcttgtcaaaaccaaatgacaagaactttatcctattaccgattttgacaagaatattatcccattcccaacgaaccaatcatcgaaggtttatattttaacagcttttttgtttattggtacaagttagtgttcggagtcgacaacaaaaacttgtacctgttgctgaaaggacaagaacatagtgtcattattgatttggtatttacataaacagcttaattcggcttatgtgtaagaaaagtggacgtatcggcagttattaataagttgcttttccaacaacttccttagcagtatcataaagattatcataatgcagaagttcaatattttgttccgtttttgtacgacgcttagtacggtaagtcttttcgttaaagtctgtccgacgacctgcaacaacgacgaaatggattctcgtcctgtcgggtaccataaattctaaaggtaattgttgtgccgcgttcttgtactttagaatagtttcttgaaaagatgtatagtacgattcgagccaatcagctggctgtccaaatcgtacgctgagatttccggcaattttggttgcaagcagaatgatgagaatcgtcaaaaaaacatgtaatacctccttgagagtagtaaatacgaacaagattagagtgcccaaaaaaagacaaaagagcccgctgtgtgcaggctcctcccattccattaatgatggtacatcaacaatatcatgttcccggcatattttcgcaacaccaaatacgctgattcaacaccacttacgtttagtatcttctcccgatacgtaactcccatcaaatatgaagctgtccaatcatccagtctccatagagggggtgcctaatctggatgtagccaatctggaccttgagaccgctgcggcagaatataaggctaaggttgtcaatcctcaccggggtgtcttaccggatgcggttgctcacactatggaggagcagctattcggtgcttgtacggtggagattgctgccttcgatgaattcacatcttttctgacaaacaaagaagtaagagcgcagtacgatcatatcctgttcgataccgtacctacgggtcatacgctacggctgcttcaattgccttcggcctggagcgggttcctggaggagagcactcacggcgcttcttgtcttggaccgctggctggctagtatccaagcaagctttgtatggagaggcggttcaaaggctgtcagatggagaacaaaccacacttattttggtcacctgtccggaagcctctcctttagtggaagcaggacgtgcatcatcggaactcagaggaacggggattgcgaatcaactgctcgtcattaacggcgtattgaccgactattccgtggaagatagggtagcagtagctttctttaacaggcaggcgctagaacaaatgcctaaagaactaaaagagcttccgagttactccatccctcttgctccgtttaacgtgaccgggattgagcatttgcgcgagtttttccaatcatccccttagcagcgagcacccatggttcaaggaggcagtggcaacctacaaaacaaataccatgactattacgggtgtggatgagattacagatttggatgaaaagggctcgtagggtcagcaggtgtggcaatagctgatgaaaaatttggtattcgaactgatcagtggagcattttatttggaaaattctaaatggaaatatttgttgacgatcaataaatgctatgctatattttttttgactgataattgtaatcattactattaatttagtgacataggagttccttaaattctttttgtggaatagaggtagctgagatgaaacaggagatcgattttataaaatttagtccaacacagaatatgacgattctgattaaaacaaatcatccagctgagacatacagacacatagcctcaaaaattatgtcatacgataacgtgtatgctgaacaagtagggtttatagaaaaatcgaaaaaaaaagttaacgcccatttacaaatggccggtggggaattttgcggtaatgcttgcatggcattggctgcttatatcgcatccgaacaaggactggaacataatgatttaagagaaatattattggaagtttcagggacaaataaattgattttgtgtcaagtgaagaaaaaacagaatgaatattgctgtcaagtaaccatgcctattcctaataaggtcgaacagagaatgatcaagtacgacggcatcgatttagatatgattatagttcgatatcaagaatatatccatattgtattagaagtcgaacaatttgatgaagcgataaaaaaaagagcgcaaacattggcaagattacttggattaaccttgggagataaacttatcggcattttattatacaaatccgaatcaaatgagttagctccgctcattttcgtcccacaactggatagtctgatctgggaaagggggtgtggttcgggtacagcttccttaggagcttatctggcatggaagaataaaaaggagatcgttgcagaagtaatgcaacctggggggatgattaaagtggttgccgattttaacggagacgaaatagcaagtattaaaattgagggatctgttgcaatagtagctcaaggcaaagcttttatagaggtttaactattacatttggcaggaggaaaaagaatggttacgttggtcaattttcaaaaaaaattgattgatttttctgagagatttggtgagctggcagcgaggtatgatcatacggttaatcattgttcggagttggaggcttccatcaacgactactccagatttataacagaccaggagaacagagaaacctggagacgagtggtgcagggcgaatcttctattttcagtcatctggtatgggatctaagaaaaaaatcggcattatgtgtggcgattatggaaaaatatcgcgcattgaagttacaaaatggagaagttgaaatcgccgattatttcaaaaatatagaagaatgtattgaaaaggaatttggcaacttccaagttaattctgactccaaagttttgttggtaggttccggttcatttccgatgacacctttattaattgctaaacgaacaggggcagaggttgttggtattgatatagatgatgaggccgttaaacttggacagggtgttttggagaagttgggtgctggcttgaagatcagattgaaaaaaacaaacgtggaaaatcttgattttacgaaagatgcaacgcatatcattttcagttcaacggttgccaataaatatgacatattggatcaattatatcctttgacgaatgaacaagtagtcgtggcaatgagatatggtaatgagttgaagtctttattcaattatccaatgaaagagacgaatcatgaaaaatggaaaatagttgataatatattgcgcccagatgatgtgtttgatatcgcattgtacaaaaaaagttagctagctggattataagagaaggaggattttatgagtgattttaaacgtgtcttgttattgggaactggccctacatcaattcaactggctgtaacgttaaaaaaacaattaagttgctacataggagttgtgggtagagaatctgctcgctcagattactttttttcgtcacttaagcaaagtgatcaacgaattcgtgcaagtattcaaaatgaacagcatcgaaagttagaaggggagtgttccattaatcaagttttcaaggggtatgaaacaattgatggaaaatgggatactctcattttctctgtgacaacggatgcttatattgaagtattaaaacaaatgaatgagaagtttctaaaagaagtaagctgcatcattttaatctctcctactttcggttcaaacagtctggtaagaaattatatgagcaatttgaattcgaaaacggaagtgattagtttctcaacctactatggggatacacgctggatgcatgataaaccgactaatcatgtgataacgacgggggtcaagaaaaagttatatattggttccacacaattcccctccgagaatgttgaccgactatgcgaggtatataaacaattggatattactctggaggttatggagtcaccaattgaggcggaaacaaaaaatatttctttatatgtgcatccaccacttttcatgaatgatttttcgttaaacgctatttttgggaatacagatatcaagaaatatgtttataaaatttttcctgagggacctattacgcaatatctgattcgcgatatgttggcccaatggaaagaaattatgaatataacagatatgttaaatataaaaaagtgaatctcctccaatttatgacggatgataattatccggtgagattggaaagtctgtcacgctacgatattgagaatttcaatcgcttggaggccgttcaccaagagtatttgttgtatatacgatatacctctttgttgattgatcccttttcagaaccagatgaggaaggaaaatattttgatttttcagcggttcctatcaagaaaatgtttatcaacagggaaggatatctggagatccccagaatgcccaaggaagactattatcgtataaaaatcatacaaggaatttctagatatctggatgttgattgtccaacgatagataaattcattaaaacatatgaagacaaaattgaaaaagttgctcaagatcataagaattcattgttatccaatgcatttgtcgttcaaagctttgataaagacataaggatgatctgccaagagttgggaaaaagcatgatataactatacgtttgacttataaatatcttatattcatcaggaggcattgtagtgaaaaagagtagcatttatagttttttatttatacttgtgtgcgtaattacagtggtggcaggctgcagtaatggaaatgaaactaagacagattcagcgaatggaaaagtgaaaacagaattaatttatgcctctgcaaaagatatcaatgatatgaatccacatctatacacaggctctatgccggcacaaggcatggtctatgaatcattggtggaaaatacgaaagatggcatcaagcctttgcttgctgaatcgtgggatatttcagaggatgggaagacctatacttttcatttgcgaaaaggtgtgaaatttcatgatggtgaaccttttaacgcggaagccgtgaaacaaaattttgatgctgtacaagcgaatgctgcaaagcattcctggattaagctatcaacaaaaatagtaagtacgcatgtgatcaataaatatacaattaaattgacattatccgaagcttattatccaacgctgattgagttatccatgaccagaccctatgtgtttctgtcacctaaggacttcattaacggcgggacaaaagacggtgtgagtggctttcatggcacaggaccatacatgctcactgaacacaaagtagacgaaaatgcaacgttttctgcaaacgaaaactattggggcggcgcacctaaaatcaaaaaaattatggccaaggttcttccgtcaggagaaacgacttttttggcattgcaaaaaggagaaattgactttgtttttacggatgatcgaggtgcagacagtatcgatgtccaagctatgaaccaattagcagactcaggcgattatcaaattgttagaagtgaacccatgaatacaaatatgatcgtagcgaatagcagcaaatcgaataatccgatcagtgaaacagctgttcgtgaagctgtctggtacgctattgacagagaaacgatcagtaaggatatttttaacgggactgaaacggttgcgaatacactattttcttccaacgtcaattatgcagatgttgaattgaagtcacgaaattatgatgtggaagcagcgagtaatcttttggaaaaatcaggatgggaattggaaaacggtgctacagtcagaactaaaggagagcaagagttggcaatgaagttgtattatgatagcaattcttcttctcagaaagtgcaggctgaatttattcaaaactctttaaaaggaataggaattcagttggagattattggtgaggagtcatcttcaattgcgaatagaagagctaccggggactatgatcttttattcaatcaaacctggggcctggcttatgatccacagagtaccatttctgcttttgcttccaattcttcttatttgcacacaacaagcggaatcgctcaagctgacgaactttataaaaagatcgatgaggttatggtttctactgatgagcagaaacgaaaaatgttatatgccaatattatgagaattgtccatgatgaggctgtatttattccaattactaatggccgtgttacagtagttgcccccaaaaatttgagtggaatctcatttaagcaaacacagtatgagttgccatttgagcaaatgtattttaaataaaagacataaaatgaaaggggagaaaccccctttcattttaatgctattactgttgatcttgatctgaaaaaaatgtggttaagagaatctcatgctaaaaaggagatttgtatgagaaggtatatgataaaaaggattttgttggcactcccattgcttttgattatttcgtttctgacgtttgttttaattaatctctcccctctggatccagctgtagttgtattgcaagcgcaagatgttccaaagattacggatgaattaattgcgcagacgaagacagagttgggaatggacaaaccatttatgaaccaatacttaaattggttgagctcctgcttgcagcttgactttggagattcctatgtcaccggaaaaccggtttggtctttggtgggtccagcctttctgaataccctgaaactgacgctgatttcatctgttttcatcattcttttctctgtagtattaggtgttgtctgcgcagtgagagagggaaaactgatagacaaatcagtaaggggattttcattttttttaacttccctgccatcatactggcttgcggccatcatgatttggtatttttccgttaagttgaattggctgccgacgagcggaatggattcatataaaagttatattcttcctgttgttgtgattaccgtgagttacacaggcatttattttagaaacgtgagaagttcaatgttaagcaatttaaatgaagactatgttctgtatggaagggcttgtggtttaacagagaaaaaagtgaccatgcacatcttgagaaactctttacaggtatccgtttcaatattttgcatggctataccgattgtactgggaagcacggttgtgatcgaaaatgttttcgcatggccaggattgggaagattaagcgttaaatcgatcctgagcagagattttccgattattcaagcatatgttcttattttggccgtaacttttgtgttgtttaacactatttccgacattataaatgcagcaatgaatcctagattaagaaaggatatctaatgagaatcctcaaaaatttatgtaaagacaagttagcaatgacatcactgatcactattgttgtaatgatagttattggtacacttgctcctttatttgcccctcataaccctgaggaagtgaatatgaagctacggtatgcaacttcatcttgggaatatcttttaggcaatgatcacttgggcagatgcattttgtccaggttaatttatggaattcgccccagcgttttatgggtattggttgcactaatgatatcagttttgattggggcagtaataggttttattgcaggatactttagaggaaaaacagatactttaatcatgagaatctgtgatattatgttatcttttccaggatacgtgatgactttggccgtggttggtattttgggcacaggccttgaaaatattttaatcgcatttgtggtaatgaaatgggcatggtttgcccgagtcattcgaacctccgtgatgcagtactctgaaatggactatgtgaaatttgcaaaagcctctggcattagcaacttgagaattatatataagcacattgttcctgtaactttctctgatatagcggtcatatcaagcggttcgatttgttccatgattttgcaaatatccggtctatcttttctcggtttggggatccaggccccgcatgctgaatggggcatgatgttgaatgaggcaaggggagttatgttttcaaaacctgaactaatgctagcacccggtttagccattgtcattgtagtatcagcgtttaactttttatcggatgctcttcaggtttcactggaccccaaattaatgacttcaaaaggcaagcttcaggaaaaagaggtgaaaccaaccacgtatgaatatattagaagttgaaaatctgaaaatatgggatattaacactgacaaagtgatcattcataacagttcatttcatgtaaaacaaggttgttgcctggcaattgtcggagagagtggaagtggcaagtctgtgacctgcaggtcaatcatgcggttaaataaaaccgggattggccaatctggcgatatattattcaaaggagaaaatttaaataagctatctgagcaagaaatgagaaaaaaaagaggaagaaatctgtgcatgattctgcaaaacggcatgagtgcttttgatccttcttgcgtaatcggtgttcatctaagagaaaccctttttgagcattttggctggaataataaagagatagaacaaaaaatgaaaaatgcaatggaagctgtcatgctgaaaaacccgatagagattatgaacaaatatcctcatcagctatcgggtggtatgttgcagcgaattatgatctcattggctttggtgctggagccggatattattattgccgatgagccgacaacggcgttggataccatctcacaatatgaggtagttgaacaattcattcaattacgtgaaagaatggggtgttccatgatcttcatttcgcatgatttagggattgttaaaaaaattgctgatgatgttttggtcatgaaggatggcagaatcattgaaagaggaaatattcaatccgtcttctcagaagcacagcatccgtatacgcaatatttaatatcgaccagactggaattaagtaatcatttcaagaaaatgatgcaggaggagtttcatcattgctgaaagttaactgtattaataagtcctatcaaaaaggtggattgttttctaaagatagacagaccattttgaagaatgtcagttttgaatgccgaaaaggagaatgcctcgggattatcggagaaagtggaagtggtaaatcaaccttagggcggttgatattggggattgaaaaacctgatgatggaacaattctgtttgaggggaaaaatgtagataagagaatggtgagattagggaacattagcgccgtatttcaagattataagtcctcaataaatccattttttacagttgaagaagcgataatggaacctttgaaggtccaaaaaaagagtgataaagaaaatcagaacaagattgatctattgctacatcaagttgggttagattcatcctatagagacaggtatcctcatgaactatcgggaggagaggtgcaacgggtctgtatcgcaagagctatttcaacagagccccaatgtattttattagatgaagccatcagttcattggatgtgtcggttcaaatacaggtactcaaattattaaaagaattaaaagcaatttataatatgagctatgtttttatcactcatgatattcaggccgcagcgtatatttgcaacagagtgatcatttttagaaatggtcaaatcgaagaaatggtcaacattgaaaatttaaaggacgttaaatccgaatatgcaagaaaattgttggattttctaatcacgttctaaagttggttgaaatactgaaaagcagaatttgttgcacaatcgagaggagaactaattgtgagtggagctatgtcttggccttttctgcgtttgtatattttggctcttctttattttagcgctaacgcaatcctcaatgtgattattcctttacgaggagaatcattgggagccagtagcacaatcattggtttagtcatgggagcgtatatgtttacgactatgttttttaggccgtgggcaggtcaaatcattcagaaacaaggacccattaaagtgttacgccttattcttatcattaatggttttgccttgattttatatacattcactggattaggcggctatttcgtcgctcgtacattacaaggtgtatcaacggctttcttctcaatggcattgcagattggcattattgatgcactgcctgagaaggatcgttctcaagggatttcattttattcgttatttacctatataccaggaattattggtcctgttcttgcactggggctatggcaaacagggggtatggattatttttctgttcttatgattggaattgccatcgtgaccggcctgtttggttacagtgtcaaaatggacaagcggaaggaacaagagcctgctcatggaaatgctgggcagacattaaacatgtgggagtcatttggccaactggttaaaaatccgtttctgttcaaatgcagtgtattaatgctcatatcttctattgtattcggagcaattacagcgtttattcctttgtatgctccccaacttaaaagcggcaatgccggactgtatttaatgattcaggcgggagttgttgtggttgctcgcttcattctaagaaaaaaaatcccatcagatgggaaatggcattccccatttatgatgggaacaatgctgcttctggcattggctgcgggatgtgtaagtttttcagtacagggaggaacgattatattttatgttggagccggacttatggggatagctcaggcaatcgtttatccaaccctgacaacctacttgtcatttgttctgccacagtcaaaccgcaatatgttaatcggattgtttattgccacagctgatttgggtgtttcgctgggcggtgtcatcatgggaccaattgctgatttttcctcatattcatttatgtatatgatatgtgctattctaggggcggtgatgatcttttttgcctatgatcgacgaacacttccagttcgcggataagagtctgttccgatggagcgatctaataataagtaacatcagggtggacacatgatggtgtcagccctgttttttgtaggctctgcccctgataagcagattcgttttatccagtgattcggcctttcattcagatcacagataataatagggttgtgaatgaaagaaaactgcattgcaattaatacgattaacaattgtgaaaggattaatcaataaaagtaaatgataaaattaaaggcagagcaaaggagaagacgcctaaaatacaccgatgatctgccccaatcaggggccttaaatcatgaggaatcatcaaaccgacaaaatcgatagcaccgctgacaaccaaaaattgtgaaaagcctgaattgagtactaatcgatattttttataatatagagtatggttaactcgaaagaatttgtagttgaagcactgaggggagatagaaagttggacggggctataatggaacttgctaaaacagatgtacgtcacgcgatgagtaaagaaattcaaatgaaccagctgctcatcgaaaataacgtcgtttatcggaatacaacacggcagaagaaaatccaagtgttgaccgctatggcgcgtaatgaggttcttcgccatttcctcgatttggatcgttctgtccagactccgatcaattttaaaagaaacctccctatgagcgaagaatatcatgattttatatacaaaataggtgcaacccgatatgcacatcatgtgaaaataaaagcggagcatcaattgtttctggattacacccacactgattataaaaggaagagacatttcctcgatgaagtattaccggaacaaccgaaatggtcaaagatatgggtagcatttttaaatgttgcaggtgccgtttttagcatgattagagaatattgggggattccacttcttgtcggatttggactattgatatattttaacccttcatcatcccctacaccttcacattctggattttcaaggggagatcattcttcatcaggaaatgagcctacttttgaagtgaatgaaagtacaagtataggtaacccaaatgaaaattcagtttcagatacgccacaagtaatcgatgattctaatcaaaccggctttggaaatgaaggagacagcgggtttgattcgccgagttctgttaacgaatttcaaactattaataacgatagtagtaagaagatttcatcttcagatgcggtaagcaatgagacggtgttgacagcttcttccgagaaaagcatgtttatagaagaaaatcttaattttttcacattagggtctccgaagcaaaaggtgatcaatgttatgggaatttcgacgtcggtcatcggaaattcatggacctacgggtattcgaatgtggaattagactctaatgaccatgtcattggttggaataatatcaaccataatttaaaagtatccattggctcaaagaagaagggggctgctccttttacgataggatcttctatccaagatgtaatttatgccatgggtacaccgacgtctataattggagaatcttagggatacgattattcgacgatacagcttaattcgagtagtgaagaggttataggttggtcaaacatcagcgataacttaaatgtagttcttgtcatccgacatccggcaaccgataaataaacccgcgttgctatgcgggtttattaagacatcttcacaaaacccgtattttatacatatgtatataaagatgtacatcgttttcgatgtatattaaagatccccatttccctgttcatgcaaaaatgcgtgagaacagtgttacaattgccttatctacttcagctgaaaatcccgccacttttaagacaaatcaagcaggagaaaaacaaaattgtgacattaagtttcacatctaataaacataaaagaaaatattacatcaagaaattattggaggtaattcgtgcatggaaaatcgttataagttattttttttcgcactcatactagcttcttttaatcttaggcccggcatcacttcagttagtccagtcttacatggcataacagatgatttggggatgaaattcgacttcggcgagtttactgacttctattcctttattatgtattggttttgctccttatttgctgggcgcttagcaaatcgataccagtccgaagagatcattaccatcttcattgcttgtagtggtatcgcaacatttctgcgtttctttacgattactatatgattacacaggaagcttccttccgacaatgtatctgcttattgctattgggtttattgtgatttttttaggttggaaaattactaaaccaacagataaagcaaatgtaggatagtacgaatatacttccccctttacgttgtcttcagcaatgatgcaacaatctgaatcatggattactaaatttaacattaaaagcagcaaatttccttttgtttttcattacaaaaattgacatttcatatgaaaataagtaatataattagaaacatttatactgcaataggctttctcatccccctctttttaaattcctgatcctacctaatttaaggagtgaaattgctatgtgcgcacgaacgctaaaagcgaatacaaggaatgtaatcggtaactattgcaaatggatcacagttggtatgattttaactttcacgggatgcccgcttgcatccgccgctccttcaccctcatcctctagtaaaactagtgaacccgcctcttccctagttacatttcaattgcaagaagctacgattgctcaaatgcaggaagcgatgaagtcaggggcactgtcaagtgtcgagctcactgctctgtaccttaaccgggtatatgcctatgattctagtggcattcgactgaattccatccctattctgaaccccgacgtactaaaagaagctgctcaagctgatcaactaagggcacaaggtattaagactggtcctctgcaaggcatcccctacacggttaaagacagctacaaggttaagggactcactgtcgcttctggatctccggctttcaaaaacctgatggcaaaggacgatgcctttacagtagaaaagatacgaaaatccggtggggtgctcattggtaaaaccaatatgccgccaatggcggcagggggaatgcaaagaggcgtttatggccgcgctgaaagtccgtacaacccagattatttggctgcagcctggtactctggctcctctaacggatctggcgtatcaacagccgccaacctcgctgccttcggtatgggggaagaaacggtatcctctggaagatcaccagcatctaacaatggtttaattgcctacaccccatcgcggggcctaatctccattcgggggaattggccgctcttccctatacgtgatgtcgttgtcccacatacgaggactgtcgaggacatgctccgcttgcttgacgtgatcgttgtagaagataagatcaccaagggcgatttctggcgagagcagaaagccgttcggctcccttctgtcaacagtgtccgtcccaaatcctatttagagctgcgagacattcaagctttgaaaggcaaacgcattggcgttccgaaaatttatatcggtaaggaccatgaaaccacaactccgatcaaattcagaccttcgatacaggcattatgggaaaaagctgtaaaggatttaactgctcttggagctgaggttgtggaagttgacttccccttgcaggcgaatagcgagaaggaccggccaacagcgaaaacacctgaagagcgtggtttgatgccggcaaagtgggctgaaaaggaattcgggttgcttaatccttatgcagctgaggaattccttaaaagtgtaggcgatccaaatttcccgtcatgggcaaatatcgaccctgcaaccgtcttcccgaatccgcccggttcggtagatgccaaacgtggcagagaccttggccactatgacgtattcattgaaaccataaagaaaggcgtcaccccttacgaacaaattcctcagtttcaggaaggtctgagggggcttgaaaatgtacgaaagattgattttgaagattggatgaagcaaaacaaccttgattttattgcattcccggcaaattcgaatatcggcaaagctgactccgatgtgaatgaaacgtcctacgaggaggcttgggagaatggcaactatttctctaatacgaatttcattctacgcgagtacgggatcccaagtgtgtctgtgagtatgggcgctatgaaggataccggtatgcccgttaatctgacgatggcaggtgccgcatacagcgataatgacctgcttcgttacgcttattcctatgagcaggcgaccaaaaaccgtcctattgcagtacgtacgccagcgcttgaggatgaaaccttttcctataacccgcaaaccactctcccaccctttatacgcaaggaaacaggaacccctgtacttaagttgaatgcttcgatcacggatgatgttctcgctttggaaggttcagtcacagatcaaagtgatatcgcgcagcttaaagtttatgtcaatggcattcgtgtcgttattacagaagataaagccaattggtcagcaacgcttccaactactaaatacaaacaggatggtgcctcccaagccgatacgctgcatattctcgtgctggccaaggatatttacggaaatacctctgctcaagtcaagtctgtcactttaccccaatgataaaggacatcatagaactgactataattgtgggttccctgaccgtaaggtattattagaaaagctatcgctacagctggcctgagcgacaggatagagtgtaatattctattcctatcgctgttgcaatcccgcttccatttatttgaagggagcgggctgtagcccagctatcaccaaataacttgacgtattgaacgatattattgagcggtttgaggctggggctattgacggatttgttagttgaaagaggcttgttcagaagagaatataatactgtccattatgacagaggctattacttagcgtattcagccattacaatatttcgatatacccttctgttccatgcacacgaattcgttgaccatcttttatcagtttggtagcattctccactccgacaactgcgggtaagccatattcacgtgcgataacggctccatgagtcatcagtccaccaacttcggtgactaggccttttatggatacaaacaatggtgtccagctggggtcagtaaaggcggtgactaatatatctccatcttccagatcagcatcttccatgtttaagatgacacgtgctcgtccctctataactccggtagaaacaggcagacctacaatcgcttcggctgggagattttctcgtttgtactcacccgcaatgatttcaccatcagacgtgataacacgtggtggagttagtttttcatacaatttgtactcttcttttcgtttgctaatgatctggtaatctagtgtatttgtgcgtacgacttcgtaaagttcttcaaaagtgagatagtatatatcttttttttcatgaataacgcccacttgtacgagttgttcggcttctttcagtaaagcctgcttataaacaaaataacgattaaccatgccgtatttgggatattcacgataaccgatgaaattccggatgaggtcgatcattcgttttgtttcttttgctttttgttcaccacccggtaattgcttcaatcgatctaataactcttgttcttttttcaaagcctcctgtcgtccttgctcaaatttccgatggccagcattaggctcaaagtttttgatattactgagaatcatggggacaagtataattggtttttcactccaacgagttctcgaaatatcgatttcaccggcacatcgcattccatatttgttgagataagcatagatagcgtcttgagtttcctgtccaccatccaacttaaccagttcatccaaaaaattatcatcacttgcatgttgcaaataattaattacttctggataaggacgaatcacatctgcgacatccaatagcgccagacccatttccgatgtaatgttgtttggtacagattgagaaagcgtatctgctgcgtttttttcacctaaccactcgtacattttttcattgatccatgacgaagcattcatagcagtcataaaaacctttgaactttgtgggtcaaataaaatcttctttaattcttggagatcttccagaataaaatcaaataaatctgctcctgatttcgtttggatgttttgttttaattcttctatcgatgtttgactgttcttaatcaaatcagaaacgattgccggatcgttttcgatttgtgcttgaaaacctgcagacgacctatctttactgctattaccgggactcagttcttttctatcatctggtaacgattttataaaatctcgctctattagggtcataaatgcgtcttttatgagcggatcagattggcccagggtatttaagaaagtttctctgctgacaggtgaagccagcatatgtgtaacatcaacaaacaaccttccaccggctatacgcatgggtgcaggggttattaacaggtaaaaagacaatcccaatggttttatcgggtcagtcatcatttgttgatgaccgacagatacataaacgtgattttcttgatcatttgcttcagggatcgggtataaagtcgtgattggacgactctggacaatataaaaagtatcatgggccaaacaccattcgatatcttgtggatagccaaaataagcttcgatctgtcttcccatgcgtgccagttgtaaaatttgttgttcagtaagggtttgagtcttttgctgatttgggtcgatctgccgggtctctgttccgccttctcttcgtccatagatagccaattttttggttgctatcctcttatcgacgatttccccttcctgtactttataacaatcggcagagaccaagccagagaccagtgcttctccaagtccaaaactggcatcgattgatagcagcttccggttggatgtaatcggatcagcggtaaataaaattcctgaagcctgcgggaaaaccatcctttgaacgataacggataaataaacttgactgtggtcaaatccattttgcatacggtagataaccgcgcgatccgtaaacagggaagcccaacatttactgatatgctgcaagattgcttctttgccaatgatatttaaataggtgtcttgttgaccagcaaaagaggcatgtggcaaatcttcagcagtcgcactggaacgcactgcataagcatgttcctctccaaaccgggagagataatgagtaactgattccacaacatcggcagggacttctacttccataatgatttgtcgaatctgcctgctgatttcaccaatttgagcacgatcttctgcttttagtcttgttagttgatccaacaatgcataatacgtttctttttgttcgatggctttttgataccccactgttgtaacacaaaaaccttccggtacatgtattccttcaatttttgataattcccctaaattcaatccttttccgccaacgagcaaaagctgcgttttttccatttcctgaaaactgagaaccaaagaactcattcaatatctctcctaaccattaaattgagaaaaaaacatttgacaagagtttagcggcatggtaaagttaaagtataagatgtgttaattttgtatatttaattttttaaagtcgcaatctgattatatcatcatgtctgttttatatgcaataaaaaagaacctgataaaactatccaggttcttttttgatttcccgctatcattagtcaaatcaaaaaccatggctcgagctaaactcagtcactgcatagttccatatcggtcctatgcagcctaaggaaatcctgaaggtttcgccgggttcttattgagctaacctacccgttagttcagcgaacgaagcgcatatagtgaacctcttatattttttccgggatgttcttctttgcatttgggaaaatgggaaaacatataagtttctataatacacttcatctcacatgttaataattagcccgagtcatctagctttgcaaaagccggtacagcagcgcctctcccttattctcaaacgttcgctgtttctccagaaattcaggtacctccgacagccgggagggtctgtaccccggaccgccgcagccgcaggagtggtaagtgtatccttgttggtatagaagctccacctttttccactgcttgatatccgtttgcttcggggcctgaaaatcatgacccatgtcatgcatggatgcttggcattgcggacagacatggtcaacccgttcatattcatccttcggcatttcaatccgtgatgtctgcttatataccttcctgcaggtaaagcaggcaaagatatctttatatgggccgtacattgcgtatctgcacatattgttcccccttttataatctagaattggtctggcatttttcacttacatcatggaaatatttcagtatttttaaattgtaatataattttccttttgatgcagcggtttaggaagttccccggtgagcggttgcgtaaaacaatatacccgactactctttcattctatacgaatcaagccttaagaacttttttctccctaaactattttcactggattactataatgcgtcccttgctcaaataaattaaattgaattcgggtaaacagccggaacattatacacctccctgtacagttgattttttatgaatttaaattgagagtctgtcaaaagatcgggatagctcatgatacataaattcttcagcagagtctgcagtcctatttacgataaatttgattaatctgtcgcattattccgtgagtgtattcaaggaggattttacctgacatgtatacaaggatacaaactcctatgaggattcctccagatcaaaaaccgaatgacacaggccagcacgtttccgcccataaattttgctgcagtctcgcatttcttacccgctctttcaccgacatatccaacttgtggaacagccccatgaattcctcacttctttaatattcatagatgttaatttgagctagctgccttatttcttgatataatcagcgaacttccgaagaaaatcgagcgaatggatatcctctctgagatgatgatgaaccagatcatccattttagttgtttccttattcagcatgtattcaagcatagcttggtgctcatgccagatgcctatcagcttccctgtttccagcatatgcagcttgcgatatctgatatagtgaacattcgactgctgaatgagctgccaaagaaatccccgccccaccaattggaacatggtttggtggaactgatcatccaaactgagaaattgatccgtagcatgatcttcttcaatcacagctctctgtctgtccagaatatcgctcagcttctgtacatcgcttaatgcaatttgcgaagaaagctccttcataatctccttttccaatgcgcttcttaagtaaataatttgttcaacggactccagatcaatataggacacaatgttccccttcttgggataaatatcaatgtaggactcaagcgcaagccacttcaatacatcgcgtagcggagttctggacagctgaaagcgttctgacaaagtcgtctcgctgagaagagtacccggctttaaggtcagtgacaaaatatcttttttcaacagttgcatgatttcttcttttgtaaacatatcattcctaccttcactttataaatctagtagacttattataaagcattttgaggtgacggactcctctgagattatcattgacaagaacaaaccctataatttatgatcaactcaatcttgtatacaagacagatggaatataatcagggaggtatcgttatgaatatgacctggagatggtatggggaaggcaacgacaatattacactggatcatatccggcaaattccgggagttatgggcattgtctggtctttacatgataaggtagccggtgaagtatgggaaatggagcgaattcaggaggtagctgatcagattacgagcaagggctttagtacggcggtcgtagaaagtgtaaatgtccacgatgatatcaaaatcggcctaccatcccgcgatcaatatattgacatttatatcgacaccattcgaaaattagccaaagtgggagttaaggtgatttgctataactttatgcctgtctttgactggaccagaacagagctgtacaaggaactgcctgacgggtccaatgccctcttttatgaaaaggctgccattaccgatgatccccgccaaatggtggatcggattctcaagggagctgggaagttcaccatgcctggctgggaaccggaacggttggcgagactggatgaactttttgctgcttatgcggatgtcacagaagacaagttgtttgacaacctgaagtattttcttgagcgcatcatcccggtctgcgaagaggttgacatcaagatggccattcatcctgatgatccggcatggcccatcttcggattgccgagaattgtccgtagtcgtgagaccatccagcgcatcctagatgcagtgaacagcccatataatggtctgaccttctgcaccgggtcactggggagcaatcctgagaatgatttgccaactatgattcgagagtttcatgatcgtattcattttgcgcatattcgtaatatcaaggtgtttgagaatggcgactttattgaagtgtcacaccgcgggaaggacggaagcgtcgatgtaccggaagtagttagagcttatcacgagaacggctatcagggatatgtacgcccggatcacggcagacatctatggggggaagaaaagaattgtcgacctggctacggtttgtatgaccgtgcactgggggttatgtacttgcttggtgtctgggatagtctctctcaaggcaaaggagtgaaataaatgctccaacttgaccggcaaggcctttcagacaaagcggcctggcgagcagcaggcattgaactgccgaaatatgatctggagcttgtagccaataacacccgagttagaccgcaatgggtgcatttcggcgcaggcaatatttttcgtgggttgatagccaatgcgcagcaacaactgctgaataacttgaaagcggatacaggtattattgcggccgaagcctttgattttgaaatgatcgacaaagcttataagccttacgacaatctaaccttactggtgttgatgagtgcagacggaagatttcacaagagcgtggtcgcaagcattgttgagggactcgcagcagagcaaaatcgtccagacgactacctccgtctgattgaaatatttgagaatccgtccctgcagatggccagctttactgtcacggaaaaaggatacgccctgaccgggcccgacggcaagtatctggctgttgtgcagagggatttgacgaatggtcctgaacagccgatgcatgtgatgagcctggctacttcgcttgcctatcggcgttatctgagagggcggcatccaatgacctttgtgagcatggataattgctcccataacggcgatctgttaaaggatagtatgattgccatcgccaaggagtgggctcgcagaggcctggtagaggaaggatttgcagactatctgcagaatgaggagaaaataaccttccccttgaccatgattgacaaaatcaccccccgcccttccttgcaagtacagtctgctcttcggaagctggggttagctgacatggagatgatcgttacctccaggcatacgtatacggctccctttgtcaatgctgaggttagcgagtatttggtcattgaagacaagtttacgaacgggagacctgcactggaggaagctggcatcatcttcacgaatcgggatacggtggacaaagtggagaagatgaaagtcactacctgtctcaatccgctgcatacagcgctggccctcgctgggtgtctgcttgggtacgagctcatcgcagatgaaatgaaggatcagacattacgtcgtctggtggaaaccatcggctacaaggaaggcttacctgttgtaattgatcccggaattatcgaaccgaaaccatttattgacgaggtattgcaggaacgcttcgccaatccctatattccggatacgccacagcggattgcaacagatacgtctcaaaagatgagtatccgttttggggaaaccataaagtcttatgctagcacagcagggcttgatcctacgaacttgactgctatccccttgaccattgcgatctggtgtcgctatttgctgggagtggatgatcaaggagaacccttcacactcagtccggacccgttactggatacgctgcagggatatttgcagaatacgaagctgggcgatcagacctccgaggttcgctgcctcctcgaggatgacaaactgttcggtgtccgattatatgaaattggtctaggcgacaagattgaagccatgttttatgaaatgctggcaggtcccggagcagtccgaagcacgatagagaagtatgtgaactagaacttacattaatgcaatcccccctgccagaaactttagtcagggggattgcattaatgagaaccaattctctaaataatcaaatcccgggttgctccacccgcgaataccgttttaaactctctagaatgcatgttttagaaacaaatagtagaatgaacattctagtatcatgaaaaatgtactattacttagaaggtcacaatcactttgccttgggagtggcccgttgacactttaatcaacgctttgttaatgtcatcaaacgtataagttgaatctatagagggcttgatattttctttttcaacaagtttagtgatttcttgtaattgacttccattggcttgcacaaataaaaagcgatattcatttcgattcttacgtgctaaagaatctaagcgagcacccactagaccaaacaatgcttttttccacattggaaaatgattgtcaactgcaaagcgataattaggtccggctttcaatgataccaatttcccttgtggttttaaaatacccagttcagctttgatctctttggtacccaaggtgtcgatcacataatcgatatcggacagtatgttagcataattctctgccttataatttatgaattgatcagccccgatcgacagtatacgtgatctgcctctttcacttccacttgtaataacaaatagtcccagtgatttggcaatggggattgccatagcgccaaatcctccagttcctccaggaatgaatagctttttattcggctggacatggagtacatcgtgcaatgcttgataagcagtcaaggcagtaaggggtacagcagcagcttcaataaaagatagattttcaggcatgatggataaagcatcttcatttacggccgcatactcagcaaaagcaccgattttattaagcggcaacctcgtataaacagggtcaccaaccttaaaattcaaaacatcatcaccaacagcttcaataaccccagatagttcattccctaaagttaatggcaacttatagtcggcaatcatccgaacactgccattcagattaagaatgtccagtggatttacacctgcagcttttactttgacaagtacctcatggctattgatctgtggtatgtttacatcatttaattccacatggattatttttgaatatttctgtacttgtgctgctctcatattcatcctcttcctttgctaatttggagatagcatgaccatgaacgcaatcgagtttttaggttgacccgcttgatatccattttttactaaatgcgtttttttgaaaacatcaaacatcttagactaaaaacgtggcgcacaattttcagttgtacgccatgtttcagcctttatgttattgtagaccctcttgcgattctaattcttccatcgtaggataatccgtgtaacctttactccccaaaccaaagaatgttgacggatctgcttcatttagttgcgcacctttttgaagccgttccactaaatctggattggctaatgaccatacaccaacaggcaccaaatcagcaaggccactttctatatccaagctaagatcttcaagagctcgtccagcacgattgactaacaatggatttgtccagattgagcgaatgtcttggagcagcttttcatttccaagatgcataacatgaaggtaagctaaatccaattgagctaattccgttacaaggtagcgataaagttcaggatctccacggatatatgaattaaatttaaaaccctgaaatgattggatagatttggcctctcaggttgaaatcatagttctggtctacaatacctaccacttcgttgttatcataaagatccaccatgaagcccgccatttgtttggcagtgtggtacttaggcatgtttgctttgtaatcaaattcttcagtatctaatgatttcttcacgaattccgtttccgttatagatggtgctaaaacctttgcttttagtttttcgcctttcatttctagttcttttgcaaggccttctgtgaaggcactaacgtaatatttagatgcagaataagcaacactcccaacagcaatggcatatccgagtgcggatgagacgttaattaactgagttccttctacatcagcataatctcgtacatatagtgtagaaaggatcgtcaaggtttcaatgttaacacgtagcatagtttcaactttatctaaattctgttctgctacaaaagaagcttcaccgagccccgcattgttaatccaggtctcaatttggtattcttttaaattgttatatagtgtgtaggcctggtctgtaacagacaggtcacttgtacgaacaataacatttatagtaggatctatatgcagaattgctgatttgagttcttctaatttatccaatcttctagctaccaagattaagtttttgccacgtgcagcaaacgccaatgccgtttcatatccaatccctgaacttgctcctgtaataactgtatacttcataatattctctccttcataacatgcagattagtgtaaatgagttttaaagatgattttagaacgatcattcttattagggtaaaaaagttagatctaacttgctattagcatatcaattttagaacgaacagtaaagaattttttatgactaaaattttaattttggagtggtattccttgacttgtttgaggcataagatacaagttctttctttcgttagagggacaagaaaaaacttgtatcacggaaacaagcagtcctccatttaggtgactccttttgcctgtcatgctgtaattccacttttaatctaaagcggtcagtgtcatatcaataatattctttaatttttgctgatccgttgttgtcttaaccaacgtacgtagccctaaccacgcattcattaaataatgagaaataactacaggatccaactcagccttgaactcacccgattgttgacccttcagaacaaggttagtcaagagttcctcagttcgcgaataactctcatcaactaaggatgcaacttcaggatccaacacgccgagttccacgcctgaattcacgagaaaacaccctagaggttctccttcatttcttactgtcgcctcaaacaactcccgaattaattctttgatcggtttttgtttttcaatcagaaacctcattttgctggtctgtttcgtttcatatcgttcgagagctttcataaataaggcatgcttatccccaaaggtatcatagatacttcttcggtgaatgcccataaactcaaccaaatcttgcattgaagttttctcatatccttgtgcccaaaacaggtgtattgctttatctaatacttcattgacttcaaattcttttgatcttgccatcgtcatcacctcgaataatcattatacaatgtagtgaaggatcggcaaactagatttaaaatatgtgaatacattacagctatgagatctgtcttatatatttaacccaggattcttcgtttgtttgcttgtaaccaatcaggcgtccatcctttttccagggcatccagggttactcctggcggaacgatagcatctatcgcatccaggatatcagtgcttaatcggatgtcgctgccttttaacgtttcacgaagttgctcaattgttcttgcccccactatagcagaagtaactgacgaatgagcttgtgtaaatgccatggcaagatgtggcaaagttaatcctgcttcatttgcaagggtttggagcttagcaacggcttcgaacttgatgcgattttcttctcgattcggatctacaacagttgaaagtttccctagagaacttgctgctcttgaatctggggcaacagcttctcccgagcggtattttcccgttagtagaccacccgaaagtgggctccaaaccattacgcccattccgtatttagcggttgcagcaagcaaatcgaattcgatgcttcgattcaatatggaatacggggcttgctcggatacaaagcgtgcggtatttttgcgttcgctagtccattgtgcttcggtcacttgccatgcctgaaaattggatgtaccaatatatcgaatcttcccttcacgaaccaggtccgtaagtgcgtcaagactctcttcaatgtcagtatggagatctggctgatgtagttgatacaaatcgatatagtccgtttgcaaccttctcaagcttccctctactgcacgcttaatccaatattttgagttaccggattgattaagcccactgcccatgggcattccgcctttcgtggccagaataacatcctgtctgcgtccttttaggatgtgacccagaatttcttcggattgaccacttgaatagacatccgctgtatcgatcagattaatgcctccagccaaagcctcatctaacatgactgcagcttctttctccgtattgttgccccaaaaaccaaaagtacctgtacctaatacaaaactgcttattttaaggcctgtatttcctaatacacgatattccatgttcaatccatcccttctccatctgctataattagaatgatcgttctaatattcgtagaagagttcacggcaagatctcacaccactcctcataactcttggcttcttatccgtgtattcctcctacgccaacaatataacatatttagaacgatcggtaaagaatgattttatgcctgaaattaagatccttcctgaaaatgaacgaagaagactccaaagccgcggtcaaaacggagctgaagtcttcttttcaatagaaatgaacattcaaagcgggatgtaaaatttacattagtttacgcatctaacgtatacaagggcaggttttccggtaaagccgccgggcgcagacatgtgctctgcattggatagacggtctgctgatcggaggaatcgtggaacgcccacatcgcctccagcacatgataagccaattcaccactggcgcggtgaggccgtccgctgcggatagcgtaggccatatcggcaacaccgatgccccgtgtattctcctggtagcccggcagcagcggtacctctgtccattcttgctcacccagcagcctgtagcgaactggccctccgaacgtgttcgggtcaggcacttgtagcgtgccctgagtgccgtatacctcgatcggtggcagagtgcttccaccaaagatgtcaaagctggtaattagcgtgccgacagccccctgcttgaagcgcagcaatccggccacatgggtcggtatatcgaccgggatggtctggcctctctttttctcgctcgtaattgttcgccgatccatcgccttgcttgtcatgcccgaaatggcagcaatcggacccagcaattgcaccagagctgtcaaataataagggcccatatcaaacattggaccgccgccgactgcataataaaattcaggatcaggatgccaatgttcatgtccacggctcatcatgaaagcagtagcggctaccggactcccaatgactccgtcttcaatcagcttcaatgatgtctgtataccggaaccgaagaaggtctctggtgcgcagccgacaagcagtcccttttgatgagcaagatccaagacagcctgcccctgctcacgggtgacggcaagtggcttctccacatagacatgcttgcctgcctcaagagctctgagacatacgtcggcgtgaacgcccggaatggtcaaattaatgatgagttcgatctccggatcagccaaaatctcatctaccgaatatacatgcggaacgttgaacgctaccgcctgctcctctgcccgaccttggtccagatccgctacagcgtacagctccagaatgtcgaaacgatggcaattttccatgtaaattccgctaattttaccacacccaataatgcctactttcattttgttcatgcctagactcccttcttcttcagaaaaaatggataatggcattcttttgttacatcggataccatcctgtcgctgaacggggcttataaacaatcccatttgttctgattgttaaatatttgtaaaattacaaatcatcaatgtatcaatcaaatggagactggaaatacgaattcaatcgggacatcattgcataagaatacacgctaacgctgttggttgtctgtcatgcctgtataagcctctgccagagagttgccccggggggccaccgcctgtttgcctgctgctgcccacagaaacccgctgcgcatcatctcggtcacttgaggcatatctatgatatctgcgtgatggcccagcgaattgtagaagacgcggccgttcccccagcgcttcgtccatacaacgggcatatccactggcccattggctgaatgggggcctggtacgatcggaaagcgtgtggttgccagcacttcaactgccgggtctacgtggaggtaatactgctcgcttttgacctgaaaatcctcaatatggtctagaagtgggctggagccgcgcttcatgttcaccatgtactctacgccgtcattgccgggatgcgcaacccattgcccgcctgtcataaactgccagtccacgttgttccggaaggcatcacacatgccgccatggcagcctgtgagacctacgccgctttgaaccgcagctgaaacattattgaccagttcctgctcaatctgtcccatggtccacattggaacgatcaggtccaagtcaagcagtttctcagcatcctggtaggcttccagggtattagacacttccacctcgaactgctcttccttcaaaatgcgttcaaaaatggtcgccacctgctctggctcatgtccgttccatccaccccatacaattagtgccttgcgcatctgtaatccactcacctttcggaatgtattgttatactacatttcttcaatggatacccagcggcgttcctctatggatcgttctaccgcttcaagcacagcctgacaagcaacaccgtcacggaagttcggcgacggttgccgtccttcagagatggcactcaacatctcaagcatctcatgggtgaaggtatgttcgaatccaatcgtatgtcctgcaggccaccaggcttcggagtacttgtgtgccggatcggtggcgagtacgcgacgaaagccctgaacgtcctcctcatcctgtgtgaaatacacttccagttcgttcattcgttcaaagtcaaaccgcacactgcctaggctaccgttgatctcgaatgaatttgtgctccgatgtccggcagcaaaacgtgtggcctcgaagctgcccagcgcacctccggcgaagcgtgccaggaacaacgtggcatcatcgactgtcacttctcccatcggagcatttgcttcagtactccttttggagctcaacccgctcatctccaaagccaacgggcgctgtttgatgaatgtctcgctcatgccgatcacttcatggaactcgccgaccaagaagcgagcgagatcaatcagatgggcgccaagatcaccatgagatccagaaccggccacttctttttgcagccgccataccagggggaaggacgggtccatgatccagtcttgaaggaagaaggcacggaaatgataaattttgcctaggcgtccgctctcgactagctgcttagccagctggacagccggagaaaaacggtagttgaagcctaccatatgtctgacccctgcttcctctgctacctgcagcatgtcacgtgaatccgccagcgagagcgcaagtggcttctcacagaatagatgcttgccatggagggctgcctcaacgacaatttccttatgggcattactcggggcgttaatgtcaatgaggtcaatatcgttacgtttcactagatcacgccaatccgtaacactttcggtccagccgtactggcgggcagctgcctgaaccccctgctcgttgcgtccacatataacggacatctctggctgcagcggggcatctgggaagaacataggtagactacggtaagcgttgctgtgagccttgcccataaatttgtagccaaccattccgatacgaagacgattagacatgtcgtgatcctccttatgggtctgagtttcaacgaatttttgacgaatggtgttatggacgaatggatgacgccctgataatcagctctgtggacaggagttctcttatcgagtcgcgcccggttagttccagggctggaataagattcagagaatcgggtataagcttcgaggctgcaagctcccccatctcataaaaaggtacgcggacactgcttagcggcggaacagccatctcagccgcatccgaatcgtcatagcctacaaacgccggaaactggtcagctgccagtccgcgctcacggagaccctgcattaccccgagggccatccggtcgttcgccgcaaatacagcatcaatatcattcaatttgtctgcgattgtagctgaggcttcgagcccgcttcgacggctgtaattaccttccagaagtagatcgtggtcatattcaataccggcctcctgaagcgcggtacggtaacccttcaatcgctcagtactgttggaatagatgtccgggccgttgagaaaggcaatccgcttgtatccctgctcgatgaggtgacttacagccgcccggctgccttctacatggtctgcatccacttcacagaacgattgcccttcaaaatggtgattcatgacgcagaacggacgtccttcttcctgaagtctctttagagcttcctcctcatcgtggtcatccctggctcctaggatgatacaggtatcgattctttgctggcggaaaagactactgtaatccatccgttcccctggctttcggaacaatagaagcagatcgagcccgctgtctctggccttgtttccgataccgctcagcatctcagagaaaaaataggctgagaacaggtgcgccttcgggacataaggcataactacaccaagatggccactcttacttcgggcaaagttacgagccagcgcactgggtacatatccaagctgattagctgcgtccagaacccttctccgcgtatcctctttgataggacctactgcattcaagacccgagataccgtcgcttcagacacgccggaaagttctgctacttccttgcgtgaaacgatattacccacctccaaatcattttatgtacgcgcgtacattttctcatgcagccatacctctgtcaatccccaaaaagcgtatccatggatggataagctcttttcgttactcaaaggaaagggtctcgattccttaaggcttgagcaagctaatcatccctactccaatcataagtactgtaattcccgcaagtatgcctatccattcctttggactcttcttttccttaaatattaaaatgctgccaacacaagcaatggcaatgctcgcctgagagatcggaaaactagccgccatgccgatcagcccgttggaaataaatagtgctagattcgcgatgctccaaaccaatcctgtaggtaaattgcgaaccaccagagagaatcgtagccgctttttgcccttcagattcatgaccatggctgagcatagcataccgagcgattgcggcagaatgacggatagtcccgatatatgaaagaactgattaataacgacataactacttaacgctaaccccgaacaaaccaacattatgataatgggtaccggcaaaggcttggacaacccagcagacttgccctgatagctggttaacagaacccctgccaatatacacagaagagaaccaacgcctatcccatattggtaccctgttatccattcacccaaaataagtgcggcaaatagcgtcgttcctatcaactgcagaccacaaatcacaggaatggcgatcgatacgcttactttttgaaaagcttgaaactgaagcaattgtccagcagcccagaaaataccagatataaaacttaccacaaaatgaatcggtgctaatgaggtagggtgaatgatatacaagcacagggcaaacagcacagcaccaatcacggtacctgtcagctgttctcggggactggcttttgttatatgtgccaatatcggcataactccccagccaacggctggaataaaagcaataatgaaatccacgcgcggaattctcctctcgtaaaaagtactcttcctacaattgttaaatatgccatgcaggaaaaaatctacagttttacgatagcaaaaaaaaccgcttctaaatacaaatatttttatagattaatatagcaaaatcaaagaaattgttttctatacgcactgggagatgtactcattacatttctaaaagctcgcgaaaaggtcaattgatcggtatagccgaccgaatttgatatgacctgaatcgaatagtctgtatgttgcagcagttcgcacgcttttttaatcctgaggtctatcagatattgtttaggcgtttcaccagtctcaagtttgaaaacggaggttagataattctgatgtagaccgaggtactccgctacttcactaatctggatgccgctgatgtagtttttctcaataaagtttatcgcttgaaccgaataaggaagctgctcctttaccgacatcgtttctcccaagtcgtgcacaagtttggcgagaatatggaataaatacccctgtatagccaacgatgaagaaagtgtgttatctccgatccgcaacatctcaagaatcgtggaatgaaagaacgtaatatcttcaatatcgattacataagggttctggcttggaagtgatatgttctgcaggtagatgtcggatttaatgcccataaagccgacccaacagtactcccaaggctcggcttcatccgcctggtaataagctaccctattggccggaattaaaaaagcctgtccttctcctatatcgtaatttttgttgtcaatcaccaacctacctcgtccttttagcacaaaatgaaccagattaaaatcgcgggcgatgggtccaaaatcctgattggataagcagagctctgtgccacaattatataaaatcaaatctgatatatttttatgctctgaactggtatacgtatcaacatattgaatcatattctcgcccattggcatcctccccactttcccaaataaagaacctatgcttgttaatttatcagtatagcataagttaaggatgacaaatatcaagaaaaggtttagctctaaactatagttttttgtaaggttctttgtttttcctatattcgacttaaaaaaagtcatgtattttctatcactacctttgttatgctgattcaataataacgttttcaagtggtttgacatattttgaaaggggctatgtgcatggctagtctacaagttaaccaaaaggaacggacatttcacttaacgaacaaatactgcagttatcttttccgtgtcatggagaacgggcaattggagcatttatattacggcaaaaaaatagagtacctgggtcaatatgaccgttttatcgagcgaagctaccgtcctgtgtctgtcggtgagtttgatagtgacttggtgacatcgttggaaagtattaagcaggaatttccttctgcgggaagtggagactttcgagagccggcaattgagatcatacaggaggacggatctcatataatggagttcacttatgatcgttacgaggtaatcgctgagaagcctaaaatcccccatcttccagctacgttttgtaaggaagcacatgaagcagagacactcctcatcacgctgaccgattctcttacaggagcggtggccgtgcttgcttacaccatcttcagcgaactgcccgtgatcacgagatccgtatccataacgaattccgggaataatcccctgagagtcaaccgtctaatgagcctgagccttgatctccctgactccgattatgaaattattcatttatcaggggcttggggtagggaacgtcatgtggagcgtacaccattgagacctgggctacagtcgattgggagcactcgaggaattagtagtcatgttcacaacccatttctggcgcttgccaaacccggatcacaggaacaccaaggagaagtatatgcggttaatctcgtttacagcgggaactttcttgcccaggcggaagtggacagctattcaactacccgattgatgatcggcatccatcctgacaaattctgctggaccctgaagccaggagaatgtttttattcgcctgaagcagttctggtctattctgagagcggtttaaatggcatgagccaagcataccatagcctgtataataaacacttaattcgcagcagttggaccgagcgggaacgacctgtattgatcaataactgggaggggacctattttgattttactgagcagaaaatagttgatatggcaaaaaaagcaggtgaactggggattgaactctttgtcttggatgacggatggttcggtcgaagaaacaatgatacctcttccctcggtgactggtttgaaaatcctgaaaagctaccgaacgggatctcgaatttggcaaagaagatcaatgcgctcgggatgaaattcggtctttggttcgagccggaaatggttaactccgactctcatattatgagggagcatccagactgggttgtgggaacacccggccgtcaacgcaagcatggacgccatcaatatgttcttgattattcccaaccgcctgttgtggattacctgtttaagttaatggatgacgtgctctcttctgctcggatcgaatacgtaaaatgggatatgaatcgatgtatttcagaagcctattcgttatctctgggcaaagaaagacagggcgaattttttcaccgctatgtcttgggtgtatatgctttatatgagaagctgattaccgaacaccctgagattttgtttgagtcctgtgcttccggtggaggacggtttgatccagggatgctttattatgctccgcaaacatggacaagcgacgatagtgaggctatagaacgtctgaagattcagtatggcacttccatggcctatccgcttagcagcatgggtgctcatgtgtcaaccatcccgaaccaccaggtaggcagaaccgcaccgctgcaaaccagatccaatgtcgcctactttggtatattcggttatgaacttgacccattggctttgtccgaagaagagtgcaatgtaattaaaaaacaaatacaagtgtataaacgtcaccgacgattaattacacagggaaccttttaccgtctgctaagtccctttgaacaaaatgagactgcctggatggtcattgatgcagaatgtgagcatgctctcgtcggttggtaccaggtgctctcgcgtccgaatcaagcttatttacgactaaagctagtcgggctgaacgaaatggcagtatattttgtggaagagctgggccaacgttttaccggcagcgagttaatgaacattggacttatactcaccccgcctcataaggcgggacaggattttaatattgcggagaaatacgatttctcatctcaattatttactttaacaaaagagatctcctcatgattggatgatgacttgaagaattagatcaaagacccgttcttttctccagttcctccgtatatctggcgcccattaaagtgatctgcgaggctgcgctgttaatattgcgcacatcttcggatgtgagttcaatgtctactgcgcctagattttcttccagacggcttaatttccgtgtgcccgggattggaacgatccacggcttctgggctaaatgaatgataaatgttcattatttttatttagttaattggcttacaatcctatcaagagagctattatacatttgtttaaaacttcatgctcttcaaactctattaatgtgataagcctttgaaccaataagttcctaaaccaacgattcaaataattcatctcctcccccttgcttgattctaggattgtagttttattatgacgaacagaggaagcgaagcggtatctcaattgtcttaattgtttgcctaatcctatcaccaccacttttgttacagctagataagtcttataatggagccagacaaaccagtaaggaggatttgaatgtcggaggacatgcttgaacaacaaaaggagctcaccagattgatcgagcgtcactcgttacagaatagcacgggggaaacagcgatcccttccctatttttctatcagcgttccagcaaaaccgaacccgtttaccgggtttacaagccttcattttgttttgttgttcaaggtttgaaagaaattttactggcacaagagaattttgaatacggaccttctgattatctgatcgcttctatgaatctgccagtgatcggtcaaatcataaaagcttctccagaatcaccctacctgagtcttaagctcgaatttacccagaaccagattcttgaggtactgaacgattctaaaatccaggtaacactaaaagaaaacgccaaacgtgccctattcgtcggccggatggaatcgtccattcaggacgctgttcttaggcttgcccgtctgctggacaccccgggagaaattccgtttctcgctcctctttacacgaaggagattttatataggctgttgcagggaccttatggagtcgaattggctcagattgcagtcgaaggaagcagcacctatcgaatccgagaagctattgactatatcgtccggaattgggaccagtcttttcggatcgaagatcttgcagacaccgccagcatgagtgtttcttcgttccatcggcattttaaagaggtaaccgccatgagtccaattcagttccaaaaacagctgagactccaggaagcccgccgtctcttattagctgaatcgacggacgccgcagacgtcgctttcagggtcggatacgagagttcctcccaattcagccgcgaatactcccgaatgtttggggctcctccaagagcggacattaagcgattgaaagaaaaatacgatcaggtcatgaatgactgagtatctggaccgatcggtgaagaagaaaaaaggacggccttgggctcaatgtcattaagataag

SEQ ID NO: 2664 - DNA, 573 bp, Unknown
  Kingdom: Bacteria, Phylum: Firmicutes, Class: Bacilli, Order: Bacillales, Family: Paenibacillaceae, Genus: Paenibacillus
tctggatgcaggagatgaggagcacaagtatgtaacgattgagaaggccgctaaagagtatccagttagcgaactctgtaagctgtttaaggtctctagaagtggatattacgccttcttaaaacggagaggaactgatcgggatcaggacgcgaaagctcttgtgaagaaagtgtatgagcagtataacggagtctacggctatcgccaaattcaactatttttgcagcacgatcatggagtctggatgaaccataaaaaggtactccggctcatgcaggtcttggggatccgctcacaaattcgccggaagcatcgctgtaattatgcttcttctacagaaggtcgtgtggcgaaaaatctgctaaaacaggatttcaaggcggccaaacctaaccaaaaatgggtcacagatatcacgcaatatcgtgtgggtgattgctggctatatctgtctgcgattaaagacttgttcaataacgaaattatcgcgtaccagatgagccatagaaatgataacgaactggttttacagacgtttcgacaagcctttaaacagcaaaaagacgtgac

SEQ ID NO: 2665 - DNA, 11087 bp, Unknown
  Kingdom: Bacteria, Phylum: Firmicutes, Class: Bacilli, Order: Bacillales, Family: Paenibacillaceae, Genus: Paenibacillus
tctaaggggtgcacttcaatccggcctttgttatttttattaatgatggcggtgtgaagcgtggaaaaggagataatatcgacaacgcagtcattgattcgtcaggagagccgattttctggcaatttatcggtgtgggtgaatccgattttggcgtattaaagaagctggacaatatagagggccgtgtggtagataacgctaacttcttccaaattcaagatatcgaatctatggaagacaatgaattgtacgaactattgcttaacgagttcccatcatggttacaggaagcgaaggaaaagcagatttattaaggctactaagtgttgtactatgagcccttctcaaagcttaatatataaaaaatgcaaaaagagagagttccgctagcaaacgctttgcgaaactctctcttttctttacacacctctaaaacgtatagaagctctacggcggttgccagcggagcgggcagaattgttctgaagaagcgaagcgatcggaagaacaatctgcacgcgcagcgcccaccaaccgtaagaaagctttcatacgccctaactaacttatccccattaatatcatcgagcaaaggataagccccgccccgcaccccgaagtatataccttgaggtggcggaacatggatgttttccaggctgacagagattcatcggaacgcaaacgttcattttcctcccgtaatgccttggattgacgaatgaacaactgtctgatgtcggcaaatccccgcaggaagagggttagaaaaccgctttgcagaacgtggaagattgcaccgatcaccaagcccagcaaccccaacaggaatagcagatttgcagtagccatgttttcacgaccatacaagagatgggggatggcgtacagaaatcctaaagtaccgacaatcagggcagtgagcccgaaacgtaaaatcattatttttcgacccgtttcgcaaagcgcaggtctgggttcgaacgagcatcaaatacgataccttgaatcttaggactgattaatgcagtgtccgcagagaactggatcggaataatcggcagatcttccatcaatacgtcttctgcctgatggagctgttcaaagcgttttgccggatcaagctcaaaggttgaggattcgatcagtttgtcatactccgggttgctccagttggtaaagttgttcgaatttttggaagtataatgccccaatacgccaagtggatccaggaagtttccttcccagcccatacgggcgatctggaagttcttttgtttaaaggtatcaatgtacgttttccattcctgattctccagcgtcactgcaacgcccaggttcgttttcagcatttcctgaatcgcttcagctacttttttatgcttgtccgaagtgttgtatttaaaggtgatcggtggcagctgggtcaaaccttcttctttcagaccttcggccagcaattgtttcgctttcgcagcgtcaaactcatagtattttttcggtgcttcatcacggaagtccttgccggatggcgttgttgttccgtagggaacataaccgtaagccggagtttcgccacctttggttacgctggtagccagtgcttcgcggtcaatcgcgtaggcaatagcctgtctgatttttttattgtcaaacggcttttgttttacgttaaaagaataggtatacacactgaaagatggatgcgacaggaattccttgttgctcttttcctgatccagggtatctacgggaaggctcaaaatcagatccagatcgcccgttttgtacatttgataataagttgtggagtcttgaaccattttaaaattaatcgttgccattgtaatggcatctttgttccagaattgatcatttttcgccagcgtaatctgctcgttatgtttccattccttggctacatatgcaccgttgccgaccattgtgcccgcttctgctgcccatttgtcatttttctcaacaaccgattggtttactggcagataggcatgacccactgcgatcgttgggaagaagctcagcggtgatttcagctcaactaccagagttttatcatctttggctgtaacacccacgtcttcaattttacctttgcctgtgttgtaagcttcggcacctttgatgtagtagagggcagaaggatcgtaggcagctgttttcggattcagtacccgtttccaggagtattcaaaatccttagctgtcagtgggtcaccattcgaccattttacgccgtcacggatcgtaaaggtgtaggttttaccgtcaggagatacgtctactttgctggcagcgccttctacgattttaccggccttatcgtatgtatatagcccttcgtacaagttatcaatcacaaagtaggacgttgtatctgatgcgaaagcagggtctagcgtataaggctcgccacctgccaggttggcagtaatttcttgcgggatatctgcttgaggcgcggcggacgggtcgttgcttgctgttttgtccgtattaccagagcatccagccaaagccgttacggccaaaagtaagatgatcgtcatccaatgcatttttttcattgtggttttcctccattactgtgattagttatgccaaaaataaggtacaccgtaccgggggttattcatcctcctttcccgcaggtatgccgcgtgtgcgcacttcgataaaggaattgccgtttttcctgcggttaggcaagaagctgcggatcatggtgacacccctccttgtccaatttcgatctctacattgttaatgttgtgagcgcgggtcaagtgcatcctgaagcccgtctccaagtgtattgaacgccagcatggtgagcgatatcatcagcccggggaaaaataggcgccaccattgaccgcttaaaataacgccaagtgaatcgttagccatcgtcccccagctggccgaaggagactgaatccccagaccgagaaagctcaggaatgattcggcaaaaatagccgacggaatagtgaacgtcaaattcacgataatgattgccgctgcgtttggtagcaaatgtctgaagataatacgtgaatgagatgttcccaagctacgggctgctaacacatattcttgctgcttcagctgtaagatttgcccacgcactacacgggccataccgacccagccagtaatggataatgcaataatcatcgtgagcagtcccggcttcataatgacaagcagcagaatgatgaccagcagataaggaatactgtacagaatttcaataatacgcattaggacattgtcgattcggtcgcccgttttgccgtgcccagcacaatagccagcaacacagccgacgagaatgccaagcaccaaatcaatggcggcagcggcaaagccgatcatgagtgaaattctagctccggcccatgtccgtgcccatacgtccctccccagatcatccgtgccaaaccaatgctctttcgaaggagagagattcgttttcaaaagggattgatcactgggtgcatagggaaccatggaaggcccgacaatcgccagcacaataatcatgattagtagggaaagccccaacagagcaagcttgttgttaaaaagtctgcgtagccgatctcgccagggtgattctttgggtctggtcaacgtgggggtggggatctgggtacgatctacaagactgaacaggctgtccttttcgacagtaggtgctgctttcatgttaatctcctttgctgactaatttgattcgtggatcgacaaggcgataggaaatatcaattaaaaataaagtgacgaccagaatggcactgtagaaaatggtcgtccccataatcactggataatcacggttaaagatactatctacgaagtatttaccgatgccgggaatggcgaatattttttcaacgacaaaggtacctgtaatgacggaagcgaatagcggtccgataaaggaaagcaccggaatcaacgcattgcgtagtccgtgacgaaggactactgcccaagaggacaacccttttgctttggcggtgcgtatgtactcctcatgtatgacctccagcatactcgttcgcataaagcgggcgataacggcaagcggtgaaacagcgagagccagcgacgggagcaccgtatgctgccaggttccccatgaggcgaccggaagcagatgccattggacggcaacatacttgattaacagcggtgccaatatgaagctgggtacggaaataccaacaatcgcgataaacatcgagatataatccagtggtcgattatggtgtagagcagccagcgttccgagcgaaataccggcaataattgcgaccacgatggattgaatgcccagcaatgcagaaggtggaaaacctcgggcaatgagcatattgacgtccgtcgttttcgattgaatagacgggcccatgtccagcactagcagatttttgagatacaacacatactgcacagcgagcggcttgtccagattgtatctggcacgcatgttttgcaataccgcttccggaatggttttggaatcgttcgagaacggatcacccggaatgatatgcatgatgataaacgttaaagtgacgataatccacaacgtaatgaacatcgtaaagagacgttttaaaatgtacatggggctttatttctcctgtctatcaagctgatttacatactattgctgttcaaattttaaaataaataaaagtatataagaatactaggaaatgataagacggtttaggtgacatgtcaaggtaaggttttacattatagaacacaggtcaaattttcgtcacaggttttccatttatataaggctaagattccgcttattcctctcgacgagtatcctgcggtatgttatgatgatactctgataacgtgttaacgaactaaagcgtttgccacctgttcttggatacgggggtcaccattgttggaggggaataagatgagaaaagcagccatgtttacgatgttaattggattgatgatgatcgtgttggccggatgttccggcggtaaggatgacagtaaattgattattggaattgatgataaattcgccccgatgggctttagagatgaaaataacgagctgaccggctttgatattgattatgcgaaagcggccggggaacaaatgggtaaacaggtggaatttcagccgattgactggtctgccaaagaatccgagctgaacagcggacgtattgatctcatttggaatggatacaccattacggatgagcgtaaggaaaaagtgctgttcacaaagccatatctgaaaaacagtcaggtgattgtcattccggctacttccagtctatccaagctggctgatctgacgggcaaaacggtgggactccagacgctgtcttcagcagccgatgcattggatgcaaatccgatcaaaagtaaattgaagcaagtgtccgagttcccggataatgttctggctttgacggacttgaaaaccgggcgtctggatgcggttgtcattgatgaagtcgttgccaagtattatatgtcgaaggaacaagggacgtataagctgcttgatgaatcattggcccctgaggaatacggcatcggcgtgaaaaaaggaaatgaagagctgttgacgcagctgcaatctgctttggatgagctgcacaagaacggaaaagctgctgaaatttcgaaaaagtggtttggtgaagataaagtattaaattaatatgtagtgtattgaactaagggtttaggagtcgaaggtcatgagtatggaatatattttacgaattatgaagcctatgcttgaaggggcacagatgacggttattttatttttcatcacgctcatcttgtctattccattgggttttatcgttacgttgctggccaaaagccggattaagccaatcgcctggctgatgcatacgtacatttatgttatacgcggtacgccgctattgctgcaattattgttcttttgttttggtctgccgatgttgcctgtcattggggagtatctggtattggaccggacaacggctgcggtactggcatttgtactgaattatgcggcttattttgcagaaatttttagaggcgggatgttgtcgattgataaagggcaatacgaggcttcgcaagtgctgggcttgagcaagtcgcagacgctgattagagtcattgtgccgcaaatggtacggattgctttgcctgcggtgaccaatgaagcgacaacactggtaaaagatacggcactactgtatgcagtagcggtaccggaactgctgcattttgccaatacggctgtaaaccgtgatttctcgattgtaccttacgttgtagcggcggttatttatttgttgttagctttggtgctgacgctattcttcagggcgctggaaaaacgttttaaattcgagtaaaaggaatgtcgggatatgaatactaatgcaatagaagtaaccgatttgaaaaaatcgttcggcaagctcgacgttctgaaaagagtgagctttaacgttaaagcgggcgaggttgtagccgtcatcggtccttcaggttcaggaaaaagtaccatgctccgtagtttggtacacctggaagatgtgacgggcgggacgatccgcattcatgataaagcactggtggaaaacggtcagtacgctccggcaggtgacattaagggcattaccaccggtatgggcatggtgttccagcattttaatctgttccctcacttgacggtgcaggataatctggagctggctccgaagctggtgaagaaggtgagcaaggctgagctacgtcgccaaagcgctgagttgctggctaaagtcggtttggcagataaagcagatgcgtatccatcccgactgtcgggagggcagaagcagcgcgtggcgattgcccgggcaatgatgatgaaccctgatattttactgtttgatgagccgacctcggcccttgatcccgaactgacgggtgaggtgctgcgagttatcaaaaagctggctgaggaacatatgacgatggtcatcgtgacccacgagatgaactttgcgagagatgtggcggatcgtgtcatttttatggataatggcgaaattgcagaatccggtacaccagagcagatttttggcaatcctcagctggagcggacgaaggtgtttttgaatcgggtgggggattaaaaatatagttgcttgttagagtgtgtgtccgtgagcaatatgtttttaagcaggaagtatgagggaagaataaaagcaagggagatggcaaacgccatctcctttttgtagttatagagtatgcgaactgtgtagccacatttgggcaatatgtagattgaggttcgtatacagatttattatttttaatctttacatacctaccgaaggtatgtagaatgaaagatacctaccgaaggtaggttttgaatgatgagaggatgagtcgatcatgaataaatctcgcaacgaaatcatctttacgctaatcattaatatcgtattgccttatttggcttatcgcctgctaattccgcatacgagcagtgtggtggctctgtctatcgctgctcttgtaccactatgcgactcgctctacaatcttataaggacgcgcaaagcagatgtgttctctggctttatctttcttggtctgattcttggcgtcgtggccgttctcttgggcggcgatgaacgcttcattttgctgcgtgagtcttatgtaactggtattatgggaatggtgtttctaggctcgctgttttttggccgaccattgatttattattttgccgagagatttacaggccatgatcctcagatgaacgataaatgggagaaacttccgcgctatcggtttaactttcgcctgataacggcggtgtggggttttagcctgctgttggaagccttcatcaaagtagtgctggtatattcgctgtccataccgacttttctggtcgtatcgccgttcttcacctacgggcttattggattgacgatttggtggaatatgagcttcattagacgaataaaaagacagacaaacgggaggtaaaagatcatgcaagacaaagcgatgaacgatagtcttaaaaggctgcttgagattgccgaagggatgattatagagaaaggatgccgggcgacgacgctacaggatatcgcggatcgcagcggactgactaaaggagccatttaccattatgtcaaaagcaaagatgaattgttcggtatgattctggaggcgggaatggagaaaaccaatcagcgcttttttgaatctgtcgcccggactcccgcaggaccagaaggaatcaagtctccgcttaacaccttaactgatcggcttcgtaacatcagtagtggggacagcgctgctagcctgatttttatttatctactcagccaacaggataagcccgccgtggctggcattctgaaacgttatcatgaagcatctatcctcactgccaaaatgtggatcgaagtcggacagcagaatggagctatccctgtttcaatcgatgcggacaggacagctcggatgttcaccgtgttcaagaacggattgcaagttcagcataacatagtgaccgctggcgataaaatcaacgaactggaaatttatgagttcttgatgaatgcgctgggcgcaggaagaggctaggcagcccctcacgttcgttttgttatccccggatttcacctttgaatttatatttactgaggaaaaatctagggatatcagcgatcggaagaacaatctgcatgcgtagcgggctcaccaccataactcctccattatctatctattaggatcaacaatttctttgtcctcgctaaatacttcaatcatcgttaatgcccccgcccgatacccgtgaatgaatgctgctgcggagtgcagggaagttgactcgcttaataaatcaaacatgacttcaattgactcaaactcgactgcgggtaatttgcttttcaacatctccatgagatcactaattttttgattcactttttgagattcagggtcggttgaatttatctgttcactaggacgccatttcccataatacatatcctctaaaatcattttcatcatgcctccctatgaatactgattatttatataagttgagctaaagatgtacatacggcgccactacgcggtcggatggtgcttcccatcgctgttgtgcccggatttcttaatcaagctaagaaggttgaaatccggccacaaaggcgaacgctatcgcttgtacagcaccattccgcccactccgttcttattccacttgttatactctttaaataaatttatgcgtttttagcataaaaatcaatatgcagttttcgcatggagtaaactttgcttgggtgatgagcaatgtataagagaattcgcgatttacgtgaggacaaagacttaacacaacagaccatggctgaattattacatatctcacaaacgacctactctcgatatgaaaatgggaccttggacgttcccagtgttgtcttaatcaaattggcagatttccacaaggtaagtatcgactttattcttgatcagacagatgatcctgaacgttgtacaggtaaaaagaatagcatgcaaaataaagcgctatgatgaccgcaggagctatatttcaatattctgttatatgcttcgtcgggaaatatacactttaataaaacgaatttaggagaatccgtctgtccccattgagagcttttgcatatgaagggacaactcaagatttcaaggtaaagtcgaagataaataaattttatgcgaaaaacgcataaaaatcaatatgcagttttcgcatggagtaaactttgcttgggtgatgagcagtgtataagagaattcgcaatttacgtgaggacaaagacttaacacaacagagcatggccgactttttaggtatctcacaaacaacctattcccgatatgaaaatgggaatctggacgtcccaagtgtggtcttaatcaaattggcagatttccacaaggtgagtatagactttattcttgatcagacagataatcctaaacgttacaggtaaaaaggcataacatgcaaacaaaaaagctcccgtgatgatttgaagtgcaccccttagaatagacattggaataaacccctggtttatccgatgaatttctagggggtgcattttttatgccagcgaaaaaaggacagaagtttaaagaatatacgtttgaaaccaaagtagaggccatacggcttcatatcgaagaaggttggacatatcgtaaactcatggagaagttcgggattgcagatcgacatcggttgaaagaatggatgcggaagtacaaggaactcggtgaattcggacttatggaccaacgaggacggcgtaaggagtatatcgaccaggataggtatgtacagaagctgagacgggaaaatgacatgctaaaaaagtgtttggaaatctggatacaggagatgaagcacacaaatatataaccattgagaaagctgcgaaagactatcctattagcaaactgtgtacgcttttcaaagtctccagaagtggatattacgccttcttaaaacggagagaaacagatcgagatcgggacgcgaaagcacttgtgaagaaagtgtatgagcagtataacggagtctacggctatcgccaaattcaactatttttgcagcacgatcatggagtcaggatgaaccataaaaaggtactccggctcatgcaggtcttggggatccgctcacaaattcgtcggaagcatcgctacaattatgcttcttctacggaaggtcgtgtggcgaaaaatctgctaaaacaggatttcaaggcggacaaaccaaatcaaaaatgggtcacagatatcacgcaatatcgtgtgggtgattgctggctatatctgtctgcgattaaagacttgttcaataacgaaattatcgcgtaccagatgagccatagaaatgataacgaactggttttacagacgtttcgacaagcctggaaacagcaaaaagacgtgac

SEQ ID NO: 2666 - DNA, 37228 bp, Unknown
  Kingdom: Bacteria, Phylum: Firmicutes, Class: Bacilli, Order: Bacillales, Family: Paenibacillaceae, Genus: Paenibacillus
gacattatccgacaaatttcaactttttcagcaatattctttaattacctatatcatggaatttatttgcattaagctggaatgattcaaaattaataactcttcactttttaaatagatagtgacttttaatagatcttttgaactaatttacatgcggaattttctttaatttttcttgtgaaattttagttcagcttaaatttcctctaatttaagctataaattttattttttaattaatagaaacgttttgattcccctttaaaaatataaatttttaaaaaaatcataactttagaactattttttttcgcaaaatttaatgaacggaaaatacaaaatagcaagtctccatgttgcaagagacttgcttttttaaagttttggcgacttgacccttaagaatgaagtgaatactcccacagcgaacgtaccggaaatatttgttgtgggatatatactgtgtacgaatcgaatcgtttttgttgccgagcgcatcacaaccgagtgagcttctgccctgtgaccagacaggaaacgaatcctttgaaaccactcatcagaaatccagacaaaccctctacatcacgtcttttaaatgacaagggcttgccgcagctgttcacattaaccgattcaaaatggtgtgcgtcaggcaggaaaatgattcgaaatgcttcactcgttgggaagctccagttttttacgcaaaacaatctcattactgtcttcctcgctaaacatcccatacaaacgagcgctgacagcccatcctgacaatccaaactgttccgaactggagatctccattaatgcgccatccaaagcaataattaaatcaccgctttttaccgtcaatggttgttcgcctaatttaccagcttgcactgcttccgtaatgagaaacagcgaaacatctctaacctagcatcgttccccttttagttgatccaactgttaagtctcttagcatccagccaatggaatatgtattttgtggtatggattattcttcccagtatattgacataattaacaaaaatgctgacatctatgtaactcgatgtcagcaggcagaaatcagcactgtcaatttgctgtaaagatatactacgaagtcaacaaccttcagcagaataagaatagtgaatagttcttcacccattcaccacatctgcttgcaaatctgttgcaatttcaatcatcttaggcacgacagcctcatcggaaatagccacatacacatcacccatgtaatgacgaaaaggtatttctacatcagcatacttccacatgaaaaagtctccctcgatcgacatggtactctcagcaccttgtatgattagcactcgtgaatacgaaaagtctggctgggatgcaaagtaatctttgcactcctccagggaaatggatggctccacaggactttcctgtatggaacgggtgattcgaaaacgctggttcattgatctgcctccacaattatgattaaaaaattctggctttcataccttataatgtccacatgctgctgtcaatttcgttagaattatatggatatttaatgtgctttcaagcatttagttttaagatgcatgttcaaactgactattgtatagatcggcatagaagccgcctttagccaacaattcctcatggttacccatttcgataatgtcaccgtccttcatgaccagaatcagatccgcattcttgatcgtcgaaagtcggtgagcaatcacaaaggaggttttccccacagtcagctggtccatcgcttgttgaatcagcaattccgtacgcgtatcgaccgagcttgtggcctcatccagaatgagcatgggtgaatcttcaatcatcgctcttgcaatggtaatcaattgcttttgaccggcagagagattggctttgtcatccagcactgtatcatagccctgcggcagtgttttaatgaagctgtgcagacccaccgctctacatgcagcttccacctgctcatcggtaacatgatctttggaaaagacgatattgtcacgaatcgttccttcgaacagccaggtatcctgaagcaccatacagaataattcatgaatattctcgcgcgttaattggctaatcggggtgccgtcaatgtagatttctccatcgttcagctcataaaaccgcatgagcaaattcacgagcgtggtcttaccagcgcctgtcggaccgacaatggcaattttctgaccagcttcagctttcatggagaagtccttgatgatcatacgatctgcattatagccgaaacggacatgtttgaattcgacatcccctttggcagtgtccagctttatggtcttgtgacgctcatctgccaattcttcttcacccagaaattcgaatacacgttcactggcggcagccgccgactgcagattggttgcggcctgtgccagctgcgacaagggctgtgtaaacagacgaatatacaccatgaaggcgacaatagttccaatagttatagtctgttggttgaccagcaaagctcccacgacacagaccgcgacataaccaaaatttccaatgaacatcatgactggcatcatcagaccagacatgaattgggacttccatgcatttgtatataagcggctgttaatgccatgaaacacttccttggctgcttgttccccgttatataccttgactacgttatgaccagcataagtttcttcgatatgaccgttgatctggccaagctccgcttgctgtgcaacaaagtatttctgtgaatgcttcataatcacgctcatcaggcaaaagccgatcagcgtagctataattccggtaacggtcatgatccagttcgtatacagcatcataatcaaggcgcccacaaaggtagccagcgcactgacaagcgtgccgagactgttgtttaacgtttgtccaatggtgtcgacatcgttggttacacggctaagcacattaccgtagctcgtagagtcaaaatacttcaaaggcatatgatcgatttttcgagacagttctgtccgcatcttctttgtaagacgctgtgagacggttgctgtaatgaagccctggaaatagttaaagataagaccaaatccatataaaagcgccaatacaagaacaatcttctgaacagcacttacatcaatcccggtcacgattccttcctgaatcaggttggcaatatcgctgagcttatcggggccaatcacgttgagggtggagccgaccagggccagtaccatagctagtataatcataggcacataggccttgctgtaggatacaagctgactgatggtctttttaaaattattcgctttttcaccagtacccttgccccccgcgggtcctttacccatgggacctcgctgattcattttcatttgctggctgtcgacggtgtgttcattcttatccatgtatgagttcctccttcgaaagctgcgaatatgcgatctcctgataggtgctgcagttcgtcatcagctcttcatgcgtgccgctccctacaatctctccctggtccagcacgataatccgatcagcgtctttgatagtacctatgcgctgaccaacgataagtgtcgtagcgtggccggtttcttttttgagagcggagcgcagaattcggtctgttctgtagtctaatgccgagaaggaatcatcgaaaatataaatttccggctgacggtagatggcacgcgcaatggacagtcgctgcttttgaccaccggacacgttcgctccaccttgcgaaattctaccctgatattgaccatccatcttttcgacaaactccgttccttgagcaataccaacggcttctttaacgagtttctccgaagctcctgctcttccgttatcgccatacgaaacgttggatacaaccgtaccgttgaacaatacagctctctgggggacatacccgattttgttatggagtgcctgctgattatagttcctgacattcacaccatccacgagtacctctccctcggtcacatcatagaaacggggaatcagattgatcacgctggtttttccgctgcctgtagcgccaataaaggcaaccgtctcgcctcgtttcgccgtaaagctaatgttgcgaagcacggcctcctccgcgtctggatatttgaagctgacattacggaattccacttgccccataacgctctcttctcctgtcgtctcatgcccgttaacgatgctggattcggtattcaaaacctccatgatccgtttggcagagatcgaggcgcgaggcatcagaatgaatatcatacttaccatcataaaggccataaccacctgcattgcataagaggagaatacgaccatattggagaacaacgtgatgcggtctggtacggccgccccgttaatcaggtaagcgccgatacaatagatagagacactcagacctgacataataaaggtcatacctgggccaatcatcgtcattaatcggttcgcgaacaggtttgtattcgtcaactcaacgttagcctgctcgaacttctcctgctgatactgatctgcattataagcgcgtactacccgaagtccgatcagatgctcacgtgttaccctgttcagattatcggtgagacgctggattctctgaaaacttggaagagcgaaaacaacaatgacacttagcattaaaatcagaacagccacggccgctcctgtggaggcggtccactgccagtttttatccgcaatcttcacaatagcccatacggccagaataggtgccttgatgatcacctgcagccccagcgcaaccaccgtttgaatctgcgtaacatcgttcgtggagcgggtaatgaggcttgccgtcgaaaagctgttcatctcttccatcgaaaaggataaggtcttgtcaaagaccatcgcacgcagacgcatagccagcccagcagccacctttgccgcgaaatagcccacaataatagatgcaatcatactgccgacggcacaaaacaacatgtaactgccgggaatcagcagttcggacacaggcgttccttccgtttgcagcttggtcgtaatttccgccatataatcaggcagcttcagatcaagccatacctgcacaacgatgaaagctaggctgcaaagtacgagcatccattcatttttcttgagatatttgaatatctttagcattctgttgctctccttttatctgatagtctttgatgtttggtgaagtatggtgcgtcctgcatctgcatagaaattcagcttctagagacaataagcttaatgagtcgaatcagttctttagcatcctcttcgtctaactttcgaagaacattctcggtccatgcaattccttcattatgcttatcaatcataaattgcttacctgaatccgtaatgaatacaatcaccttacgtttgtcgttgacatcagtacgccgtacaactagtcctttcttctccagactcttcagtgccgttgctacccgtcccgtactgacggacaagtattcgctcaagtggccagaggtaaccccgtccttattgaaattcagacaaatgagaatccccatttcgccacgtgagaagtgccctcgttcctctaatgccggtttccgcgatttgacgatatactcgaatagttctgtcgctaatgctttataatccattggtcacaacaccttctcgctaataccttatagtatgagataattaatcttatagtataagataataataatgtcgagtcacaaagtcaattagagaaaatatggaatacaaaaaaatcctccgtaactagcttgtatctttaccaatttttctacacaaagtccaatataaagacatcagagctaaaactgaatctcttcttatgtatcttcctctgaacatcttcattattgtttgtaaggtcaagttctacatgccgtactttgatgaatcgtctggtcatcgattccgcccacagattcaaagcatattcggcaatcttacgtatttctcccgccacaatcggcaaccttcttccatgctcctgcccaggcagccagcaaattggtttgagcaacaatattctggatgctctctgtgatcgcagagctcattaattagaccttttgtagagtaccttgatagagtactttacagaaggtctaaaggacgtactttttttgcttaatcgattcgaatcgttttactgacccaagcaggctcaatcagtaatgtatacagtcaatcttaaaaccctgtagtatactgtgtagggattgcagtttcttttttcaattttgatgctgcttccagtgaccaataaggatttctcaacatccctctacccacagcaaccagatcggcctcttcattaccgataactgcattcgccaaaattggatcttccagtcttccaacggccatcaccggaatatccagagcttctttgatatcttttgccaaggggacttgatacgctgcgtgagttcctggtctgccccatgcagctataggtccctcaccgccagatgaaatatcaaacatatctactcctgccttttgatattccttggcaaaagcaatgctttccttaataccatatccaccttctacatattctttggcagaaatacgcatcaacagtggcatatcttccggcatttcgcccttcgctgcctgaatgatctcccgaccaaaaagggtaagatctttaccatattcatcttcccgtttgttcgtaagcggcgaatgaaattgatgaatcaaatagccatgtgcaccatgaatttcaatgctgtcgaatccagccttaacagcgcgagctacagcagcacgaaatttctcaacgagtcctttaacctcttcggttgcaagcgcgcgaggttgttttgaattttcatcaaatgcaatagcagatggtgctacagggacttcagcatcttccgccttgcgtccggcatgcgcgatctggattcccactttgacaccgtagctgtgacaagcatctacaatccgtttgagagcaggaatctgctcatctgaccataaaccaagatcaaaatcggagatacgaccatctggctctacatctgtcatttcaattatgataaaaccagctccgcctaccgcccggctaacgtagtgtatataatgccaatctgtggcgaccccatcctttttgtcaaccgaatattggcacattggaggcataactacgcgatttttcaattccaaacctttaattgtatagggactaaataaatctttcatgtgagaaagactcctctctgatttatattatgaaatgcatcaataaaatgcatgcacaagcatatacattaacatgtttgtttcatttgtcaactctaggcatgatttcaaaacttcaaagtaattggtgcaaataattctttattgtttggattcacacttgatcattcatcttcagattttttgcaatgcttcgacaactgaatcgtcaccagtaatcagatcaaatgctcgcttgtatgtgttctcctcatctaaagctgccacaatggcacgggctacatcctcacgtgggatactgccataggtgatattctccgcggcagccacttttcccgtaccgatttcatttaaaagaatccccagtcttatgattgtgtagttcaaactgctgctttccagctatgagtaatggctatacttgagacaaaagttattcttacattcctaaaatttctagttataagtgatactttcttgctttaactgagaatttttacgtttttttggattataactgagacttatcctccaacaataacataatcacaccctaatatgatcactcgtcattctataactgtgaagagaaatgagaaccagtagattccttttagctactggttctacctgaaccgcaacagcgacacaacatccgtttgagtaaactgtaggcaatctgcccggctaaaaaagtctaagacatataccaaaaaaagtatagctaaattcgtctcatgtattaccgtaactcatacctgcgtcaatatgccggaagtgtattcaataagatatccttagctccttggcttttgtcttgcgtggctctttagccgcaaatactcttgctcactttgatatcgcgatccccttggtttttgtacactgcggctttaacgcagccccgttgtttctttgcactccacctaggcgacattctttagcttggcgtattgttgcaggtgtaaggcttttgccgaagcccaaccgccgatgacaaattgacatcggacaatttgtccgatataatcaaaacaaatcggacaaactgtccgaatttataatatgaagggtgaaactgggatgaatatcaaaaagttgtattttttacctgtaggtgaatgtttcctagatcaatcggcagttaatcgaacccttgcccccgggaaattagtcggaatgcctgtgtggtcttttctattggaaacgaccagcgggccgatactcatcgatacgggaatgcccgacgcttttatcaacaatcccgattactacaaggggactagacgtgaagggcgcgtcgtccccaacatgtctgacggcgactcgatcgtaaatgtgttaaagcgtgtaggttatcgacctgacgatattcaaatggtcattagctcccatttacacttggatcattctgggggaaacgggcatttccgcaatacgccgatccttattcaaagggcagagtatgatgcggccataaacaatgaggattactctccattagagtgcaggctgcctgatttacaatatcaaatcattgagggtgaccatgaattgattccgggggttcaaattttattcactccgggtcattcccctggccatcaatcagtccttgtcacaacggaaaagtcgggtccagtgctactgacaattgatgttgcttatactcgggagaacttcgagaatagcgtaccgttcttgacattcgatcaagagatggctgccaaatcgattactcgcatgcaggagttaattcaggatgttcggccgtcctatgttttcttgggacacgatagagatcaggcgcaaaaatgccgcacctttcctgacttcctgtaatggagggacaggccatggatactcaatcaatggctttatccggcaatgagcggaaattaatggggacactttgcttgctcattattttcggaaacatcaatatgaccatgtttaatttgtctataccttcgatttccgctgactttgccctgacctcctcgcaggtgagctgggttatggttggctacagcattttgatggctatcggcgccggtacttacggcaagttaacggagtccttttcctttcgccagctgtatgtcattggtttaatccttttagctttcggctctatgatcggcttttttgcagcttcatacttgcaagtcatcattggaagactgctgcaggcagcaggggcctcatccatctctcccctgtcttatgcggcagtaaccctgtattttaagcctacagtcaagggacgggtgctgggaaccttatccgccacaattgcctttgcttccggcttcgggcctgtgttcggcggtttcgtggagcaatactttggctggcgtgctttgttcatcgtgtctagtctgagcctatttgttatccctttgatattcaagtatgttcctgacaagaaacacgaccgcggttcattcgattttctcggagctgttttgttctccgcgggactggcgttggtattgctaggggttacgaactattggtttatgctcattgcaggagcagcagttcttctatggttcggtactcatattcagaaaaaagaacatccatttatcgatgcatctttcatgaaaaatgctccttaccgacgaattctagggattggattccttaccttcgtatgcaacacggggttaacctttactcttcctgtcatgatgaagaattcctttcatttaccaactagtaaaatcggtctgctgatgcttcccggtgccgcctgtgcagccttgctcggatcccggatcggaggttggacagatcgtttcggaagctcccgcgtgcttgtcatatcgcaaagtctcgtcatcagcggatttatactactgggggtatccgtacatttgccgccatggatcgacgctttattgatcattatccttatgattggattcaacggtgtcctcacctctagcagcaatttagtttcgacgacactccgttcggctgagctgggtgtagggatgggtgttttcacactggcctatctcctaggcggagcattcggccctgcgctggtcggccgactgattgatctaaagatgcctttttctgttgtttattttaccatttccctgttggcaatcctgacatacttattcgcaagaaaagcaaatcgtagcggaagctatggtaattagtttggtagacttacgacatgtccgaaagatacggaggatgaatagatgagtaaattaaatttccaactgtcctttgctgctattcatgagctggccgaggggattcgaacaagggaaatatccccggtagagattacagaacatgcgcttcaccgcatcgaacgtttgaatccgaaactgaacgttttcgttacccaaacgtccgaactggcgattgaacaagcgaagcaatcggaacgcgatattatgcatggtcggtacaaagggccccttcacgggattcccatcgttcataaggatctatattacactaaagggatccgaacaactgccggttcaaaaatattgaacagcttcgtccccgattacgattcgacggttgcagctaagctacatgaggctggaacagttctgctaggcaaagtacagactcacgagttcgctgcgggattgacaacaactagcccgcacttcggtccttgcctcaatccgtggaacactgaacttgtaacgggaggttcaagcggcggctcggcttctgctttagcggctggacttacttatctgggcacaggctcggataccggaggttcgatccgcatacccgctgctttgtgcggtgtcgtagggatgaagccgacgtacggtcgggtcagtcggtatggtatcattccaatggcctggtcattggaccactcgggtccgttgacccgctgtgtcatggatgcgtccctgtgcttggatgtgatgtctggcttcgatccaaaggatgaatcgactgtcgatctgcctgcgccaggtatcaagatgtatccgaatggtctcaggggtgtgcgtatcggattgccgacaagctactattacgaggatttgatgccggaagtggaagctgcgatgaaggccgctatcaataaattccgagaactgggagcagaaatcatcgaagttagcctgcccctgatcaaacatgttagaagtgcgacgatggccattatgatgacggaaatgtactcgtaccacgagaagtggcttgagacagaattggaacagtatggaccggacgtccgaatgtttcttgaaagcagtagagatattccggcttccatttaccttcagtctcagcgggcccggcaactaattgtcaatgattttttgaatgcattgtccggaatcgacatcttgttgacgccggcaacaccgatcactgcgccgcgtgcagatgatgatgctagtgtattcagattgaactcatttacggttccgaccaatttgactggcttgcctagcctgagcatgccttgcggcttctcaccttccggtctgccgattaatatgcaattgattggccgccccttcgaagaagcgacagtactaggtatcggcaatacttatgaaatgaatacagactggcacaagagacatccggatttgtaagcctgaatatatttgatggagggtaatctatggatcaaaagcaacttaactctgaagttagcaggaaagcatcaaccgaaaccggaacagatacgacgagcgacaagaaaaaagcatacgagcagtttattcattcgatcgcaagtttaaaggaactggacctatcgggcattgaaccgcatttgcctccaatttacaaaaagcactataccaagaaataaaaaaaagctcatcggtcacccaaatgaatgtatttttaatttttcacgaaatgtattataatatgaagacggacaacatgtcctatacacgaaaaacggacatattgtccgtttttcgtgttaaataacagttaaattaatgatgaagggagatgtttatgatgaattcagaatcgcaatctgtctctctgaaaattcccagagaggagttaaaccgaagacgaattttggcggcggctagagaacttttcatcaaaaacggtgttgacaatgtcaatatgcatcagattgcgaagactgctggagtaggacaagcaagcctataccgccgctactcggataagggcgacatatgtcaggagatcgcgtatgaagaataccaacctttgtttgatgaagttcaagcatttcttgatcaatccccagaaaccgctgccttggaccggctttaccatgtaatcgtaagatatgtctcttttttagaagcgaaagttccttggctctgtgaggtcagccgggcctcaaccgggcatcgtccgttgcaatctccgttatgtcaatggatgcgcaatataagcagaaatctgctaaatgaggccgttgaacagggagacgtatccggggtggacatttcatatactattgaagccctgctggccgtgcttcacaatatcgattaccatctccaagatgaaggctttacaagccaacgagttcttgatggattacaccgcatatttattgaaggtttaagagctaatagacattaaatgaggggctggccacaaagccacataacatggatgagagatagtcctgcgtaacccctctttttatctcataatggtatattgaatgtacaaagaaaccatatcctttcaaatggtcgggtggcacctccattttacccaggaacggtttcttattgttttacaattggagaacaggacgtccctagtcatttttatgacttatgggacaacccttttttttctgccaatggctgctatgcgaattgtccggatcggacttccatggcacgctctccttattcggtcttcttatcatcagcagcgctctttcgtctacttcctgtaggcttcgtagcagcaggcttaattacaagacctgttacatcatcaatcacctgcatatccaagcatgtatgatccatctgaataatatccaacctatatatggcctctctgtttgcataaccacgggcgacttcatcataaatagtcttagccttatttatatttcgaagtctttctactgcctgtttatcaattcggtcaataatatcggagattgtgctatatttaacttctgcttcgttcaccttcgcgcatcttcgttctactaatctatgtattgttgctttcgatacacgatatttatttaggtagtccctttcaagattttcttttaatatttcaatttgcttatcagtaagacggacaagaatagtatccagtacaatttcttgccgttctggatggcaaattgtcatcactttgttatcttttcttcctgtgtatccttttcctttatttgatattaatctctcaagtcctctggatatcgatgcgtcttcgtattttctataatttgccaaaatacgcataatggttgccctggatccgccaaactttttcacaattttagagattaactcttcttgcttaagtttaaacacttcttcatcctcatgaagaagttccttatatttatcattaaattttgacacggcttgaatattaccattctttatcttttcgagtaaaatcagcggctgtatcagatcaaaacgtttactgacctcgtctctttttttcggatctaattttgcaagtacattatcgtatgacttcttctcttgttgcttctcaagtttcatcgaggcttccggtacaaaagtcgggtgattcactaaatcagtaaaaaatatctctagatcctcaccatcaggcctccttagccacacatgagggggatttatggtaaccaccttgaactttttcccataaagacaacactaagcatatatcctgatttggttaaatgcatacaacattcctccatctattttttctacttgggggttcacctgtgtgtttagtgatattatgctacgggatgaaataagctcgttgagattggtgattaatgttccttttgcgatgaggtgataaatcaatggtttaattaagaggggatctgtattgtttacgaatgtggaggcaagatggtcaactggacaagacccaaatacactgaagtcgatagataacagggttataccattgtgaatagtactttctctcttttaaaaaacctttcaaaaacttaaggttacgggacagagatatcggaggtgtttttgggaaaactacttgatattcccaatccttttttgatgcgtatgttctacaatatttattacctaattctgttcgatcattgtttcgttcttctttgggctccagttttatttgataaagtaatggaatatgcccttgcctaaaaaccaaaacatcaggaacatggaaccattcatgcccttcctcaaagatagacacttcaactggttgtacataataacgaatcacttctgtatccaattcgagatagtagtaaaagagacgttcggataatgactcatactcaacggttcgtttgtttttctgactaaaaaaaactaccaataatatgatgatggtagtgacttccacggttacttacttttcgttttggtagatataactcatcttccaaactccacgtccaacttctccaacccataaccaaaccacctttacgaaaagtatcgattatgatcctaaatttgaatttgatatcaataataccatatgttatcatatataggatagatatagtaaatagaaacacaaaaaaaccaatagaaacaagggttttgtttctactggtttaaaaatgtctcaaacatatacccaaaaatgtctcagttatcaaccaaatcagtctcaattattaccgttactcacaccagcactctatccgcataatgttttgctgcatagtagggaggatattgtcatgccagttcttccggttattcgcctttcaacgccctgtttttgataagcatcagcttgttcttgtttcctaaccatcgcacggactgtgtgttctttgttttctttcaaaaaatggataagatgttgtccaatttgtccatttgaacctaccaccaaaaccttcacctaatcactcctcattattatattttttcctttcccattaacttaaatcaccattcttgggcagtaaggtcgatcatcttgttctaattaaacattaagtaaccgaatggtttagcacattaccaattaaatgcatgcgcatgcatttaatttagtgaaaaaatgacttgctgtcaagttttgaatacaaatattgattgcttattctccagaaaaaatacgtcgatgatttgaataaactttggttcatctttgctttctaagttctcattcttcggtacgttaaactttgagcgcttctggtatctactaggaagcgctcgtattgtatattaattttgatgtggaggaaaatctatattctcatgctctccataaaaaagctcaatgcgttggacacccactttttgggatgaagaacaagctgaatttccagcttgagctcggcatgctcaaagggtaacacctttaactcttcccgttcaatctcttccagcgcagccattagaggtagaatggatataccctctccagtcttgatgctccgtttgatcgcttccggattacccagctccagactcacgcgataggtgattccatttgctcgaagcactctctccagcagttgtctgtagttgcacgtatgctcgggcatgatccactccgcatcaaccagatcattcaggtcgattcgctctttagcgataagcggatggttcggatggacaatcagcacaagcggttcttctcgaatggtaatccactgcaacgccggattgcttgaatcgtccgcgaggatcaacccaacatcggcctccccttccctcacctggtgcaaaatcatctcttcgcgatccgtatgcaatcgtatgttcagatctgggtattctttgcgagtcgcctgcatatacggcggcagaaaatacgaagcaatggaatccatagtaccgatcgtcatggagcctccgccctgcttggccaatttttctttcgattgctcgaaaagctccagcatttgtccagcaagcttgaacagctcttctccggcggaggtaagacgaatcttattgttattgtagcgctcgaacaatttaacttgatacgttttctccagcttctgaatctgggtcgtgacgctggattgtgcgtaaccgagcacttctgctgctcttgtaaagctttcacgaatggcaacttcccgaaatgtttgaagataaatgaaatccaatctggccaccccatcgaaaattttgattagaatcatcgtttattatagataactctgatgctgtttcctatgttacattagatttaattcaacgggaagggataactgatgatgatgaacgaacaacatattcatgggattttcataccgctgattacaccttttacgcgtgactataagctggacatcgattcgtaccggaagtatgttacctatcttgcaggccatgacatccagggtctggtcgttaacggtacgacaggagagtcgccaaccgtatcctgggatgaagtgaagctgatggtacatgtgacgcaggatgttctgaagagcatgaacaaaaccattccgatcgttattggcacgggaacgaatgatacctattcaacggtgcatcggacggaaatggcggctgaattaggagcggatgcagccatggtggtcactccgtattacaaccggccgacgcaggaaggaatattggagcatttccgtgtcgtatctcgtgtaggcctgcctgtgctagtatatgagattccggttcgcacgggtagtcgcatgacaatagatacaattcgcaaagtgctggacctggatggcataattgggctcaaggacagcacgggcggtcttgatctgctcttaaaattgacccagtacgagaccaagcctgtcctctgcggagaggatgcctatttccatgccatgctatgccagggggctaccggtggtatgcttgcatccgctcatctccatatccagaagtatgtggatatataccgacgttttatggctggcgacatgaacgggtcgcgagacagttttatgctactgaaaccgatgatccagcatgtatttgcagagccagccccggccgcgatcaagtggtggcttacccaacaagagattattgccgccgagcaattgcgtctgccacttatgcccctgtcggatcaggtgaagcagggtctcctgaattcaatcatatcctgataaatcagcttatctcagactccccaatcataacgtagaagaagcatctcctggacaggagatgcttcatttcttagccggaacaggcagcctttagaaaaacgaatttaagaagataccctctatagtagaacgctgcgcatcttcatccccaaccaactccaactgtctgtcatcaggaaaacattttttacaagtcccgctatctgcattgggttgttatacaaagagaatattatgaataactacatactcagcgttttcatcctaatgaggtctgcaatctgaaaagcttacaagcaatagctggatggttattagtaaatccagttgcaacattaaagggattatttcctataagcgaaattattgcaaaaagagggctgccgatgaatttcaccgacagtccttctctttcaagcagtatactcctcactcctattcgctggacagctccttgagcgatttgactttaccatggggatgctgctcttgctttcgtgacttccaggctgcttctttccttttcttctggtgagccataacagatatcctcctttggaaattgtgatgtatactactttcttaagttgtcatttctcagctctgttcattcataaaactaaattcgttgaattttctcctacatatcacaatcccaaatataggatgtcaaaatcgcttagtcataaaaatgcactcacgcactttatgtttgcgggggtgtatttttgtgattaagcagatcattgttctattataatccatgtatgaacttacttatttaaaataggtatctctccaagcagattctttaaattaatagcatcccacggcatatgctctgttatacctaatccaactacatctgtttcttcagatagttctttaatcagattaagtagctgaggcatttgcattgttcccgcaggagaaaaattatagggcgcttcagggttggcgaacagtaaagaacgaaatgcttttgggtcaagcacatctaaatcaaggtgaatagctagatgcttaatgccactttctttaatccactctctaatagattcagtactattcgttaactctttggttcctgcagttttaatccctagtctttgaatcacttctgtgtctgattctgcaggagctatacctagtctttgaaacgcttctgaaatggcttctgtttcttgttctgtaggagccgctaatcccgcgataaagacattttcaggttttagtgggattttcacatgttttgcgaactcctcatctccttctcccaaaagatttccgagcggtaatgtatgtccgttatcatagcccacatatctaactaaatcactgtgagcatcgatccaaattaaacctaattccccaccgtatcgttcgttcaaataggcaaatggagcttgttccactaagcagtcaccgccaaacattacaatacgatctggcttatgagcatcaatgatatgctgagcagcctctaactgtttaagtagctgttttctcccattcataccgttttcgttttcaagctgagtaccgttataagcttgaattggaacatgaataaggggttgatcattatccggtgctagccaagcaagcagttcggctccaaaagagtaattaggattgtttcccccttgccattgtggcatcaacaggcgtattgtttttttagtcatgtttttctctcctttacttcaaaagtaaggttagtataaactgaacacaaataaaaacgtagtacgcactattttgataggtactacccgaaaggatattgtaaacatgagtatggctgaatttaaaggtaaagttaaaaacattcaagatacaccttttggttatacagtttcactgattggtggtaaatggaaaatggttattatttatctcctagccgaaaaccgaacagttcgctttaatgatctgaaaagacagataggggctattacttataaaacattgagttcacaactaaaagaattggaagcggatggtctggtgaatcggaaagaatatcctcaagtcccccctaaagtcgagtacagtctcacagctaaagcagaaacgctattacctgttttggaagggttatgtgagtggggaacaaaaaaccaaaatagttaaatccaattttctaataaaaagcctgtatgcaaaaagttgtcctgttttccaacattgctattccaagtttaaactctctagttaagtgaatccagcaatggctgaacaacagcatgcagccgtcttgcaaattctattatcttaattatcgcttcaagctagatttatttcccgaatcacttcaagcggaaccttcggttttcggtcttccgtcaacaacccgttgacttcctgctgtacatcggttacctgtgtatagcaatagcccgagacgctttaattgctccggtgattgcacggaaacgttcgataaaagcttcgactgaatccacctggtttccgtatccccagcccttgtccgtctggaaggcaatgccgcagaattcgcttatgataatcggttgtcgtcggtaggcatatccttctgcaaaggcatatttccaattgttaaaagagatgctgttgtttacgatgctttccttgtcctgatatcgctccaaaaactcttcgcccgtctccacataatcatgaagggtcaaaatatccgagaccgtatgctcccaaccgtcattggtaaccaccggacgatacggatcaatcgtcttcgtcagatgatagatggtttgcgtgaactgctgctgccttacatcatgtccaatggtcgatatgccccacgattcattgaacgggacccaagttatgatgcttggatgattgtactgctgcggcacgatttccagccattccttcgtaaagcggctaaccgcctgatcattgaactcaaaggtcgacgccatttctgaccagacgagcatgcctttcacatcacaccatataaaaagcgagggtcttccagcttcatatatttacgaaccccgttatatcccatcgcagctattttatcgatatcttcgataagagcttcttcaaaagggggaatcagatgagtttccggccagtagccctaatctagaatcagccgctggtacaaagggccattatttcaatagaatctgtccgtttcaatcgatattttccgcatgccaaaataggaatacaccctgtcactctctttctcatcctcatacagagcaaactctacatcgaacaagttgggcgattccggtgaccacaagcactgcttccatggaccacacgcttcatgaaatacatgggcctccaccgttatccagggcctgtcggcagataagctgacctttttcacatgctgtcctttcagcgcaatccgtgtctccatgcgtaaattatctttagcctcggtacccatgagctgaaagtcaaagcggatcatatgacggtcgatatccggtgttatcatgacctcattgattcttatctcattcacatattcaatccacacacttttccagattccggtgctctgtacataaaagcattcaaagtttcggcacctctcccggcggcaccgtccatgagaggattcgtcatacggcggaatatattcgtatgcaatgtcagaacatgctcgatttgaagacaatggttgcgacgtcaggttatagctcctttcattttagccggctcttccatcagatcatgggcagcaccccagctcaatatttgctccaatgccgaataacgctggccaaacatctccttgtatccacggtactcactgtaaagcagattgcactggaaactggctttcatcaaagcagctattttatcaagagatttcgggagcatacaggcatcacaccggagcagtttcgccagctgagaaggatgggttagtacaatctaaaaaactccttcaatagctgggcatgtgtgtatggcgacgtacaaatcgaaattacaaattttgcagttgaataaaagaataagcggccgcttaggacgtttggttaacatgtcctacgctaccgcttctgttaatgttttttatttcagttatatatgggattatattgtctgtttggatattgctccgaaatattctacaactacctcacggaattccagagcagcccgcgaaatataccgactcctgtgccataataaagcgatctcccgtaccaattcgtgattttctacttgaagatatttaagatgttcccgtgaatttcttgccgtgcttggtatgaaggctatgccaatttcagcttccacaagcgtactaagccttgcaggttcatccccctcatacacatacttaggtataaaaccttccgatttgcatacagagtccactaaatcgcgagtaccgtagcctctctttacaccgacaaaccattcatcccttagatctgtcaacgttacactgcttcgatccgccagccgatgcccctttggaacagctacaaggattgggtcgataaacacgatttggcattcgatgtcatctccctctattggaggtgaggacaagcaaaaatcgacctctcctctatgaagcagcgttaccatttcctgcgtggtcagcatttgcacatgaaattgaatatagggtcgctttttccgaaactctcgcagaatattgggtaatgtgcttgcggtggtcactgccaattcgagagtgccatgttccgggctggataaatcactaagctcctgcttcccctgctccaattcaaataaagccctctctgcacggtgaaggaatctgcttccgaactcattcaatcgcagtttcctccctgttcgatcgaatagaggaacccccagatcttcctccaggcgttgaatcgttttgctcagcgacgattgagtaacgtgcagacttcgtgcagcttcggtcacatgttccaaacgagctaccgcgagaaaatatcgcagttgaagaagttccattatgatcccccattcattccctcaagtcaatgagattataacatcaaatgcgttggaataaataatcgctttcaagtacgatgatattaattcgctatggggggaccagaaatgagcgttcgcagctggtggttactgatttcagttggtctagggatactattgaacccattaaattcttcgatggtttctgttgctattccaagtctgcaaaatgtattccaacttgactttacaggtgtttcctggattattttttctttctacattgcaagtagcatcgcacaacctgtcatgggaaaggccagcgatttattcggtcgtaggaggatatttctttctgggcttgttgtaagcttcattgcatcattattagctccattatcaccaaatttcgggtggctcatcatgttccgcattgtgcaatccatcggaacaagcatgatggttggggttggaatggctattgttcgaattcatattacagagaaaccagcaactgcgctgtctgttttgtccatattcctatctggagcagcagcgattggcccctttattggcggtgtcttgattcactggtggaattggcctgctatctttttcatcaatattccgtttgtggtggccagctttgtattggcttggaggactattcctaaggacgaactgccaacatccgtagcacgcaacatgtcctttcgtaaatggtttgaattgattgatgcattaggaattctgctcttcacagtggctttggttaccctgctcgttggattactctcagcaaaatcatctggacatatcttattaggaaatgtcattttcgggctggtaggtctcgttgcgctggggatattcgtacgacatgagttaaaagcgacatcaccctttattcctttacgtacatttgccaagtaccctgcgatgacttgggttaatgttgaattcatgctggttaatgtactatattactcgctctttttcgggcttccgtcctacttgcaaatggtacgtcatgtcagtgagttccaaacaggcattctcatgctaagcttaggcttgtgctcgctaattacttctccaattgcaggacaatggatcgataaatcaggaccccgaccggcattgctggtgtccgcaattctgatgacattggggtcagtgtggctcgtgacattgaatccaacttcaccggttatcagcgtgtgtttggctttagctgcattcggaattagcaacggtttgaacaatgtaggtatgcaagcagccctgttccaaagttctccaaaagaaataatcggtgtagcatccggattatttaacacatccagatatctgggaaccattatctcttcattattgatagctatcgtaatgggaggtacgtttagcttcaagggatttcaaatgcttgggatcatccttacggtaattgcattgtctttggtattcatgagtcggcggcaccgggagtcagcgcaattgcatgagtcgtaggttcactaagttcatatctcaaaccattgcgcggcaccaatcatcatgcatccaatgtcatttatttggattaaagatctactacaacaagttttaattcagcgacattgctacataaaacttcgctacattcaaaccacaaaagccgtaaatctccggggttattggagacttgcggcttttgtggtttgtttagattgccccaaagccattcgaaagctttggggcagtttccgtattttgaactcggagcttgtttttaatgcctaaagtgaaaaatcaggtggacattattccacttccgtctgttactagtaagttcgctagctctgtttccaacattgctttaacgatttctggattttcttcaaaaggaagttccagtgagatttgcaatacattctccatatgctgaacagtaaagaaaatgattgaatcccgatagatgtccctctcttctggctcgatatttttaaacagctgatatttatccgacgcttcgccaaggtaattgaagacaataggtagcttattcaggctatacttcagataccggttagactgcggatacaacgaagccatttcatcattgtatatgagatttagaaaattcagattacgcgctacggccaactgcatactgtttctgatctcatgcccatgttcatccgcatctgtaagcagtacagggatttggtctataaattcacctataatatcaaaatactgcttctcctcatatgcacggccataattggtgagaagaataggaatctcgtccacttgcaaatatctgcggaaaaagcggttagctagtcgtatagccaagtcccacatgtctccgattgcgtcagaatcattccaatctgcaagttctactgtcacatctgtgcccgttgtatggctgcgctcatcaattgcgaggactacagcgtccgaagcagcagcaaatgcggacaagcgaaatttgtcgacaatctcttgatcgcccatgccctgaggtcctttgcgaacctgactcacataatcacggtagcttcctgctagttgctcttttacattgctcatgtcatcatatgcacggtagaactcactcttaacgacctctccgctcatgccatcatagatgagatgtgaacaagggagcagcagcaaatgatcccgtaaattaaggcgaacaagcgcaatgcgatataacaagtttccggttgtttcataagggttcataaagaatgcaggcagtatatgtgagagtatacgattttgcatctctgcaccgtagttcgataaatctatcattggaatatccatgcgctccttcatggacaacatttcccattcccatccgacatctgtttggaccaacacacttctaaagagttcatgacgctctatcaggcgttgcatgattgcagataaccgttctacatccagcaggtaactatcaaaaggaatgacacctcctgaggattgcggatgctccaaatgataatgttgagcgggagcaagcgcatatcgttgtaaaggctcccctgccagcatcgtgctgttccattggtcattcatccgcagcagatgttccagccattcctcagcatgccgcttcacagcttcatcgtctaccatcgtatctgtgtataactttttacagtcaggtgcttgagcagccgcttcaaaaggaagcaaatgatgtggatgaaggtcaggatgaaggcgtgacaaaatgacttccttcagcgcctctgcttgtacagaatcgaaaggatctatgtgcaaagttaattgatctcgcccttcaacagctgttgattggaaatgagcatgtacgttataaaccttttcgatgatgtcgattgcctcggcaatatcacgtgttagcatacctgacattgaagtgtctgctcgcatatactctgatatttggcgaatagtctgatattgaaacacctgattaatccctatttcaatgccaatagcctgagcctgtgaaaccaattgaatggcttttagggagtgtccgcctaaatcaaaatagttatcatcaatgccaacaatactgacacccagattctgcttccaaatatctaccatgtgccgttccatgccgtttcgcggggctgcatattcaacacctgtttgaatgtctccgtccggcgcaggaagcgatttacgatcaatttttccgttagtggtcaacggcatcttctccaattgaacaaaatagctaggcagcatgtacatcggaagattcggaaccaacgctgctttaagttcctgaatggtcagatcgctatcagccacaaaataagcacataaatctttttgtcctgattcattctcacgagcaataaccaccgctttacggatcgcaggcaggttcattaattgcgcttctacttctccaagttcaattcggtaaccccgaatttttacctgatgatccatcctgcctaaatattcaatatttccgtctgccatccatcgcgccaaatctcctgtgcggtacatacgttttccgggttggaaggggtctgctataaatttctcatctgtcagctcacgatttcccatataacctcgccctactccatcaccaccgatgtagatctcgcctgcaattcctatcggaaccaacttccgattcatatccataatatatacgtgctggttagccattggcttgccaatcggcaccgtatgtgtccaagctgtcatcgtttccccgtcaatgtcgtatgcagttgtgtctacgcagcactcggtaggaccataaacattagttatttgcggacgatatccgggccgggtgctcaaaaatgttttaacgagatgaccgggcagcgcctctgctccaaaaataaaatgctgtacattcaggtctgcaacggagtcttgcatttccgtcagcatatgcatgtgtgccggtgtaccatcagtaaaatcaatccgttgggatctgaaatagtcagccaaacgatgaccattggtgctaatctctctcggcaccacgtgaagcgcatgcccgagaagcaggcatgggaaaatttgtttcactgatgcgtcaaatacatacggcgatagccatgccatccgcattggcgatttgtatttcttatacacttgttgtctaaatgcggttgtcatattaacgacattagagtgttgaatcatcactcctttgggtttgcccgttgtacctgaggtatacatcacataagccaaatggccagggtcacaaacttcagccaagttggaaccgtcttctgcggatagcctgtgactatcaggtgaaatgatcagcacatccgacggtaccttcgcggccatttctggcatggcaaccataagcttaatatggctgtcttgtaacatatagagcgtacgttcctgcggaaactcagggtcgataggtacatatcccccaccagcttttaaaataccaaaaatccctacaatcatttcgatagagcgctccataatcattccgaccaattgatccgcctggactccttctgctcttagcacgcgagccagttggtttgcacgcacatttaattcgttatatgtgatctggctatctccaaaaactacagctacttgatctggagtcttctctacctgttcttcgaataattgatgaatggttttttcacttgggtatttcaccgcggtatttccccagacatccaatatcatttcgatttcctgtggcgtaatgatctcaatttcagaaagctttgtctgtggttcatctacaacagctttaatcaactggagaaagtgatcggccattcgtttaatcgtgcttctcttgtacaggctatcggcatatgtgaagctgaaaaccaaaccttcagagctttccatggccgtaagtgtcaaatcgaattttgccatattctgttcgcctgggcacagagtaacctgcaagtcttggaattccgtcgtaccagagtccatgttatctagctcaaaaagagtatcgaataacggattccgactcaggtccctctgtacattcagcttctccaccagcatttcaaacggataatcctgatgctcaaaggcatcaagcacctggtcctttacttcctgaacatattcgtaaaaagacttatccccttcaggaaagctccgcaatgcaagcgtgttgacaaacatgccgacgacaggctgcaaatcgtgatgctgtctacctgcaataggtgttccaacaacgatatcctcctgaccgctgtacttgaacaatagggtcttgtaggctgcaagtaataccataaataaggtagctccagcctgcaaactgatttgtttcaagccgtccacgtcctgatgtgaaatggcaaaggaaacggtgctgcccgaagtgctacgtgttgcaggtctttcaaagtcgactgggatacccaaaatcggaatgtcgccgctcatctgcttgagccagtatgcttcttgtttttccatccatgagctaccaatatctccttgctgccataccgcataatccttgtattgaattcgcaaggccggcaacgttttttcttcatacagtgcgggcagctcgttcagcaatatactcatagatacaccatctgaaatcacatgatgcatgtcaaacataaaccaatgacgctgtggagattcttgcaacagagcagctcgaagtaacggtgccttcccaagatcaaaaggtctgataaattgtctcatcattgctcttgcttcgttctctccgtgtccctgcataacctccaaagtgaaatcgacatggtcgtgaatccgttgtaccagtttatcatctacgaattcaaaagaggttcgcaaagtatcatgacgctgaattaattgcttaagcgctctttctaatcttaaaaaattcagttccccttccatcaaaagcatggcagacatattgtagttattcatgctgctcaaaacgtatagtctattttgagttatagatgccggataactgtctctcaattcggcaacaggaatcgctgcaaatggatttggtgacaattcatgaacagcctgcgccatttgctcaattgttggaaagtcaaatacataacgcaacggtaactcaatattcagttctttgtgaatttttgcggccaatgcagttgcacgaagtgaatgtccgccaatggcaaagaaattatgatgaattccaacggacggaatgtcgagtacctctctccagatttgtgctaacttcgcctccatggctgtgcgcggcgctgcatattctgcagtcaaatcagtatgttcctcgaatgccgacagtgccttgcgatcaatttttctgttcggtgtcagcggcatgttctgcagttgtataaaatacgacggtaccatatagttcggcaatttctcattcagcaaattcaacatcatactgccactgatttctttttcagctacgtagtaagcggccaaatgataggctccctgctgatctgcacgagccatgacaatagattctttaacaccgtccaccttgataatttgcgcttcaatctcaccgagctcaatccgatacccgcggattttgacctgatggtcaatcctacccaaatattcaatgttcccatctggcaaccatcgtgccaagtcacctgtacggtacattcgctcatagccaacttcctctgctgcaaacagattggctacgaatttttcttttgtcagctctggacggtgcagatagccgcgtgccagccccggaccggatacacacagctcaccagggactcctgcaggtgaaagatttccgtgtgtatccaccatatacacgcggtgattagatactggccgtccgatggatatgattccacctaactcagaattttcttccgataccggccaaagagacgttgcaacggaattttcggtaggaccatacgcattgtaataagccactcggtccttccatttggacaccagttctgcggtagaggccgatcctgctgtaagcagaacacgcaaatcaggcatgcgatccgggttcaggtatacagcatagtttggcggcagcgttgcaattgtaattctgcaggcagccatgtattgctcgaaacgttcataattcaaaatagtctcggaggaaggtatatacaatgtcgctccgcaaagtaaagactggattatttccgagcatgacgtatcaaacgaataactggcaaacatgacaacccgatcggacaagccaatactcaatttttgctcgaagtaggttttaagattactaagaccgtgatgctcaagcattactcccttaggctgacctgtcgtcccggacgtatagatgacatatgctagatcgtttggacccgatacagcctccagattcgaaccgttctgatgatatacgggcagcatttccccgcgtacatccgcttttcttgtatcggaagcgactccgtcctgttcaccgtcaagcaccagcaccttgcctccaaacagcaccttttccgtcaggtgctgttgcgttaacaacagttccgtacctgagtcgtccagcatgtagcggatgcgttcctccggatagcttgggtctatcgggatatatgctccccccgccttcaaaattcccaatatgcccacaatcatttctacggaacgctctgtcatcagactaaccagactatcggctttcacaccatagctgcgtaaagtacgggccagacggtttgcgcgctcgttcaattcatggtaggtcaattgttgaccttcaaaatataccgctgtctgatccgaagtctgcagaacctgttcctcgaacagttcgtgaattgtttgttcacgcgaatactctgccgtggtatttccccacacctggatgatgtgctcccgctcctgcttagtcaacagatccattgtctcaattaaactatccggattcgctataatttgatccagcaactgcagtagatgtccttgaatctgcgacacactctgatgatcatatacctgggcattgtaggaaaaatcaattcgtagcgtatctccctgaagtactatgatgcttaaatcgcagctttcttgctcagtattggcctcttccaaagtagtctcaaacaccattctatgtccaaaaagtgccagttgttgcactttcgttgtaaccatttcacacattggaaaatgtccatataccgcagattcatcggtttgctgctgcacatttctcatcaacccgataaagttggctcctgcttcggttcgaatgcgaactggtaaggtgtggttacccagtccaattgaatgcttcgaatccaatttatctgttaaaggacttgatatggagcaagcgaacaccacatcatctgtaccgttatacttttgtaataaaattccccagactgtctgcagcagcgtatttatcgtcacctgctcattttgtgcaattcgctgcagtgccaccgttcgttcaacatccaaattaatctccagatgctctgcctgatatggactgcgccccatcagattggcatatggcaattgaggtgcttcttcatagccttcgagcagagtactccagtagcgagaagcctttagggtgtccctatgtttttttagaatccctttgtcttcttccgaaatcagcgtcaattcgcccagcttagtattgggattggctacaacagttttaaccaactgtacaaaatgccttgccatgctttctaccgtttcccgtttaaacaaagatgtagcgtacagaaattggagctgaatagatgcttcctcctcactaacttcaagcgtcagatcgaatttcgcagaaacctgatctatgtcaaaagagtggaagaacaacttgtccaacttcacttcctttttctccatattctgcaatacaaacatcgtgtcgaacaacggattacggctcatatctcgtttcagatcgagcttttccaccagttcctcaaaaggatagtcctgatgcgcatatgcttgcagtgcacatgtcttggcgtcctcaatgcagttataaaacgtctgttcagcgtgaggatgattgcgtaatgcgagcgtgccgacaaacataccgagcataggctccaggtcagcatgcggtctacctgcaatcggagtaccaacaatgatgtcttcctgccctgtgtaataatgcagcaatgctgtgtatgcagccataagtaccatgtacagcgtagaatccgtatgcaccgccagttcttttaaacactgagtcaattcctgtcccatttcaaactcaacagcgtcacctttcgtacatcgtgttaccggacgctcaaaatcagttggcaaatccagttgaggcaagtcaccactaaatctattcagccagtactctccctgactctttattcgctcctgctgagttttgctatgctgccacacagcatagtccgtatattgaatacgcagcggagataatacttcaccgctatataagcgggcaaaatcaccagctaatatttcaatggatactccgtctgaaacgatgtggtgcatatcaagcatcaataagtgctgcggctcctgtccttcctcgtccaatcccaatttaaccagctttacacgtagcaacggagcgatcctcaagtcaaatgggcgtacaaaggaacgggcatgttcttctgctaaattttcaagcataagttcattggattctgtccgcagttctgatattgtggcatattccaactcaaagtgaatcgtatcgtgcacccgctgcatcggcacaccattcaccagttcaaagcttgtccggagtgacgcatgacgtgaaattaattgacggaatacctcttccacctggttcacatctatcggaccgattactctcagtgctgatgtggtgttatagcttattccatccggatccagctggtgaagcacatacatccgtgtctgtgcaaaagaaagcgggtaagtgtcgcgtttttccgccaccggaatggatgtatatgtgatttgatcctgttcttcaagcaaggccgccaattgctcgattgtcggtgcctcaaatatgttttgcaaatccatcggtctgtttaaatctttgcgaactctagaagttagtgtcgtcgcccgcagcgaatgaccaccaatttcaaagaaattttcgttgatgcctacttgcggtagacccagcacatcctgccagatgtctgccaattttatttccatccacgttcgcggtgcaacatggtcggccaaacgatcttctggtatcggtagcgccttacggtcaattttaccgtttggtgtaagaggtacgttctgcaactgaatgaaatgtgaagggaccatataattcgggagttcttcatttaatatcttgcgaagctcgctccccgtcacttcccgttccgccacataataagcaacgagttcgtgttggttttggctatttgcatgtgccagtacgatgacctcttgcatgcgatctgccttcagcatagtcgactcaacttcgcccagttcaatccggtaaccgcgaattttgacctgatggtcaatccgacccaggtactcaatgttgccgtcaggcatccatctcgccaggtcgcctgtccgatacatgcgttcatagcccgcttccccacctgtaaacggattggtcacaaattgttcagccgttaattctggacggtgcaggtatccgcgtgccaaccctgggccggatacgcacagttcacctgagattcctgtcggtgcaagttgcccatgtgcatcgaccatatacacgcggtgatttggtacaggacgtccgattgagatggatacccctgcttcggactctcccggtactggccaaacagacgttgctatggaattttccgttggaccgtaggcgttaacgtaggtcacaccgtctctccatttgctgactagctcagtactggtcgccgatccggccgtgaacatgatgcgtagttccggcattcgttcagggctcaagtatatggcataggttgggggcagcgttgcaattgtaatgtgatgatccgccatatactgctcaaacttgtcatagctgagaatggtttctgatgtcgggatacataaagtggccccgttgaagagcgcctgaagcatttcccagcatgccgcatcaaaggaaaagctggcgaacgatacaacacggtcggaactgctgatccgcaatgtttccctgaaatacgtatgcagattgcagagtccacgatgctcgagcatgactcccttgggctggcctgtcgttccagacgtatagattacatatgctaggttatgaggaccggatatagcgtccaaattcgtaccatccctgtgatatacggacacgggttctccttttgcttcagccgtacttgcatccacactgccttcgcccatttctgcatccaacagcaggaccttgcccctaaattccagtttttcaaccaaatgctgctgcgttaacagcagttccgtacctgaatcgtccagcatataacggatgcggttctccggataagtcggatcgatcggaatgtaggcgccccctgccttcaaaatacccaagatgccgacaatcatgtcaatcgatcgctctgtcatcaggccgattaggccgtctgctatcacaccgttactgtgtaaagttcgcgccagacggttcgctcgctcatttaattcacggtaggtcacttgtgctccttcaaaatataccgctacctgctctggtgtctgcttgacctgctcctcaaacaacccgtgaatcgtctgctcacgtggatatgctgctatcgtgtcacaccaagcacccagcatttgctcgcgttcctgaggggttaatatatccagctcgcaaatccgaccagctggattgatcttgatttgctccagcagttgcagcaaatgcccccggatctgttctaccctttcatagtcatatacctgggcgttgtaaccaaaatgaactcgcagcgtctctcccggtaacaccacgatattaaaatcataattcgtctgctcaaccgctcctgctccggttattttaaaatcagcttcctctctttcacctaattgctcaatttgttcatccaccggatagttctcaaataccataatatgattaatcagttccactttctgctctgcctgtgcctgaatctcatagagtgggaacgtttcgtatgttcccgaagcaagcgcctgtcgctgagtctgcttcatcagctctgtaaatgcagttgcttgtccgccttgaatacggacggggaccgtgttaatgaatagtccaatcatctgctctactccggcaatgtccgctggacgtcccgataccacgctcccgaaaacgacatcctctgtgcgattatacttttgcaacaaaacgccccaggccgtttgcatcagcgtatttattgttacctgttcttgctttgccagttgcagcagggccgttgtcaggtctatacccaaatcaaattccagatattcggcctcatattccttggacttccctgttttggcctgcggcaagaccgccgtctcctcatagcctcgcaggtaaccgttccaatactccgctgcttcctgacgattctgcccctccagccattcgatgtatcggctatatggtgttaccacaggcaattgcggtgccttcccttctgtaagggcggtatatcctccaaagacttcgttggtaaccagtgacaaacaccagccatccattatgatgtggtggaagctccatacaaaatggtatgattcatctgatgtacgcaagatagatacccgcatcagtgcatcctttgccagatcaaagcccctctgctgatctcgacgcgtgaactcctcgatgtactgctcttgcgccgacttctccttctcacgtatatcctctacgtacagttctccgcgtttattccggtacaccacttgcaacggctcgtcttgcaaatcgctccggaagttggtacgcagtgctgaatgacgctgtaccaacaagttcagactggcagagaatgcagcgagatccagcgttcccttcagttcaaaggtggactgctctacataggcgctcgactgggaatccagcatgttgtggaacagcattcctttttgcatcggcgtcatgggatatatattctcaagctctccgtcaggctgaagttgctccaccatccggtccagttcttcaaggcttaagtccgaaagcaacacatcactcggcgtcaattcggagtgctcccgagatatacaatgctgaatcacttccagcacattctgcttgaattgctctgctagttgctcagcagcattttgttggagtgccttaatgttgtattgaatgcttagttccagcatgccatctgtaacaagtcctcccacgtccataacacaggacatttgggtcagttcatgagtattagctccgctggaatatggagaaaaatgcatgccgctatgctgcagtgtctgatcaaattcgcccaaataattaaaacttatctgtggctcggcatatgttgccccggacggtccattctggctgagatatctccagatgccatacccaattcctttatgtggaatgctgcgcagcatctccttcatccgtttgatgtgcccggagatatcatcttcccggttaatccgcagcagtaccgggtattgactcgtaaaccagccgactgttcgtgaaatatccgtatccttcatgatttcttcccggccatggccttcgagaagaatcgcaaccttttcactgccagtccaagcgcttaacgtcttgccgagtgccgtcaacaacagatcattcacttctgtgttgtacgcgcggtgggcttgcttcagtagttgatcagtctcttcctgcgtaagcctcacatttacgatatccatgtcttgctgcataaacctatcgctatgctcttgggacactagaagttggggcgactccgatgccgccagttcattcacttgctcccagtatgcgtgctcactttccatctcaggactatcggcataggctgataaccgctccgaccagacccggaaggagtctgttttggccgggagctgtatggcttctccacgtacagcctgctcataggcattcgacaaatcctccaacagtatccgccacgatacgccgtctaccaccatatgatgaatagccagtagcagatggtcgccatcagcgcactggaacag

SEQ ID NO: 2667 - DNA, 26768 bp, Unknown
  Kingdom: Bacteria, Phylum: Firmicutes, Class: Bacilli, Order: Bacillales, Family: Paenibacillaceae, Genus: Paenibacillus
tgtgcaatgcttttgactccctcagtaccacgctgatacctacgaatggcctccaatttctcatctaaactgaatttaggcaaaaaactgcacctccattgttagtcgtgtctaacaaatggggtgcagttcagttgctggctgctttttttgttaactacgtctaggctgcgttcggtacgaacttaaccaataacgacaaacgaggatacgccagcaggtacggatctaacgcggaataatactccatcatctctaaaagtacgcagaatataaggctggttcgtaggtgtgcggactctgctgaatcgggcagtaccaaagcggtcgaagcctgcagcttgcacaaaggttccatctaaacggcgcagtgttgcgaaaaatccagacgtgttaaaaggcacaccatcattgttagcccaaatgactgtaaaacggcgcagagtttgtgtagggctcacattgcgatatctcgtaacaggaacctttctgcccgtagatttcaatgtttgcggaggacgaatggccacttcaaatcaactcctttgttgtgatgagatagtaaatgcacacaaaggagttttggattgtgttataaactacgacttcttataaataggtatataccgaactcaaaatgacactccatgtacattatcgttcgattcgggacctcatcatgcccaatcgcgccgtagcgtaaagaggtcttttaacgcgtctgtagacagctcagtaatccagccctcggtactggttatgatctggtcgctaagctgctgcttgctttccagcatttcatcaatgcgttcctccagcgtgcccaacgagataaatttgtgcacctgtacatccttcgtttgtcccatccggtaggctcggtctgtggcctgattttcaacagctggattccaccagcgatcaaagtgaaagacgtggttggcggccgtcagattcagacccacccccccggctttgagcgacaaaataaacacggacggctgctcggcaggggggagcgtgtgagattggaattgatcaatcattcggtcacgcgcagttttggatgtgctaccgttcagatagagcacaggctcttgcagctcctgagcgagtacccgctgaagcatctgtcccataccaatatactgtgtaaaaataaggcagcgctcgccctcctcccgcagttccttgaccatagccagaatgcgctccagcttggatgaacggctaatgaccgcttcaagatcggactgactataaccggaatccgcggtatctgggagcgcctccttcgttaagagggcaggatggtcacaaagctgcttcaactgggtaagggcggataaaatggcccctttccgttcaatcccttccagcttctgcatccgttccatcaactctttgacaatctggtcatagagcgcgccctgctccgaggtcagatgaatgtacgttttcatctcattcttgtcaggcaaatcaagctgtatagctgggtccttcttcttgcgtcgcagcatgaagggctgaaccagcttttgcaaatctaacgtgcgctgctcgttatgttccttctcaatagcattaatgaagcgattgctaaaggcgcgtgagctgcccagataacctgggttgataaaatcataaatggaccatagctcggacaaccgattttcaataggtgtcccggtcaacgcgatccgatgacgtgcaggaaagctgcgcacggctgtggattgcttggtttgcgcatttttaatgttttgcgcttcatccaggcagactgaatcccaagtcatgctttgtagcagctcttgatccagggttgccgtagcgaaggaggtcaggatgacatcggcctgctcgacttcttcgcggaacaagtctccctgctcccgcttgcttccatagtgcagcatcaccctcagcgaaggggcgaagcggctgagttccttctgccagttgcccagcaccgaagtcgggcaaatcagcagcgagctggaacggacgcccgtctcggcggcaatatcctgtaggtgcagtaaataagtaataaactgcactgttttaccgagccccatgtcatcggcgagacaggcacccagtccaaaacgccgtaaaaaggcaagccatgcatacccgtcccgctgatacgtccgcagctcggcttgcagcccgtccggcacgtccaatgcaggccattccgactgccgtccgagctggctgatcagcttcagcagatgggcattcagctcgacttccagtcgaaagcgtgccgcatcttccggctgctcgcccgaggcgtctccttcaggctcgtcggcgttgccgagcagatgtagctgcaggatgtcctgaaaggacaatccctgagcgctgtcgatcccggccatggcccggcggatctgcgccagcagcgcggggtcgagcgcgatccattgcccgcggaagcgcaccaagcgctcgttgcgagcgaccagctcggcgaattccgactcgctcagatcggcatcgccaatggcaacacgccaatcgaactggacaatcgagtccagtccgaacagcgagctgcccttcgtgcgctctcccgccccttcgccagggcgtaccttggcccgcagcttcggcttcttgcgggtagctgcctcccaccaagccgggagcagcacctgccaaccgctttccagcagacgctggctgtcggtcgtcaggaattgccacgctgcttcgtcggagagcgggtgattcagcacgtcatcgcggcttccggcacgctgcccggcaggcaaaatcgaggtcaagcgttctagccacccggctgagcgctcacggacatgtgctgtccaggcatcgggccatgagccggatgcgtacccatcattggcgagctgtacagacaccagcaacgccgggtcctgcttgtcctgcaacacaagcttgagctgccaggacggctcgtcgtcctccagctctggctccagcagttgcagaagcggccgaaatggcgcggtatcggctttccagccgatggcgatgagccaggcccgcgcgtctagacccgccgcggccgagcggttgggagcgaagagaatcggatattctcttcgcaaatcggcggtttccgcttcggtgccgtaccagcgctgaaatacggcagccgagaacgccgctatcagcccatcctgctcgtccttctccaagctgcctagcaaagcaagctctgccggttggatgttttccagtgcttccgcatcccacatccattgcagcttccctgcctggaatgccgtgaagctgggcacatatgctttcgcttcaatacagtgagcaagtaaagggatcagccgaagccacggggcatgggcctcgtcccagatccattcgatatgctttagaagctcgcgctctgccagaaaaggaatcacctgctccgaaggcagcaggataatatccgtgtcttgaacatgttgaatctccagctcggtgccataaaacgaagcctcatgccaagcaaacaaacgctgcttcagaatttggccggaaatgctatagttcatggaggaatcgccatagatcagcgcgtctccataggtagttaattggatatgcacggtaatcgtttcggtatattgactcatgataacaatttccctttccgcaattcctcctgtagcgcccgcaggcggctatgacggctggtgaaggtcgtgaagaacagctcccagcgtgattcttgcttcattttcttgtacagcttgaacagtcgctttaacagcttgactgctgctttatagctggccctgtttttttctagcacataacgttctaccgcttgatggtaaaaggggagtagtaactcaggcgcgttcttttcaatgggctgtaacacgctcactcgaaaactcaatggttcactgcgtatgcttagctgatagtcgatccatgaccgccatttttcgtgggcaagcagcgcctcttcatacattcctccggcaaatggaagcatacccactagcgtgtcccacatgtcctgctccgcttctggaaggtgctgcaaaaccacatcccaatcatgcatataatcctgtaaatggtcatcccgatgactgtgaagcaggggaccgatatgctgcagtccgtccttgagacgtgcccaatcctcggctttgcgcaacgcctgtaagaacaaaagcaattggttggaagagatttttagtggaaaagctcgttccgcttcctgaagaagtacccaggcttcattatcctgcgattggtaaatatgcatccagctacgagccaacatccatggaagtcgtgctaaagttgtaccgagatcctcctcagccgcctgtaaatgctgtaattcctccgtatatatgctggagtcctgtctttcggggtgcacccagttcagccaaaactgataatacgtgtttgaaaaataagtaccgttacgcgattctgtcagcatttttcggcgtaaataggctaaggtttctgcgatacggacttcttgcataggttcatcggtcagctccagcgggctttcaaaatcacgctcgatagcttctttaagctcatcggcggcgatttgcgtgtaataccccatataggtatgagagggatagcccggcatgggagactgaggcaccagcttttccagcacacgcagatgagcatgcagtccgtatagctgttgcatgccgggtgaaagcggtggcttcacagcatagatcgaggctaaagcgctttggacatattgggaattttgtgtgttcacacggttaagggcgatacactgatcgaacagatcatgccactctgaaatggccatatctggtatcttgcttgctgttttactgagagcgtttctggttgcttccttgtgatccggtgaaagattcgaccgggaaggagatgtggtacgcgtgtcagcttttgccgtcaatcgggtgaatcccgccgaatgagcgttcactaaagcatgtacagaacgttcctgttcattcgcgtaattcagtagtacggcgatcatatgcttgcagttggtgtggacagggcatgtacatctgctggcagcaaaagcactcaagtgaagatccacctcgtatagctcgcttccatccacgacagctgcgatatggtcggcatcaggcattgcgaattcttttacctttccctgcttaaaatattgaaagcctcgtttgatcgtcacgtcattaaaatggtcagccacgttttgaataagctgttgccactgtatatcattcataagataggttggtttcatatgcattagtctcctaagagagaatagttgatcgggtagtagcttaactcttccattatatcagttcacgaatataaattgagtggagggagaattggaaaatttcgaagaatatccgccggataaaggcaaaaagcccccttactctatagcgtaaggagacttgagtcatcgggcaggaatggggggctatcctctactgtttcccatccggattctccactcggcggaagaccaaggagatgacaagaagtaccaaggggactgccgcgcatataataatgccaaagtaacctgttattttatcgaaattgcctatttcaataaaactttggggatacatgctcagggtaaataataaaattaacgggagataacagatatacttgttccacttttgggtgagttggctgattcccgttacaatatagaaataataattcgaggcggtcataaaaattttgatcgtccacaaaatgataaataatatttcaaatcgttccaggaatgcgccggggaattcaatttgctgtgcaaaagaaacgaccggccattgcaatcgggaaacttcttcaactgacatacagccaacgaccatcgttaccatcaagagatacaaacccattgcaatcgagtagccgatccagccagccttccacgccttttgtggattggccataacatttgttaatatgagcaccgattcaaaacccattgccgaaaaaggtacaaccttaagagattggaagatcgggccccatcctttatgaaaaacagggcgcaaattatcgatgtcaaaatgattgatattgaaaacgatcaacaataaaaaaacaataagggttaaaggaaaaaaaagctcgatcaatcgaaccattgcatggagaccaccccaggtcaaatacccaataagcagaagaaacggaaaaataatcatgcttattggcgttctctccaatgcaaggcccttgaggaattccgccatcattctgcatacaagcgagcagatcatcatgcaatatacaataaatgcgatattgatgatttggccgatgaatttacctgcgatcacaggattaaactcatagaacgtcttccctggaaatcgtcgacacaatttaacatggataaaaatgacgcctatcccaagcagacttgccagcaaaagtccctgccacacgtcgggcgtttgcgtctgctccgcaatggttcttggtaaactgacaatacccacagcatacacggtcgaagtgacggtaaataaggattgcagagtagatattttttcctgtttcatggaaggtatattggacattacgcgccctctccttttgtataagcacctgtccgttcgatctgtactttagcctgaacgtcgatcggtatttgactgaatgtatcttgccaattttcctttacccgatcccagtaatcgggatagttcacttttacttttgtgccaaaaccgactacatctgctctcatttctttctggagcgtgtttaacgatagggatactgtttgtctgatttcatcttgcgccgcttctttagcggtttggatgaatgattccttcaggaagtctacagaattatccgagctttcgtttagtttgatatctgctttaatacgaactgtgaatgagagatcctgcccgttgaggtgggggataagttttgtatggacatcttcgacttcaaacaccatggattgttccgattttgggccttcagttctaataattgaacccttcgtttttcccagcatccagttgatcccgataacatcctcttcgtctagccaataggcaaatttcttcgttttgccgctgaccaaagctgcgcctgagaagtggttgccttcattggtttctaggcattgaatgacgaagtcagatccttgtgaaatatgtgtagaaatttcccccaatgttattctatagggtattttggagttgaaatcgctatttttagccaatgcttcaaggtcaatggaaggtatctctttatgtttgccgatcttattgagcgcttctttcgcactgcctttaacgatcataacaagtgattttcgactcggtttataagagcgagtaaacgtatctaacaattggtcgattcttgttttttgtatagcttggtcactaatcaaaatcaagcgaataaaactatataaaggagcacgggataccagcttggcctgttcccttgaagcagattgaatggaatttttgttaaaggttgttacgttactatacatattttttctggatttctgcgctattaaatgctggtaggtaagctccagcatttcctgctcatctgtatcaatggcgacgccttgaatgatactcaagttatcgatctctctgctgtcccaacaaccagtgaggagagcacatgcgatccatacgacgacgcatttttgcacccgtagggttcgacgaaacagaaagatgtaagagatcatgggcttacttccttttcctgttagattgtgtttcgtccagtgtttttagcatcataggacgttttctgaggtatttaaaaggaacccggaccaaagtatcttgttgatctcttagccgaattggggctaggggtgacatgtaaggaactccaaagcttttgatctggaccatgtgtacgcctaagcaaataaaggctaaaatcacgccatacagcccataaatccctgcaatcatcataatggggaaacgaagaagccgtattccaatactcccgctgtactgcgggcttgcaaaggacgcaatggccgtaagaccaacgacaataatcagaaaagcacttacgaccgccgcctcgaccgctgcttgtccaatcacaagaccgcctacaataccgatgacttgtcctatgcctttaggtagtcgcagacttgcctcgcgtaatatttccaatgataactccatgattagagcttccacaaaaacgggaaaaggaattccctcccttgaggcaacgatagagatcaccagctcaggcgggattaatccaggatggaaagaaataagtgcaacgtacagcgaaggcaggaatgttgcaatgaatagagccattaaacgaagcatacgaaaaaatgttcctaaagggaaacgctcgtaataatcctctggggattgagccagcatccagaaggtcatgggagcaatcaggacaaaaggagtgccatcaagcataatgacaactcttccggacattaaagcatttatagctttatccgagcgttcagaggcttgaatctgtgggaacggagaccatgaatgttcctcaatccattgctcaataatcccggtatcggaagcatcgtccacatcaatcgtttcgactctttgtttaacttcctgaactagctctggatttgcgatatctgatatgtacaagatcgctaatttccgtgaagatctccttcctatggtcattttatctattttgaaacttagatctttgatatgccgccttaccattgccaagttgctttccaaatcttcaataaaaccttctctcggccctctcaccaaagtttcggtgctcggttcatcgacacttcgcgaaggaaactggcccgtagaagcaaaaaaaacttcatcggtcccttcgatcagcagacaagtatttcccgataacacttcaattacacatgtctcaaggtctgccccttctttcgtaccgatcgtaaatgccgtctgctgtatcagttcctcctttattttctctagattaacttgggagtggttttcacggattccagtcaaaatgagtggcttaacgatttgttcgttaattatgcccgtattcgcaataccggagagataaaccatcactacatgaattcccgtttgtcccacgtccatttttttgaagacgacatcaggaagatgacccagggtcttttttagatggtccaatttctcctcgagtgatctcgccatgactcgtcctccttcaaaagcttaaatcaacgatatacatgtaatatgtgtaaaatggtaatatatattcatgaaatggtaatttagcgtgttcgacgatggaggagctgaagacgcgagagacagagggagtttttttgagtatatgtaaacaaaaacgaacaccagtggtgtccgtcgttgtcatacatatgaggcgaggatactctatccccgagataacgtcatataaactattccaagtggaggtcactttttgaactcgtagaaatgtgcctccaacatgctcagagaaagctcggcagtagtggctactacgatatccgcaccttgcattagcgaaggtgttcctacaccgaccgcgaacatcccggcgcctttgatcgcctgtatgccagcctgtgcgtcctctataccgatacagtcggcaggctgaacgcccagatttgcggctccggtgaggaaaatttccgggtcaggtttgccatgccgaatggcggtaacatccaccacactgtcaaaatagtacgctagctccagtcgctccaggataaatgctgcatttttgcttgcagaggccagcgcgatgccgattcgggcttcacgaagctctgtcagaagcgctttaatgcctggaagaatgtccgagggagttacagctgagatgagccgctgatactccgtatttttccgtgtggccagttcttgcttgccttcttctgaaaacgtatcggacaggttaccgcgcgccagtattttgtcgagcgattccgtacggctgattccttttaactgttcattaaattcccgatcaaaagggatgctaagcgctgccgccaagctgccccatgcctgaaaatgatattcggcggtatctgtaatgactccgtccagatcaaaaatgactgctttcatttggtttcccccctgtctgcccgatttatgaaacgctgttcgtcattaacgactgtccactggtaatgtgcgttggctctccatacagctccagcgtcagcggttctccgtccaacagggtaatgatcacttcattttcctgtacgagaatacttaacaagcgaccgcgatagttgattttaaacgtatatttgttccagccttgaggcaggaagggggagaagcttaatgtttcacgatacgttctcatcccggcaaatccctgtacaatcgccagccagcttcctgtcatggaagtgatatgaagtccgtcttcggtatcgttattgtagttatccagatccagacgggccgtccgcttatacatctcgactgccttttcctccattttgagttcggcagccagcacggcatgaatggacggggacagactggattcatgaacagtcattggctcgtaaaatgcaaaattgcgcgctttttcttccagcgtgaactggtctccaaagaaatacagcccttgcagcacatctgcctgcttaatgaagcaggaacgaaggattttatcccatgaccatttctgatttaatggaaggttgctgggatcaagggaggatacaggctgcaaatccttatccataaaggtatcgtgctgtacgaagacttcccgctcctcatcatagggataatacatgtgagtgatgatatcctgccaatgggcaagctcatcagccgtaaccgctagatgcatcgatttttctgctgaaatttgaggtaagaccgataaggtatatttcaaaacccatgcagccagcgtattggtataccagttgttattgacgttattttcgtattcgttcggcccggtaaccccgtggatcatatactgctgctggcttttggaaaagtgaacccggtcggcccagaagcggctaatttcgaccagtacatctatgccgtattgatgaaggtaggaggagtcccccgtatagttggtgtaattgtaaatggcatacgcaatggccccgttacggtggatttcctcaaaggtaatctcccattcgttatggcactccacacctgtaaaagtgaccatagggtatagtgcaccccgtagcccttgctgggctgcgttatgcttggcaccctctagttgttggtgacggtacagcagcagatttcgggttacatccgggtctgcaagcgccaggtacataggcacggcatatgcttcagtgtcccaataggtggcaccgccatatttttcacctgtaaagcccttgggaccaatgttcagacgggcatcttcgccgtagtacgtagagaacagttgaaaaatgttaaagcgtattccctgctgggcctctgtatctccctcgatttctacatcggctttgtcccaacgtcgagcccaagctgcgacatgctcctgcttgagcgaagtatagcctttgttcacagcctccacagcgatgcgttcagcttgtggaatcagtgcatccttttccatatcccgtgaggtggtaaccgccacaattttttgcagctggatactgtcgcccggagcgacgctgtattgatagtggcgtgcagcatacaaaaagctctcttccgtcgtctgcagatcctgtccctcggtcacaatacccatggtagcgtttacggtaaaacgcggaataccgaagggattatctatagttgttgtggacaggctgatgaattgttcttgaacctctcgggcctcctccaaccaaaaaacctcatcatagttcgtatcttcattcttcgtattgccgtccaaataagggacaagctctatagttagaggctgctcgcttatattcgttgcttggtaatcaatcaggcatagctcacgagtggtgatgctcagaaaacgctccgtagtgatacgaacctgattgttcacggtgcaggtgcgtcgcaggataccctgtttcatgtccaactcctgcacaaaatcgctgatgtgtgccgtaaataagtctacttcctcttggtttacgatcagatggatgccgatgaagttcatggcattgatgaccttaccaaaatattcaggatagccatttttccaccagccgacctttgttttgtcggggaaccatacaccggagatatacgttccctgatgatgatcacctgaataagcttcttcaaaattgccgcgcatgcccatataaccgttgcctatggacgttatgctttcctgtaatcgcatgtgtgtgctatgtagagtgtgtgttgtcagcttccagctatctacgtcaaataatcggttgtaaaccatgattgcgtacccctctcggaaaatgagatcgttgttttaacgaaaccagtatatgagcgagtttagtatatagtgcaaccgtttgccctgtcaacgcaaaaaaactgattttatgggtttccacaaaatcagttcttgttcattccgctaagaatcatagtaattggctggatttgcgctccacaattcggtggggaacaatgatgtgcttggtcaattccttggggtcctcgattttttcaatcaggcttttggctgcctgataacctagagtgaagatatcaatatccacggaagtcagagggggattcatcagctcagctagcattagattattgaagctcaccatggataactgctctggcatggacacgcctagctgagaaagcattttctgtactgccatggctacaaggtcgtcgctaacgatcatcgcggtaggcggcggggtggcctgcaataatgtgcgcatgtcctccagattaaatggctccctgaccacgtattccttgggtaaaggcaagcccgcctctcgcaacgcatcctgatagcctcggagtctttcaatattcacgatgtgttcatgatcaccgccaacataagcaatgtgctgatgattcagcccagtcaaataagtgaccacatccttggcagcctggtagttatcgttatctacatgggtagtttcactgacaaattgctgaggcttaccgattacggtgtaaggtattttttctttatgaaggtactccacaatgctatctttttgcttggagtacagaacaatatagccgtcaacacgcccggtccgggtcatcagcttcacgcgggatagcaattcatcgctcgtttttcctgtgacaatggacagtgtatagttgtgctcatttacccattcgctgatcccacgaaggctttccggaaagaacgggttttgaaagattgccacatccgattcaggcataatgatgccaattgactgtgtgacacggttagccagactctgagctgaatagttgggttcatagccaagcgccttcatttctttacggacacgtgccttggtcgcttcgctgattttggggctgtcttgaatgacacgggatacggtggaagtagcaacattagcacgttttgcgacatctttgatggttactgccatcgtcttcgtctccttttgctatctcaagcaggaaatattatgttctatcatacgatattgctcgaaaatcaacaaattagcggctttttcgagtatttctatgatcattagccaagatatttacaattagggtattgccaatagaaagcgatatcattataataattgtgcaaccgattgcataatgtttatagggtacaaacaacgctgtacatactataagggatggggattgaaggagcatgaaaaaacttctatcatttgatttttggcaaaagctcgggaaagcactgctagtggttgttgctgttatgccggcagccgggattatgatttcgcttggtaaagtagtggcgatgttggctggtgatatccatttctggttgaccgtcggcggggttatggagaatttgggttggggtattatcaataatttacacatactgtttgccgtggcgattggtggttcctgggctaaggaacgggcgggcggagcttttgcggccttaattgcctttattctcattaatatttcaacaggaacgattttgggtgtgtcctcgaaaatgctaacccaggagggtgccaccacccacactctttttggtgcatccattccggttagtggctattttacctctgtcttaggggcacctgcacttaatatgggtgtgtttgtcggtatcatctccggctttgtcggagccgtggtatttaacaagtactacaattaccgcaagctgccagacgctttagccttttttaacggcaaacgttttgttccttttgtcgtgattttatggtctgtcatcgtaagtttgatcatgtctgccatctggccatttgttcaggggggaattaatcagttcggtatttggttagcgacctcaggggagtcggctccttttgtagcgccatttgtctatggtacactggaaagactattaattccttttggacttcaccatatgctgaccgttcctattaactatactcaacttggtggcgtttacacgacacttacgggttccggggcaggaagcgtcgttgccgggcaagacccgctgtggctggcttgggcaagtgacctaagtgcgcttcgtggtactgatccgacagcctacaatagcttgttggaaggcgtgacgcctgcccgcttcaaggtaggacaaatgatcggtggagcaggaatccttatgggactagcggtggctatgtatcgccgtgtagacaaagataaacgcagcaagtacaagtcgatgatcttttcggcagccgcagctgtctttttaacaggggtaacggagccactggaattcatgtttatgttcgtggcgcctgtgctgtatgtggtttatgctattcttaccggtattgcgttcggaatggccgacatcatacatttgcgtttacattcgtttggtatgattgaactgctgacccgaatgccgttgtctataaatgcgggtttggtgcaggatattattaacttcgtgctgacttgtgtggtgtttgctgtagcaacctactttatcgcgtattttatgatcggtaaattcaaaatggctacgccgggaagactggggaactatacggatgaggagcctcaagggacttccgtggcggggagtacaaagacagagggtgtggcagctgtttccactcaaaatcaactggctacggatatcatcaagacgcttgggggtgagcagaacattgtcgaggtggacgcttgcatgacccgtctgcgtgtgacggtgaaggatacggatgccgttggagatgaaaagacgtggaaagcgttgggtgccttgggcttgataaaagtagacaatggggtgcaggcggtttacggaccgaaggccgatgtgcttaaatcagatatacaagacatactcaacaggtgattactttgaagttgttaaccttaaatgcacatgcttggatggaagaaaaccagcatgataagctaaagcagctggctgcttttattgatgaacagcagtttgatgtcattgctttgcaggaagtgaaccagtccatggaagagactcctttgtcgccggacgatttgggcgcttattatagcgcagatcctgaagttgtcattaagcgtgataactatgcttatgtgctgaacgggctattgtccgatgcttatcagtggacgtgggctcccgcacatgttggttttgccaaatacgacgagggtttggctattctgtccaaaacaccgattacagctacggtgaacgaatatgtttcctcgctacaggattatgacaactaccgttcacgtaaaattgtcggcgttcaaactgtggtggacggggtgcaggcctggtttgtaagtggacattataactggtggaatgatgaagaatccttccgtggactatgggatcgtacaacaaaagtgctaaattcttttgctccgactcctgtgtttatgatgggtgatttcaacaacgcggctgaagtgcgtggagaaggatatgactatgtactgcaatcgggctggtcggacacctatccgaatgcagcagtacgtgatgaaggccacacggtgattaaagctattgctggttgggaaagtaatgcggagccgctccgtattgactttatcttctccaataaggctgcacaggttcaatcctcaaccgttgtactgaacgggaaaactggaccagttgtatcggatcattttggggttgcagttgagttggagctgtgagaaagaaaggaggccagttgcttatgcaattggcctttttcttatagatttcgacttgaaacgaatgacatattggataactatagcgatcaacaccaaaatcaaattgtagtaaaagggagtgttgatgctaaaccgttccatgagtgcacctgcgatgatcggagacacaatggcccccaattcggacaaagatacgacgttgccgataaatgagcttctattctcctcaggaataacatcccctagttgcgagtaaaaggaatccagatagctggctcctcctatacctccgatgaacatccctaagtatacgatccacggttctgtgaaccaaagaaataagatgatttccaccatgatcaacaatagaccgatgatacaaagcatcaagcgatccttaagtagatcagatagtttgccaataaagggggctgatatgaaggtcgatatgccgataatggtaaaagctaagctgatttctgcagggctccaatggagtttgtaggttgcatatacagagaagtacgttaaaaatatagcgaatgcactcatttcaaggaaatgaacggtggaatagagcagtagctgtttcgttagcatggtttttcttttcgactcatgaaggggtgcgtgctgttgctgaggtttggaagagagactggggaaggtcattctggagacggcaacgaaggatatacatgagaaaatagcaacgaaataaaacggaatggataaagaaaaataagaaacaatagctccactcataagaggccctaaaatcataccggcaccttcactgctgctgatatatccattgagcatgcctcgattatctgcggtgctcatatggttgatcgtgactcttacaaagacggttagccctatggctaccaagccttggaggagtctcagtatggctagaatgatgaagcttgttgcaatcggaaacaggagcatacaagcgatttcggcaatgagcaagctcaaccccaagcgttttgcgccaatcttttcataaattcgtcctgccaagcctccaccaagaaatctacctacataaaatagagaaaataaaatgctcatgccgagtacggatatcccgaattgctctacataaatagcaaagagtggaaggatcatacttccactcatgttagcaataaggctgatcacgatcatacaggcgatattacgatttaaatataagtgtctcaccataacctcgaaacctctctttggtcttgcatcatgggaaccgttattcggattgcacctgattacgggtaaacggcttcaggtcgagttagcgggttcccatatagggtacgcaagcgagttcctcgcggtgcctaaatcccattgcaatgatggaggtatgaagcagcggatggaggaatcttgattagagcgtggtgttgcctttaggctggaaagccgcctcctggtggtggccaagctccataaatccggcgtagcagcacgatttcacccaaatgatatgaattgtgggaagcgatattccgcagcagtcctgctttcgtttcacctgggaaatgagctagtgagtcatccagttgcgcggtttcggcaatctgtacagcctgatctacgccctgtaaaaattcgttaatgacagcctgccatgcctcttcgctttgcggtccggtctcttcgggccagctttccatggcattgcccggaagctggggcttccgtccttccaaatgctccagcatgaactgctgccagtaaatcatatgcttcagcagttgataaatgctgtaaggcatttctgcatttttcttccctgcgagctcgacgtcgatgtctggtaaagcccgagctactcgaatatgtccacgttccccgaccagtgatttaaccagtgcttgaccgaataattggtttgcatccgacatgtatcatcatcccttctatggagaacttatttctagcttattctcattttacgattatacaattatattttccaaaatgaaaatatccatgtagtaagaagagaaacagaaataatttttaaaaacagttgataataattctcaattgcactaaaataaaattgtttcaaaggaaacaaagtatcaataatagatatattttgtatatatacggaaatgttaaaggggagctttccgtaatgcatatattgttttctttgaaacaaaaatgggctataatgaaaggaggagtatgccaaaggagtgaccattttttcgtatggagaaagcgacaccagttcagcatgtttatgatttgctcattaagatgaatcaccagctggagcagcatcagcagagagagagcatgactattctcgaagaaatacacgagcattttgatggaattgcttcactcaatctgacggatgtgcacgtcattgactgtattgggaggcatgagccgattaatgttacgacattagcggatcgaattgagctgagcaagggtacagtttcgaaagtcagcaccaagctgctcaaggaaggctggattcgcagaacccagcttaacgacaacaagaaagaaatctattttcggttaaccccgtcagggaaaagactctttcttatgcatgaacgactgcatgttaaggcacagcatcagttatttcaatttttaaatcgttatagctcggaagaactgaatgtcttgaaacgtctgctgtccgatggtgtagatctcttggaagctatggagtggcaggacaagagtctggactaaagggatatcgaatcatcaacgatgggcacctgttaatctccaagtaatagatacatggggagatgcaggtgcttttcttttaatgtaatagccgttttgcttccatatagagcacctgtacgaattttttcgtattaatgcgggcttgggacagtgaaggctccacattgttttgcagctccagcatttttttgcggatttctgtaaaatcaaaaaatttggatgcataattttcaaatttaggatgggtatagtcagtcaatccgagcgatactatatggcttagcgtctggaaaatagcacggcggacacgttgctccgatgctttgatttccttactcagctctactgctgaagctgaagcccctaaccgtttggacgctacattagcaaatatatccttcaacggtgggaacagatagggagatagattgcctgtttcctcctcatactggtccagaaattccagcatgtccagtaaatccatactcccggcttcgccgatcatccccatttcggagagcagaaactgcccggaagttacgatgtttcgggtcggttcaattgttgccgttgggttattcgttgtgaacatcgacaacccttgaagcgtgcgttgaatatccgtaatcgactgctgcatgcgcagacgctcagccaccttatgaataactgcaataatctccagtcgattcaaaggcttggccacataatattcaataccgagcgagtaagcctccccgatcatgtttttggattcgatgcgagaaatcataatgattttgccgctgaattgatcgccgagtgcacgcacggtctgaatgccgtcacgaagcggcatcagcaagtcaatcagcaatacatcaatccggttcagctccaggaggccgctattcacgtaggtaccatcctctgcttccccgatgacttctcctagaccctcgtcttcaataatgtctgccagcatagaacgaattccctgatcgtcatccacaatataaaaacgcatcggggctatcttcctttctccgtcagtttccgtaaaggcaatgtaattctaaaagtggtctgtaatttatctgtattctcttcttcatcctgttgcagttcaatcgttcctccaaggctctccgcgacctcacgtacataaaacaatcccataccggtcgacggctgtccttcctcatcatacttggtcgtataccctggtgtgaagaccatttcccgtttccgttgaggaatccccggaccgttgtcggtaacactaaaggaagctatatcctcttttcccggtagacagcgaatggaaacgtcaatccttccgttgtccttcattgcttcaaccgcattggctgtcaggttattaataagtgtcaaaacggtataaacatgcagcttgggtaacaatggatcgacatctagggtaaaacgaatagacttgtccagcgattgtgcgtatttgctgttcgttcgaatgattagctccccaagctcttgagaagccatgtaatgcactccgctttcggcatcaatcagcttggacaaaccagcaaaaatccgctggctgtcttttttgatctcgtgaacctgtccggaaatacgaagtgcctgtctggcgtaatgttctctatccttcagagattcatcctgctgcaactcacggtacagctcgtagctttcacgagtgatttgttctgcatgtgacagcgttttgcctaactggaccgactcctcatacaagtccgatacaaggagtaaaattcgctccgtctgctgcctttgtgcctcttcatgctggaccgattgatttaaccgaatcatattataaaacccaagcacgaagaagctgcggatcatagccatgaaagctactttgctgatcttaatgatgtcccagaaatcgccgtccatgctccaccggacgctaagttccgacacacttgcggcaacctcaatccctacagagaggatgcccacacggagtgcacggtaaggctcagcattaatgttaaggacctggaagagcaggccgtagaccatgtaataaaaaaaggtagggccgtgcagtgtcagcaactcttcgaagggaaggccgggctgagtgtaatgattgagtaagatgcgaaaggcgactaccgctatccctgcaagcactcccgataatgcaggcggaatatgacgaatagataacagaaagaaaaaaaatacaggcgtaccaaagctgagacggaatgtattagcgaacgggtgaatattcagctcacctgcgagcggtacaaatacaagcatgagcaggaaaaggagcgtattcaacttcatccatattcacctcctgggtattcagtcagaaaggcaatgtgagctaaattcacaggctcgccgttaaagtttgtgaatttatagaaaaaaataaatgcagctgtagataattgtcgttttttatagatcagattgtagtataaataacatcatttgaatattaagaacagcatactgcaaaaatatacaaatcagccaggggggacacgaagtgaaaaagattaatttgacgatgcaaatctttatcggtctggctttaggtattattattggtgccttattttacggcaattcaggggtggaagtctacttaaagccaatcggtgatattttcatccgcttgatcaagatgattgtcgtgcctattgtgatctcaacgctcattatcggcgtagccggcgtcggagatatgaagaaactgggtaaactcggcggaaagtctattctgtactttgagattgtaacgacaatcgccatccttttcggactgcttgttgccaacttggttcgaccgggtgacggcgtggacatgtcccacctggccaagagtgatatccattcctatgtagagactgcagagaagtcaggccatagctttatagatacgattgtgcatattgttcctaccaatgttattcacgccctgggcgagggagatatgctggctattatattcttctccgtactgtttggattaggggtagcggcgattggtgacaaaggcaagcctgtgctgaatttctttgaaggtgtagccgacgccatgttctgggtaaccaatcaggtcatgcgcctggctccgttcggtgtatttgccctgattggaacgacagtggccaagtttggattggcctcgttatggcctttattgaagcttgttttgtcggtgtacggctccatgatactgttcattgtgattgtttttggaattatcgccaagctttgcggtacccgcctctggaccatggttaaaattttgaaaagtgagctgttgcttgcatattcgacggccagttcggaaagtgttttgcctaagatcatggagaagatggagaagttcggatgtcctaaaggaattacgtcctttgtcattccgattgggtattcttttaatctggacggttccaccctgtatcaggcactggctgcgatttttattgcccaaatgtacggaattgacctgccaatcacgacacaaatcacgctggtgctagttttgattatttcctccaaaggtattgcaggggtgccaggtgcttcctttgtcgttttgctcgctacacttggagcagtgaacctcccgctggaggggttggcttttattgctggtattgatcgcattctggatatggctcgtacggtagtcaatgtattaggcaactcgcttgccgctgtggtcatgtccaaatgggaaggccaatatgataaagaaaagggcgaggaatacgttgcttcaattaaataagatgtaacgaactgaatagttgccagaaagagcacttttgcgaagtaatgcgaaggtgttcttttcatttccagacttattaagacctttcctttttcgacatttttcgatgttttttgtatgaatatataggtatatggacataaaaacgattcttattacctatgcaattttagatttatttataatgattcttaataaaattccgatattaaactatatcgttttatatattggcttagaagggaagagcatatatgtttcttaaaaaaaatgagacccactcacttgctcctttagtagaagaaagccgcaaactttcacaaagaatacagcagaaggattattctgccgcaatacaagtttcatccaaatcttccgagattcaagaaatcgcaaacaatgtaaaccaagcgcttgaatccatgaaaaatgatgctcaacatgttgacatccgtctgaagcttgttaccaaggctatagagattggcttatgggacatggaggtggttgcgggtgatcccgtcaatccaaataatacgtttacatggtcagaagaatttcgtgctatgctggggtatcagagcgaaaaggacttccccaatgtattaaacagctgggcatcccggctgcaccccgaagatcatgacagagcattgaccgaattgtcggatcatttgctggattttacgggaaagacgccttatgacgtacagtatcgtttgaagctgaagcatggagaataccgctggttccgggctaccggaacgacgatccgcgatcagcagggagtgccgcttcggattgcgggcgctctattggatgtgcacgaccagaagattaagtctgaagagttggaggccatggttacaagatacgatctcattaaccttgtgctggtagaggctccttacgatgtaaacattattggaggaaatatagaaaatccggataatacattttggtggtcaccgcaattccgcgcaacgctaggctttaaggacgagcaagatttcccaagcaagcttagcagttgggcttcaatcctgtatcctgaggatgccgaaatggcgattaagattttgaatgatcatttaaatgattatacgggacgcacaccgtacgaaatggaatgccgtttagtgcgtaagaatggcgagcatcggtggtattattgcagtggaaaaagcatacgcgatagcaagggagtgcctattcgtattgcgggtaccattcgtgatattactgtcgaaaaggaaaagcaggctgtcgcggatgagctgacgctcaagatccagcatctctccgattccattacggaaatggtgaacggcgttaactcggttagtaaccaggcgcaggagctggctacggctcaggagcaatcgacagaggcagcgaatcaagccaaagtcagtgcagaagagacgcaaaacatttccaacttcattaaagagattgcgaatcaaacgaatctgctgggtctgaatgccgccattgaggcatcgcgtgcgggcgagcaggggcggggttttgcagtagtagcagatgaagtgagaaaactcgccatacacagtgctgatgcgaccggaaatatcgagactagtctggacgaaatgaagacactcatcgagcggattttgcacaatatcggtaatatgtctacgctgacacaaacacaagccgcgctaacgcaacaagtaaatgcatctacagacgagatcaacagcatgtccaaagctttgttggattttgcaagaacgatgtaaggcttcatgtagaaatgagaccgggccttaggctcggtctctttactgtttttggaagatgaactatacttttcggggatagatctaaaaatcacctcatagtaactttatgtggaaaagaggaatatacgtgagcttacttagttcaatattggtcggaattgtagctctggagcatgtgtacattctaatattggaaatgtttctgtggacgactccgcgggcgatgcggacgttcggcacctcgaaggagctggcggaagcaagcaaatccttggctgcaaatcaggggctgtacaacggctttttggcagccggattggtgtggggcttgttctatccggatactgtgttcgggcggcaaatccaattattctttgtcatttgtgtggtagtggctgcgttgtatggtgcattaactgccaataagtctattttattaaagcaaggcctgcctgccatcctggcactaatcagtttgtggatactctgaagacacccttaacgggtgtcttcagattgtcgagaaaccccgtctttttgagacgtgggtttctttttctttacatcataaggctctggtctctggagaaacaggggggttacccctgtttctccaggcgatccaggtggatcgccatcttcttcatgttctgcacggctgccgtcataagggcttgttccctgacgtttggtagaccgcgcaaacggcaatagcgaaacccatggagctctttggcatccgcgaagcttcgctcaatcgtctcttttcgtttgcggtacagccgtttcccggatgggcttagccggttgctccgtacccactctttgctgtcttcccagacatgccgagtcaccactttgcggtggtttcgagactgggtacactgctctagcagtgggcaatgctggcactgagctgggtcagaggcatactgccggtatcccttacggtccgtcgttcggtagggcagttcctgttgggctgggcatctatacacattgcgtttggcatcgtattcaaacttccatttcggaaacagcccttgtctgggatggaatcttcggtgagcaatcacggcaaaaatctttcggttttgcaaacctcggcaaatcggcgtcgttaaataacctgaatctagcgcaacagcttctacttgaaaatcaaagcgttctctttgtcgatccaaacgggacaaataggggacagaatcatgtacattccccggcgtcacatgtacatccgtaatcagattgtacttcatatccactgtgcggtggtccagatagaagaagccttcaggcttgccatcacggatcatatagccgctgtccgggtctgttttgctcactttaatttctttttcttcgttcacttcctctcgggatttcaaggcttttttccgtggcttttccggtcctccttcaccgcttcgttaagctcgtccatatagtctttggtattctgcaacacttgttctttggtgtactggtgcctgttagcattggctttgacgtgtgtggaatcggtgacgagaacacgcccacccaccattcggtgagagatcgcctgcagcacaatttcatcgaagatatcttgaaagatcgtggtgtctttaaagcgagtgcgacgattccagctaatcgtcgtatggtctggaactttatccgttaagccgagccccaagaaccagcgataagccaggttcgtctgaatttcacgctcgagttgccgctctgagcgaatgccatagaaataaccgagaaagatcattttaaacaacacggtaggatcaatggcaggacgcccgttgtccgcacaatacagcgggcttaccttctcatgaataaaggagaagtctatatatgtatccactttacgaagcagatgatcttgcggtaccagttcttccagagaaaccaattcaaaagattgttgtttgtctcgatgaggtcgcagcatatcaacaccgtccgttctacaatagttacctgtattatacaacattaacgcggtgtctccttaaataaaatgaacataaaaaaagctgtcgagactttctcgacagcctgaagacacccttaatggtattatccccttctagt

SEQ ID NO: 2668 - DNA, 41661 bp, Unknown
  Kingdom: Bacteria, Phylum: Firmicutes, Class: Bacilli, Order: Bacillales, Family: Paenibacillaceae, Genus: Paenibacillus
cgttctacctcgaagatctcatctgtacaacgactgcaatcgttgtacagaccgttcgagactacgtcacctactataactcaattcggattcaaacgaaactaaataaccagtcgccggtagattacaggcgactggctgcttaaacttgaaaggtgttttgatccctgtctcacaaacgggggtcagtccctaaatggtcggcagggctttttagtcttacattgattctgtacttcttgattatgaccggctatgattttatgccttatgataagctgccttattcgaattttaagtatatattttttgtttcatttttatggtcagtgtcaccaattagcaatctttaatgttgggacagctcgtctgctacttgtttatttatctgaagttttatggtctaagtcatgatgtaattcggttgctggtattttggcactatagatttgacctttggcaacagggttagagatgtatacatagctcccgcttccatccggcgcacttcctgttgcccacaaaccttcactagattcttcgccttcagacaaattccaaaactcataagcttcaggctgagactcttgctctgcttcaggaggaaaagaagcggggaccacaacaccgtttttttcttccaattcttggattgccgccatccattgatattggtgatagcggtcacgtgctagcattttccgtagtgtagctctgacgctttcatcttgtgccatatgatatagccttgctacctgcaaccgaccctgactctctgcgtgcaaattggaccgcatatccgccaataggttgccacttgcgacgatataagagccgttccatggaactccatttgaattactaggtaatccaccaagaccgctgaccagcaagtgctgcgggttaattccccccataatggcagccgtaacagggtcttttgcagcttgttcttgatcttctggtttagctccatcaagtagttgactaattaaagcacacagcatctccacatgccccacttcttcagttccaatgtccattagcatatctttatatttttcctcaccgcgacagttaaacccttgaaataaatattgcatcatcacggtcatttctccaaattgcccccccaaaacttcttgtacctgccgggcaaaaagaggatcaggacgctccactttcacttcaaactgcaactctttttgatgtctaaacataattactcctcctatagttaagcagcttagtaaattctaactgtatttaaccttttcaagatgtaataaaacgaggatcagcataacaacaatctgataggagtctttacatttaactatctgtttgtttggtttgtataaaaattattaaggagggaagcatatgttcacgttttaaaaaaagtttaaggaggtttttttacattgtatttttataaagaagatctaattaacataatagtacccgataagcccgacccggctgctgctaaagtgattcaagaagtattaggtggtcgattcggagaaatgcgtaccatgatgcagtttttgtttcaaagtaataattttcgtggtaatgctgtgcagtttagggatttgatacgcggagtttttctagaggagcttagtcatgttgaactggtccaacatactattaatcaacttctgactggctcaggcgcagaccaagccggcgatgctggaattgatcatgctcctttagatgaggcgataaaacacgcaaatcctcatcattttattatgggagctcaaagttccttacctgttgatgcaagtggaaacccttggctaggtagttatgtttattcccacggcaatctgattagtgatttgcttgataatctcgtactcgaatctacaggggttctgcaaaaatcccgaatttacgaaatgagctcgaacaaaacattccgggaaacgttggcttttttgattgtgcgggataatgctcatcaaaatgcatttgctaaagctttagagacacttggagttgattggggaaaattgttcccggttccaaactacgatattaacaagtatccagaatgccggaagtatgttgaaatgggctttcacaatgcacagtttaattttcgattggattctacccgtattggagaaatattcaatgggcaaactccaagcagaaacggtggggatttgagtgtggtggatcctccagaaggttttcctcttccgtatatgcctgaattgcctaatgaacatagcccaggtctgcatgatcttaacacttaggtttaaacaaataagtaaggatgtaactaggttaatgtccgtaacataaaaagaggctgtccttcgtaaagaacctacgaatcaaggacagtctctttttttattcgcgtagcctgtaattcggcataacatttcgttctaccgaagtaacgccgggaggcagtagtagcggatcaggattccaaataaatttcatcaatggatacatggcgttctctagacaaatctacatattcatcatcgttaattctcactaagggtctgaagtaatcagcagaattgttcagaataatcgttcctgtctgacctgtagtcagcagaacctgcttattaatgaaattaggaagcatgtgtctgatgaacacttgggtagcttctgggtttagatgtccaaaactcatgctgtgcagctcacgtaatacggtgagcagttcctgcttcgtctggtacacacgattggaaatcatcgcgctatacacgtcggcaatagctgttatgctggcaaaaggatgaatatcttccttgaacagtccatggggatatccacttccatcttcacgctcgtgatgctgcaaggcgacaattgcagaaatctcatcgctggttgaattgcggataatatcatagccatatagcgaatgttttttcatctcatggaattcttcgggtgtcagtttatccggtttgttcaaaatttcatccggtatcatggacttgcctatatcatgtaagtacccagctttaccagcggcatatgcttcttcttccgtatatccaagccatgtggcaatgtaatatgacagtacacctacttggagagaatgattataggtatagtgatctccccgttccataattaatagcagagatacgacatctttttgacgagccagctctgaaacaagagggccgaacagctcatcgactcgatattcatcaaattttccagttgaggaggctttgagaaacatgctttcaaagccactgatcgtctgctccatgagaggaacggcacgtttgagggactcgggggaagctgggacatcgggggcaaagtcaaccggaatgctcgctgaaccggcatcaatgtcgatataatcgacaccgtgcataatgagtttggaaatatcgtcatgctgtagctcggtgccctgaatcatgacaggtacaccgtgcccattgtatgtatcggatttgaggcgatctcccggcttggcatcggtaacgtgtactctcatgcgctaacctccttattgtcgtaaatttgtcgaaaatacgaaacaaacttaatatatcaagaattaaatggtatgacaacgactaatttactattattccaagctgtaaaataggtcccaggaacccgtttcctatcagatacctacagtagataacgtcaatactttttactatgtttatgatatgagattgcccagagactacagcgaagcttaaggactatgtccactcatatgtaccatattgctaaataacatggtatgcttaaacattagaagctccaaagtcgatatatataaagtatagaggagggcggttatggagatgacgactcggcaaacgttgaccattttgcataccaatgatatccatagtcattttggcagtatgccttcgatagccgcgatgatcgatgaacgaagagccgcatcacgggatgcgctgcttgtgctcgacataggagaccacatggaccggatggcccccgaaacggaaggaacgctcggtggggcaaatgtggatgtgattaatctaacaggatacgatgcaattacgatcggtaacaatgagggactgacttttaccccggatatgattgaacaggcatatgcggggattcattgtccggtcgtatgcggcaatatgacagagcgtgccacggggatgaacccttcgtggatgaaggaatcccttatcgtagataaagcaggaatcaaggtcggtttacttggtgtgacggctccttttgtagagttttatcaattgctgggttgggatgtgctcaatccgtttgaggtgctggggaagcagatcgcggcactgagaaagcaggttgatgttttggtcttgatgtcgcacctgggtctaccttccgataaaaaattagcgtcgcagtttcctgaaattgacgttatccttggaggtcacacccatcatgtgctggaggaaccgctttggatcggaaaaacagctttatgtggggcgggtaagttcggaacgctgctgggtgaagtgacactaagtcgtaacgatagcctcgaaccgtttcgagtcacgtcgggcggcgtagttcctgtggatcagacactactggacgaaaaagtggcatcggccattgtggtgcatcgcagacaagcagagcgcgccatggagaacaccgttgcggtgacggatcggaaactggagatcgcatatgatcaggaatcccctttcgggaatatgctggcacaagcggtgtcccattttacaggaacagaaattgccctcgtcaatgcgggacaactgctcggcccattacctcaaggggatatcagcaaaggaatactacattccttatgcccttcgccgattaatgcctgtgttatgaagttgcggggaagagatattcggttggcgctggagcagtccttgctgcctgaatttacagacaagcccatgacgggttttggcttcagaggcaaagtgcttggcacgatgtgtgtggaaggcttggccattcagtatgaccctggccgtgctccttatgaaaaagtgacggacattcgtgtagcgggtcaacctttggaagagcatgaggaatacacagtgggcacgttggatatgttcactttcaaagcaggttatgaggtgcttgcgaacggaacagatctccgatttatgcttccagaatttttacgggatatgattgaaatggagttgaagcgtccgggcgcgatggaagaatgttttgtagctaggtggcttcaggtatcaaaacaatcgggagaggattaagctgcgactggtacctgttacattattgagagccggcatgaagctgggcaaaaaaatatacaatgaaaacggaatggtgctgctctcggaaggtgttgagcttacttcgcgattgattgaacgtctaggccaagtcggtattggatatgtatacattgaggatgctgtgactgaagatatcgtcattcctgagatgatccatgaacagacaagggccgcggcgctacaggaaatcaaaaagcagtttcaaggtttatcatcctactccgtagatcataagcacaaatattttggcaagtcattttataaggtgatggaatccattctggacgatattggaggccgtcaggacgccgtcattatgttgatggatatcggggccgcggatcaggatttgtatcatcattctttgaacgtatgtttatattcactagtacttgggatatccaatggctacgataataaccagctcatggagctggggataggttcactactgcacgatattggtaaaatgaaaatttcacctcaagtactctataagccgggtaaattgacggatgaggaatatgagcatatgaaaacacacacggtgatcggctacaagctgctcaaagacgaacctggcattcccttattgtcggctcattgtgcattacagcaccatgagcgtatcgacggcagtggatacccacacggttggaaaaaggaccagatccacgaatatgcgaaatggatcggtctggccgactcgtacgacgcaatgacagcaagtcggatatacaaacaggctttgttgccctatgaagcgatggaagtgctgtacgccggggcaggaacgttatatgagcagcgaatgctggaagcctttcgtgactgtgtagctatttaccccctgggactctctgtggtgctcaacacgggggaagagggggtcgtggtgcgtatacatcccaaaatcccgcaaagacccgtcattcgcattgtaagagaccgggatgggcaggaagtgaaggcaccttatgatgtggatttgtccgtatccctctcggttatgattacaaacacattgggtgctactgtcgcccctttcggaggagtacacgtagattagcagatgatgtggaagaaagtatgcagacactttacacatcatgatatgataattatacgtcttttgaggttaataacagaaataaggtgaaaacataatgacagttctacaaaataacacgctaccccaaatatcgccaacctatgatccgtgggacccgattgtctcactgcgtacacatggtcgtcatttgcttacgagtgtggagatgaccgtaacgcatctatgtaatatgcgctgtgagcattgcgctgttggcgatatgctggttatgaaggaggcccctttccttccgctagacctaatgctgaagcgtttggatgaagtcgagcatctggagacgatcagtattacaggtggggaacctgctttactcgataaaacagtggatgaagtaatcgttccactgctgaaatatgccaaggagcgcggtattcgctcgcaaatcaactccaatctgacattagatattcgcagatatgagaagatgcttccttatctggatgtgatgcatatttcatttaactatttgaatgcagacgatttttatgaagtgggttttgcaaataccggccggccgactccgcgtgcgggtgctgttcgcctgtatgaaaaaatgatggaaaatgcccgcagattgagtgaaatggggatgttcatttcagctgaatccatgattaactatcggacacacacgaagctggagggcattcatcaattaatcaacgaaatgggatgccaacggcatgaggttcatccaatgtatgcgtcgaattttgcctctgctttgcctgtgctttcactcgacgacatgcggaactctatccataagctgctggatgtacgtaatcaggacatgtggatgttgtttggtacattaccgttctttgcttgttcggatcgggaagaagaccgcaaactgcttcgacgcttgcgtcaggaaccgaatattacggtgcgtaatgatccggacggaagaaaccgtgtgaatgtgaatatgttcacgggtagcgtgtatgtgacagattttgcagacataccggctttcggaaatattcaggaagatagtctggacgatatttttggtgaatggctgaatgagcatccgctgaatcagactgtgaactgtcattgtgatgccgctgcctgttgtggaccaaatctgctcgtggcggatatgtattacaaaggaatagactttaaatcaagaaaagcattacaactatagaaatggggagttcgtattggatggtcataccgagtttcattggggattgctagctgtgaatctcctcttggtactgctgcttgtctttctaaatggtgtatttgtggccgcagaattttcgctggtcaaaatgcgccaatcccgattgacgcagctccaaagcgagggtcatcgcctggcaggctatgcgctgaaggtgaaccaaaagttggatgcttatctgtccgccacccaattaggcattacgctggcttcattgggcttgggttggattggagagccagcaatatccggctacctgatagagccactcatgcacaaactcggtgtaactgacggtacactgattacaacggtatctgttatcgtcggattttgcgtaattacctttttgcatatcgtattgggggaactggcgccaaagtccttagcgattcagaagaccgaaggtgtggcgttgtttttatcggcgcctttgctgcttttttataaggtctttctgcctgtgatctgggtattgaatgctgcggcaaacttgctgttgcgcgcattcggcattcagccggctagtgaagccgaagcggctcattcggaggaagagattcgtatattgatgaatcagagcgccaaaagcggtgtgattgataaggacgaaattaagctgatggataatatttttgatttttccgacttgcttgcccgtgaaatcatgctgccgcgtacagatatggattgtttatatacgaatttgtcgtttaaggaaaatctcaagatcatcagcgagaccaagcattcccgctacccggtagcagttgaggataaagaccagattatcggttttgtccatattacagatcttctgctagctgagcagggagatcaattggatctggcttcggtggtacgtcctattttgaatgtgccggagtccatggaagtgagtcacgtgctacgccttatgcagaaaaaacattcccaaatgactctcgtggtagatgagtacggcggaacggccgggctgctgacagcggaggaaattttggaggaaatcgttggggatctctatgatgaatttgaggatgaacgcccgagtgtggaaatgaaggagaacttcatctctgtggacggtcgtatgctcattgaggatgtcaatgatttgactggagtgaacattgaagacgacgaggtggattccatcgggggatggctgtttaaggaattggagggcattccggtgaaagggaagaaaattgagttttataaccttacctttgaggtggaggaagcaacaaggcttcgcataatgagagtgaagattcaccgcaagcctgagcctgtgattgaagatgagctttcaggtatgtaagttattatagagtgctgaagaaagagcttttagatccacgtaccgtggttttaaaggctcttttttgattagaaacagttctatagttattttcttgaacaattatttttatctgtgattttttgttcgagacttgggcgatgcggcatatgttgaatagtaaaacagatggatcaatcaaaggaggtcccggcccgtgaaatttccacagcaaggtgagtatgccccgtttgtcggcccgttcgatccgtgtccgcccgttctgtgtaagacttatgtgcttccgccaaacttgtttatacaatttcagccccctggtctaccacaattcagtccagatgaggcgctgacgaagggaacgctatggcctatgctttacagcccttatgagcctaggagaaaccaggggggaggcgaatagaatggagaattcaaatcagggtcagtccccattccaattccagcagcaaaatcagcatgagagcgggcagcaacagccgaatccatatcaaagcccttattcaaatccgtatccataccagaaccagtatcagaaccaaactcagggctatagtcaagccggaaacccggcccaaggctgcacgccccaaaccaagccagttgatgcccagtattatgcgttgctggagaagctccaagcggtggattttgtgttggtggagctgaatttgtatctggatacgcacccagatgatttacaggctatcgaacagttcaataagctgacgcaggaaagaacggcgattgctaacgagtatcagatgctatatgggcctttacaaaattttggccgtgcctattccaagtatccttgggagtggagtcaatccccttggccgtggcaggtctaggtaggtataaccttttataaaggaggaacatgaatgtgggtatatgagaaaaaactgcaatatcccgtacgtgtcagcaaatgtgatcctcatatggccaaactgcttatggagcagtatggtggagcggatggcgaactggcagcggcattgcgctatctgaatcagcgctatacgattcccgataaggtaattggcgtactgaacgacataggcacggaggaatttgcgcatctcgagatgattgcgactatgatttataagctgaccaaggatgcgagcgtggagcaaatgaaagcggctgggctaggggaatattacgcggcgcacgatcatgcgctatattatcaaaacgccggcggtgttccttttacggcggcctatattcaagccaaaggggacccgattgccgatctatatgaggacatagcggcagaggaaaaggctcgagctacatatcagtggctgattgatctgacagacgatgtggatttgcaggatagtctgaagtttctgcgtgaacgtgaagtgattcattcgctgcgtttccgtgagtcagtggaaattttgaagggggaaagagaccggaagaaagtgttctgagaaagttttataccatcaacggtttaaattgttagcttgttctatatattattacaaataggaaaggccatctgcaagcctcaagtgcaggtggcccttttttatttttttacattcatctatcccctaatattaattacttggaacgatggattttttggacgtctggactagaaactgtgcttaaatacaaagcagaggatagccttcctcaatatttagataggtagccacatcaaaggaaaaaaactccataaccaccctgacagaaaacttatttttgttctagctgtgcaaaatactgctcgttgtataagacgcttggatgagtaggatggtgcaactgagctatgcgatgatgcgattttgccttttcaatgtcgccgattcggtcgtaacacaggcataattgcaagtgtggaaaccaggtatagtacgacgaattagttaaggccatcacatcctgtgggggctctatcagcgtcgcctgacgaaaccagtaaatggcttgagtatactgctcatcttcaatgaacaaattgccaaaggcacagcagaactgggcgcgtggtacatcgaggttgagtgtgcgaagcagtgccatacgctgctcctgtttttgaccctggtgagcgtagcaatctgctagcttaaaacaagcagcaatccgatcctcaatccatccttgatcgagccccagatagtgttcgtactgctggatggcttctagtatgcgtccgttatcatatagttcattagcgaagtagtagtgatctcgctcagaaaatgcagtgcctttctcccggtgctggagataaatatgtaaattacggtcagtgtaggcacgtgtctttttatgagtcactgccatattgctgtgaaaggtgctgccagtcacattcaggaattcgtgcacaaagccgatccatctgaatctacgatcacgccgcaccattcggtttcttttgagcttatgcagcggctgcccctgttcatctacagatagtacataatccatcgtaatgctgtcataggagacggtggcttgttttttccagtcgagaaatgccagtcgatcttgctcctctaggatgtcatcagcatccagccaaaattgatattcctgtgttgcctgatcaaacgcataattgcgggctgcggagaaatcatcgcaccattcaaaattgtatacccgagcattgaacgatgcagcgacctcttgggtactgtctgtagaaccagtgtcaacgatgataatttcatccaccagatcatggactgatttcagacaggtatgaagggcttcttcttcatttttgacaatcatacataagctgacagttaccatgctctttgtccccccaaaaaacttggtataatctccattttattaggatagcttgctcattatgtagtaattcctatggatcgtttagaggatgtgtgatgatcataaattcaatcttgctctaataaattagaaaatcaaagtctgatatgaagaggaggagattgtgcaaaattcgatattatcaagtgcgacagggaaataaatttgatggctaaatgtagttagaaaaccggtaacagaaaaaaggcagttaactggaggataagattgtatttttgtattgatgttgttttcattgatatttccaggtgtaagtccattcataccacgctcactcccatatcgcttggccgcaattatggtatgccttaggacatagagggagaacggtttatgaggcttctacctgatggaggcgttgaattatgcgtatactaatcggtagcccggtacaccagaaaccggaaatattgtctttgtttcttcaagctttggagcgattggaggcacctgacgtgctgccggattatttatttgtcgatgataatgacaatccgacttcaagccaatggcttgccgatttttccaatcggctgccaggcagggttttacccttgttgacaggctcacagcaagtggagaaccgaagtgatgagcacactcattattggccgcctgccctcgtatggaaggtagctggctttaaaaatcgtcttatagattatgcacttcagcataattatgacgcgctgtttttggtcgattcagacctaattctccattcccgtaccttatgtaagctggtggaggcggagaaggatattgtatctgagattttctggacacgctggcagccggaggggcctctattgcctcaggtgtgggttagtgatgaatataatttgttccatcgtgaagaaggcgaagtgttgtcggcagaggagcgagcgcaacgcgagttgcatttcatacaccaattgcatgttcctggtttgtacgaggtgggtggtctaggcgcttgcaccctaatccgcagacgtgcactggaagcagggattcactttggtaaaatcaaaaacgtttcctattggggagaagatcgacatttctgtattcgggcagctgcatatggatttccactttttgtggatacacattatccggcgatgcatctgtaccgggaagcggacagaataaaagcagagcagctactattcgccctaaagtattttacaacgagtgctgttcatacggaccattcagaacatttagcatatctggatcactccgatacttctactaactctcctgccttcaatcgttctgcatcatcaagtccctctaagttccctgaacctcctgttataccgtatgatctccgtgagtcagctgtctttgccaagtacactgcagattcttttactgtaccacaaacattctctggtccacgacaaagtgaacttcatacgccacctgtcaccaaacccaaattgacgctgactatgacggtatacaatgaggcagatcgcaagctcattgacgtgctgcggagtcatcgggaatatattgatgaagcggtcattattgatgatggcagtcaggatgatagcggagagttgtgccgtgagatcctaaagggaatcccactgcgtttaatacgcaatgaaacagcttcttttaccaatgaattagagctgcgtaagcagcagtggagagagacgttggcttcctctcccgaatggatattaaacatggacgctgacgaaatgtttgaatcccgttttgctcaaggggtacattcgttgttagcgggaacgaaagccgatacgatttgtttcaggttgtttgatatgtggtctcccacgcattaccgcgatgatgattattggcaggctcatcggtattaccgtccttttttgattcgatataaggaagggttctcttataaatggaaggagcagtccttgcactgtgggagatttcccgaaaatgtgcttgaccttcccagtgaaatcagcaactaccgcatccagcattggggatggtatacacctgctattcgcatggccaaatttcagcgttaccagttgcttgatccaagtgctcgttatggctggaaagagcaatatgaatctattttggacccgaacccccgactcacgctctgggtgaatcaggacaacataaatgtagaagaagaaactgcgccagaatatgaagctgcccaccaggtaaacgacatggatgttgccgagatttcgagtgtccaggttattgataattccgatctgcaaataaaaagtgaaaccaaggacttactttatagtaaatgcaaactgtgtggctcatctgacacggcagtatttcatagctatgaacgctttaccttgatgggatgcggttcctgcggattggtttttcgtaatgatgtggatcatatacagcccgaagatatgattgcagagatttataatgccaaatgggttgctatgcgggatagtgcagcagcatcaacttatggagatcatgccctttttggactcatgctgctggatatgttcagtaccggtaaagggaaattgcttgagattggatcaggtaccggagaatttatccatgctgcccttcaagccggctgggatgcagtgggcattgaaccttccatagactcgcgtgcttacgccaaatacaaatatgacgtggatttattgccgggttactggggcgatgaagccgaagaagaaactcaaacccaagaagcacatgaaatacaggaattgaatgaaaaacaagaagccgaagaagatactgatttaccactggatcacaaatacgaggccgtagcatgctggcatgtgctggagcatattgcggacccagttgcatttttgacagatttacgcgaacagcttcaacctgacgggacgatctatattacggtgcccaacaaaaattcgttcactaatgaggcttatggcgtttactcgcctttatttacggaggaagatcatttgtatcattattctgagcatacgcttgcgctcttactggcaaagtccggcttgcgcccggtggctttgttcacccgccagcttccctctggtttagatgccttgctgcaagcccatcctttatacggtgagcttacccttacggagcaaatgggattgttggccaaacttcaaggcgagaaacggggtcatgaactgtgctgtgtcgcaagggtaatttagtcatccccaaaaggaggcagtatccatgaacatgtctgatccgtatctgtctcgcttttttgtatattctgaccccaactcctccaacatgatttacagactcccccaaagctggtggagtcgcccctatgagtatgagtggtgtctccaatttatgtctgggcaagatacagtactggacgcagcatgtggaatccctcatccattcaaatttgagttggcccgccgttgcgctcaggtctatgcctgcgatctggatatacggatcgtttccgtggatgccattttggccgaggtgcggcgggatatcggagaggaggctgccgagcgcattcaggagattttaccagttcgtctccactccgcacatgccaatctgacggctctaccctatgaagatgccagttttgacaaaattgtatgtatctcggtactggagcatttaacgcctgatgaatctttggcagccttacgtgaatttcaccgaactttacgggatgacggaatgcttctgcttacgtttgattatcctacagtggacttatcagcgatggagcaatggatagagcaggcgggattttcgtattggaatggtgtggatatcaagcttccacggggtgctttacacacggatatgtggggcggtctgcattgttttaggactgttttaaaaaaatataagagttagcggtatgcgcaatgaggtttacacggacctctcttattgcttatcatgagaggggttagagttgtaaacctacataggaaaggaatgactgataactacatgaacaatgcacctgtgttgaagaaacctgaggctatggtatttgatatggacggtacactttttcagacggagacgctattgcttcctgcgtaccacaagctgtttgatacgctgcgcgctgaagggctttatgaaggagagactcctcccgaggagcttattttgaatagtttgggtatgttgctggatgaaatctggagaagagtgatgccggaagccagcgaagcggcccacagaagagcggacgagctgctgcttcagctggagctggagggattgaagagcggaagtcatgccctgtatccacatgtaaaagaaacactccagtcccttcatgagcaaggtgtccgattgttcgtagccagtaacggcctggagggttatgtaaaagggatcgctgctgcgtatgaaatggttcccatttttgaaggactgtacagcgctggggagtacagcacgctttccaaagtgaatttgctggaaattctgttgagcaagcacgatatttcgaatgtatggatggtaggagatcgctcctcagatgtggaagcaggcaaaaagaacggacagacggtgatcggttgtgcttatgctggatttggcgtgaacgatgaattgaaggggtctgatgcgattattacggactttacgcaactgcttacactttataaaaacgccgagtaactgtgaaacacaggttaatggttataaataggcttgacgtaccatataaataaaacatgctagcactgtcgggcagacgaaaaagaaaggaaggcagccactttacgcggagccttcctttgtcttattctcagtcttactctctgctttatcttctgttttatcttctgctttgtagtccgtctgaggctttggattaatttgtgtgtggtagacccacaaggcatattccatgggcttggcgatggaacggcgataggtatctttttctccaatacgtgaaaatacctcgcgggctggtttcgggttgacttccagcacgtatatatgaccgtccttattaattgccaaatcgagcgcaagctcgcacaatgccccgtagctttcttccagatacgcagcgatgtccagtccgagtttttccccctgcttgatgattttctctctacggctctcatcacgaatccattgcgtcagcaattggttcatcggtaccgccttgcctccaccatgcaggttggaagtaacactccgatgtgccccgattcgcccggcgcatccggttagctcccatactccttggctatttttctgcaccagcatacggtaatcatggaccctgccattcggcaactgcacaggaatgccttcctgaacaatgtagttatccatgttccagctgctcagacgcggctccagacggtctagacgtacccgctgctggggaataatatggcgtttgcgattgcggccttcaatcagatacaggcccccttgcttgttaacaggttcaatccgtaaaatgccgcgtcctcccgtaccattaatcggcttgaggtacactagtgaattctgtttgagcatccgttttacactatgaaatccattgaacagctctgttgcaggcaaatgggggcgaaaggcagaccttctcgcaagctgctgatgaatgacccacttgttactcagcggtcggtttaaatatacaaggtctgtatactgcaatcggaactgcttcaactgacgatatcgctcactgcgctgtacccggcaacggtcgaaaatcatatctgggaactctcgccactttcggctccattttccgctgtgtggatcatagatttgggcaaggagcagccttcgatccttgtggacatctgcaggagtgaatacatacatatccagtcccagtcttttcccttctgcaatcatgcgctcatatatgtcgcgttcctccaattgcttcttgttgttcaaatacaaggtcatgatgcctaggacaggttttggcacagcattccaccttcctctgccgtctgcttatcttgggataactccccgtgaaatatcagcgtgggtttcccggtcggtccagtcgtcatttcatgcgcaaccagtccagcgcggaaacaggttttgagactggccatattatcggcggctacgctgcacgtcagacggcgcagctgtttgagctgggcggacagcagtctagcgcccagtctgcggccccggtaaagcggacgaacaattacgatgcaagcatccttcccgtaattcagagcgagggaaaatcccgcaatccgcagccccttctccgtgcgcacatatgcgcacaggagggaggaaccaggggtgttcaattgctccggcgtcaatacagccaactgccgtagagcattacgagtaatgcgcatgccccctgagctgcgggccagaaacagtaactgtcgtcgtctcagcagccagctccgggcaggcaaatgttgaacatcgctaatttgcggcatgattccacttccttgatcatgatttcattcgtccggccaaaaaggagctgtactggaatatgcgtctaagcgacttttggcggatttccggctcgtcaaatttcatcggtttggcattggcctcaaaaaaccagagggttccgagcgtatccacgcccaaatccatggacatttcgccgtgagaaagaccggatgcgcgttcaatttgacgtgcaatctgtatggccgtacttttaactttgttcagtagatccgtgctgtcctcaggcccaaacagtgaggacagtagcttgaacgggtcctctacactcccgccacgcgggacatgtgtggtaatgctccctttacccgccagtctggcaccgaccccggttatactccaggagccacggatatttttttgtaccaggatacgcaggtcgaagggttttttctgataggttgccagatcgatgccctgttgaatgatataaggcgagttgcccgcttcccggcggatacgtccccacagccgggatagcgatacagatctgtaggttacactttttttgtcatgctgaatggtcagtctgtaagccattagatgttctgggcggaatttaagaatcataatcccttttccggccttaccgttttccggtttgagatacaggtatggatacgcagacagcatttttcctaaggaagacaggttgcttaaccgtttggttgccggaacaagctgacgagtggtttccgaggtacgcaaccacttgaacagttcccatttgttaaaaaagcctggattgtacagctcaatgtctgaagcatgtgaaatttcatccaactttgtgcgcacagaggttttaagttcataattacgattggggatgcgattataaatgacctgtggaggtggaaaattctgttcctcccacgtctgtaaactcttgttgaaaacgtagcccttaaccgtttcgtctgccagtttcaggtccctgacggtaacaatgtacacctgatagcccatccgtgttcccgtttcaagaatatccctgaaattgcgctgattgcccttgaagaattgttcttcgtcgtgcactgtcaatacagcaacgactggcttatgctccgcccgggtattcatagttcctcttttctgcggaatttactgaggtaaagacagtggtccaaaatatgctccacggatgctttaccctccgcacgcaacgatggatgctgaaaaatggatcggcctggcttggagttggcttcaaacatccataccttttcatcctgatcaatacccagatcaaagccgatttcacccagtagatgctggtgatggtattcaatggcttctgcgagcgtaactgctacgttcttggcacgctggagcacttcacccgcccggtctccgaatacccggtttaacgcctgttcaggtgtcataagggagccaccgtttttgatgtgggtcgtgacactgccgcgtccggcttttttggctccaatgccgacgacgacccattgattatttccatttttatgcatgtgaaatcggaaatcaatcgggcaattgtcaatctcgatcagctggataccctgttgaatgacgtaaccctttaacatctgtccctgattggagtgaagcatcctgagcatggagttaaaagaggcgaattttagcaatacattgctatttttcttacggtacctcacaaaatagccttgcttgggaacatgggacagacggtagattcctttgcctaggctgcctccacttggcttgtaataagcaaattgatgtcgctccaacatacctcggatacgttcagagctgggattcatatatgattcagggacatagcggttaacatctggattattttccagcagattatagatatcggacttattgaaaaagctccagttaaagaagggaattcgtttgcgggaaaagcgttcgcgtagttgattgatcgccggggaaaaatcagagcgtcggctcggcaaacgattataaattacgtccggcagaggtacaagtttacgtgtgaattccccgctggaagacagaaaatagccgttaatcgtatcattttgccagttaatatcccgaggggtgaaggcaaaaatataagattttttgctgccttccttcagcaattgcttaataaagcctgtgcgtgatccgaaagggcgagtggtggagttggtaccgtcagacagcacgccaatcaacggccctagctgtatatccccatccagatttcgcaaatagatggccccgcttttgggaacacggattgcattacgtaagccggaggtcaagtatagatggcgtcccgccttctgaatgggttttactgtagcgggaatctgatccttaccgagccgcagacgtacggacttggctccggataatttaaggcttttcaacaaggaagtggatatatacgccaccttgtcgggctgctgtgagaaatgcacattgcaatgcgttaaactcatctgtttatcctcctataccgtatgttcaagggaggcgcccgcgccctttggccctgtcgctttggaatgggtcattaaatatcgagcatattcgagcgggcggttgaccgactggaaagcgcactctggctgacgggtctgaaaaaaggaggcccggccaggtcgggaattaacctccaatagccagatgttcccgctccggtcaataccgtaatcaattcccaactcgccaaggcggccataacgttcctccagcgccctggtaatggtcaaggacagcgccatcatctgcccgatgatgagacgcgtggtgtccgcgccaaattgttcacgaaggtaaggctcagctggatgggcttcgcccccaccgtgaagattagaagtcagagttccttgtctgccttctcttacggcaaagcccgtcaggcgccaatagccgttgccatccttttgcatgagtgcgcgaacatcaaagggatgattgctttggcttgttaatttcaagtaaggctgcacgatataagcgcgtttgtgtgcaattccgtggacccatgacaatcctgcatccaatttggaaaacaagcgccggaacgggcggttacgggagtctctaccctgtacaagtagtccctggcctccttctgccagccggagatacagtgtgctcttgccatgtgttccggtctgtggcttcataaacagctccgaatggcgtcgtagccattccacaagctggatcgtgtcccggtatggcgccgtaggcggcacaaagggacgcactttatctaccgtatgcaaagcgcgatacacctgccatttgccaggtaagttacgcgaccagtagatgagcttgcgcgatttttgctccgccatatcttccagtgtgcgcctgacattctggctctcgtgagcatggagacagcggttatacacaatatccggcaacggaaagcggccggatgtccatactcctttacggtaaacataacctcgtatggagtgatcttcaaatgaaactccttcggcggtaaacgccattacgctaagaccagagcgcctgcccaacagacttagcctgcggcaaaaatcggcttcagtaatagggggagtggcagcctgattccggctaacaagcacgcccagcgtgcctggcacaacaagagacaccgacaacagctcctttgacagccagactctggaagaggtgaattcatttgaagccggctgaataacagcagtattcaatcattttttttacggacgggcgagttttctgatcatttaacggcgtgttgtcattcttcgatggcttcgaattgacctccagcaaccagatgcgccccgtgctgtctattgccagatctataccaaattctgcgaaatgggcgggaatcgctttttctactccgcttgcgatatccagtgctgctgttttgagagaggtatgcccattcgatttaacggttgcgggcagcgtggttttggcaagtgcttccttgactgtactcagcgtgccgcctcttgccagattggacacaaagtggctgcctccggcgatccgggcgacaatggatgttacggtccaagtcccggacgaatttttctgtacaagcgcacgaaagtcgaccggacgcttaccgtgatcaatcaaggtaagtccctgttggagttgaaagcgtgttgttttcatttttcccgctaagcttttgtacagtttatcgacgttggcatacatttgcttgcggggtgtgcccgctgttgtggatagcaccgaaaaggtaccatccgtttgtttgttaatgcgcattatgcctttacctaggcttccgcgcactggcttgagaaaaacagcgggatactggttgcacatttttttgaaaacagcaaaggtttgcagcaagtgggactcgggtaaatacttgcgcagggaagaatttgatttaagcgcatcaaatacttcatttttatccagaaacttttcgttaaaaatggttgtgccgtactgcgattttacttctttcatgaaatgctgtacgctagttctgttctcgagtttacgggaggtaagacgattattgacgacatcgccggcgggcatgaccgtctttttccagcctccgtcatacacccatccctgaactcgcccgggctgacttccgatatgctccggggtgaaaaaatacacatatgctccttgtctgcggcattccccgactagttcacggcagaacagggtgatcggcccgaaaggcttgtcgggctgttcgggatagtcccgactgaccagcacgctaataagtgggcccactcgaagtgtccggcgacctcggctgtaggttactcgcagatcacaattggcatgaagccccatttttcgggctagcacgcttcccacacgtaggccgctgtagcggggcaccgatatgacggtaacctcttggcggaacgaaccgaaggcgagctgaacggggtggccagcggatattttccatttgcgaagcagggactcgccgaccatgagtacgtcatcctgcaagatgcccgatccgatgatttgaatcgttgtttttttgatggacatcgtggatctccttccgggcagcaacttgatgtcttgaaagtaacgggaaacgtgaatgggctgtaatagcactgattcatcatatgaggacatatatcccttggtgattgacggacaatgtgaaatgttgacactaaacttgtattggaggaataaacaatcatgaacatctatgacaaagcccatgatttagcgaaagcattgaaggaaagcaaagaggtagaggaaattacgtcagcgatgaagctgatcgaaaccgatctagaagctaagaaaatgctcgacgatttccgtgaacgccaaatggaagtacagcaacgcatgatgagcggcgatatgccagcacaggaagagatggaaaagatggagaagctgtttgaggtacttagcttgaacctcaacatccgtcgcctgttcgacgctgaacgtcgcctgagcgtgattattgaggacgttaacaagattattgcagacagccttcaacatttgtacggttcatctctgtaagtttgtctcatattccttcctgtcctctcatagactagatacatagagtcacagggagaggaagggatacgattgggttctttcaaaaaatggaaacacggtttgtacacactcattgcattggctatggttttgatcgcgttaccacgcatctcgcttgcaggcggtttgaactgggtcaacggctttggaatggtatgggtactttttgcgctgctagtcatcggagcaaacatgcattttttgctgggtgtggatgaggaaaagcgcaaaacgctggagcgtgtgcgacgggccaaaatgcagcagtggcagatgaaatgggataaaaaagctgacaaaggcagcatgtagtgagttttttcagcttgtcctgggcttgtctcccagatgacaaatcaatcatagtaagaagcgatcccttgtaaaagaggggatcgctttttttgctatttgcgaagcggagaagtcaaaatgaacaagggtctaaaatatagggatattgtgctataatagatacagaatgatacagattgaacgttgggggtgtaacagagttggacgggctagatgaaacagttacgaagcatgagcagctattgcgacatatcgagcagttgaaaataggctccaaaatttctgtgcgcaggttggctaaagaaatgagtgtcagcgaaggaacggcctatcgggccgtgaaagaagccgagaacctgggaatcgtcattaccaaggaacggatcggaacagtacgagtggagaagcgaccgcgcggcttgtccgagcagctgacctttgcagatgtcgtaaatattgtagagggacatgtgctgggcggaagtgaggggctggagaagcccttgcacaagtatgtgatcggagcgatgcgcgaggaagctatggcccgttatattgacgcaggtagtttgctaatcgtaggtaaccgtgaggatgcgcattcacttgcattggagcagggggcaggtgtgctgattacagggggcttcggtacgagccgagaggttaagcagctcgcagatcagattagtctgccgattatttcctcacgccatgatacttttacagtggcatctatgattaatagagccatatttgaccgcttgatcaaaaagaaaattatgctgattgaagacattgcggcaggcaaaccgaaaacgttgaccttgaaaatcaacagcacgcttaccgagtttgaagaactttcggtgacgaccggacatcatcattttgcaatagtggatgaatggaatcgtttaattggtatcgtcagccgcaaagatgtggaggggcttctacctgagcatacgatggataaatgtctgatccgcaatccgataacggtcacctaccagacctcgctggcttctgccgcgcaaatgatggcgtgggaaggtgtagattatttgccggtcgtggaccgtaaccgcaagctgcttgggtccgttacacggcgtgaggtgctggaggcgctgcgtaacgcccaaaagcagccacaacttggcgagacgttcgaccagttgatctggaacgggtttgctgaagagcgtaatgaggacggatcgttattttttcgcggttttattattccgcagatggcgaccaatttaggtacgatctcggaaggcgtactggtcaacgtgatgacacaagcgggctaccgggcagctagagacatgaccggcaaggattatgtgctggacaatttgacgacttattttattagacccgtacagatagaggatgctgtcgttcttcgtccgttgctactcgagctgagtcgccgcacctgcaagctagaaattgcaatttcacgggaaaaccatttggtatgcaaagcagtgatgacacttcaatccattgaacatggttagtctacctatggatcagagcagggtgtgaagtcgaatagatcgacttagtggctttcaggcagtctttcttttgcttccagccaaatttgcagcaccccttccattacaagcatcgttttgacctggatcgtatactccttgtcacgaacggtgtattttttttggtgcagcaacatacgtaccagcttgctgtcagagtcaatttcgaacatatctctgccgcgcagcacctccagatcacgactgacacggcgaagaagttccttcaggttgatagaatcaattttttcggccgaagcttcctccgcgatcagcttgatttctttgacaacggtttggcgcttgctgtatttgcgcaatgttttgttgtcttcctcggcttgctggagctggaattgaagatcctggttgttcgtccatagctgattgaagctggcatgccagatggcattgtagatcattcctcccgtaatcataccgagtacaaagacggaggataattgcataaaagggcgcaggcgctcaaaaggggggactctcattgtcgtttcacctcacggtcgtccgttgccgcatacccacttgaccagctctgcacccatatgagcgcctaaaaaggcgaaaatcaaatacaatatctgcttaatggcaggtgacaaattaccatccaacatattgctttcaatgactcggatcgggtccatcgttccccccacagcggcggcaagcgcccatattttaattcttccggcaacctccagcatcgtctgggttggcggctgaagcgataccacagctcccattccgccgagcatggctcccccgagcacgatgccgaaggcaatgaagaagtcgagaatcgctttggatataaaagtgctcatgctcttttcctccttaggtatacgaatcaggaccgcgcttgtccgccgaggtctgtacttttattctatgggcgctactaacgcggatatgataaaatagtttgaagaaaatcaagcggtgaaaggaagagaagcgcatgagttcatttgtgcatttgcatgttcatagcgagtacagcctgctggacggcgcggctcgtaccgcggagttggtcaaacaggcatcagcttacggaatgaaggcgctggcccttacagaccacggggttatgtacggtgccattcctttttatagagcgtgtgtagagaacggcattaagccgattatcgggtgtgaggcctatatgacggcaggatcgcgcaaggagcgtggcagccggaaggatcagcccatatatcatttgattttgctcgccaaaaataaaacaggctatcaaaatctgatgaagttgtgctccatcggccatttggagggctttcactacaagccgcgcatcgacatggaggctttggctgcccatcatgaaggcatcatatgcctcagcgcttgtttgggcggtgaagtgccacagcatttactgcatggtcgggaagccgaagcacgacgagcagcggaacggtatcgtaacatttttggcgatgatttttatctggaacttcaggaccatggtctttcggagcaaaaacgtgtaaatcctctcttgatcgcactggcgaaggaactgagtattccactggtggcgacgaatgacgtgcattacttgactgagccagatgcggacgtgcaagacgttctgatctgtatcgggacagggaagacagttgacgatgaggaacgcttgcgtataccaacacgtcagttgtatctgaaaagtcaggaggatatggctcgtttattcccgcatgtggcagaagccatcgccaacacggtgcgtattgctgaaaaatgcgaactagagctggaattcggtcaatccattttgcctgaatatcgcccgctgccggaaggaatgacctcttcgtcctatttacgcaatctgtgcgtgcaagggctggagcgtcgctatggaagcgatcccggatgggagcaaccagaggaacgggaaaggctgaacaaacggctaaactatgagttgaataccattgacagtatgggtttcagcgattatttcctgattgtatgggattttattgccttcgctcataagcataagattgcaacgggaccggggcggggttcctcagcaggcagtttggttgcctatgtgcttaacatcacgaatgtcgatccgataaaatacaacctgttctttgaacggtttctgaatccagaacgaattagtatgccagatatagatattgattttagtgatgaacggcgtgacgaggttatcgactatgtagtacagaagtacggaaatgagcatgtagcgcaaattattacctttggaacgctggcggcaagagccgctgttcgtgatgtcggtcgcgcattgaacgtaccgtatggcgaggtggacaaggcagccaagctgattccggcgcagttaggcattaatatccgtcatgcgctggaaatcaccccggagctaaaaacgctatatgaaacgaagcccaagacacgtgaactgctggatatggcgatcaaggttgaaggaatgcctcgtcatgcttcgacacatgcagcaggtgttgtcatttcgcggactccattgaccgatgcggttccgcttcaagaggggagcgaaggggttcctttgacgcagtactcgatggaaaatctagagcgcattggtttgcttaaaatggatttccttgggctgcgtacgctctccattattgaacggtgcatacagtggattgcggaagagcatggagaaacgcctgattttaatcgtattcccgataacgatccgcatacctatgacttgctgggcaaaggagatacaggaggcgtattccagctggagtcggccggtgtacgccgggtactcaaggatttgaagccgagtgtattcgaggatatcatttctgtcctggctttgtatcgtccgggcccgatgggctttattcctaactttatacaggccaagcatggtcaaattgaggtttcttatccgcatcctgacctggaaccgatcttaaaggatacgtacggtattattgtgtatcaggagcaaatcatgcagattgcttcgcgcatggcgggcttttctctgggagaagccgatctattgcgccgggctgtgtccaagaaaaagcgcgaagtgttggatctggagcgcgggcattttgtcgaaggcagtatcaagcagggatacacggaggaggaggccggaagggtttacgatatgattgttcgttttgctgactacggcttcccgcgtgctcatgcagctgcttatggtgtgctagcatttcaaacggcttatctaaaggcccattatccggtacaattcatggcttcaatgctgacagctgtgatgggaagtcatcggaaagtagctgaatatgtcgtcgaatgccgtcgtatggatatcgcagtgttgccgcctgatgtgaatgagagcggagtgttgtttactcctttacagcagggaggcatccgcttcggcctagcagcgattaaaaatgtcggcacacaggcgatggagagcattctcgctgttcgcaaggatcggcctttcgacagcctgctcgatttttgtcgacgtgtcgatttgcgggtatgtaataaaagagtgattgaatcgcttattcaggcaggagcctttgattctttgacgggtcatcgggcacaattgcttgccatgctggatgaaacggtcgatgcagccgtcaagtggcgcaaggaacgggatgacttgcaaattgatatgtttggttttgtggaaatgcccaattgggatatcgaatatcccaatgtacccaaattcagtgccagccagcagttagagctggaacgtgaactactgggactgtatttatccgggcacccgttggatgattttgagtcgctgttggaaagcagcgaggcggatcgtttgatggaactgggcgatgtgccagatgaaacggttgttgtgaccgcaggcatggtagtgtcactcaaaacgattacgaccaagcagggtaaggccatggccttcattgagctggaggatcagattgagcgctgtgaggttgtgctgtttcctgaggtatggaagcgaagccagcagtggattgaaaagggagctttgcttacgcttcgagccaagatgcagcagcaggacgagcacttcaagctccttgcggatgagaccgccccgctggcagaagactcgctggcccggctcctccagcgccgacgtgccagtacgcgctcgtccgccgctggaacatccgtgccagctgctggctctcctgctggcggcccgggcgggagagcggcgcgcgtgtcgcccccgccttcggcagccaatgcatctgcttcgcctcaaccgaaggcggctcgtcccgtggcggctgcttcaccgcgtggagctgaaacggctcgcggtgagcaggtaccgctcccgcgcagctcggagtcgaccgtccgtcagcgggtgtttgtcaaaatcacccgccaggccgaggaggacgccagcttgctggtcagtctcaaggcactgctccaggagcatcccggtgctatgcctaccgtacttttttatgagagcaaccagcgtctgctggctttgagcgatgcttacagcattaagccttctcctcagctttttgatcaaatggagtcgatgttgggtgaaggtacggtgaaagtcaaatgataggcacacagcaaaccgcccttattgtaacggtttaatgaacattttccttccttcccgcatacacttggaaaactggcggaacaggagattcaacacgtctcctgcaccataaggtcccgtacggtgaaagaatagaactgcacggtgaaagcgggagggaaattatgtcctatgaatatgcagaaactttgttaaatcgcagaggcattcgtatcgagtccattgcggacattgtttttcagcttcagctaaaatattatcctcatttgacgatggaagaatgtatagacagtgtcaaagcggttttgcaaaagcgtgaggttcaatatacgttgctcacaggtattgcgctcgatgagctggccgaaaaaaaacttctcccccagccattgcaagccattatggaggctgacgaaccgctgtacggagtggacgagacactggctcttggaattacgagtgtgtacggcatgatcggcttaaccagttttggttatctagataaggaaaagacggggattattgaacagctgaaccaaaaaggcagtggtattcatgtgtttttagacgatcttgtcgccggactagctgccgctgcttcttcgcgcattgcacaccggagcctccatgccaagcattatcctgcatcattggacgcttaattgacctgtgtagacagagttgatgattttctaggccctccgacggaacttgaatgatcaggagggcttttgttgcgggaaaaaagtaaggtatgttatcatgagtctattatatgggctcaaaacttgaggcttagggggtagaaacaaggcatgtggacggtgatttatattgcaccgacggccagactggctgacatgattaagctcaaactgtctgaagaaggttttatggtgcaggcccgggccatcagtgcgtccaagcaacagtttgagatacttgtgccttcgggtgaagtcgaagaaattcaggaagtgcttaattcgattttgcgcccttgagtccggaacggcggaaatgatacagcagcatgagtggaacaaaggatgcacgatcggcggtaatgttttagtaacaggcgttgacgtgtgtatgaacataatgcttaaaggtgccgcatagacggcagaggaccttgtatcggttacggctgacaaataaacggctggagaggtgtagttgtgtttaaagatttattccaaaagaagcgtaaatacgcgaccatcccttcggaacgggcgctgagcggcgatcaagcggacatgccggatcgtcccaaacgggaaattcccgaaggtcttatgaccaaatgtggcaaatgtggaagtattcaatacagcaaagaactagagaaaaatttgaaagtgtgtccggtgtgcggataccatatgcgtttgaatgcaatggatcgcattcgcatggtgctcgacgaagacacgtttacggaatatgatgccgatatgatttcggttgacccgctggattttccgggatatgcgagcaagctggagcaacagaccctgaaatctggcttgcgagaggctgtcgttacgggcgacggccttatttatggacatcctgttgtcgttgctgtgatgagctttgacttttttactggcagtatgggttcggtcgtaggagagaaaattacccgcgccattgagcaagcaatagacaagcgtctgccgctaattattttctcaacttccggcggggcacgtatgcaggaaagtattttaagcttgatgcagatggccaaaacaagtgctgctcttgctcgtctggatgagcagggcttgctgtatatttctgttatcaccgacccgactacaggtggcgtgtccgccagctttgctacgcttggagatattaatatcgcggagccaggagctgtattcggctttgcagggcgtattgtaattgaacagacaatcagacagaagttgccggatgattttcaaacatccgaatttaatttgcagcatggacaattggatatggttgtacaccgcaaggaactgcgtgataccctcgggcaactgcttgatctgcacagtgtgaaaggggtggaatagatggctggtgaattgccttatgaaaagcccctggtcgagatgcgacagaagatcgaagaactcaagcaattcggacaggataagcaaattgattttacagatgaaatcaaccgtctcgaggaacgttatctcgagatggaagaagaaatatattcgaacattacagcaccacaaaaaatgcatttggcccgtcatcatcaaagaccaacgtctcttgatctgattgagcaggtgtttacggactttattgaattgcacggcgaccgcttgtttggagacgatctggcggttgtgggcggaattgccaagctaaatggtattccggtgaccgtcattggtcaacagcgtggtaaggatacgaaagataacattgcacgtttctttggtagtgctcatccggaaggatttcgtaaaggcttgcgtcttatgcagcaggctgataaattcaaacgccctattattacatttattgatacgaagggcgcttatccgggtaatacagcagaggagagaggtcaatcggaagcgattgcccgcaacttgcgggagatggcaaagctttcggtgcctgttatttgtgtggtcatcggcgagggtggaagcggcggtgcgcttgcgtttgcagtcggtaaccgtgtgctgatgctggaacatgccatttattcggccatttctccaaacggtgcagcttcgattctatggaaagatgcttccaaggccgatcaggcagctgaagccatgaagattacggctaatgacctcctgcgcatggaaattatcgaggatattgtgccggagccgaaagggggcgcgcatcgtaactatgaagtgactgctgccgcaatcaaggagctattggaacgtcatttggcagaccttacgaatatgagctgcgatgaattgagggaagatcggtatcaaaaattccgaaaaataggtcaatacaccttcttaaaaccttcggaatctgagcctatgttgtaatacgctgtaaacgggtaacaataaatatgacgaacttcctatacaaataggaaaaagtgtagtagatttaattgttggaaaaagatataaagagtagcacctttgaaaacggaggaaaaacccaaatgcgcaaaactaagattgtatgtaccatcggtccttccagtgagtcattggaaaatgtgaagaaactgattttggctggtatgaacgtagcccgcctgaatttctctcacggtgatttcgaggagcatggcaaccggattaaaaacatccgtcaagcttgtaaggagcttaacaaaaacgttgctattttgctcgatacgaaggggccggaaatccggacaggaaagctcgaagttgaacctattgagcttgttcaggacgagttcattacgctgacaacggaagaaattctcggtacgcaagatcgtatttccattacgtacaaagatcttccctcggacgtggagcccggctccaccattctgatcgacgatggtctgatcggactcaccgttattgaagtatcaggcactgaaatcaaatgccgcattgttaatggcggaacgatcaaaagcaagaagggcgttaacgttccaggcgttgctatttctttgcctggtattaccgaaaaagatgctaatgatatcattttcggtattgagcaggacattgatttcatcgcggcttcttttgttcgtaaagcaagtgacgttctggaaatccgtgaattgctggcgaaacacaacgcaagtcatatccaaatcatttccaaaatagaaaatcagcaaggtgttgacaacctggatgaaattttggaagcttcggatggcctgatggttgctcgtggtgatctcggtgtggaaattcctgctgaagaagtgcctctggcgcaaaaattgatgattaacaaatgtaatgtagctggcaagcctgttattacggcaacacaaatgctggattccatgcaacgtaacccgcgtccgactcgtgcggaagcaagtgacgtggcgaatgctatttttgacggaacagacgcaattatgctgtccggcgaaacagctgcgggtaaatatccggtagaatccgtactgacgatgtcacgtattgcagaaaaagctgagtcctctctgaactaccgtgatttgttcaagaaacaaagaacggctcaagaaattagtattacagaagcaatcagtcaatctgtttctatttctgcacttgacctgcatgccaaagcgatcctgacgtccacacaaagcggaacaacggcgcgtatgatttctaaataccgtcctgaagctccgattgttgctgtgacaacacaggaaagaacagttcgccgtttggctctgatctggggcgtacatgcagtacaaggcagaccagtcgttgacacaacagatagtctgtttgacaacgcactggaaggcggtcgcaaatctggcctcgttaaagagggcgatttggttgtaattactgcgggcgtacctcttggtgattccggttctacgaacctgatcaaaattagctgcgttccagcacaagcgtaattaaagtctccatgacataataccgaggctgtattgttacaacaagcaaaagagcattcaagtcaataagacttggatgctcttttttttatgttctctagcttttcatttccagtccttctcgtcgtatgaaatcaagaaatgcctgttgcatcaagttcatgtgtgtatcttgttgatacacgatgtttatttgataatggctcctttggttatcagcctcgggataagggagccattccaccgagggagcagcattttcattattatccactccgcttgcaggaaagaaggcaagcgcttctccgccgcttacgacttgctttaccgcttcccaagagttgatttccagatgaggcttaactagagaggaatactgatctacaactgacgaaccgctatattttacccatgtgtgcttgtccagcacatcgggtccatcgacctcctctaatttgaatgcagatgcagaacggataactcctacttgatcagaagccactggctctgccaccgtatactctggaagagaatctctatcgtcgagaaaagcaaaatcaatttccccctgtttcagtagctgcttaattgcatccggggattgaatctccaactgaatacgacaatctggatatcgttgagcaaacttagtcatcaaagtggggaggagatacgtacctgatatcgactctgcactcagatgtaattgtgcctgtgactcttttgtcagttcatctacagcttgtctagcttcttgttccagagagatgatctgctttgcgtaaggtaataatttttttccagcttccgttagtataatcctgccttgttgaagagagaatagggaaacacccatttccttttccaagcttttcatatgaaagctgacagtaggttgtttgacttgcaaagcttcggccacatccgtcgccttatggaatttgtcgatcagcatcaaaatacgcaattttagaatattcatggaattcaacagctctccttatatgtcattgatatgtgaatttcaaactatagattaattatataccgaaaaataatttatctatcaatattttatatttgttttacaaaaccacgtcgttcgtctaacattccaggcctacaatgtaaaagtgttgatggtcataaataaaaaaccgtcacttaactaaggggaggacaataaaaaatgttgaaaaaatggccgttcattctgatgactctcaccatggtatttgcacttgcagcttgcggatcaggtaacaatgctgcaccacaaggagaagctgctacaggaacagacaataaagcagctgctgaactgacagggaacattctggctgttggctccactgcacttcaaccattggtagagcaagcgggacaaaaatttatggctgtcgataaatataaaggcattgcagttcaagtgcagggcggcggtagcggtactggcttgactcaggtttccggcggacaagcggacatcggtaactccgacgtgtttgcaaaagaaaaactggagagcggcgcagatgagctggtcgatcaccaagtagctgttgtagccatgtcagcggtagcgaatcctaaagtaggcgttacagacctgaaaaaagatcaattggtacaaatctttacaggtaaaatcacgaactggaaagaagttggcggtgcagatcaaaaaatcgttatcgtaaaccgtccaagcagctccggtactcgtgcaacatttgaaaaatacgcattgggacaaaaaacggaagatctgccgggctccattcaagaagattcctccggtactgtgaaaaagctgattgctgaaacaccgggtgcgattggttatctggctctgtcctacatcgacaacacagtaactgctttgaaatacgatggcgttgaagctaacgttgaaaatgtagaacaaggtaaatatccagtatgggcttacgagcatatgtacactaaaggtgagccaaaagagcatgtgaaagcattcctggactacattctgtcagatgaaatccaaaaaacggatgtcgtagacttgggatacattccagtagcaggtatgcaagtgaaacgtgatgctgacggtaatatcacgaaataaggagagtcacacctcctgttcgatgaacgcagctaacgcgagtatattcacgaagaagaggcggactagcgtccggcctctattcttcggttaaaggagttacagtatggaaccaattgaagggaaggcatacatggaacagaataaacgatcccgagttatgaaagaaagacattactgggaagaatggaccggccgcatatatacgtcggtttgtgtcgtttttttagttgcagtcattgtctccatcgtatattttgttgcctccaaaggtgtagctacatttgcggtgaatggagtcagtctgcgagagtttttctttggaaccaaatggagcccggatggcgaacctaagtccttcggcgcgcttccgtttattacgggttcttttgcagtaaccatactggcggctttaattgccagtccactcagcttatgtgcggctttatttatgacggaaatcgtgccgaaatcgggtaaacgtatccttcaacctgcgattgaattattatccggtattccgtctgttgtatatggctttgtcggcttgaccgtgatcgtcccgctgctgcggaacgtgtttggaggacaaggcatcggcattctggcaggctgcctagtgttgtcagtcatgattttgccgacgataacgagtattatggcagatgcgttgtcttccttgccgggggggctgcgtgaatcctcttatgctttgggtgctactcgctggcagacaattgcccgtgttattattccgacgctgttgcctgctcttttaacaggaattattctcggtatggctcgtgccttcggagaagcgttggctgtacagatggtaatcgggaatgctccgcacataccgcattccttgctggaatccgcttcgaccttgaccagcgtcattacactaagcatgggcaatacagcgatgggctccgttcataacaatgctctctggagcatggcgcttgttcttctgctcatgacattcattttcgtgctgctggtaaggctgcttgaaaggagaaaccgggtttgatgaaagctaaaacgaccgacaagatcgctacatttgtaatctgtttcttcgccttgttcattgttgcacttttggttggattactgggcttcattttagcccgcggagtcagtcatatttcttttgactttttaaccagtgctccccaaacattacgtgcaggcggtggtattggcccgcaactatttaattccgtatttttgttaatcttaactttgattatcaccattccgattggctggggcgcaggtatttacatggcgcaatatgcaaagccggggaaaattacggactttatacgacttgtcgtcgaagtattgtcctccttcccgtctatcgtcatcggattgtttggactactacttatcgtaaatacgtttgattttggcttttccctcttatcaggagccttggctttggccgtatttaacctgccgctgatggttcgcacaacggagcaggctttccgagctgtgccgaaggagcaaaaggaagctggacttgcgcttggattgtccaagtggaaaatcatcacctccattttgttgccagctgcgctgccaagcttgattacgggtaccattttggccgcaggccgtattttcggggaagccgcagcattgctgtttacagcagggatgagtacgccgccgcttgattttactgattggaatccattgcatgccagatcgcctattaacccgatgcgacctgctgagacattggctgtccatatttggaaggtcaacagtgaggggattgctcctgactccaaagatattgctgcaggcgcttctgccgtactggtgctgcttgtgcttacattcaacttgagtgcaagatggttcggaagagttgtataccgccgtctgacagctgccaaacgtatggattagaaaggggatggagaacaatggaacatgtgattacgcgaacggtaaaaaccgccgcaccagcaacatccgttcagtctacgcgttcggaacagcttgcggggcaaccgccgcatccgttcagtactgaggatttgagtatttattatggtagctttgaggctgtgaaaaaagtgaatctggcctttccggaacagacagtgactgccctgatcgggccttccggctgcggtaaatcgacctttttgcgctcccttaatcggatgaatgatgagattgcgtcttcctctacaacgggacatatctggatggatggacaggatttgacggcaccggaaacggacgtgatcaagctgcgtcagcaaattggcatggtgtggcaacgtcccaaccctttttacaaatccatttacaataatatcgccttcggtcccaaataccgtggggtgcgcaagaagaaacagcttaatgaaatcgtcgaaagcagtctgcgtaaagcggcattatgggacgaggtcaaggaccgccttcacgactccgctctggcgctgtctggcgggcaacagcagcggctttgcattgcacgtgcactatccgttcagccgaaaattctattgcttgacgagccagcttccgcgctggaccctgtgtctacaggcaaggtagaagagctcatcaccgaattaaaaaaagaactgcgaatcgttattgtgacgcacaatatgcagcaggctgcacgaatttccgattatactgcttatttttatattggaagtctggttgaacatgggaaaacgaacgatattttcacgaatcctgaaaatgagcttactcaggagtacatcatgggtcgatttggttaagcgatgttgctcatcgacctactatatatgagctgcacgtaaaatcctcttactaatccagcattagtaagaggatttttattgtgttcaacgttttgtaacttttttaatctattagtaaattaaaatatattgatcgtttgggtatattttcatataatacaactaactatttatcatgcataaatagtggtttagttcccctcgctatcaaaaagaatcttctgcaagagtaaatagggttaaactgaacacaattacccaaatcaaaataagggagagggttcaaatgaagaagaagatgtgtccaaccgtaaagatgatagcgctttcaagtttggcaattacagtaacgtcaggactcctaagtccctcatgggctgcggcacaggagatggtgccgactacatatgattcaggacgtgaatcggcgactgcttcttatgaacttaccacagattcagctgtgcgacgggacgtttatggtggtgatgtaaattcaggtgttttggatcgtgagccattatttgggctgtcggctgtggcgaagccaaccgctgttgtgaatacagacagcctcctgaacaaaatgcgcgactttagcaagttttctacggggaatatatccaaggatacgacgcttgccttaaatattgtatcctggcaattgccgcatggcggattcttcaaagctatggaaaagaattataaatctaaatgggatggcaaagctgcacgctccacatggaaaagcaaggatggtgttgaactcggaacgtttgataacgaggccacgacaaccgagattcgttttttagcggatgtatacaaaaaaaccaaaaataaagatattaagaacagtgtacaaaaagcagtcgacttcgtactaacctctcaatattcctcaggtggctggcctcaagtataccctaaacgtggtaattattccgatgctgtaacttataatgatgatgcgatggtcagagttatggttttggctgacgatattgtgaacaagaagcagccgtttgatagcgatattctggataactcttaccgctccagacttcagcaagcgctaaacaaaggtatccagtacacaattaaatctcaaattgtaaataatggtacaccaacaatttggggggcacagcacgatccggctacttatgcatctgttgaagcccgggcatttgagttaccttccaaaacaactacagaatcagtaggcattactgcttttctcatgtcccagccgcaaaccgctgaagtgaaaaaagcggctcagagtgctttgaaatggtttgacgcgaaccgaatcgacggtatcaaatacaatcgtcaaggtccggagtttttccaaaaggacgcatcgagcgtaatgtggtatcggttctataacgtggaagacaataaatatttcttttcagaccgggatggcaaaaagtataccgacatcatgaaaattagtgaggaaagacgacttggttacgcctgggcgggaagccaggctaagagcttgctcaagctggcttcggatagcggatattataaactgtccaagccgttgccacaataataaaggcattattatatatgattggagagggcggaccgttcggtcaatgtcattaagataag

SEQ ID NO: 2669 - DNA, 47817 bp, Unknown
  Kingdom: Bacteria, Phylum: Firmicutes, Class: Bacilli, Order: Bacillales, Family: Paenibacillaceae, Genus: Paenibacillus
cttatcttaatgacattgagagtaagggagattcttttatagtatcagaagtgaccggcaggaattttgtatatgaagccaatataaacgtgccggatacagattcccaccccagtgattctggaaaagattcgatagacaactccattggagcaggttcgttggtttttcgttctgacttaacagcaaagaattcgtattcaacaaatatggatataaaaaataatattgtgaaattaattaaatttgttgatgggaccggatatgaaattgcgacatataacaatgatggaaaactggatttacagccaaatacagattatcatctcaaagtagaagcgcaaggcgatatcactaaggtttatttgaacaataaattagttatcgacacaaaagatcaaacttataaggaaggacactttggtctcaatgtacgggatacaacggctttttttaatgaagttaaagtgaaactaaaacataaagatgaatgattaaagttggttaaataatgacatttgtaactctatgagtttagtttgtgtcgccgcacagcgacacaaactttttttaattatttggggcgaagaatacattgtaagcaaaatatcaagtggaaaaggtataaagttggaagagcaatttttgttcgtatttaatcgaattgaacaaaccaaacataacttaatgaaggaggtattatcaatgattatgaatgatgagaaattactgcaatattatctggaactcaaaggtccagaggcgggagaatggaactcctctccacagtgcattcacacacagttggtgacaagggattacgtaaagaagacattcgatatttttgatgaaatccaagtatgtaatgttggtatcggaactggggattgggacgattacctaggatattggctgaaggaaagaggtggtttaaccagcattgatattgacgaaagtatttgcgagatatttaagtatagacaacagagagagcggcatccgaatccatcaaaggttttatgcaagagtatattcgattccgatttgcctcaagaagcctttgatattgtaaccctaattgggtccgctattaatgaaacaggggaccttaaaaaatgcttagattcgtgttttagtttaatcaagcatgggggatatttgatgtttatggcaagtttaaaatatacatccgttgaaatgttggaggaatacataagtaatactaaatatcatattgtgcaaaaaaatgtatacgaagtgttccctgaatatccgtttttcatcagcaaaatcagaaaataatcaggctaagtgtaaattgacttactgcaaccactctatttgtataggattggttgcacaatctttggtacttcgcgaatacttttttctttcatttgcgatataaaagttttcatttgtaaagtgattatatatattcttaccttccttcagtcattttcatcgacctatcaattataaggacgcgatgctctcgcttcattttattaatcgagactaatagagatccgcatcataaataataagtttaaatatttaccaagctttccgtcattcattggaaggtgccctgatcagtagcatctttccaatgaatgacggatctctacataaaaaggtgtccagcgaccttagagatcgtcggacaccttttgctgttcttacgcttcgttccttgattcaaccttgcgctacgaaacgattaacttcttctaacgacggcaaggctgcaatcgctccaactttagtgcacacgatggcgccgacttgattggcaagtgtcacaaattcctgctgctgcttcgcgttggaggtaaatgccttaggctgactcagctggctgatttgatacagcattgctccgacgaaggcatctccggcaccagtagagtcgatcgatttgacagcgatactgccgattaacgaacgggaggcaccacttgagatgagggttccttctttccctaaggtaaccgccaccgtcttggctcccaacccatgtaaaagatccaatgaagcatcgcggtcagccagccctgtaatgatgtttaattcctcttcgcttacctttaccaaatccgcattgtgtattcctcttctggacagtgtgataaattcctcctgcctgtctttccagaggtccccccggtaattgggatcaaaggaggtgaattgcccattggccttcgctccatccaataaagacaaatacgcttctcggaaaggatcggcgagcaaggccgttgccgagccaaaatgcagaatggcagcctgccgggtccattctctatcaatatcctgcagagacagttgacggtcagctccgcggttgaacacgaaatcccgttcgccgttagcggcaagggaaacaaaggccagtgtagtcggcgttgacggatcaaaaaggagcatggacgtatccacatgctgctcatccaacgtttgcttcaggtacatgccaaagggatcagccccaactttccccaagaatgacgcttttcctccgagcttggctacggctgcgcttacatttgccggagcgccgccggcctgcttggagaaatgctggcccttggcaagattaacatcaatatccgtgcagaaaaaatcaatgagcaactcgcccacacaaagaaccgttctgtcatttttcactttaattcacctcttggtagatttagtttagaacaggggtcgagtcccggtatacgatatccgttgcgacatgagtcactcggtatggcatggtattgtctttgattctggacaataacatttcggctgaaataatacccatctgactactataaatatgcacggttgtaagatgaggctcgacaacccgggattccgaagcatcatcgaacccgcaaacagcaacatcttccgggactttaatccctttgtttttcaaagatttgatcacgctgatggcaatgaaatcattggcgcaaataaagacggagggacacttcctcagggcatccaactgctgttccatccagttctcctctacaaagaagttgcggtcaggcgctacaatgctaagggcaggatctacggcgattcctgcttctgctaaggccttattaaatccggcccagcgttcattgaagcttttgcaatgattgtaatcgcctacaaaaccgaagctttcatagccatgatcgatcaatttccgggtaacacagtatgtgctgtgttcattttccattaataccagatccgccttcaattctggatacatcatatccgcagcgcaatcaataaaaatggttgggatgcaaagatctgtgatcagcttgctgtattccttgctgaacatttcgatgcagaagatgccagccacattcgaaggttcaaaattgccgggtagagtcattgaattgatatcattctcacgaacaaaataaatagataaagtatagccctgtttgctgatttccttctccagtccgctgatcaacaaagatccaaagtgtgagctattaggaagattacaggtcaaaagtgcgatattgccctgtttttcagaagctgtttccatataagaaaattgtttgtatttaagctccattgcttttttgaccaccttgtccctagtaacggcgggaatactctccactccattaagcgccttggaggcagtgtttctggaaatccccaaggcatcagcgatatcttgtatcgtaacctttgactttctcgtcatattgttcaccttattctccgaattaagattcttcatatttctaaatatatagtattttcatgtttttaacaatgtatttattcaaatgaataataaaagtttacgtttgtttatttatattgtgcaattttgatagatttttgctgaaaacattacaattatcttgaaatacgccttttgaatgaatttttcatccgaaatatattgactaattaaatgtgcatctgataaattgtaagagtaaaatatgttcaaatgtaaattgtaagcccattcattttgggaatgtgtaaaattctcgttctgttggaggtgtggatattacaagcaagtatttgaaaaacatcttggttaattatgtcagagagatgacataacatggcttatattttgtgtcgtataacaagccgtgaacagtaggagggaaaatattggcaaattcgatcgttcaaaaaaggggactaaaggcttcagaaacaaaaaaaagaaaccattggttaagctatatgcttcgaaattatatactgtatttgtttctgcttccgtccataattcttaccgtcattttcaagtatgttcccatgtacggctcgatcattgcgtttaaaaatttcagcccaagaaaaggcatcatcggcagtgaatgggttggatttgaacattttcagcggtttctttcatcaccaaatttttatgacattttaatgaatacgcttaaattaagcgcttacggtcttattctcggtttcccagtaccaatcattctggccttaatgctaaatctggtcagaggagcgaagttcaagaagaatattcagcttattgtatacgcacctaacttcatctcggttgttgttgttgccggtatgctgtttgtttttctatcgccagctggaatagtgaacgctttggtaacaaccttcaccggcaagccgattgcttttatgaccgatcctgcctatttccgaacggtatatattttgtccggtatatggcaaacagcgggctggtcctctatcatttatgtggccaccttagccaatgtggacccgcagttgcatgacgctgcaacaattgatggcgcttcattgatgaagagaatcttccacattgatctgccagctcttaaacccgtcatggccgtcctgttcattctcgctgcaggaggtattatgtcgatcggctatgaaaaggcttacctgatgcagacggctttgaacacacctacctcggaaatcatcgcgacttacgtatacaaggtggggttgcaatccggcgattatgcttattctacggcaatcgggttgttcaattccgtaattaatgtattcctgttgattttcgtaaataccgtcgttaagaagctgaacgaaggagaagggctgtattaaagaaggaggtatttatggatattcattacaccgggaaggaccggattctgctcatcatcaattatattctacttggtttgtttgttctcgctattctgttaccgctggtttatgtggtgctttcgtcctttttaactccaaataccctgattaccaaagggtttgccattacatcatcagactggacactcacgggatatgccaaaatcctaagcaacagtgccatgatccgcggtttttttaatgctattctttattcagcagcctttgcgttcgcaaccgtattattttccgtcttcgcggcttatccgcttgcgattgaagagttggtagggaaacggtccattatgatctttttcctgataacgatgtttttcggtggcggtctgattcctacctatctggtgattaaggatttaggcatgttgaatacggtctgggccattattctgcccggctcgatcagcgtattcaatattattctggcaaagacttatttccagggacttccgaaagaactgttccaggcggcgagtatagacggagcttccgagctcagtattttctttaaaatcgtcctgccgctttccaagcctattatttttgttctagctttatacgcttttgtcggacagtggaattcttatttcgacgccatgatttatctggatgatccgaagctgtttccgcttcaactggtactgcgctccattttgatacagaatcaggttcagcccggcatgattgccgatgcgatggcacaagcggagcttaagaaattgtctgaaatgattaagtactctgccattgtcatatcaagtttgcctttgattgtcatgtatccattcttccagaagtatttcgaaaagggtgtcatggtaggttcgatcaaataacaaatcgggggaatagagatgaaaaaaacattactaaccttgtctgtgttggcactttctacttcactgcttgccggatgtggcggttcaggcaataattctgcggcatccgaagattacaagctggaaaatgttaatctgccgcttaaagagaaagttactttgcattttatgactcaaagctcgccgctggcaccttctgatccaaatgaaaagttgatttataaaagactggaagaaaaaacaggggtgcatatcgattttaccaacttcacctccgattccttcattgaaaaaagaaaccttgctgttgccagtggagatcttccagatgccatactggatgccggatattccgattatgatttgttgaatctcggaaaggatggaactattatccctttagaggatttgattcaaaaatatatgccgaatctgcagaaggtattgaaggaagcacctgagtacagatccatgataaccgcacaggacgggcacatttatgcctttccttggattgaagaactgggttctgagaaggagagcattcattctgtaaacgacatgccatggatcaatgtagagtggctgaaaaagctgggacttaaaatgccaaaaaccaccgaggatttaaaaaaagttctgctcgcatttaaaaatggcgaccctaacggaaatggccaagcggatgaaatcccgctgtcctttatgctcaataacggcaatgaggacctgaattttctgttcggatcattcggtcttggggacaacggcgatcatacggtagtgaccaatgaggggaaagtggtcttcactgccgatcaggatggttataaagaggggattaaatatcttaatgagctgtataagctgaacctgatcgacgaagagtcattcgagcaggattacaatacgtatctggccaaaggccagaatgaaaaatatggtctctactttcaatgggataaggcgaacatctcaggagataacgataaatatgaattgatgaatccgctcgccgggccaagcggtgaagttaatgtgacccgcacgaacaatctcggctttgaccgggggagaatggtgattaccagtgacaacaaaaatcttgagcttacggcaaaatggattgaccaactgtatgatcctatccagtccgtacaggacaactggggcacctacggcgacaaaactcagcagaacatttttgaatacgatgaagcgagtcatatgctgaagcatcttccgcttaagggaacggcccctgtcgagctgcggcaaaaaacgaatatcggcggtccattggcaattcttgacgagtattacggaaaagtaacgaccaagcccgatgatgcagtgggacggcttaagctcatgaaggaaagactcgttccttatatgaaggctgaccataatttcccgaaagtcttcttctcgctggaggatcagaagcagatctccacattggaaaccgatttgtttgcttacgttaaccgcaagcgggcggaatggatcaagacgggtaaagtggaagaagaatggaccgaatataaagccgagctgtccagactggggctagataaatggctggaaatcaaacaaaaaggctatgacagatatcttaaagatcaaggctgaaacatttaaatggtagtatctcaaattcatttgcaaaaactcaaattattatgttaaataccttatcaacaatcaaaaggagagcggatactatgaaagaattaaacctaacggacgactatagcggcagaaagagaaaaagtaactatagtgagacgtacaggcctcaatttcattattcaccggagaaaaattggatgaacgatcccaacggcatggtttactttgaaggagagtaccacctgttctaccagcataccccccatgatacgcaacctgattttggcaacatgcattgggggcatgcggtaagcaaggatctagtgcattggactgagcttccaccggcaattccacctggggaggacggagcgatcttctcggggagtgcagtggtggataagaacaataccagcggatttttcgacgaggaaggatcaggattggttgccatttatacgaatgagggcaacaaggctcagcctggaaagccgcaggtgcaaagcattgcttacagcaaggataagggtcgaacctggacaaaatatgaaggtaacccggttttatttccaacggacacgctagactttcgtgatccgaaggtgatttggcatgatgaatcatcaatgtggatcatggttcttgccgtaagggaccgtgtagaattttacacatctccaaacctgaaagaatggtcttttgcaagcgaattcggttccgacattccgcatatccaccgagggatatttgaatgtcctgatatatttcgaatccaagtggatgaggatcctaataccacgaagtggattctgatgctaagcgtcggggatagaaatggtgtgaatccagacgatccggaaccaccggcaggcggttctggcatgatgtatttcataggcagctttgacggtaagtcgttcacgccagatgaagcgttggaatctatcgatactatcaaatgggtagactatggatcagacttttacgcggccgtgtcatggaatggcatttcgaacgaagacggacggaaaatttggatcggctggatgaataattggcgttatgctaccacgcttccttcaaaggaatggcgtggcaagacatcaattccccgggagctacagctaaggacttacccggaggggcttcgcctaatccaaacacccataaatgaattaagtcagctaagaaaaccgattttgtctctgcaagatttgacgattaagccaggtatgaacgtgttgtctgatatttccgcagccaaggcagaaattattgcagaatttgaaatcggtactgccgtggaattcgggtttaaagtacgaaagtccgccaatcaggagacgatcatcggatataatatctcgaatgaggaattgttcgtcgatcggacgaagtcgagcgccactgattttcattccgatttcacagcaatacacaaggccactatgaagccagagcatgagaggatacagatgagcatttatctggattggtcaagtgtcgaagtgttcggcaatcatggaagaacaatcatttcagacatgattttcccggacttcgaaagtaagggtctagaactctacgccattggtggagaactaaggatcgtgtcgcttcagatcaatgatctggtaagcatttggggaaatgagaatgtttagacgttaactattgatatcattcaaattttaattatctcacgaaggaactcattgagtagcgagtgtcaaattgatttttcaatttgacacttttttatattggataagataatgagtttgtgtaagctaaatagcaataagtctgttaagacttagttgtagattcattttcgaatgaacctctctcgggtaaattgtgtattcttcttatatagacttttggatacaaggaggcaacgtccgtggattcaatgcagcatattattggctctaatttggctcaaatcaggaagactagaggattaagtttggataaggtggctgaactgacaggggtcagcaaagggatgctggctcagattgagaaggggaaatccaatcctacggtaacaaccctttggaaaattgcaaacggtttgcatgtatccttctccacctttctcaaagaagacccgccgcaaatcacgaagattcggagggaagacctgcatccggttattgatgaggacggtaactattttgtttaccctgtattcccgtatcacgctgaaaagaagtttgaggtgttcacggtaagtctgaagccaggctttacacaccaggcagagaagcatctgggtgaggaaacgattctcatgatccgtggggagatgtactttgaaatgcaggggcaacagctcaagctgagtgcaggggatgctgtgcaatttcaagtatctgacatacatacctaccgcaatgattcggaagaggatgccgatttttatgtattgatttattatgcggattagtgggatgattagcatagtctaaaacaggcttccacatcaggattttgcaaaatccagagatataaaaagagagcaacgaggaaaagagaggaaagaacccatggaaagcaagtacatccgagaaacctactgcttcaaaacgtcccgagtatttcccaacgatatcaacaatcataacacgctcttcggcggccgattgatgtcgtatatcgacgatatcgcatctattgcagctgctaagctgtgtcgtacaaacacagttacagcctctacggattcggtggattttttgctacctatccatccgagtgattctgtcacgctggaagcgttcgtaacctggacaggccgtagctcgatggaggtgttcgtaaaggtaattcgtgaaggactgatgactggcgaccgaaaaatcgcagccacagccttcctgacctttgtggcattagacgagaacaaccgtaaagtgaccgtgccgcaggtgattccagaaacagaagagcagttacaattgcaccagacggctccatcacgcgcagccatacggcgtcagcggagggaagaaagcaagcagctggctagttttctgacaacagattatccgtgggaactgtaacgtactagagattatcaatttcatcgttttacgtaaaaaggagccgtcttttccgttagcagtctaccatgatctgcttggaatacggctccttttgaaaataacttgagctattctactttaactacacggaaatgctgatttgtcccaccgttatcgccccattggatggctttagctccatcggcggtggcgccttcagaaatatcgatcagcttgccagttgcccgatttttcagcttgtaataaccaccggttacggatactaattgccaatgctgactggaccagcctccgtcgctccactgctcaataactgtgccgtctgttgtcgtaccgctttcaacaccaattagctttccgctgttgcggttcataattttataatatccgctgcctgcatccttgagctgccattgctggtttgctgccccggaatttgcacgctgctccagatctgcgccgtccgtcgttgcattgccaataatgcttagtggcttattgctcttgcgattcactagctgataataggcatccggatcaatggcaattggcgtcgttatcccctcgaccacaccactggcggtgtcaatattaatgctgtcgaaccaatccatggctaatgaagtcgctgttggaaaacgcagtggcaaccatacatattgagaatcctgcacaggaccgctccacgcacccgcccaacggtcgcccaaatacaggtatgaagttgtctgggcaccttcaacaggaatcacgtaagccgactgtgaaccatatgtcgtaccgtccccgaagtttatcgtattactccaggttccttcaatgctggatgcggtagcatacttggcctgattgggattccagccggttgccccggatgtaatcaggaagtagacgtctccttttttgaacatcgccggagcttcacgatattgtccaggccaaagtgtagtcaccagcgattcaacttgcagaaaatccggtgtcagtcgataaatgttcagatctgcgtttacccgggtagccgaaatgaggtaagctgtaccgttatcgttgtatacggtcatatcgcgcgaatcgtaatccagaggacggaagctgccctgatacgtgtaatcgccgtccaccgtatcggaagaggcgacagccactcgggcctcgttgtaattaaccccattctccttgtgcatccataatacgtatttacgtgttttttcattataaatcactttcggacgttcaatattcgaaacattcagctctacggcggagctgctggttagtacgtttttacgaaactcccagttttttaaatcagaggaacggtaggcggatatcgccttgaacgtgccgttgggattacgattttcaccaaaccaataatagtaaccgtctactttaatcataccacccccatgggcatggaccacgtttccatctgtatctttaaactgaatgccattcacgacattcgctgaagcggctgaagcgatcttaggtgaaaacatctgaaaaatgctcaacgtcagcaaaatagagagcataatacacagcaagcgggcaaaatcatatttcattgtttcgtcctcctctgtatgtgttattttaaagcgctttcattaatggactctatgaagtagttttaatagagctacttatcccaattgtatccatattgaattgaaagtgctagagtagtatattgaccatgtacacggcacacgccatccatatctaacagacttccatcgagcggtgagtgttacaaactggctgatattcattaggtatacaggaggcaaccatgaaaatatacgcgattgatacgagcaagccggaggctgaggagcattacgaatcactggtaaatcaggtttcgctggaaaagcagcagaagttagatcgttttttacatcgggaagatgctttgagggggttatatgccgatgtgctgctaagatggttggcctgccggcaattgaaggtatctaatgccagtcttcaatttacatacaatgcattcggtaagccttccttgattaatgcacccgcattccattttaatgtttctcactcgggaaaatgggtggtatgcgctattgatgatcacccgcttggaattgacattgagcagctccgtcctattgatttggaggtaggtagagtgtgcttttcggacacagagtatgatgcgttaatgcgtcaggacgcagacagccgcttatcgtatttttacgatctatggacgcttaaggaaagctttgtcaaggccgaggggcagggactaaccctaccgttgaagtctttttcatttgagctaaaggcacaaccattcataggcttcacgacagagggctttaccaccgagtattgtcattttaagcagtatgagctggatcaggattataaaatggctgtctgtgcagctcatgaccaatttgcccagcaggtgcagcagatagatataaatacactacgcttggaagtggcaacataggcgtaatatgaagtggatatgcgtatagttgaaaaaaaggagatgagtggcgttgacattcgttttgttcaagcacggccggttgtatggggagtgggctttcaaaggagactctatcgttgtacagcatggacggatacaggccatcgggtatgctcgggagcttgaattacagttgtccggtaaggaatatgaaactgtggattgggaagacgcctatgtactgccaggcttaaccgattcacatatgcatttgtctatgcatggtatgaagctggctatgctggatttaacatcagctacctccaaggaagagatgctggctatgctgcgcaaacgggtcgctgtaacaccgccgggagaatggattttaggactcaactggaatgaaaatgcgtttattcctgttgaaataccggatatagccgagctggatgccattacagatcagcatccggtatatctcactcgtacgtgctttcatacgttcttggccaattcagaggcatttcgacgtgcgggtattaacgaggacacccctgacccggcttcgggagcctatgggcgagatgcagatggacggttgaacggattgatttatgaggaagcatcctttgcctttactagtgtgcagccagagccggattattcggttaagaaggatacgattcggcgggcttgtatggatgcgctaaggcttggtttgactgctgcgcacacagaggatttacgttttttgggcagcgtggagacgatgcagcaaatttacagggagctgagggaagaaggtcttccttttcgcacacaccagctcatctatcatccatttttggaagaagcgaaagtgcaagggctgcgttcaggtaccggaaatgagtggtttaaaatcggtgcgataaaaatgtttgccgatggcgctattggtggaagaacggctttattatccgaaccttacagtgatgctccacatacctgtggaatggcgatccaaccgcagccagagctgaatcagatggtggctgctgtcagagcagcaggctatccggtggctgtgcatgccataggggatggggcggcgcacatgattttgacagcgatggaggctcatgcgctcacggaggaaagcggtttgccagaccgcctgatccatggacaggtgcttaggggtgatttggtcaagagaatggcgaagctgccgctgatcgcggacatccagccccgttttgtcgcaagtgacttcccttgggtactgggtcgggtggggaaagaacggactgaatatttatatgcctggaaaaagctactggaagcaggcattccatgtgctggaggtagtgacgcgccgattgagccgttaaacccttttcttggtattcatgcggcagtgactcgtgccaagccggaagaaatgcatgagggctatcttcccgctgaaaagctggatgtacatgaagccattcatttgtttaccacgggaagcgcagtagcagccggtgaggctgatgaaagagggacgatagctgaagggaaagccgctgactttacagtcattgaccgtgatgtatcggaaagcccgcaagctttacttgatgttaaggtacgaatgacagttgtaaacgggaaagttgcatatcggtcataggctgggaataagtatatatgtcaaaagccttcaacttcacttttcatgtgaggttgaaggcttcgtattttataaaccacgctgtataaatcggtctgcgttttttacactggaccacagatcagagctggctccgcccggataccagtaggcgaagccagcaaacccagcatcctgtcccaagcgatacttacgagtgaaggatcgtccttcctcgagccacagcttatgaagctgcgtgtctttgtaagacacggtatactgctgaatatcctcattccagattggtttggaggcggaacgggatactagctggttttgctgatctagtgaaatatcagaggaagcgattgactttccgctagcgttaagcgtccaattccgtgtaaataatggcaacgccaagatcgctttctccggatgggtggtttgtacaaaacgccgcacgctatcacggagccatggcagtgaggacacagagccggggatcgagctacctccccaatgctcgtcatatcccatcaggatcagatagtctgccgcagcgccaagctgtttataatcaaacgcggcagtccagtccgttccgtaatcaggagatacacaaatcgccagtaccgtattctgactcttcaacttagcttttaattgttggacgaacaatgttaaattggcacgatcctgaccatctacattttcaaaatcaatgacaagtccgttcaaaccgtacactgatacggcattagcaagctgagttatggttgtatttcgtagaacctcactggacagaatttggtgcgtcagtgccaggttggaacggttgcctaccatcgcccagatatttttatgatgctgtttggaccaggcaagcagcgacgaattggtataatcgctgataatacctgtttcatttagaaaaaaccaacgtggtgatagggtgttgatgttggattggagcaccgtattttcaaactgctgaacggtttgatcatattgccagcctattcggatggaagaagcggtggaagcagtttggttagcatgctttgttgaatacgttagcagtcgttccagcaatactgctgtttcttcacgggtcagagaggatgcaggacggaaatagttgctttcacctttcataaagccgtaacgatttacggtggttaccgcatcaagggcccaatctgcaatttcgccagtatctgtgaaggaggaagtagcatctcctgatccgcccgaagagcggatgagacgtgcgatcatcaaggccgcttcttgacgggttataggactattaggttggaatgtggcagacgttcccccctgaacgatattgagttgagaagccgcttcaatccatccatagtaccacgtctttttggcaacatctcggtaggaggaaacggccgcttgtacaggctccagaccgagtgtacggtccagtgcggtaacccattcggctctggtaacagcctttttaggagagaagtaaccaggttgtgtaccattcaaaattcctttagcgtgcagggaaataatagactgataggcatagctgtgtgcaatatcttggaacgtagcgccggatgctgctgctggagcagctaagtacgaagtgaatgttgtgaatattgtgatggctgcagttgctgaaagcgtgagcctggttaaccaacgtgatcgtttggaactcataccaaataaccttcttttttatgatagattgtagactcatatatcgttactcgacgaataatactatcaaaaagaggaaagttattcattgctaaattgctggaaaaataccaaaaaacccgccacctatgcggcaacgggtttgatattggataaactatgcttttttggcatacataataccgatggtctgtggaccacaatgactggaaatgacacagcctgctgtagttagcagtacctcttgtgcgttcgtttcttctttcaagcgagcttgcagcattagcgcgtcttcctcggccaaagcgtgcacgacaataatgatatcgttatccatctgatctcgttgattcagtgcattttgcagcatctgatccaaagctttttcacgtttgccgcggactttgtaggcaggcgtcatttttccgtcaatcactttgatcaccggacgaattttgagcagacttccgatcaggttttgcatgcctgaacatcttccgcctttatacaggtattcaagtgtatcaatgacaaattccgtgtctatgagcggcctggttttcgtcaacatgtctacaatctgctctatcgtattaccgttggttgccaaacgagcagctttcatcacaagcaggccaaagccgcacgatagattcaaggaatcaaaaaccgtaacgcggccttccggaaattcagaggcagcgagtagcgcattctggtatgtcgatgatagctcggaagacagactgatatataaaatgtcgtccccttgttctatgtagggcgcaaaggcttgaataaaatccgatggagaaggtgcggcggtacgcggtaaatgtccctcgcggcttacacgttgaaataattgttccgggtgaatgttcaccccatcctgcaatgcctcatcaccaaatactgtatacaatggcacaatgctaatctcgtactgttgacgccagtgagcaggaacatcactggtactgtcggcaaaaattttaattttgttcatacattgaatcctctctgtgtgatgcagaaaaattataaagattgcacggaggaaggatagatatccgctgtgctattcggaacggaaagaccgatggccagaagagcaataaagcccacaataataagtgcattaatgattaagcctgtaatagcaaaggttttcttacggttttttaacgcaattccaatgataccgaccacaagtccgctacaattcagcaacaggctgcctaaaaaaataaaaggaagcaataccgttccggtttgctgcagagcgacttccgggttcaacgtttggtattggctgaaatgagccagcagattaatgaccataatagccagaataatatatccgatcaggctgacaagcgacataataaaagaagcaattccgggaccggaatgtttgagcttgaccggaggctgaaacacaggagcttctgaaaaaacagggtgctcctcagacgcagcaggtttttgcaaattaggatcttggtaactcattttttccactccttgaacatagtccgaacaggtactaattttccacaaaataaacaaaaaagcaagccatcttacacattacccttcaaaagacagggtctaatcatccaattctgtatgcggtctgttcacacacgctggctggtaaacttcatacggtttcgataaaataagaagaacattcggctaaaaggatgagatgaaaaggagtacacaaacatgcaacgaaaatggatatttgtgggatctataatgatgatgttggcggtagccattggagcgttcggggcacatattgtgaaaacccggatcgacgcggatgctttggccgtgtatgaaacaggtgtgaaatatcatatgattcacgctgtcggtttgctgatcattgcgttggctgccggacagtggggtccttccaaccgtttaagatgggcggcgcgcctgttattgacgggtatcattttgttttctggtagcttgtatgtgctaagtttgaccggaatccgtgtgctgggggctattacccctctaggaggcgtgtgttttattgcaggatgggtattgttggcatgggctgccatgggtctgaagaaagagaattagagttcttttcggataatgcaaaaaaagagaatggacaagaaagacgtcatgtttttcctgcccgttctcttttttcatgcttcgtttttttgtgaagtatttacatttacgatgtgatttcatcgatctcattcattttaaaggagtacacttgcttctcatctacatgatacacactcagcaggctattatcatgatccaggttgaggatgcggcaaggaatgctgcgctgtccgccatagcggttcacgattaaccgtacaagcgtattatcatgtatatagcgtttgatccattcatacgtactaaggtcttgttgtgttgcaggctttggctgtacgtgggattgtttgatttcttgaacgactggtggcttgttcgtaattgcggctgatttctttttagagaatttttccgcgagcgtagcggctgcatcagatgggctattcacggctgactgtttttttaggtacagtgcagcttcaattaaattgccaagttcgataccggattgaatccggctatccgcaatttgctcattttggctcaagagattaagcaggaactgaagggcctctacgttcgaacgacctttaactaatacatctacattaaataaataactggtttcgtcttgatttgattcctttttcatacatcctccagcccaagccatgggtaattagtcttttatagtacctatcaatatatcattaaaacgtaatctatcatagtgcctaaggccctgttgttggatattaacaaaaataaaatctatataaagccctatgcgtaaaattttcacagataagcaaagccagagttacatatacagagaataaaggaggtagggggtgaaatcaagtagtttaaattttaaatatattacagtggggaaatataatataacgaagcagtatcatccatccagaagaaaagtaagatcccccttaacgaaagggggagggggcatatcaaaaacatgatatattatagtaagcgtaattaaagtaaattttattttcgatcaaactcgtacatttcacctacaagcacttcgttgatggcatgcctgaaatcttcctttgttggggattcggccgcttcctttaatatagaaaaaaagtttttaggatcatacagacgaagtggggaaaagaagggtccatgtgtcaacggccaatcgccctcaacagtagaggcaattttaagaagaatgtctgaactacagacgttcacctcagctttccagggccctgccgaccattcatggctaaattctacggggccgtttggttcactcagtacgcaaaacatttcaatgtccgaaaaagggacgtcagtacctttggcaacagatccatagacccctatagccagaattttgtctctgtatacttcatgtaacctcgcagctatttcgtggcaagtctgaagtctctcacttcgagaaatgttgacaggtccattcatgtccattagtgacctccctctgtttcctacggtctaagtgacttgtccaatttacggattcgccattcagcgcgggtttaatttcacttgcgagcccttgccgcccgtctggattccagtttccttcacccctgcttccttcagatcgaccagtagccgctctagtaccgctttggcgacgggggcttcttttgctccagacgctttaacgaccaactgcaccggtttgccggaacgcagatgtttgtctgcctgacgcagcttcgtgtcgtaatcatgctcctcaatatgagcagtgaagcgaagctccttgaccttttctttgccgctgtttcttgcggctcggccgacatttttgcttgctgcggtttctttttgcgccagcgcttttcctttgccctttgccaccaagctacagggcggtggactgctcatgagtgaggtacataccaggtccaccccttgggatcgggccatagccaaggcttctgacttggagacaacgccgagcttctctcccgcgagtccagtgagtaccacttcgtcagctttaatttgctcgttgattaatactgccacgtaaatgtagcctcccttaaacaatgataaagctatcatatacggaacctgtttgtgattcaattttagatttatccgtattgacaaaagtcactaacccctataatcttttactgataatgattatcattttccgatgcaatatacatacaggggtgactgaaagaaatgaaaaagatgttgaatagcctattattatttgtagttttgactattgtattggcgggctgcggtgcagctggggatagctcgaagacggaaggtactgcagggtctgagcagacatccacaacggctggtccggttacggttaaggacgaccacggggaagtcaaactggacaagccagcggaacgtgtcgtggtactcgaatggacgtttaccgaggacctcattgcacttggcgtacagccggtcggcaatgcagacaatgaaaactacaagctgtgggtaacgccggaggcgaagctggctgataccgtaactgatatcggcacacggggcgaaccgaatctagaagcgattgcggcgctcaagccggatcttattatctctaacgccgataacaatgcagcgatctatgcgcagcttaaaggaattgcaccaacgatagaattcgatccttacaaggggaacggctatgattacgaccgtatggttgaaatctttaagcaagtggctgtagctaccggtaaaacggaacaggctgataaggtcctaagcgaacttgaccagcactatgtagatgcaaaggctacattggagaaggcgggcaaagcagactttcactatgcgctgacacaggcctttacagctcaaaatgctgccagtctacgaatgttcaaagaaaattcggttgtagtgggaacgcttgcgaaaatcggcatggtgaacgactggaagtcggacaagaccgagaaatacgggtttagcaccgttggcattgaagctcttccagctgtacaggacagcaattttatctatattacacaaaagacggacgatgtatttggagctgcgatgaagaacaactcggtatggaacggactgaactttgtcaaagaaaaacgtacctatccgctggacggtacaacatggacattcggtggtcctatctcatccaaagtactggttgatcaagtagtgggagctctgacgaaatgacccgaacagacacaacgggtttatcgaagacttggcgtgtaggaagcatctttgggggcggattgatcgtcctcatcgtgcttttttttgtaagcttgtgttatggagaggcttcaatcccgctgcatacagtaattgaggcgttgacccagcgtcagaatacgcttgatcataacatggtgtgggatctccgaatgccgcgtacggtcatcggaatcctagcaggtggtgcgctggccatcgccggtgctctgctccaggccatcaccaaaaatccgctggcggcttctgatacactaggaattaacgctggtgcctactttgtggtcgtccttggcgcggtgatgtttcccggattgctgcatcaggcgccgtttctatttgccgctgtcggcggcttgcttgcagcggtactcgcttacttcatgggcgggggacgagctggaagtccgattcggttggcgcttgccggcttgattgtatccatggttctcggttcgtttaccggagctttgcatatcttttattcatttgaaacccagggactgtttctctggggttctggctcgcttgtgcaaaacgactggagcggaacaacttacgcctggccctgggtcgtagggctctcggtcactgccgttctgctgtcaaggcagtttgatgtcctggatctggatgagtccacatccacgtccctcgggcaaaaggttagcttgacccgggcggtgggaattgtattggctgtcctgctgtcgaccattacagtcagcgtcattggacccattggttttgtgggtttggtagctccgcatttggtgcgcttaagcggtctaaaaatgcatcgatgggtgctgcccggttccttcctctggggggcattgctgttgacgggcgctgacgtgctggcgaaaatggtccatcaatcaagcatggacctgccgaccggagccgtgatggccttgatcggtgctccttggttaatttggctgattctgtggaaaatgaagctgccttctggtattagcgggcagtcttccatgaacataggtgtgcgctctcggaaattaccgtatggcaggctggtcacgttatttggatgcggtgccgtgctgttgactgtattcagcctgatgtttggagggatgcgaattcctgtcggcgatctattgtccggcctgttcggcggtgagaacgcaaattcggccttgctgcagtttagaattccgcgcacgctggtggcagccggggctggtatcgcgcttgcggtcagcggtgtcttgatccaattagccgttcgtaatcccttagcggatgcctcgatcattggtgtttcttcaggggctggctttggtgcgcttgcagtgattatcgtttggcctgggctacctgtttatatgctgcccatcgcggcgattgccggagcgacggtgtcggcggcggtgatcttctttttatcatggaacaagcacctaaacccgtctgtggtcatcctacttgggattgctgtatcagcgatcggagcagccggcattcaggtactgattatccaaggctcgctttggggcagcacaggctatatttggctgacgggtagtacctacgctcgaaactgggggcaggtggcgacgattctggcctttctgctcgtgttgttgccaatagcctggtggctagctcgccgcttcgatcttttggtgtttgacgatagcagcgctatgggactgggacttccggtacgccgcactcggctgctggccatggcagtgggtgtgctgctggcgggtggagcggtagcctgtgtggggacaattggcttcatcgggctgattgctccgcatatcgtgcgtacgttgattgggcaccatgtactccgctccattgttctgtcgagcctcttgggagcagtaatgctggtgctggctgatacgattggccggacagtgcttgcgccgaccgaaattccttccggattgctgatcgcactgatcggtgcaccgtatttcctgtacttgatgtatcgctccaataagagtaagtcagtgtagttaaatatgtacttgaacaggctgcttcccaacggtgattttccgtggggaagcagtctttattattaattttctacgtaatcaatggactttatatttacaaatctaataaaatagatataatgttttatatggaaccgtcattgatttataaagcattgtcaaacgaaactcgtcgtctaattatgctgtggttaaaaaaaccagaagagttttttgatgaacaggcttatctaaaacaagggcttaattttcaaattggtgtatgtgtgggagatattcaggctaaatcgggacttgcgcagtctgtgatttcaagttatttattaacaatgcaaaaatccggtttgttagagtctgagcgtattgggaagtggacgtactatcgtcggaatgaaaaaacaatccgggaatttgccgagtacgttcaaaaagaactataaactgaaaggaggttttttttcacataacatatctagaaatctatatatataattaaattggaggcttatacttaaaatgaaaaaggttaacccgttacttattatcattctggctttaggcgtattcggcattattacaacggaaatggggattataggcgttctccctcaagtaactcaaaaattcaatgtatcagctgcccaggctggttggctcgtcagtattttttctttagttgttgccatttcaggtccgttcttgaccttactcgtttccggcatgaatcgtaaagtcattctattaaccgctgtattcagttttgtcatttctaatattgtctatgcctataccactcattttgaggtcatgctcatttttcgtgttcttcctgctatttttcatcctgtctttttttcggtcgctctcgtgactgcatctcatcttgtcccccctgaaaagagtagtaaagccgtcaccaaggttttcgctggaattacagtaggatttgcgtttggcgtgcctttgacttcctatcttgctgaaaagatatcgttagaagctgctttcttgtttggagctgtcgtaagcatgattgcatttgtgggaatactcgtatggcttccttccctgcccgttcaggaaaagatgtcttatggcaaacagcttggtatattacgtaaacctcaattgtggttcaacattgtgactgttatttttatctttgcagctatgttttcggtgtatagctactttgccgaatatcttggagaagtaactcttatgaacgggtcatggatcagtatgatgttgatggtctttggaatcgttatgatttttggaaactttttatttggaggattattacataaaaatctgacaaagaccgtcatcatgttcccattgctatatatggtcatttacgtattcacttatgctctaggagcttctttcctaccgatggttgtggttgtactcatttggggggccgtgcattccggggggctaattattagtcaaacatggttaaccactgaagcgaaagaagctccagagtttggtaacagtctgtttgtctcattttctaatctgggtattacgataggggctgctatgggcgggtggtttatctctcacttgggaatacaccagctcatctggagcggattgatgtttgcactgctagcgtttttatctatgattataaaaataaaattgttcaattcgaatgcaacggaagtcaacgtgcgttaaaatatggagagatattagaagagtactctagaagatgatgaccataaattgatgcatggggtgatgttgattgaatttcgtatggacttcgatcttaatgacattcgtaatcgttatcgggattttggcgttgctcatctggggagtgatatccttaattaagcgttttcgctaatcgcaatgaaggggtaggcatctctatgtacaggtgtaaccttgcatcaatacgtcaaattctcaattataacgggcatactcagcgatcagtagagcttttaaatgaggagattttagatttggaaggtgcagggtaccggattatacatgcttgattggaagtgcaagagcatttcgggaccagcccaagctttatcaagaaatggcgaaaagtaaatctctggatgaacaggatatactacttcaatttgcggcgttggatgtgaacgccaaacttctaagcgatttagaggataatcaataaccaatgtaatggtcctatacagtcctagacaaaatgccaatttggatacgtacagataatgggcttatcaattatttatgaggaggacgattgcattgaaattaaaagaagtgctcttaggcacacacagtttcgaagcgatgaaagctttttacggctctctcctggatttgcaggttgtagaggaggggccttcgcggttgtcgtttcaagtaggggaatcggttcttgcctttcaggaatcctcccacatgaaaaatgagttttaccatattgcctttacgattccaacaaataaattcatagaggcaaaacagtgggccatcgaccgtgggatttcattgatttcattgcccaccatacactcgataatccagtcgctgaagctttcggacccaactctatacttcgtataagcgagattggtcttccggtcgatgatgttccagaggtatctagaataattaccgaaaacgttccaacttaattcatggggaggggctggacagaaattcgcgccgctaggggatgtagaaggatcctttattgtcatagataagcaacgaccctggtttcctgatgataggcttccgaccgtgtgcagcatcagtgtcttgtttgaaggttcacactctgccagtctttcactgcataatggtttgtatcaattgagatcagacggatagtgcttcccatctccactacccccggatttctggaataaagcttacgatggggtggaaatccggggatcataatacatacaggagagaatatatgaatattagactacttaattcaaatgaaaaatatccaatagagcttttgttactagctgatccatcgcaccaacttgttgaggaatatttaaaaagaggggagtgttatgtagcagagattgaccatcatattgttggggtctatgttcttttacctacaagacctgaaacagttgagttagtgaatatagcagtgtcagaaggtatgcatggtaaaggaataggcagacaattagtaacacatgcaattgaaacagccaagacacaaggttataaaacgatggaaatgggtacaggaaactctagcattgggcagttagctctctaccaaaaatgtgggttcagaattgttggtgtagatctagatttctttgtcagacacaactatctagaagaaatttatgagaatggcatacagtgtagagatatgattcgtatgtctcaggatttatagagcttaaattctttgcaagcccatcaaaggtatcttaagtaaggttctgaaaggtatatgatattgtgccaaaagatggtacaataaattgcggaaaggctatacaatcattggattgcaatagtccttttttaataagttgatatcctactaagttcctgataaggggtggttactttgtacaacacaacaaccacgatactcacagagatagcaaaacatatgagagataatgatttaatcctaagtgatttagctagagaggcagaaatgaatccgggcaccatgagcagtattattaatgggaaccgcacactttcagtggatcagctagaccgaattacaaaagcaatggggcatcccgttggctattactacgaacggtatgtgtctgagtatttaacagaggctaatccgaattggcgtcgaatgagtccttttatacataattgtgcgaaattaaacaaactggactgcattcatgatgtggtcaatctattgatggataagttgggctattcagaatccttatttgagcttgcggaagaattatttcatgaaaagatgtaccaagcggcagccatactttatgaaaatgtagctttaagtgagaaaaaacaatactcagaacgcctcgctatgtgtcagtaccgcttgttccacactaggcaaggagacaatcaagagaaaaattatgaggcggcagttcaatttgaaatatatgttgaacgactagatgagatagatcagttagaagcgttaaaagatttggcgaatacataccgttcgttacgtaaatgggacaaagtagaactgttcgctaaagctttgggagacaaagctaaaattcaatacaaactagaacaacagcggcatcatatggaaaaagaaaattcaaagaaaccaagttttcctctgtttgcttattgggcattctcacatttacttcgtgcagaagcttgtgaagcgaggaaagactatgagcaagcactccagcacacttatgcttatgccgatttaagttgggtgaaagatacggatgaaactgctttgaagtggaagaggcagtatgaagagtgggctgtggggaatacctatttgaataagattcttgcaggcgagataaacgttctatctgattatgtagtttatatatcatcaagaaaagatgagattcttccggcacttgatattatcgtcgattcggctaatagataccacattgatgtagatgatattttaaagcaattcaatgaggacatttcatcttttctggagcaacagaaagttgaaagcttttatactagacgattcataacagaacgttttatgcatttttcgaaggaattatcagtctactatttgaccaaaggaagattttctgatggttttaaatttttaataagttgtttggaaaaatctacattaatcaataataaatcgtatataattaagtgtatgcggctgtatgagtcttatcgagagtatgcatcaactgagataaagacagcgtacagaaatttgattaatgaggtggaaaaggatgaaacataaaataattttaaccgtactggtaacgagctttatgttattgacaatagtattccctcgagcaggctatcaagacattgaacatgactatcaacctgcacagcatggggaaatgtaattatttctaataggaaaaatatgttttgtatttaaaataattaaatgatatatattgctaaattcaatggataatggaacaggttagatggaatgatccgtctagcctttttattgcgtgttttgctgtatataagtaatatgaggaaatcttcttttgagaaatatatgtaaaaagtgcaaaaatgttatgtgtgctgttgtaaataactgaagggtatatgactttgttccaaaagaaaatgatgggctaaagtaattcttactaactgtttctcattacatggtttaattatgtatcatatgccgagtctacgttgaaagggtggtttatctatggagatcacacctacgattagagcagaagttcaaacctatctgataagaaaaagcttaaccatgaccgagtttggtcacattattgatttgaatgtaggaacagttagtggcattgtgacgggcaaccgacctatttctgttcaccagctagatcggatcactatgggaatgaatttaccatcggattatttttatgaacgttatattgatgaatgtattgaagaagaaccgcttaactggcgaagaatcagcccttttttgtaccggtgcgcggagttagggcgacttgattgcttgcgaagagttgtaggtatgttgctagataatcctgtttatcttccttcactttttgaagtagccgaggattcttataaaaaaggttatactgaagcagcggcgttcctttatgaaaatgtagcagaaggggaaaagtatcagtattcagaacgattggcggtttgccagtatcgattgtttacgattcgtatgggagacgatcaagagaaaaactatgatgcagccattcaatttgagccttacgttgatcgattagatgaggtagatcagttagatgccttaaaagacttggcgaatacataccgctcgttacgaaaatgggataaagtagaactattcgctaaagcaatgggagacaaggcaaaaattcaatacaaactgcaacaacagcggcatcatgtacacaaagacaattcgaagaaacctaattttcctttgtttgcgtattgggcattctcgcatttacttcgttcacaagcatgtggtgagaggaaagactatgaaaagggacttcaacacattaaaaaatacgctgatttaagttgggttactgatacagatgaagaagctttgaaatggagaaaaaggtacgaagactgggcagtagtaaacacgtatgttaataagcttctttctggtgataagagggttctttctgattatgtagcttatatttcttcaagaaaagatgagattcttcccgcacttgatattatgattgagacagctaaccgataccattttgatgtagataatattttaaagcaattcgaagaagaaatcatctcctttctggagcagaaaaaagttgaaggattgtatactcaacgattcacaacggagcgatacactcatttcgcaagggaattggcgatctatcttttgcgcaaggggaggttttcagaaggcttcacatttttgtgtagctgtttggaaaagtctgctgaagctaataataaaatacaagcaatcagatgtatgaggttgtttacacattttaaagaatatgcatctgctcatacgagagcagtctatggaaatctgattaaagtggttaatgaagatgaagagtaagttgattcaaccctcctagtatccagttttatgtcagtagtattagtaattacgatctagctggacaataaagaggaatgttggaataaaatagtctcaattataagatcacaatagacctagaaaattaactatgatcaagaggttagatggaattatccgtctagcctttttcatatcgtttgttttgctctacataaataagcttctagaagtgacttagcttggacttttatctgtaaaaggtttattcgaccattggaagattatataatgtggaaagtagtatttaaataacaagacatattgcctattcccttcatttcccttatgataattgcactactacctaagaaggagatacatatgaagaaagctattctgctattattgatgtttgctattttaattccatcacaagtattggcagcaacatctacaaaagcaatgtcaacaagtgaaatcgaaaaaatatactttgagaattacaaagatcgtgtaaaagaaattaaagttgcacaaaaaaaacttaatgctgttctgggggcagaagttcgtgagctaactcagagattaagtcaagcatcagcgcgctataaaaacgaagtgaaaaataaatctagtaaagtggtgatagctcaagccaaggctgattgtgataaattaaagaagcagctcggcgtggctaaggtggaactaaataaaacagttaaaaattacaaaaaagaaagcgaacaagcattaaaggatattgcaaatcagaaagcagaccttataaaattcattaagaatcacacagcaggaaaagataaacttacagagtctcaatttagcaagcaagttaatggaggtattatatcgattgacggctcatttactggcattttaaaaatgttgacggaagctgaataatggtgagtaaaggcagcaggtatcacctgttgtctttttaatttaggcttagaatggaagtcattgttggagactttggattgctgtgaaatggggacaaaggggatatatggatatggatgaaataaatttgttcgtttttatataatgaagtacgattagcgaggagaaaaatgtatgaatcgtaagttttttatcatggctttgataagaggtattttcgggtatttcccttgtgggctgggagttgcagtattattggaggcttatagcagatatagtctaagaggttttttaattggagctacatttttccttatcgggggattggtgctttacttcacaagacgctatgaatcatcagattgattactttagataaagcaaatattacattagaaggagtatatgatgttatcaccaaaacaagaagagagccttagtaaatttatgagtaaaattcttaggcatacaccagaacagtttggaattaagttggaccatgaaggttattgccacgtgcaagacttaatttcagcaattaaatcagagaatagatggtcggatataggagaagcagggattgatcaagtcgtaactaattgtccaaagaagcggtaccacatggtaaatggatacatacgagcgaactacgggcacagtgcaggaagattagattacaaagaatccattccgccaactgctctttatcacggaacaaatagcaaagtagttgataaaattattaccgagggaattaaatcaatggggagaaaatatgttcatctatctgagacacttgaatttgcaacattggcaggtaagagacgtggtgaattagtcattcttgaagtcgatacagtaaaagcgctggataataatgtgaagttctatatcgctaacaatggtgtttggcttgccgattttgtgccaccacaatattttaaaaaaatttaacactgatattttcgtttatattataaagtcagttgcattacttgaatctgttagtgaatctattattctataaaattggatgctatcaaaagagtgaagtcaaataatttactttgccaggcatttatacaatacttttgacatagtaaatccgtttatatcagtccatttgtcatataatataaaaggaaatttcaggataacaggtggatatccctaaacatctccttctgataagattatttccatctaaatttaaaatggacgtgatcaattggggagaatattggttccacctgataagctaatggaagtggctgaccagttcttgcatggtaaacacgaaatggaacgtatgttgaatttactgaatggaagaattgattttgtccaacaaggttggtctggtgctacccgagagaggtttttccaagattttcaggtctctagacaatccatgggcgtgacacttgaacgactttctacggttgcacaagaactcatttttatttcaaaaaacttcacacagttagatggagaaaaagttgtactggatgtgccagggaatggtatgcctgttaaaacggcatcaagcggcgaaggttggctacataaaatttttgaacagatcggaaaagcggagatcaccaaggctgaagcccagatggaagctagcaagcttcaaggagaaattctgtgggatactgctcagggagcgaaaggtgctattcaggaagatttaaccttggggatgctgcctgacaaagaccgtgactatgatcatccaatggcagctaaagtaggtgaaattcttggtcacgtagctacaacattgcagggagctggtgaggtaatcgttggaacaggtggagaaggattatcagttgctgtttcatccacgggagttggtagtattatcggaatacctggattgattggctcagcagctttagcggcacatggaggtacaaccgcagttaaaagtgcaagcggaatagggaagagctcagccgaattgtggcagatggcgaaaggagaaggtggaggttcatctaaatctactccatcttcgggagctaaggcagaaaaggctccacatgtaatcgagggaactcacaataataatatagggagtataattaaggaaggaaataagacgaaatatacaaaccctgctggcaatgaattgacatgggttgatcaacatcccaaaaatattaaccgggatattgagaactttatgaatagctcagatgtaggaaaggcaactgaagcaaaagtagctggctttttaaaagaagaacgggaagtcactggttttggacaaaaaattttaaaaaaagatggtcaatttgcaggtgatttagatgtagttacaaaaaatgaattaattgaggttaaggcttcaatcaaagcagttaaagaaggacaacttgagaaaatgacaattacgactgataagctttattttaatccagaacagaagaaagttatactttatatcgataagcctttgggcaatctatctcaaagtaatatagaaaaattagataatatcaagaagctaggagtaactgttgtaaattccttagaggaattaagaaaggtggttaagtgatgggaagttcggcttttattttaatagaacgagaaaaatatacacctgagaaattactaggagatgcaatcgtagctgcctttcatgcagatgctggattatattttgacaatgataaaaaatataagaacgaacagtttttttcaacaactctaaatatatcttataacccactgggtgctgaaaataaccagcagtttatattctatattgacggaattgataattacgaaattaattatgagcatgatgaagatattagtggattagattcaagcttgtccttgtatcaagtaggatgtattgaagatgtttatggtgttgaagagctgatttttcgctttatatatgaatatctcaagctaaatcctactgactatttttggattcctgattacgattgggtctacagttgggaagatatgcagaagttcagatctctgccctatgatccaaactggtgctataaaaatcctaaatcaatataattcacaacgattaatgaatatctataagcttgctcctttaacaataaaatgggagcaagcttttttcatagtaatttatctgataaagaagataatttgcatgcacctaagaattaagaggcgggtttaaacaggagagtcttcaatcaggctactaacttagcgatatgggtaaagtatacggaaggtgcgtgaatgttatgaagtatgatacattcttaaaattatgggaagaacaaaatagtctaatgagactattgttctgtgaaaataaagtgttagactgaaaaacaaagcattagaccgtgaaaaataaagttgtagaatggcagccggcattagccaacgggcaggataacgcaaccattagatggacttatggttctcatatgatacaatttatcccagaagtatcttcgcgggttcatgaaaagcagcggtgatgaactaataggagaccaacacaaaaaagtggtagttttatggatatgcaatagtttactatagggtcttattcctcggttcgtctaaccgattgtaacggagacttcatgaagtgcctggagatatggaaataaaagtgttgcctgacaatggacatagcgggactggaagagcggaagtgacaaagcccataagcgtaggtcacagctcataatacgaacggagaactattgcttaaccaagatattactggaaagtgcggaggataatttggatcgcaattcgctggaatcgagtggagattcacttcgcagacaactggtggcactacgcgccgaatggaacttggtactagaaggaggggcaggacacatgcaagaagaacaggaaatattcgcgggcgacggatataacaggtcgtacgcaatggctacgggtatgccgattttgaatcttaggggtagcataccgcgtgaaagtaacggccaactaccgtttccgtgggtgacaacgggcatcaggattgataaagaacagatgttggaaaccgttatgaagcaaaagacactcgagtatttatttaatatgcaattcagtaaggaggaaatgaccgaccgcaatttggttgtaggctgttatgaatacaggaatccaaatgacaaggaacaaataatgctatatgcgctggtttcgttgaaggaatttctcgcgagatacggcgatgaacgggcattggagattctgatgcgagttggctgcacatacgagaagattatggaggaatgtgatgaagccattaaagaacactttgcagtgttgcgccggtcacttcatttaaagaatttgagggacaaatatgatgtcgtttacgagtggagtgaagaggaaggggtaaagacgtacataatcagatacaccaaatcgagttatacgaagattaaagctaaatcattcgaagagttggccaaactctatgatgagcaacggaagaaggatgcgaagaagacgttcgcgactctggaaccgttagaagcatttatgcaagcctaagaaaactgcccctttacggggcgattattcaacatttcatcgaacaagattcgaggaatatccagcgatagagaggattctcgacagtcgcatcggaaagtgctgacccgtacgccatatatggtcgaatggggactgatggaagacgttgatccagccgattatttcggcaaaaccatagaggtagaacgatttaaggcgattggaagcctagcgattcagggagaatttatcgcctcggtgtgtttcttactgacggcaatccgatcggcagcaccgaaacggttgtagatatcaacggggatggcatgttctcgctccccagtggcaagctgctgcagagtataagtggcaattccttcgaggcgtggcagtgcgactggctggatcggtacggcggatgacaagaacctcatcttgtatcaaataaactttatcaaaacagctagtcttatcacatgaaataattttgcaccacttgttacgctaacagagaacgttagttcaataaacgagcggcagtctaggactttattttcaggtccttgactgccgctcgttttttatttgggtcagtctaaaacttattattccaagtctgacgatttagcaattcagaatcagcttaggaccaacaaatccagtctaaatctttattttcatcggacaactattagagaggagggatttaagaatcagaaattttttatcatggatttgataagaggtattttcggttattttcattgtgggctgggacttgcaaaaatattgaggcttataacagatacagtctaagaggttttttttaattggagctacatctttccttgtcggaggtttgggactttacttcacaaggcgctatgaatcatcggataggttattatagatagacaaatattttattaaaggagtatacaatgttaacaccaaaacaagaagagagcctcagtaagtttatgagtaagattctgagacatacaccagaacagtttggtttgagctagaccatgagggttattgtgacatccaagacctgattcaagggataagatcagagaatagatgggccgatgttagtgagttgggtatcaagcaagtagtaaactattgtggtacataagagctaattatggtcacagtacagacaggttagattataaagaggctactccaccaaccattctctatcatggtacaaacacaaaggtaatccataatattttcaatgaaggaattaagccaatgggtagaaagtgtgtacatctgtcggaatcccttgagtttgcaattttagcaggcaaaagacgtggggaactagtgatcctcgaagtagacacagaaaaggcattagccaatcaagtaaagttttataaagccaatcatgatgtttggcttgccgaccttatatccccacagtacttaaagaagcttgaataaagtgtaaacctagaacattaacgatgataaagggactagatggaatgattcgtctagtctttttgatatagcatgtttgctatacataaataatcctcctaaaattttgaacgtatccacgggcgtccacacttacccgaaaatgctgcataaaatatcccgggtgaacaaagaggaggtgcatgtaataaccatgatacacatggaacccgtacaagtgggtgagcatacatttatcggagtcgaagtcaaactgcctaaaacaacgctgctgactatctccaactcccgtggttacatcatgtgtggtgcactggatgttggactgctcaatgagcggctggcggatcggaaaattcttgccgcacgagctgtgggggtaaaaacgctgaaagaattgttggaagcgccgatggaatcggtgacgacagaagcggagcagctggggattaagcgggggatgccaggctacgaagcattattgaaactggtgtaatgaagcctatgtgcatatgttgcataaaagtagaggaacaagaaccgaaaaaaaccggactttttggctccggtttttttctatgaaaagttctattctatcgagaagaattctttgaattatatacgaactatatgatctgtaagaacaattattcggcaaacaaattggtcaggctctcgttaaagggtgcttgcacaattcctttttcggtaatgatggcggtaatgtactcatgaggtgtaacgtcgaaagctgggttgtagactttgatgccctgcggggcggtccttttaccaaagctttcggtaacttcctccgcagaacgctcctcgatcggaatatctgcgcctgttgcggtctgcaaatcaatggtagatagtggggaagcgacataaaaaggaatgccatgcgccttcgctagcacagctagactgtaggtgccgattttgttggccacatctccattagcagcgactctatctgtgccgacaataacggcctgtacccatcctttggacatcaccatgcccgccatattgtcacagagcagtgtgacatcaatgcctgcctgctgaagctcgaaagcggtcaggcgcgcaccttgcagcacgggacgggtttcgtcggcaaatactttgaggtggatgccgttctcctgcgcaaggtacatcggcgcgagcgctgttccgtatttcgctgtcgccaatccacctgcattgcagtgagtgagtacgcccatcccgtcctcgaacagaggtaaagcatggatgccgatctggcgacatacttcttcatcctctgcctgaatggctatggcttcacgctccagcccggcattccagtcttcgacctgacctccgctagcttcaacgatgagttccccagcccgcttcttcatgcggtccagggcccagaagaggttcacggctgtcggccgtgaggtagccaaatgtccgcacacggcatgtacatgctccagccacccagcaacgtcggtgccgtcgtaggcggtagctcctagcacaacgccgtaggccgcagccatcccgatggcaggcgcaccgcgtaccttcatggcatggatgccgtcccatacttcctcggccgtgaataaatccagcatgacaatcgtttcgggcagcagacgctgatccagcatggacaaatggttacctttccacaccagcgaagatagagcctgcctggacactgcagctttcccggaggttaggggtgccgaatctttcttttcactcatattcattaagctcctttagtttgggcagctgttgctgtccgaacaatgtctcccagttcccgaatcgaatgaagctcgcgattgcgaagaaccaaggatttaccgatagataacgccagacgttccgcagcttccttgatagcaggatcggcaatggtgtcgatatctgccacatgcgacaggctgatgatacggcgaatcactttgcaccctgcaaaaccaatcgtatcttgcagtactttctggagatacaagtcctgatatccagctgtacgtgccatatggtcggtgacatgctcgtcccacagtttacggaacctaccctcaaactgctcccatacctgaatggcagtctccagaagccagtcacgcctttcctttagagctttctcgccagaggtccatccgggctgagctgcgtagttcaacagcagattggcgatcaccgctccgatatcaaagcccataggtccgtagtaggcaaattcaggatcaatgactttagtcgattcggtcgttacgaaaatgctgccagtatgaaggtcaccgtgcagaagcgcttcggttcgtgtcaaaaacttttctcgcagcaaagccacttccaagtgaagcacttgatctgtacgtagtgcctctgcttcgtcttcgatgtaggcaccatagttgttattatctgagaaccgatacggttcatccagaatcagatcttcagttattttgcagagatctgggttgataaagcgtttaaccaggtcttttttatcctgctgattcatgcccaaatctgaggtgaagaagagcgtgcgtgccagaaactccccaatatgattagcgaaatatggataggtgtttccttctattagtcccttgcgcatgatggtgtgtgagctaagatcctccatcacggtcaacgcaagctcatcgtcatacgccagtaccgcaggaactaattctgggcaaatatggtgttcctgctgaagtgcctcgcgttcaatacgggcacgatccagtgaaagcggccaggattcacccacaatttttacatagggaagtgcctgcttggcaatgatactcttgttagatttagaatccgtaatgtgaaaaaccagatttaagttaccatcaccgatttctcggcattctagacgggcatcctgactaaaaaatccggggatgttcttcacgaattcgattgcttcttcggtcgttaaaggatgatattgggacaacgaagtcacctccataaattgtgcgcatgaaatagtttgaaaaatattacaatattaaaccaagtatttcgatatgatagataaagtataacgaaaatcattgaagttttgtacattttttttatggggattgaaagaggaagaaaggagtactcttctttttgtttcgactccgtatagagagggtaaatatgagacagacgtccggcagatgatattaggatgcccgctggcgtcttaccgtcagcaatgacggtgatggatacgtaaacgttcctgaaaatcaatttgatgaaaaaggaagggattatgatggctaaaacaacaagtaactcgaaaaatacgcaaaccaaatcggtggaggaacttttaaaccgtcaagtcgctaacctcaatgtgttatatgtaaaaattcataactatcactggtatgtgaaaggctccagtttctacacactccatgttaaatttgaagagttatacaatgaagtgacattgaaaatggatgagatcgccgagcgtttgctcgcgttgaaaggttctccttccgcaacgttgaaggaatacctggagctgtcatcgattcaggaagcaaacggcaacgaagatgctcccaagatggtacaaaccttgatcgaggattttgcaactgtatgtgaggagtttcaggaaggcatcgaactggcggaaagcaattccgaccagccaactgcggatttgctgatcggttataaagcggatttggaaaaacatatgtggatgcttcgctcttatttgggctaattgtcagaatttcgattcatcacttatgcctagttcggtgaatttaattccactccatagtggtggggttacgctctgaaataaccctttacatgtaaaacgctactgacgtcatgctgtcagtagcgtttttatggctgaaaagaggtcatgcatctcatgttttttgtgtaaatttataattatataaacaaccacaggatgtattttgccatttgtgtgctggtagggtgaacattttatgaagaaagttggataacgtgtgtctcttggttgcacccttcaagatatttattataaaataacttgagaatcattgagaatcagtttagaatgattataaataaatttttaagtattacttgaaatcagggggctcccctgtttaaatatactttctgatttcgacaccacactacattttttggagggtattgcaaatatggctacaaactttaagattgaaggtctcaaagcgaccattgaaggcaaggaaattttgaaaggtattaacctcgaaatgaagggcggagaaatccatgccatcatgggtcctaacggtacgggtaaaagtacactcgcgtctgctttgatgggtcatcctaaatatgaagtcacagatggtaaagtaactttggatggggaagacgtgctggatatggaagtggatgagcgtgcacgtgcaggattgttcttggcgatgcagtatccgagtgaaattgcaggggtaacgaactccgactttttgcgtagtgcgatcaacgcccgtcgtgaagaaggacaagaaatctccctgattaagtttatccgtcaaatggaaagcaaaatgaaagagcttgaaatgaatcctgagtttgctcaccgttacctgaacgaaggcttctctggtggtgagaaaaaacggaatgaaattttgcaaatgatgatgattgatccgaaaatcgtcattcttgatgaaatcgactccggtttggatatcgatgctttgagaatcgtggctagcggtgtcaatgctatgcgttccgaagagcgtggtttccttatcattactcactatcaacgtctgttaaactacgttaaaccagattatgtacatgtgatgatgcaaggacgtattgttaaatccggtggtcctgagcttgctgagcgtctggaagcggacggttacgattggatcaaggaagaactgggtatcgttgatgaaactgtaggacaagaggcgtaagccggaagcgaggaggaaaactaatgactacacaaacaatccttccggtagattccgagcaactgcgtgttctgtccgaacgtaacggcgaaccatcttggctggccgaagacagacaaaaagcacttgagcttgcaggcaaactggagcttccggtatttgaaaaaacaaaaatcgaacgttggaaattaaacgattacggtcaacataaacagagcgaggtcattgcatcggtagggcaggttcctgcagccattgctgatctggtcaaagagcaacaggagggcggtctgattattcagcgcaactccggcgcggtatatgtgaagctgagtgaggaattggcggcgcaaggcgtcattttcacggatttacaaacagcggttaaagagcatgctgatttggttaaagctcatctgaacacagttattaaggctgaagaaaattcattgtctgcattgcatgcagcactctggaacggtggagtatttgcttatgtgcctaaaaatgtagagctgaacgttccgcttcaagctgtattcctgacggacgatgcgactgcaacatttgcaccgcatgtgctgctcgttgttgaaagccacagttctgtgacttacgtagacaactatgtatctgcggacttggcggcacctgttcttcataacggtgcggtagaagttgttgcaaatgcaggagctaaagtgcgttatgcgacagtccatcagtttggagagcaagtaacggatatttcgattcgtcgtgccacgttgggaaatgacgcagctatcgaatggattgtgggcgaaatgaacaacggtaatacagcaagcaataccatgtccgtgctcaaaggcaatggctccaattcggatgccaagatcattgctgtaggttccggctcacaaaagctgaactatacgacacaagcacagcattttggtaaaaattccgccagtcagatgattacgcgcgcagtaatgcgtgaagaagcgtcttccatcattaacggaattacaaaaattgaaaaaggtgctaccaaagcagacggtcagcaaacagaacgtgttctgatgctcagcccgaaagcgcgtggtgacgctaacccgatcctgctgattgatgaagatgatgtaacggcaggtcacgcagcatcggttggtcaggtaaaccgtgaacaagtgtattacttgatgtcccgcgggattagccgtacagaggctgaacgtctgattatttatggcttcttggcacctgtcgtatctgaaattccgctcgaaggacttcaacatcagctgcaaagccttgttgaaaggaagttaggccaatgaatactgcattgatccgtgaacagttcccgattttacatcaggagattaacggtcatccgctggtttatttggataatgcggccacttcgcaaaaaccgctggcggtcatcgaggcgatcaagcactactacgaatatgataattcgaatgttcaccgtggtgtgcataccttgggtagccgcgcaacggatgcttatgaaggtgcgcgggaaaaggtagcccgctttctgaatgccaagcgcagtcaggaaattatttttacacgcggaacaacaacggcgttgaatctggtcgcttcttcctacggtagagctaactgtaaggagggtgatgaaattgtcatcacacaaatggagcatcacagtaatctgattccgtggcaacaggtagccaaagccacaggcgcgactttgaaatatattccacttcaagaggatggtagcgttgatcttgctgatgtggagaataccattacagagaacacgaaaattgtagcgattgcgcatgtctccaatgtgcttggtgttgtgaaccctgtcaaagagattgcagctattgcgcatcgcaaaggcgcagtcatcgttatagacggtgcacaaagcacaccacatatgaaagtagacgtgcaagacatcgatgctgacttttatgccttttcgggtcacaaaatgtgtgctcctactgggatcggagcactgtacggcaagaaggcgctgctggaaaacatggagccgattgagttcggcggtgaaatgatcgacgatgtgggattgtatgaatccacatggaaggagctgccttggaaattcgaaggtggaaccccgattatagccggagccgttggcttgggagctgccattgattttctggaaagcatcggactggatgccattgcgcagcatgaaagccgtctgtccaactatgccctcaaacgtctccgtgaagtggaggggttgacgatttacggacctgcagaacgtcatgtcgggctcgtaacctttaacctggatgatgtgcatccgcatgatgtagctactgtactggatagcaaaggggtagctatacgtgcggggcatcattgctgccagccgttaatgcgctggctgaaagccagtgcgactgcacgtgctagcttttacctctataacacggaagaggaagtcgacgctttggtcagcgccttaatccaaacaaaggagtattttggcgatgcaacttgatgacttgtaccgacgcgtgattatggatcattataaaaatccgcgcaatcgtggacgttttgaggaagatgccgttacggtggatttgaataatcctacgtgtggtgaccggatttctcttcaactcaaaacgaaagacggcgtggtcgaagatgcccgttttactggtgaaggctgctcgattagtatgtcctcagcttcgatgatgacagaagcggtcaaaggaaaaacaattgatcaggcactggatatggcgagccgcttctcttctttaatgaagggagaagccgtcgaattcgatgattatgaagaattggaagctttgtcaggcgtaaataagttcccggcccgcatcaaatgtgcaacactggcttggaacgcgctgcgcaaagggattgatgaagataaataatttaaatagaacagaggaggtttgagaaacatggccaagaaagcaccggaaatggaagagtataaatatggctttcgtgacgagcacaagtccattttccaaacaggtaagggtctcactccggaaattgtaaaggaaatctccaaaattaaggatgagccagaatggatgctggagttccgtctgaaagcactgaaacagtttgaaaaaatgccaatgccaaactggggcggagatatggatgaactggatttcaacgatatccagtactatgtaagaccttccgagaaacaagggaagacatgggaagaagttccgacggaaattaaagaaacctttgataaactgggtattcctgaggcggagcaaaagtttttggctggtgtatccgcacagtatgaatccgaggttgtctaccacagtatgcaaaaggaactggaagatcagggcgttattttcatggataccgatacggcgttgcgtgagcatcctgagattctgaaagagtattttgcaactgttgtacctcctgcggacaataagtttgcagcactgaatagtgcggtatggtcaggcggaagcttcatctatgtaccaaaaggtgtgaaatgtgaagttccattgcaggcttacttccgtatcaactcggaaaacatggggcaatttgagcgtacgctcattattgctgacgaagacagctttgtgcattatgtagaaggctgtacggctccaatttacagcacgaactcgctgcatagtgcggtggtcgaaattatttgtaagaagaacgcacgtgttcgttatacaacgatccagaactgggcaccaaacatctataacctggtaaccaaacgtgcggttgcggaagaaaatgcaacgatggaatgggtcgatggtaacatcggttccaagttgacgatgaagtatccagccgttgtattgaaaggccgtggagcgaaaggtatggtcttgtccatcgctgttgcaggcaaaggccagcatcaggatgcaggtgcgaaaatgattcacttggcaccagacaccacctccacaattgtatccaagtcgatcagtaagcacggcggtaaagtaacgtatcgcggattagcttcattcggtcgtcaggctcaaggtgcaaaatcaaatatcaagtgtgatacgttgattttggataatcaatcaacttcagatactattccttataatgagattatgaatgacgacatcacgcttgagcacgaagcaacagtttccaaggtatcggaagatcagctgttctatctgatgagccgtggtttgactgaagcagaggcaacgcaaatgatcgttatgggctttattgagccgttcaccaaagaactgccgatggaatatgcggtagagatgaatcgtttgatcaagttcgaaatggaaggtagtatcggttaaaacgcagtaacccttggtgtgacaaggtacttgaggtaattaaagctgttaaatcggagttgtgccgatttatgctgactcggattttctctagtagagaaggcgaactttttaagttcgtcttcttttattttttctgtgatgcctaagtccataagccttctttctactacataaaaaaatttatgcttaggaccgcagatacttgcctagcacttatgtatgtttgcttaataggatgttgtgagtgacataaacataaggaggcataccatcagatgcagaagaataaaactagagtggagaagaaaaccctctcttctaagcagacacagaggcatgtacatgaatttgaaggtagtaccaaactggctgaagaaggcgcagaccgacataaccaccgctttgcaggtgttactgggcaagcgattcgagttggaagaagtcatgtccatgaaatcgatcttacaaaaactgatttcgtgaaccactttcataatctgaaaaaaattagaacaggaccagctattccagtcggaaatggaaaacacgtacattttgttacgggccaaactacattaaatgatggtcatgtacaccagtttaattttgcaacattaattcaggcacctcttatttaatgacggtggtttgaccgaagctgaggtaatgattgttataaacagctgctcataaagaatgagagcatcgtcttcgatttttcggtgatgtgtaaattactcgaaataaatcaaaaagctctgctaaccataaaggaactgaccccataacgt

SEQ ID NO: 2670 - DNA, 1485 bp, Unknown
  Kingdom: Bacteria, Phylum: Firmicutes, Class: Bacilli, Order: Bacillales, Family: Paenibacillaceae, Genus: Paenibacillus
tgagtacgcaaattccctaaaagaaacgctgacatccctcatacgagaaatgtcagccgcaccagcaccttatgtcaaaaaccctgaaaaagattttacccgaaagaaaaagctgccctttgaaacggttatgcaactcctgatctccatgggggggaacagcctatataaggaactcttggaatcacaaggttatgacgtaaataccgcgaccacttctgcttttgtccaacagaggaataaaatcctgccgtctgctgtggaattcttgtttcaccaatttacgcaatcatatacggatatcaaggactaccgggggtatcgtttacttgctgttgacggttcggatttgcatatcgcaacggactctgcggacacggacacctattttcaaagtcaaccgaacacgaaaggctataaccttctgcatttgaacgcagcctatgacttgtgcaatagactttacgtggatgccattgttcagccacgaaggttttgcaacgagggaagggcgttggctgctatggttgaccgttccccgatcaaaagcaaaaccattgttattgccgatcgagggtatgaaagttacaacaatttcgcgcatattgaacgcaaagggtggaactatgtcatacgggtaaaggatttggattccaatggtattctttcgggcttgcgtgtgccctctagcggagagtttgattgggacattcatctgacactcacaaaaaaacaaaccaaagaggtcaagtctcatcctgagatgtacaagttcgtcccttccacgtctacctttgattttttggatctgcaggagaacttgttttatccgatttcctttcgggttgttcgtttcatcctgcctaatggcacttatgaaaccgttatcacgagtctttctaccgctgatttcccacccgatgaaatcaagtccatttataacatgcgatgggggattgagacctctttcagggcattaaaatacaccgtcggtctgacgaattttcatgcaaagaagcaagagtccatcatccaagagatattcgcaagaatgatcatgtacaatttcactgaaatgatgaccttgcacgtcgtcatttcccaaatggatacacggcatccctaccaagtcaactttacggttgccgttcacgtttgtagatatttcctgcgctctcggcacgatgaaccctcgcccgatgttgaagcgctgattcgcaaaaacattttgccgattcgacccattcgctcagggcagaggaatacacgcaaaatccgctggaaatcagctgttagcttcgtctacagagtagcataattcggttcacatgaacatttttttaagcggatactctatccgctttgtttgctgtacgcttttttccttgcttgcacaaaaaacaaacggcacggggcttttcccatgccgtttcggatttcatttttattcccggaattgtctttgagcttatcttaatgacattg

SEQ ID NO: 2671 - DNA, 28892 bp, Unknown
  Kingdom: Bacteria, Phylum: Firmicutes, Class: Bacilli, Order: Bacillales, Family: Paenibacillaceae, Genus: Paenibacillus
acaaacgggggtcagtcccagacgaagggagggccttattaaactacagttcgtataaacgaggtcatacacttacatccacatacgcctgctgtaacaaacgggtccgaagtacgagtttatggcaaggcttgtccgcgcgcactgacatacaattcataccattcctcacgggtcatcagctcgctctggcgttccgcatcctgacatgccttgattcgttcaggattggcgctgccaatgacaggctgaatccgtgccggatgtttcataagccagccaaggacgatcgcttcacgtgtcgtttccttttcagaagctagcttctgcacccgttctgccgtcttaacgacatgctcaggctgcccttccaaaggacctccgctaaaacgtccctgcgccagcggtccccaggcttggagttgaatatcctcggtttggcaatattccatcaaaccttcgccaaaatgtacatttgtccctgcctgctggttcacatgtactgtctgatctacaaaatgcagatgggccaggctcatttccagctgattagcgattagcggctccggtaggctccgttccagaaaccgaatttggcttacattcatattggaaacgccaaaatgccgtactttgccagatgtcttaagctcgctgaacgccttcgctacttcttccggctctaccagcggatcagggcgatgcagcagcaggatgtccaaatattcggtacccagacgcttcaggataccatccacggactccataatatgagcatatgagaaatcaaagcggcccgggagcgtaccatctggcagaaaaatgccgcatttggactgaattacgatttgttcacgcaagcccggctgtccctttaaaatccggccgaaaatctcttccgctttccccatacgatagatatccgcatgatcgaacatcgtaatcccaatggattgtgcagcttctacagctctttccgcttcaacgacatgctcctgcgtaaacggtgcatggctccattctccaccaaaaggcatacaaccgagcgccagccgactatcggagattccacgtttctgtaaaggcataatcttcatgctgctcctccttcattcctcaaaatattctctgcttcatccacatatgaatagttcgtggaaccgctatcacacacctattttaccacttacttacggtcgtgttccactttggtccccatccacatcttttatccgaatatccccatgctcagataacgttctccggtatccggggcaatgcaaagtacccgtttgcctgctcccaaacgccgcgcttcctgaatcgccgtccatatcgtagctccgctagagggaccaaccagaatcccttcctgggcagcaatcgctcgtgtcattgctatcgcatcctcatcggaaacctgcacgatttcgtcatacacttccgtattcagcacggtgggaacaaagcctggactggtgccaaccagcttatgtggaccgggttttcctccagatagcactggcgaacccttcggctcaactacaacaatccgcagatccggcaaatgctgacgtagcatttcacctgttcccgtaatggtaccgcccgttcccgaagaagcgacgaacacatccagcttcccttccgtctgttccaaaatttccagtgccgtcgtcgtgcggtggatatcgggattggcctcattttcaaattgatgcgggataaagctcccttcaatttcagcccccagttcgagtgccttgcgaatcgctcctggcatccgttcttccgctggtgtcagtacgacctcagccccgtaggctttcagaatattgatccgttccttcgtcatattcgagggcatcaccaaaattgcacggtaaccccgggctgccgcattcatcgcaagaccaattcccgtgttgccactcgtcggctcaataatggtgcctcccggctttagatgtcctgccttttcagcctcggcaatcaggttgcccgccgcccgatctttaacactgccgcttggattaaaatactccagcttcacatacacttccgcatcctgcggccctgtgagccgttggagtcttacacaaggtgtatctcctattaaatctgtaatactatgtaccactttaggtgccatcgttgtatcctccttagatcgttccttacagcgtcatttacgatcttaatatcatactaccaaaataacatacttggctccttcctacctgtcgcttttgtaaattacataaaactcatcaacttagtatgtaaaattcttgcaaaatgggtcgccagatatcgcctgtaatgatatactcgcattactatttttccaggaggatacaagacacttatgagtaatcaagaaaatatgacagcaaatcgctttcccccctccttgctatggttgacccttggtgccttcgccatcggcatgaccgaattcgtcattatgggactactgcccaatgtagcccatgatcttcatgttacgattccgcaagccgggcagttaatcaccagttacgcgcttggtgtagccattggtgcgcctgtgcttactgtattaacccataaggttccgcagaaaaagctgctatgcctactcatgaccatattcattttaggcaatcttttttccgtcattgctcccagttacgaatttctgattgcggcccgtatggctactgcattatcgcacggaacctttttgggagccggttccctgatcgctgcccgactggttcgtcctgacaagcgcgcgggtgccatttctatggtgctgaccggtttgaccgtggcgaacattattggtgtgccctttggaacctttatcggacaacaactcggctggcgtgcttcctttggagctattgtggtcatcggcttgatttctctctttggtatcattcgttacattccggtaattcaccaggacaagccttccagtctccaacaagaagtcaaaagcctgttgaatccaaaagtgctgctgatgctgctcacaggtgcagtcggttgtggtagtctgttcactgtctttacgtacattacgcctttgcttacggacattagtggctttgccgaacatagcattacctggattctcgtcctgtttggtctaggggtaacgatcggcaatatcgttggcggcaagcttgcggattggagactacttccatctctgatcgcaaactatgctgtactggctattattttggccattctgacatttacgcttcaaagccaggtattggccgtcattaccgtctttatctggggcattgctgcgttcggcatcatgccgggtattcaggttcgcatcatgaatctggcctatgaggctcctttgcttgcttctacctccagtcattccgcattgaatctgggtaacgcaggcggcgcttttatcggtggagtcgttattaatcaaatggggttagccgctattccatgggttgcatcgctaatcactgtcggcggtctgctactcatgatagttagctacattgtggatcgtaagacggctcatactaaagcaacagcggagatacagtcatagaatcgttctgtttgttggacagtgtacagctatcaaccggagaacaataaatggcggcatatctctaaaaacagcaagttggacgtaaacgattggttcatttttcatagattgagggatattgtccactctcttcttctaaattcctcatagtatgcattgcaatacaaatttacgaggaaagaagtgtgtatgatgagccttttttttacaaacaacacgagtaacacgatctatgctgcctatgcttatcctgattccgactgtcatcccatgaattattctaaaatgggctggtatcggctagagcctggtgatacgagagaaatatggagcgggtctgtagggggaaccacattctattattatgctgaagatcactccagaaatacatggcgtggcacgtaccgcacacggcttccgagaaatactagccatgattttcattggtgttggaacgatagcagaggatcatccagacgagtggggatgcgccgacttgccattgattcatctgtagaaaattacactgttgagtttagcagaaccaaccaaagcttactctcaacaaagacaactcgcagagcgttaccttccaaatcggaggactccggcattaacagaattccgagaagaccgactcgatttaaaaaaggaaccccagttccagtaaagtccaaacgataagtcaaagaattcgccaataaaaggcgcaacctggttgcaaacactacaaagcccctttgaaaaacacaatgaaccgcaacccgcaagatggacatttttttaaaaaagtgacccccttgcgggttatttttatttcactctggacattcagacgcttgttgcaaccatagtattttgcctcgccgttcagcttaaccaatgatcaaaaaagtcccgatagccctgcttcatcacctgacttgaaaactgttccatggcgtatgcctgattttctgtagaaacccgacgcggtgaggcggcagccatattgaccagctcgaaccagtttttctcattccctgaaaaagaatgcgtagagctgatatgtccatagcaaggatgctctggcttcacgacaattttccccatagcgagcgcttcggtcagcggcattgcgaatgtatcgaatttagagcagctccaatacaccttcgccgtgttcatcagtgcaaatacctcatcttgcgtcaacgcaaattgaagtttaacattgtccgggatatcgtacttcttcatactttccttgtagcgttcaccgccaaataccatatagacatccttgtcaggattatgcctcgcatactccagcaccaaatccggacgtcggttctcctcatctctaccaatccacatcacccggttctctaccacttgcgagggatcaaaatgcttttccaccagacgctcattaaatccgatcgggatgactgtcacatcggtaacgccaaacttcgaagccatctcctgcttgagaaacgcagtctgtacaatagccttgtccacgatctgataaaaaggcttcatcatctcatagcctgtaagcgccggatcaggaaaactatgcggaaaaagcacgctgtttttaaaaaacatgttcaaataggtaaagccagataccgtataaataacgtgctcaatctgctgctcatggagttggtccagtacgatgtcatagttgaccaggtctcccttttcgtgctcatagcccggaagccagtcatggctgctcacatggcgctccggtgatacaaatacgatgtccacccccaattccgacccgatctgcttcaggcgttctgcaaaaatacgtggaccctgcgcttcagcaaattgtatttttctcatgactaaaccgacttttttcatgaatatattccctaccttctttggctaactaaacacagtctatgtcttaagctactatctacattgttgggcttgtccccaatccatcattgctgcacattggttcaaacaggctaacgtttcatccaactgggactctaattgctcttttgaccatttgtcggcgtttctatgcaggttcgttccaatcctttgcaaatcacttgtgattaacaacagcatccagagcgaaaataccaccgcaaacatgccatattccagcataaatgccgttcgatccactcttttccctaacagctccagctgctccacgtatgtgtccagcatacgaatacgcaattcggacgtcatgcgtcggggaaacaacggatgggacatatcgatcaggtgatatacatcccacagcggtgtgttcagatgagcatgctcccaatccaataccataagccgttccccgctcagcgcatagttccccggatgaagatcaccatgagacagtacaacctgctgtgaaaaagatacatgctccagctgtacatatatacgcagcatctgttgcttagataaacccagtgagctgcaaagctttaacacatccggcttgcgcgtatatagctcggaaaccatctcctgaataagtggcttgggtccccgtaacggcatcccagcaaaacgatccgtcggcaaagcatgccaccatgcaacaaggccaacagctcgcaataaagtttcgtctgcgtgtagatgatgtaacgaaccaaggtcctcaaaaaccatccattctcctccgccatccgcacctgcatcagaccaggctagcaatcgaggatagatcggtgataacgcaggaagcacatgctcatacacccatctctcacgcccctcctgaccatcgttggttagcggtttaaatatataactttcagaggatgacacgtaaaaacgttccacatgccggccattcgtacctgtatataaaatttcacgattccgcaccagcgtatcatttaaggtaccgtcaacattcacatattgatgaaaaggattcatagccacccaacttttttgtataaaatgtaatagcacgatcatatcacagtcctcgttccgaacgaagcccagatcatcttggggtaactcgctgcacccaaaaaggggcttgcccaagcagatcacgcgacctgttggcagccccttatcacatccatactcctatccttactctattctataccgattaatattgagtattgctggactcgctcgtattaccagacttaaagcctttgaacaattgtttcacattgtgataacgagtgttcgtaattttagctttgctgttaggaccatccgatctcaggatcgagtcctttacattggaaatatccgagttatccaaagtcatattcactctgaatgtagaacccccaagttggcgaaccaactttccgatatcatcggctctaaagtttttaatgttaatcgtgccttcggcattaatttggaatactttatcgtacgcatggaacgctccaccgcccgtaatgtttaccgtgcctggttctttaagcgtcaaggcatcttcacctacatcctcccacgttacgttggaaatagttccgttgccatatacatgcacaccatccgcagcaggggcagcgatggtcacattttttagtgttgcattattttcaagcttgaaaataggcttttgagcctctttctggcttccgtctcccaaggtatcgggatcagccactacagtcttgcctttaccatcgtatacttctccagctttaacaagtatggtcttatgaacgacttctggtgctgcatgtgcagaataattgccgacaaataaagcgaccaacattcctgataaagcgagactgattccctttttcaatactttagctgtgtttgttttcatttcaattcatccctctcgtagatattttttattgttccaattcttcgttgactagaacgcgtagaccgtatcaccaccttcgtacaatgaacccattaaccgatacatgtctataaagcattattatactatttacatatgtatacttggtttttggttcaaagtaaattcattctataaattcaggtgcacacaaattgtaaatagagcggttacatttacaatttgtataattctattataatcctgcttccagtaatttcaatatttttttcggcaaaatatgtgctctttttcaattaagtacacaattttgccttttttatacttgtacaacgctgtttttcagcaatttatgcatcacaagacttgaatatctagtctcgttgacttactctagatcactataatggtattcacaagctcttttccgtcctataccttatttttgatgtgatctatactattgaatgacacgtttgatgaacgtataatgtatttagtgctttgaagcgttacatctcaacattactggtgagaaaagagtggttatcgtgcaaaacaatagtgagattccgttaaaagaacaaaatattgtgctcattggctttatgggtgtaggcaaaacgacgatcggttcccatctagctcgcaagctgtatcgcgatttcgtggatattgaccaggagattgaacaagagtacaacatgccaacaaccgagattttcaaaacttatggagagaaacgtttccgtgagattgaaaaagagcatattttgaagctgtgcagcaacacacgccttaaaatcatttccgttggcggtggtgcatttttacaggaagaggtgaaacaagcttgtttggcttcatcgattgttttcttcttggatttgaattgggattcctggaaagatcggcttaagatgctgattgacacccgccccaatctacaaaacaagactttaggggaaattgaggatcttttccgttccagacaggacatttacgcggtgaatcactccaagatcgatacggatcagttggatgcggaagaagtcgcagactatattattcaaacgctgaatctaggttgggagttatatgaacctactcgcggattgaattaagagttacaccaaaaaggagggctccagcatgcttaccgcatggggccctcctttttggttcactacggatatattactgactggcgagtaatgctatccatcttttaagaatggctatgcagcaccgtcaatatctctctcagttcagtgacaggaatctgccccggagcggaagctttcttagcagcaccaaaggtcagagccgaaccaaacagttctccggtcaggcggctcacgacacctttccccgccatcgacatcgtaataatcggccgatctgcatgctcttctgccatggtacgtgtggcatccagcaaagtgagaacatcggctgtattggtcggcatcactgctatcttaggcagatcgcctcccaattcctgcgccttgcgtaaccgggacacaatctcctccttcgacggcgtcttatgaaaatcatgattagatataatcacatatacgttatgcttatgtgctgcttctaccagcgtcttcacatcagcttcctcattaaaaagctctacatcaataagttcaacttgtcccgtttcggctactgtacggttcaaatccacataactcgccgcactgatttccttttctccgccttcccgagcgctacggaacgtaaatacgagcggaatatttgctaaaatagaccgaatttcatgtaaggcagctttcaccttttccaaatcctccacatgctcgaaaaaatcgactctccactccacgatatccaggtcgagcgtacgcaaataagtagcctcttccttcaactgctccaacgtttctcccaccatgggcacacaaatttttggcgctccttcaccgatcagaacatctctcacctttacgattttagccatctctatctcactcccaaattacagtttcaagtcgaacatgtacaataattcatagtataacgcattctgaataagcatgcagatgattaggtcctgtcgtcatttatttggtatccagtacgattttaggggacaatttgcgacttgctggaaaaactaaactgtaccgaaaattaacgaacaccgccagtacgatccctagcacattcacaataatagctagcataaaaacactcggtatctgagaatgtttcaaaagaaagcctgtaaacacaggaatgaccgtgtatgacagcgaggttgctgtataaacaaacccggtaatctgtcctttacgttgactaaaaaattcactcattacggttaacgtcagctggagtacacccgatattgaaaacccaatgacactcgcacaaataatggccgccgcccctgacttgaaaagaagaagcgctccaaaagccaacaaggaaatacatggataaataagaataatgtgaacaggtttaacccattttcttaacgcaattaccaatacaaacacggaaatcagtgaaccgacattgtaataaactaataatctgagagacactgattcggtcataccgataaactgttgtccaaaagtaggcagccataattgcacaatataaagcaaggtaggtcccgtaaatccgagcaagataagacatatcccctcctgccaaaaccgcggcttactccggtcatttgtctccaattttcccgtttgctcaacgcttgatacagaagtatcaccaactggctcctggggtgactgaacccgcatgtctgggaacttcatcttgaacaagtaaattgcatttaaagcaaatatgagggctggtaaaaagaaagagaacccgtagaaaatgtcgtgattcataaaaaagataatcattaacggcaaaaatgccgccccgacggatataaaacctctcaccaacactgtagccgaaccagaggattgggggaaagcttcgatcagcgctggataagtacctgaatcaagaaaagaattcgctacacctgccagcactgccagtacgatcgccatctcaaagctgggactcagcggtataccgaccaagaatacagccatcagtagccctgctgccacaataaacggcttacgaccataacggtcggagagcaccccggatatgtacagcgtaaacaacctgccaaatcccatcgcagaaaccaagagactgatgcccgcctgatctgtatgcaaatgctctgttaaaaaagacatgtgggacgctagcataatattaaacatgccgaacaaaagatagtttacataaaggcctgtcgccactggaaaagaagaacgtttcatcatgaattcacctgcttttgtaagtaagtcttgtagtattaaaaatgtgaatcatttcacattacctgtgtcgatgatgaagtatagaacacattttaagatttatcaagtttaaatattgcgggacctcagcctagacgcgctgatgcgttttcagatagaactccttgccgtaacttagtgcaaagttccgaaagtccactactgccggggataaatatctatttttgatgctggctaggtagataaaacgctcgtattctggatttacaataggcaatgttttgacgttaaaataatctaacgatgaaatgcgaggcataaccccaattccgtaattgacagacaccagtcctgccattgctgtatcctcttcaatctcgcaaataatctgtggcgtaacgcccgctttggcgaacaaattttcaataatgggccggaccccactctttttgttaaagaagatcaccggataatctgccgtatccttgagatcaatttggtctagagtcgccagtggatgttcaggcgaaacaatgacaaccagttcctgctgagccaacggaataaactccacatctggttcattttccatgtgagagcagaacgccacatcataatgttcctgcttcagcccctggataatatcgttcgtattcccttggtgaaacgaaaaggagatatctttacgggcatctagagctgaaaaggcttgaatgatcgctggaatgaagtgtgatcctaacgtgtaaatgaacgccaaatctatatttccatggcttggactcactaactcccgtaaattgtgttctcccttttctaattcatccatcgcgtgctccacatactttaggaaaaatcgtccgtatttgtttaaccgaatatttctcccctgcttctcgaacagatgaactcccaaatccttttctaattctgaaatcgcatgacttaaactgggttgagtaatacatagtcgcacagctgcctgggtaaaatgctccatctccgcaagtacacgaaaatattgtaagtgcttcaggttcataatgatgtactctccttctttaattcatattttaaattatagacccaaactatgaaaaaagataaaaatatgcattagatttataataacactccttatataataatgacatagaaagaatgtgaataatttcacttatctgtaggcgtaatgtaatacagctggacgatgcctacctaggccattgatctaaaatttaagttgggagttacacttatgaaaaatccttatatcagaatggcagcagggctttacatcaactattttcttctgggtatgatcaatgttattctatcgtcgaatatgagcttcctgaccgttcaattaaacacggataaagcagccatcggctatctggtgtccgcgattgggatcggtaagctgctcgctctcggggtagccggaaaaatgtcagacaaatacggaagaaaaccactcattgttattgcatcatttgcttatttaatcttcctgatcggcattccacttgcgcccaactatacgttggcattcgtgtttgctattatcgcagggctttgcaactctatgatggatgcaggaacgtatcctgcattaattgaaggctttggaaaaaaagccgggtctgcaacggtgctggtcaaagcatccatctcgatcggtgccattgtgattccattcatgattgctttctttattaatcacgacatgttctatggttattccttctttattccagcagggatttatctgctgaacggtatcttcttgtcgataacagctttccccaaccacaaagcagaggaacaaaaggcttcaatggaggctgcccaatccacagatactttccgcagcgagcctaagttttggcaagaaggtttatctctgattattatcggttttacttctactgtattgttcatgatcgtgcagctatggcttcctacctttggacaagaggccctgggcatggacaaagccagcgccattaaattgctgagctactatagtataggttcattggtttccgttatcttgttagctgtggtacttggtagattcattaaaccgattactgtcatgattgtatatccgcttattgccctgctttctttactggctttaattacatggcacaatcctgtcgctactttgatcagttcgttcctgatcggcttgtctaccgcaggcatattccaaattgccctcacggttatgacggaatttttccgcaagaacaaaggcactacgacttctctcgtgaacatagcagccagtctttcgttcatcctgatgcctttggctaccgggggcatgtccaaaagtttgggaattacctcggtattcattctggatattgcgattgctgtagtcagtattttgctggccgtgtttgttgcttatcgatataaaaaagtatttcattaaaccacacagattacttggaggcttatattatgaaaaatgctggacgtattgacggaagaacacaattaattggactgcttgctacaccaatcggacactctttgtccccggctatgcataatcttgcgtttgaaaagctgggtctaaataacgcgtatatggcctttgaagtaggaaatgaacaacttgaagaagtggtacgggggatgcgcgctctgaacatacgcggttataacgtgtccatgcctaacaaaacagctatattacagtaccttgacgagctggacgacagcgctaaatttacaggtgccgtcaacaccgtcgtaaacacagatggtaagctgaaaggctacagtacagatggatctggttatgttcgtaacttgcgtgaacacggcattgacctaaaaggtaagaaaatgacacttgtcggctctggcggcgcagctacaccgattgctattgaagcggctcaagcaggtctggctgaaatttcaatctttgcccgtaacgatcagttctttgctcgtgcagaagagaatgtccgtattattaatgaagatatgaaacacacccaagtcaaggcgaatatctatccattggaaaatcaagaacagctacgtgaagagatccgcacaagtcatattctcgctaacggtacaggtgttggtatgaaaccgctggaaggcaaaagtgtgattgaagatgtgtccatgcttcgttccgacctgatcgtaaccgatgtagtgtacagcccagctaaatccaagctgatggagcaagcagaatccgtaggtgcaaccgccattaacggtctgggcatgatgctgtggcaaggcgcattagccttcgaactgtggacaggccaagagatgccggtcgcttatattaaagaacagctttttgctgataagctgtagacatagagctgctaacaagtgcactaagcaatgaattccttctattatatactcatgcatgtactcaaaagactatgctcggcgaatgaacacttctgccgggcatagtcttttgattaatccttataagggtcaaattcattggccccagccatgcataccccaataggcttcagttcatgcataacttctacagtctcggaatgagcatccagtacctcgcgcagtttacggtagacgaacgggctttcatctgtaccggctccgcgcagctcgacaccatagttccgaacggcctccttcatctgtacgtctgtgatttgtccaccactccgtgtacgggttttccaattcattttaccggctgcctgggtacgactcataatacgacctgcgccatggactgtactatagtaggaatcccgattttctaccgtatctcttccacgcacaattaccgaaatatcgcccatgcttcctccaataaagcccatctggccaggtgccgagggagtggcgcctttacggaccacaatggtgtcacgcccatcatgctgttctttccatgcgtaattatggtggttatgcacagtaaagtctgcttcggtccccataataccaagcacttgttctatcacatagtcacgtcccgcatacgcatagcgtccagcaaggcgcatcgcacggtagtacatgtcccccagctcactgttcatatccagcagcacaggcggctgatccatatgctctcccggcgcctttccgagaaactctcgtccagcggccaagtttagaaacccacttgctgttttgtgtccaaagccccggctgccaaaatgattggcaatccagacctgtcctgtcgcttcctccacgaatacatcaacaaaatgattgccactccctactgtacccagctgttctctcgccaaggacttcagtttgtcatattcttgtttcccaatcgctgcatataccgcccagtccggatcatcgaacagctcatggtctacctgaattgcattcacacggcctacgccaaacgaaatatgacgtgcaatctcatccatcacggctgaaatacgcggcataatatctgctgcaaacagcttcgttcttaccgccttattcccgcaaccgatatcatacccgacacctgaaggcgaaatttgtccgtcatacaccatcacaccgccaatcggctgactgtagcctttatgatgatctgccatcagcagcgcctgaatcacattgccgttttcggcacatgtacgggcttgagataatgcccctggatcaggtgctccccatactcgtactccattgatttcttgataagccatcgtcgtttcatcctcctgtaagtcactccatgattaaacttgtaaagtcgttaattgcatcatgtacgttttaccagcttccgaacagggcgtaagtattacaagtacaatagtagatatcccctaagaaaatgaaaaaggatacccatgcagccaaccagactgtaggatatccttttataatcatttagaaactatgaaatcaattataccaatcttttttgatgattccgaattgatccacaataaaaggtttggcatcatttttgttttgatcaatttcatacgttacggctgtaagtttgtttccgtctatggtgataccaacaaaattctgtacctgtcctcgtgtaggtctacgattgtcactcggatctgggccatatactgccgcatgattctcttcagctagttcaaagagattatagtacttatctccaagtttttcgcttgggttcttgtagtaaactttggggccagcggttgctgggatgacatagatacttccgtctggattcacactgtattcaatcgtcttttcatttaatgtatcttttacttttgttggcgttgttgctttacccttttgattgattggtttcgtacgtgcataaatatgatcgtgcccttgcacaacaaagtcgatatccagctcagccattaaaggtgcaatctggttacgaactccgttattatctatgatgtcagagtctgttgcatgattagaggtagtatagggacctttatgaatgttaacaatgatccactttgcacctgcccttttggctgccgcagcatctttctttaaccattcaacttgatcttcagaaaaattggcatatttctctgagtcctcattggagttcagtacaataaagtgagcattgctgtaatcaaaggagtagtacgctcctgttttagtagcagaaccagctggttcattaatattaaagtgatcataaaaagcgtagttctcatcctcgtgattacctgctgaaggaacaatggttgtattcaaaagacttttttgtgaatgtcccaacaaccagtcccactgctcttctttggtaccggtgtctacaatatctccgttgtggactacaaactgagcattacctacagtttgaagtgcttttttgagcgtctgtgaagacaatatggcttcatcttcgctttttgcttgtgtatcagctagatcaatgaaggtaaattcaccgctcttaggagccgtttgaaacgtacctgtttcgctccatatcccgcgcgctgcatcacccacacgataataataagctgtgtccgcttgaagacctgtagctacggctttatggacaagctcttctgcagaattggtcgatggagaggaagtgccttcaaatgcgatagctttcgtaaaatcagcttctgaatccgttttctttattacttgaacagtgctgttcgtgagcagttttgaagtataccaggtaaaccctttggagccttttgtgtctccataaaatgtagctgtaattttactaatactatctgtgttccctgatgattcagcatagacagccgaagcagacggaccagtaatcaaacctagcataagagcaatagacatagatattgctgaccatttttgaaacttcttaaacatgtgtacactcctctttgcggttaaatatgtaaaagttataattatgatcataacaatcaattgttaatacgttgtttttggaaatatagtactttgtaaaaatgaagttatgagtgtgtttttatcctactttgatcaccgaagattatgctttaggtatataaaccaaaaaaggcctaccggatgtttgcaaagtttgcgaaaccggcagcccttcttcctgttctaggtgctcttgacatataatattagactgaccccatataagaagcagtgacggagtcttagaaagttattaagggatttgttaaatcgctaaccaactaatgtgaggaagtatttttcaaatctgcttcataacgaaggccgaattgttgtcttgcctcctccatcacttcagcgactgtaagtgaacactccaaggagttaatggaactgttgcgttcaccactcttgatcaaatcaataaattcctgaatttcataatacattggctcacgcgtctgagctttggttagatcctcaattgtgccgtcccgataatgaattttcacctcatagggctggctgattttatcgatcaccatcgttccattctcaccctgaatttcagcaggcagataagaatctgtaattttggaatacatgacgatagcatccatatcaggatacttcatcacgatactgccctcgccatcgacaccagaggataaaagtacaccaaccgctcgaacctcctcaggtttgccgaacaaagtcaccataggatacaaacaatacactccaaggtccattaaggaaccattggaaaaggccggattaaacgcattcaataccttaccttgcttaaaagcatcaaagcgtgaggagtattgacaatagcttgcaaaataacgccgaacccggcctattttatacatatgatcctttattattttaaagttaggcatcagtgtggatttaacggcctccatcagcagaacatcgttgttgcgcgcggcttcgatcatgctcttcacctctgctgcattagacgcaaagggtttctcacacaacacgtgctttccatgattcatacataagatcgcctgctccgcatgtaaggaattggggctggcaatatatacagcatcgacctgatcacttgcggccatttgcgccaggtctgtaaaaacctccggctggctgttatatttgtcagcaaaagttttgcccttatcctctgtgcgtgagtataccgccgtcagggaaaattcgtccgtctccatcgcagcttgaataaatctctctgttatccagttggttccaataataccaaaacgcatcacagtatcccatccttcccgtgagtcattacaaattatatgtacctattctcgcattccagcctaaacttgtccactataccgttattcatacctcatgcctcaacatgttcgttcgacaaaaaaagactgtagtctatcagcataatttatactgattgtaccacagtccctgttatttatttggggtttacaccttcagtgcacgaacttcagactcggataaaccggatgcttttgcaatcacttcgatttcaagccccatactcagcatattccgtgcaatttcaaacgctttttggcgctctccctcaactttcccttcagctttcccttcagctttaccttcaatctttccctcagccttacctagctttaagccttcttcccttgcgccttcgatcatggaagcctcatcatgcagatacttttgtcgggcttcgtactgtaaacgcgcctctttatcctgacttagaaactccagcgtagtcatcgcctttttcaaaccaggttcattcatggctaatacctcccattgagatggattacttccctttagaaacaaaagccaattgaccaagctactgccaccagccggaatctcgtactcatccagtttgggcagttccaaaaaatgcaactccatatcatcactaaacggaatgcctgtacggtcctctgtcaaatgaaacacattatgataccgggtgttcggcaggaaagagtaattcaaaatgttgattgttacacactttctcagcagtttgtaagattggccttcgtataattgtcccgcatactgcttactccaatagaataaggttcgtttatccatgtcatatttattaaaaagttgcatctccacattaataagctgaccttccgacgttctggctcgaatatccaaaatagactgcttatcacgcggggcgtctttatccgtatacggattcagaagtataatttctgttaatgaaggtttccctgcctcctcaaaggtacgatttagaaaagttaaaagaacatcacggttttcctcgcttccgaaaatgcgcttaaacaaaaaatcgttgcgggggtccagcatttctaccaatagaatcagctccatctgctcatattataccacgccaatgaataagaaaacacaacaaagaacatacgttctcatatttatcaatcgataatatatcatctttatgagtgtcaagccatattcctgatggatcattttcagtatgcctacctgcacatatgtgcaaagctttatagatgttaaacacgaaaaaaccgtcctcgcggacggtcaataatctctattttttggagataaccttgcctacttccgccaaaatggcgtccatggatgcagggtcgtgtacatcatactcatcaatgttcagacgcagcacaggacaggcatcaaattcgttgatccagttggaatatctgcgatgcatttgctcccaataagaacgctcggtctggatctccatctcgcgaccacgctcctcaatccgactcagtatggaaggcaagctgccttccaaatagatcaacacatcagggtgcgggaaaaacggtgtcatcaccatcgcctcaaacaggctagtatacgtttcataatcggtagggttcatcgttccctgatcggcatgcattttcgcaaaaatgcctgtgtcctcataaatagaacgatcctgtacaaaacctccaccagacaagaaaatatttttttgttccttgaagcgttccgcgagaaaataaatttgcaaatgaaagctccatctttcgaaatcgtgataaaatttctccagatagggattatgatcaacctgctccaaagaggttttaaaaccaagacgtccggccaaagcacccgtcagcgtagatttgcctacacccactgtgcccgctaccgtaatcagggcattcgcaggaatgttgtaattattcactatataagctcctttacatcggaaacaatttgtttaaattgtgcctgattttctacaaaatcaatttcattcccgttcacggtcaatatacgaggggaaggggactgttcagcgagaaactgcatgcctttatcataatctatgatcaattgctccagataggcggggtccatctcctgttcaaaagagcgtgcacgcttgcgaattctccccagcaaggtatccaaatctgctctaatataaatgataatgtccggcttaggcatatcgtctgtgagcaaatgatagatttgacgatatttttcgagcttcacacccttaagcgtacgttcggcaaaaattaaattcttgtagatatggtaatcagaaataacgggctgagctttctcgatatattgcagaccggtatcctccagctgcttgtaccgattgcagagaaagaacatttccagctgaaaactccactcatctatattttgataaaatttatcgagaaatgggttctcctcgacaatctctttgatcatcggcaaatgtagctcggttgaaagcatcgaagctaacgtcgttttacctgctccgatcggcccttcaacggctataaatggggcttgtttcatggggttctgctcctccttgtactccagtccatcctgtggacaactatcctattgtatcacaaggtagtacgctaaaggcataccaaatctatggataaaacaaaaaaaacagagcgctacattttgcttcatagcgtctctgtttctcatttaaaccaacctttttcattaaaacgtgtaattgcctcaatccggttactgacacccagcttatcgagaatgactgaaatataattgcgcaccgtccctgtcgttaaatacagttcaccagcaatctcttttgtgttctttccgtcagcgatgagcgctaaaacggtcttttcacgctctgttagcgggttgacttcggcataagcatcatcgaccagttccggggcatagatacgccgacctgccataatacttcgaatggaggaagccagctcttcactaggactgtccttgagcaaataaccgtgtgtccccgccttgatcgctcgttcaaaatacccgggacgggcaaacgtagttaaaatcagcaccttacagttcaaacctttgagttcctcagccgcatccaatccgctcttgatcggcatttcgatgtccataatgcatatatcgggctggtgcagcttcaccagttctatagcttcttccccgttgctagcttttccgactactttcatgtcttcttccaagtccagcagggaggctagagcacccagcagcatacgttggtcctccgcgatgacaattcgaatcatggccccacctcctcattcggcttttcagtgatattgggcactttaataaccagggtcgttccctgatctgaacgcagctccatacatccgttcacgaattcgagcctttctttcatacctttcaggccgtttccacgaaaggttccattttctctcgtaataccgactccattatcctgaatccgaagggttaattccttacgggacggctcaatggtgatggaacaagcggtggctccactgtgcttaaccacatttgtcactgcttccttcatacacatactaaggacattttcattcattaatgatgtatgctccagcttcgggtcgccctctagagtcaattcaatgtgagcagcctttaaaatctgccgaatacgtagcagttcatcctctagtcgcataccgcgcatttgagtaaccatttcccgcacctcttttagtgcgcttctcgccgtgagacgaacatcgttaatttcagcatgagcccgctccgggtactgatccatcagtttgcccgccaaatcgctcttcagtccaatcagtgacagcttctgacctaaggtatcgtgcaggtcacgcgcaattctttgccgttcctccagcttaatcaattccgatattttcttattggcatcctccaattggacttggagccgatcgcttttgttgcgattaaaattcgtaatcggaaggagaatcacaccgatcagattgagcaggataaaaggaatctgtttaataaaaatgggattctgagaaacaaaaccgtaattgatcaatccaatcgtaataaccattaaaataatatacagcgtcgtaaatgcagccttacttttaatattaccgatcagataggcgataaatatggaaaaatacatataactaaacagcagtgtcatggtaatcgatatggcaatttgtacactggtccaaaagtatataagccagcctttcgagacaaaagccaatacataacatgcaaaaaacactaaaataatagcagtacccagaataatatgacttgtagatgaagaactaaagtagtaaaagggcaggatataaaagacgacccacacataagggctaagtcccgtatttctttgaaaaatctgataccatttttgcatcctgccaccctcttctacttcacttgacttatatctcttatcatatcataccaagttttgtacaacgttattttctttctgtgcttacaacaggtgtagggatgggtttcgtgactgcaacacgtttgctaaggagcggctttacttgtttaaaggtcaaaaaggttttcgtattttcatcccaaagtcggaactttaatgattgcagactgctactcactgtgatcgtggtcgccttttgaagtaacggtgtcgcttcatgcgctttttccaaattataatttggcactttggggctcaaatgatgaacgtgatgaaatccgatattccccgtgatccattgcaatactttaggaagcttgtagtaagaactgccttctacggctgcattaatataactccactcttcatcgtgctcaaaatacgaatcctcaaattgatgttgtacatagaacaaccagatgcccaacataccggatacaaaaaagataggtgcctgtaccagaaggaaggcctgccatccaatagcccagcacaacagtgcatacaatgcaacgatggatatattcgtcacatgagtgttcattttttccttgcgtttggctgtcttgatattaaagcgataggaaatcaaaaaagtatagatcggacctagtccgaacataacccaaggatttcgatatatgcgataggccagccgtgtccatgtggaagcctctgtgtactcttctaccgtgagcacccacatgtcacctgtgcctcttttatccagattactgctggttgcatggtggatcgcatgactatttttccattgatgataaggacagagcgtaataatacctgtaatcgttcccacaatgtcgttcagcttgcggcttttgaagaaggattgatgaccacaatcatgaaaaataataaacgtccgtaccacaaaccccgatgcaacaatggcaatgggaagcgtcagccagtacgaaaccgacaggctaagataagcagcataccacaataggatcagtggacccaaagtattgatgagttgcagaacgctggatttcgtgtttattttctcgtagggagccatatttttttttaattgggctaatgggagttgtgtcatactcattatgatcctcctttaaaatgacgcctataccttgatcctgttaggcgtacatgttgatctaatctcagtataaggtgaagactgtagacgctgtagtcataaacgtcagctcgggtatatgacatttgtcatatagacaagtaacataaccccttttccaaatgttcgcgggtttcttttctgaggattatttgttaaaatataagctataataacgctgtatgtgactggcgaagtcagtggaatgaaccacgagggagcatacaaaaaaagcgtaccgttcgcctgggagaagtatttgcagaggattcgtctgtcttgacgaccttgtgcaaatactttttttcgtttacaagaccatgacaacctgttgataaatcacgcgataaattcagaggaggctcggactatggctattatcatgaaatccaaagaagcagctgagcaagtatatgcaacgatccgttcacaggtagaagaaatgaagcagcaaggacaccgtccccatctggcgacactattggtagaaggcgatccggcttctgcctactatgcccggaccaagcaaaaaatagcggagaagctgggcatctcatttcatcttcatacttttgatcgtcatgttagcgaaaccgagctactgcacctgatcggcagtctgaacaatgcaccccatgtacatggcattatgctggaactgccgcttccccaacatctttccgcctccgttattaaacaatccatcgccccctacaaggatattgatgggattacacctgataacaagctggctaccgtaacaggtgacgccggattatatcccgcaacacctcaagcctgtatcgagctgctcaagcattacggtcacacattggcaggcaaaaatgtcactctcgtgggcatcggacagacagtgggacttccccttttccacatgttgcaaagagaaaatgccaccgttaccgcctgtcatgcaggaacacgtgatattgcagagcatctgagccatgcagacattgccttcgtcgcagtcggatgccctgatgtgattacacaggatatggttcatccaggtctgattttggtagatgcgggaattaatgagacgctagagggaaaaatagtgggggatgccgctttagacgttggggagaaggtccatgccatttctccggttcccggcggtgttggcaccttaacaactgcgattttgtataaaaatctgctcaaagcaatacatctgcaacactactccagagaggtggtctattcatgagtgaactgtcgtggaatcattccatcggacattttctgaaagaggctgcaagtgcagcgcctacccccggcggaggaagtgtatccgcactggctgcggcactaggcgcggctatgacctccatgaccgccaacctttcacaaggagaaaaatatgcgcacatccataaaccaatcacggaagtcattagcagcatggaaagattgtctacacattgtgaggaactaatggtcgcagacatccaatcctttgaacagtacatgaccgcgctgcgtttgcccaaggaaacggacgaagaaaagcgctatcgtacccattccttacagacagcggtgatcgctgccattgaggtacccatgcgcctgctggaagtatgccgggacggattgtcgcaagcctacaacattgtggaaatgtccaataaaaatgtgatttcggatcttggcatcggcgcgatcctgttcgaagccgccgctcaatctgccctgcttaccgtcgacattaaccttgcttcgctgaaagatttggatgtcaaatactgctatgagaccaagacagccgcactcatccgtgaaatcggacagatcaaagaacaaaccttgttgatggtgcgcagtcgaatagcgaattagattgctcataaccgtgtttaacctgttcgaaccaacatattctgcttactcattaaaaaacagcctccaaatccatctctaatcgtgggtttggaggttattttattgaaattcatacattttggaaaacttttctatataatctacgtctatggatagggggatacattgatcaagaaatgaggaaaatcgtatgaaaagacgggctctattactcagtataatcacgttattgctgctcagtcccagtgtatgggcggccggagataactccacatcccatattcgcgcctatgattccgggagtctgattcagtctgatggaagcttgtggctgtggggttataatcaatccgtaccgactcgtgtagagggtaagccggacgttgtaaaaacattttctaatatcatcaacgagggcgatctggtatttaccttacaagaccactctgcttggtatgtgcctagaaataatattgctgaatccgtgaaattcgttcctctagaaggattacagaacctcgcagctgtaagtaatttgaatgatcatgtgctcgctctgagcagcgaaggcagcatatcttccgctgaacggctcgacaatggaaacatctctagtccttttcaaaccctatctggcatcgacgagattgccaatattgatagttactatgaggaaagaccggattatgaggaacgctggatatttctaaaaaaagacggcagtgtatggaaaaatacaaaagccttgcagggcttcgaacctatttcatcattaaaggatattacgtcaatcgctaaaaacatagccttaaaaaaagatggcaccgtgtggacgtggcccaaagaatttgataaaaatgcaactccgtccgaaactctatccgtatcgcaaattcaagccttatcggatatcaagacaatcaaggccaataggtattccaatctcgcaattgatcagcaaggtcggctatggttctggggtgctacagttacgggttactcagataatacaacctatcacaacgaaaatacccctgtactattaacaggagtaaaggatgttaaagacgcctttttcgccgaacgctccatacttgccctcaccacagctgggaatgtatatgttgcgtctctagatggtgaaaagttaccatccaatgcaccctttacattacttgctaaaaatattcaaagcatcaaagcaggtccacggcacgtaatcatgcaaaaaacagatggctccctatggggctggggtgtcaacaaacacgtgcagctcggtataggggactatgagtttctgtatagttcaccagttcctgtacaaaaaccgattcttgtccgtctcaatggttcgcctgtctctctgagtaatggtgtcattacccgcaacgggcaggcgtttattccccttcgttctgtttttgacaaactgggggccgagatcgcttatgatttcaacagcaaaatagcgaaaatgaatcagtctaagacagaagaccatcctgtctctctagaagtaaatttcaaaaccagccaaacaaaagtgaacgataaagctgtaaagctcaccaatccgcccttcatggtgaatggtattggttatcttccattaaggctactcagcgaaacgctaggggccaaagtagattggatacaaaaagaagatactattgaaattacgacaaaatagtaaattaaaaaccagtccatatatgattcatgttggactggtttttaatgctatatactgcgtataatatgcgaattcctatctgttttgggcaattcattacaacgcagaatttcagatctattgtttagctttattctctttttctctttcgaccagcatatctacgatcatatcaatttgcccggtaatagcgattggatcataacgataatacgtatcaaaatcgttaaagaacactctattgttcttcaccgctggaagattcccccacacagcggacgactttagttgtttgagcgcgtcaccctttttctcggggtcatacgtagtcaggaacatataatctgcgtcatactgtggcaatacctccatcgaaagctgcaccgtttgttccttggagttcactgttttctttggcatgttcagtttaagcgcattgtatacagcttggccgccgcgccccgcattgtcgccaaagatccaaagtgcgtgcttgtccgtcagctcatacaaaccgaaagttgccttttcgtcaatcacacctttaagacgtgcgcgaccttcagcggcctttttatcaaatgcagtaataaattgctcggccttctccttttccccagtgatatcgccgaacagcttgaccgtatcatagatattagtcgtcgtaccgtaaggaatgtacagggtaggtgcgattttagacaaagcctcataattcgtatccttcataaccacgatcagatcgggtttgagttccagcgtcttttccaaattggtcggatcacccacctctttggttcctttttccttcagcaaatcggtcagaaaaggattttgaaacgcagtcggctccacacccaccacgttagcacccacggacagcaattctccgccgtaaaaatccgttacaatgcgctgtggctttgcaggaatttgaatatcccctttaaccgttttaaagcttctagtctctccagtagtagccgactcttgcttatcttctgaagatgaagccggactacttccattattatttccgccgcaagcgctgatgaatacagacaatacaagtaacatagctgtcatcataaaatacgattttcttttcaactgattagccccctatatattgtggagatgatctctaaaacagatgataatgattatcaatatcgtaagaaatatatcaagtgtcgtccttgctgtcaactgaaaacgaactttgcatcatttcactttaaaaaacaaaagacctgccaaaaaatggaactgaccccataac

SEQ ID NO: 2672 - DNA, 24526 bp, Unknown
  Kingdom: Bacteria, Phylum: Firmicutes, Class: Bacilli, Order: Bacillales, Family: Paenibacillaceae, Genus: Paenibacillus
acaaatggggtgcagttcagatgtggctgcttttttacactattattactgcgttaacgctgggcctacccttccagcgcctgcttcaattcctcaggcgaagcgtcccaccattcctcgttatgcgaaatcagcagacttttaagtgctgccttatcctcacttccgagatcctccagcatgaaacgacgcttgagcgcataatccatacgattgacgtgatcggcgaggattttccagccgcgtttggcttcgtcgtcaatcagcatctcgcaggcggtggcaccgccgtacatacgtccttcgggcgtacgatccacagctacccatacgagccatacttggcgtccgttcggtacatcctctttattcgtagagaacttgataccgcgttctactttacttttggcatgcatggcaccgatatcaattttcgcctctcctcggtcaatgatgaccggggacatgctgttcaggtcgattgagcctgcgccgaaacccttatgtttactcttgccactgacaatgttcagtgcaatctgttttttgccgtccggctgattttcactcatgcgtcactagacctccattttccgtcttcacactcattctacactataaatattttaactaataatctcctgaaagcaaacatatacatgctgtagatgcttgtcaacgggaggtatccattgtatgaccccagcacgcactaaaatcgttttattgtctacactagccctcggtctcctcgcagggacgttatggtttgcctggcagccccaaccgcaatccgacccgcagtccataggccaaccactatacggctccctgtctgagtctgcgcttgccccaaatatgggcaagcctctaggggcaaacatcctgcctgacctgcccaagaaccctccacagcccgctacagaaatcctcagcaagagggtggtagagtaccacattgatgtgtctctggaaaaaggacaggttttgcgaggcactgagacactgacctggaagcatccgggcaagaaaaccgtgaatgatctgtatcttcatctatacccgaatgccttcttttccatggaaactacctttatgaaggaatccggtggaaagctgcgcggagacaccatgcccaaagacggctttggctccatgacgctgactgaactaaaaacagaagacggtttatctctcatgcaccgcatccaatatgtgcagccagatgacggtaacgcaggcgaccgttcgctcgtgaaggtgcgtctacccaagccggtacgaggtggcgaagaaatcacattatatatgaagtttgaggtaaaactgcccgccatcttcgctcgtatgggtgcgacagatgattttgtaatggcagggcaatggttcccgaagctcagcgtctacgagactgaaggacagcgtggacgcgccgaggagggctggaacctccaccagtatcatggtaactccgagttttatgccgattttggaatttacagcgtacggattcgggtgcctgaaactcatatcgtagcagcgaccggatttcccacccgtggtgccgtccgacagaacggccaaaaaatatatcaattttatgccgatgatgtacacgattttgcctggtccgcttcacccaactttgtaaccgtagaagaacccttttcttctgctgaagtccctggtgtcaaaatcaagctctaccttgacccgtcgcacaaggagctcaaagggcgctatatgagcgcagcgaaggccgccctttcgtactacagcaaatggtacgggccttatccatattccaccctatccatcgtggttccacccaaatcaggcaatggagccggcggtatggagtatccgacactcatcacggccgctgctgcgggtaatctgaatcctggctatagtctggaacggacattagttcatgagattggacatcaatatttctacggaatggtagccaataatgaatttgaggagccgtggctggatgaaggcttcacctcctatgcagaggagcggcttatggagcaagaatatgggcttacccccaacctgccattacaatcgggacaggtagcttccccacagccgctaaaccgtgagtcatggaagtatggctcagctgctgagtacgcgcaaaatgcctactctcgaggcaagctggtactacggggcattgaacgtcaggtgggtatgaaaaaaatggatcgcattatgcggacctacgtccagacgtaccgatttaagcatccgtcctcaatggattttcaacgtatcgtggagagagtcaccggacgctcatggagccactattttgaacagtatgtatatgacggccagatggcggacttttcagtggatcacatcacaaaccacaagctggagaatggatatgaagcagtcgtgacggtcagcaaaaaaggggcggattatcccaagatccctgtccaatttaccttcaaggatggtaccacgatattcaaggcttgggacggcgcgggcaaaagcacaacttttcggatcaaaagtacttctcccgtttcctatgtaacccttgatcccctatataccattgcactggagaacaagcatattaacaatagcctaaaggccgaattggacgaaaagcaacaaacccgttggagtgttagtgtaaccaagctgttggagacactgcttggaagtctgtcatggtgaggtgtctatagatgcggactgttataaaagagggctgggcgctggtgcgcatacgattctatatcgttatcattttatttctgtatcgactactgtggggggtgtttctctatcggctggtgcagtctgccgttatcccgctattgctccgttatcctgatcagggtcaaaacgaactgggacagaccttattttggatggagagtcagattgctctgatggacagccgggaagtacatgtgtatttgtggatactactaggggcgactgtactacgcatactgatcactcccttcattagagccggaatatatcaaagtctgcataccgatgcgactgaaccgcaaagcctgtcctttttcaagggtatgaaacgccatggcatgtcgtcgctgttgtattacaccatcgagttgggactgctgctgcttcccgccttttgggtagtaccgagactctaccctattgtagcaggagcacttcaatcttcctcttatctgctgcatttattgccctatgtcattggatggatggcatacggatggttcattcggcagtgcatcctgtatatgcaactgggtactgtcggtggtcacgccatactatcgtccctgctcgccttctttcgccagctcctcccagctgtcggtatatcccttttgctcggtgcttgtgtgctgctggtcttcggtctatttggcaccgtggcgatgatttggactggcatgctggcgctcattctccagcaatcgtatcattttgttactagtctggtcaggctgtggcatatcagttcgcagtacagactatggcataccgatatctctagtagaagctaagccctgcctttatgttttttacttcatttccgtctgtcgaaaaacatgattcatacccgcgcaaacgacacataactgaatactgttaacaagatctgttcctgggacattaggagcagattttttttgtaactttttgcaatgaaacatttgccaaagccagccgtctttgttacaataatcgcagtgaactgatagtaacaactttgtaatctttattgtaacctttatctcaaaaataacgttattgtgaatactgctctccaaggtgcacatcttaagttaagcctaattcctggcacctaggaagcgggggaaccagtttgggtgaattgatctcgcaacagagtggtcataggggaaccttctaccgaatccttaagctaacctcgcaggcattggaaggggtatattttttttgaagaagaagctaacgatcgcagctatgggtcttgccattgcctttacatcttttacattcggtggcggcagtgcatatgcagactctaagatggaccaggtcatccaagatgccaaaggaacgaactacagaagcggaggcactacactcgagggattcgattgctccggcttcacaatgtacgtatacaacaaactgggaattaaacttccgcatcaatctggatcacaattcaaaatgggatcttctgtatcccgagatgaaatgagacctggggacctggtgttcttcaacaccacaggaagaggcatttcccatgtaggtatcttcgtaggtgaagggaaatttgcccactcctcgacttcacgtggtgtagtagttagctcactgaacgaaaattattacgctaaccgctatgttggtgcaaaaagaattatgagcacagacgcttaccattctgtagcttcagacattcctgatgacgataacgtagaataactaacgcacagcaagctaaccctagccgcaatttgattctggccggaatcgaattgcggttttttatgtccacaacatcagcaattattatctttactgacgaactgagacctcaaaaggtttcaattgtagcgaacatcgtcggttttaccgtcaccgctgggggagcatatgagcagtaattccttcttattgaatgtatacccgacttaggtatgaaataaacacgcttgccattcctctgcaacttgtctacaatctgttgttaatgattgaagtacctgtgtaaaaggaggatggaacacatgccggcctcaatatccaactatcggatcgtaccgatggacgagcatcaagcggctgcaatctgtgagtggcactatgatccaccttataacatatacggttggctcccctgggaacaaatgaaggcgcttgaagtcgaatttggaagtcccacgcttcgccaagagcaatatgttgccgtactggataaagagaacaaactgacgggatttgctcaatattttcctatgatcggtgtgacccggctaggtcttggaatgcatcctgacagatgcggacatggcaaaggctctgattttgtccgtgccattgcagaggaagctcaacgacgcaacccgaagaatgaaattgatctagaggtgctcacttggaatgggcgcgctatccgggcctacaaggcggctggatttgagcttacagatacctatgaacgccagactcctgatggcaaaaaaccattttattgtatggtatatcgtcccgagcacccaacccagattctatgataaaagcgccttcggcatacaaccacgatgttgtatagcgaaggcgcttctatcatcatacgacagatcattacaagctcaatgactgctgcgcattttttcaaaagcttcattatattgttgggcttccttaatatccacggccataataccgccgtcgtcccaagaggtcaaacgcagagtcacggtcttataatcaatcgtaataaatggatgatgattgaatgcttcagatatagcggcaacttcatccacaaatgcaatccctttcataaaactggaaaaattatattttcggacgatccaacgtccttcctccagttcccagccctccagtttctccagatgtgcttcaatctcttcttgtgtaaaaggcatgttacgaactcctccccgtttatacggaagcctttcgaccgcttaaatacggccaaaactacgatatattggtgtacatattaccacggccccgttgataaatccataagacggacctcaaatcaaagggactgacgtcagctcctcgtccccaataagtacatagatgcgatgctgctccggctcatagatcacaacgccactccctacagtgattgtgggctctgtacccagtgcataaaataagtcttctgccaaagcttcattgacttcctgacgtcccgccggatccagcctgtcccaatcttctgcttccatctcaaaaaattcatagctatctgggatgcgccccacagcctctgtcaaatcgttcaaaatttgttcatactcacgcccatgctttactcccatgccatttcctccaatggttccgccattcaatacataatcaccttattataccggaaattcgcacttaacaaaaaagagagttttgtcgataaatactataatccgtcttgtaatgacgcgcttggggcaaggacgaccccggcggcatgaaaggattcaaaatctattctcatggatgaggtgtatcatgcaaatttcaaccattatcggacttgtgctcgggattgtgtcactggtcgtcgggatgatcttaaaaggcgctccggtcgtcaatttggtcaataatcccgctgcttacatgattattttcgtcggaacggcagcgagtatatttatggccttcccgatggcagaaatcaaacggattccgaagctgttcaaggttattttcaccgaacaaaaactgttagaccgcaaagagctcatcggtacgtttaccgagtgggcatccattacccgtcgtgaaggtctgctcgctttggaatccaaggtagaagaaatcgacgatccctttatgcgtggcggcatgcgaatgattattgacggcaatgatcaggaattcgtacgggacgttctgatggaggatatcaatgctaccgaggatcgacatcgctctggcgcactgatcttctcccaagccggtatgtacgctccaacgctcggggtactcggtgcggttgtaggtctgatcgcagctctggctgaccttagtgacatggaaaagctctctcatgccattgcagcagccttcattgcgacgttgctcggtatttttacaggttatgtcctgtggcatccgatgtccaacaagctgaaacggttatccaaaaaagaagtggagcttaaattaatgatggtcgaaggtctgctttccattcaatcgggtatatcgacgattgccatcagtcagaaactgacgatcttcctgactccgaccgaacgggctacgttgacccagaaggatggcgattccagtgagtaaaaagagacatgaaccgcatgaagagcatgctgacgaaagctggctgttgccatattccgacttgatgacccttctgttggctcttttcattgtcttattcggtatgagctcgctcgacgccaaaaaatttgaaactatggctcaatccctgaatgcagcttttagtggcggcactggcgtgctggatcactccgccgctaatccgtcgtcacaatccatggatatgggcaaaaataaagaacaagtgtcacaacccgtaaaatcgaaagctacttctacctctgaactgcaaaaacagcttgcccagcgggaagaagaagatttaaaaaagcttaaaaaacagatggatcaatacattcaaaataacggcctgaccccgttgctgaataccaaactaaaccaatcgcaactgatgatcaccattagtgataatgccttgttttcatccgggcaggccgaagtaaagccggaagcaagaaaactggccaagtccatttctagtatgctccagcagttccctggctatgatgttatcgtatcgggtcacacggataatgtaccgatctccaacagccagttcccgtccaactttgatttgagcgccaagcgctctctgaatttcttgcgtatcttgttgctcaatccagatctcgatccaaccaagtttgtatccatcggttatggcgagtatcgtccattggcaagcaatcaagatggtcaaggacgctccaaaaaccgtcgtgttgaaatatctgttctccgcaaatatcagaacgggacacaagtcatcagtcctacctcaagctcgaatgaaggttgattatgcatatgttatatgaacaaaggcaccgccgcatttttatgcagctggtgcctctttgtttagtgcttcctataatccgaccctgtcagatacgaggatcatacgctgtagactatacgaagcccctctggcattagctaagcgtataatcgagcatctggccaagctcctgcttctcagcctctgtcagatcacgccaggcacctttctgaagggaccccaaccgaatgttcatgattcgcagcctttgcagttttttaacttcataaccgaaggcagcacacatacgccggatctgacgatttttcccttctgtcaggataatacggaatacatactcagatacacgcgtcacctcacaaggtagcgtccgctggccgagtattttcaccccgctggacatgccctgcacaaaagacggtacaacagggcgatccaccgttacgatatattctttctcatgcttgccttctgcccgtaaaatcttatttacaatgtccccatcattggtaagtaaaatgagaccttccgaatccttatccaggcgtccaatcgggaatatccgctgtgggtgccccacaaaatcaacaacattgcctctaatatggctctcggttgtacttgtaatgcccaccggcttgttcaatgcaatgtagacgtgatcggacttctcgcgcagtggcttgccattcacgcgaacatcatcgccttcttccgcttgactacccagcacagccacttcgccgttaatcgtcacgcggccgctctctaccagcttgtctgcctcgcggcgcgagcaaaaaccggtttcgctgataaacttgttaatgcgcaacctgtgtaccctccatttctactaacacacttcctcctgcgcccagcccgttactccggcttggcaattggaagctgcaccagggctgtcgttccctctccctctgtgctttcaatatccagtgtgcctttatgactctgtataatacgctgactgaccataagtcctagtcctgtccctgtttctttgtttgtgaaaaaaggttctcctagcttggacagcatttctgcgggaatacccgctccctgatcccgtatagagattttaacgctttctccctccaagaacaaatgaatcgtgatgataccacctttactcatagcctccatgctatttttaagtaaattaatgaatacctgttttaactgattttcttcagcgtatactagggcaggctcgtccgtgacctgaagattgaatacaatgcccagcaggtgcgcctgactatctagtaaagaaatcacgtcgctcacaatatagcgaacatcctttttctgaaaatgcactgcctgtggcttcgccagtattaaaaactcgctaacgatcaaattaatgcgatccagctcagacatcataatatcgttgtgtttcatattcaacacttgattttgctgctgtagttggagaaagcctcgtagcgtagttagcggattacgaatctcatgcgctacgcctgccgccaattgtccgacggttgtcagtttctctgatctgcgcaacaactcctccattcggttgcgacccgtaatatcacgcgacacgcagataaaccccaaaatttggccttcttcatccagaataggcgacgtgctcatactgatctctactgtacttccatccttacgcattctaagggtctcacttgatacgatgctctctccctgaagcaggctcttcttctgaaattcatactcctcctgttgctgcggaggtacaaactccagcttacgaccaaccaattccttcttggtccagccgtacaaagcttcgaaggcatgattgacccgaacgacgcgatcctcctcgtcggttacatgaattgcatccgctgtctgattaataaccgattccagatgctcctttacagaacggttctcttcatacatctgttccagtcttctcgtgtacatccctaggttgtaggccatcgcattgatgcgttcacccaactgtgcaagctcatgaccaccttttatttctagccgtgtatcaaaatgaccatcagccatctcgttcactttccccagaatcgactgaattgggcggacaaacagacttgccagcacatagcttccaatgattacaacctccaaaaggacaatggaaatagcaattaagcttatcaattgcttggaaataacagaagtaatcgtatcataattcataacaatacggataacataggcttcgcggttagccgggtaaaaaggtatgtaactgacgagaacccgttcgcctttgatatagcagtcttgtacaatactctccccggagaggattgctctggacacggccaaacgatcttcctgcactcttgttagttgatatgtgccaaattggatcggtttattgtacatgtaatagtatttcgaatcgttcccgttcttgtccatcgaagcgccaccaaaggttgcagggttaattcctgtaatctccatgatgcgataatccacttgttgggtttgctttacgatctcatcggggctcaggatggttatgaaatcttgcactgaagtatcctgaaaggaaattcgaattaagtagttacgtttttggtcataataaaatccccatttgttaatctgtgaggagcctgaaccggtgtagtcaaatgatccggtccaaaaatgatccagtttctgaccttgcgccattgcagcctgtccatgctcatataattggtcaactgcatttttccaataccctgtcaatggatcagatggcgttacttcttttggatccgaggatttaataaccttatacccctgcccgtctcgaatcatcaaagaaatattagtatctctgtggagtgaggccaccttttgaagctgttcctgctgaatatttcggatgtcaggacctagctgattagcagccaacgtggcagaaagccacagattatatccgagctgcttgtcaacggcctcccagctatgctgggtttgttcgatagctcctccgataattttagccgtcagaaccattttagtttcactgtcacttcttagattttcgtgggtcgtgtaataattgagtgcgatgtttaataaaaggataaacaggacggaccccgacaaaatgatcgttattctgatttttatcgacacactgatttctcacctcttgccgtatgctggcgattactggcaattgctaactcaatgataccgtaatagcgcctgtgataccagcatttacatttaccggatatacataaatacacaccttgtgtacagtattgtcaatagacgagggtttccctacaatataagaagataatcatccacaagtagtccacaaatacacagattttattataaactgtggataaacctgtggacaagtgccgtgttatccacaattttattcacatcatgttaacaacggaatatttgttcgttggataattccgcgttttgaaaggagtattttcccagtgaccaccattgatcacgcctattggatgaaagaagccattcaggaagcgtataaggcagaaatgttaggtgaagtccccatcggggctgtcatcgtaaaagataatgaaatcataggtcgcggctacaatttgcgcgagacggatgctgacccaaccgcacatgcagagatggttgccattcgtcaggccagtgagcacttaggcgcttggcgcctgctggattgtaggctgtatgtcactttggagccgtgtccaatgtgcgccggagccattgttcaatcacgggttccccatttgatatacggaactacagatcccaaggcaggctgcgcaggcacgctgatgaatttattacaggagcctcggttcaatcattgtacagaagtaactagtggtgtactgcaggaggaatgcgcctcgctgttaacgaacttttttcggcatctccggcaaaaaagagcggcagccagattgtctcctcccccatcctcatcctgaggggaaaacgtccaaaacacttcatctcattgctaattccccatggaaggagaccaacccatgtctatgagcttgtataatacgcctcaaggtatctttttacggccatttagcttggcggatagcgaagcccttctcgcccttaggcaccgtaatagggattcccatgcgccttatgagccgctttacgaggattcatttttcacattagagaaacagcaggattatatccgtcagaaattgcgtcaagccgaagaagaccgaggttacgtgtttggtatctttctcttaaaggaagaacggctcatcggttatatctctatttccaatctagtacgtggagttggacaattcgctgatatcggctacatgatggatcatcatgaacagggtaaagggcatatgaccgcagccttaaagttgatcatacaatatgcctttcgtgccttatctctacatcgtctccaagcgggtacccttttgcataatgatccctcacaacgtgtattaaaaaagtgcggcttccagccagaaggcattgctcgcaagcttgtacaaattcagggcgcatggcaggatcaccagatgtttggacttttagctgaggatgatgtgtggcagagctaaatgactgcacagggacaacattaacagtaaacaaaaaaccgcccggcttatgccgagcggttttcttacatcatattcgaaaaaaatgatgttatacaatcatgtcatcccaaacttaaggagcaacagtttgcattttttgttgcagctgttccatagtcaggacttgatcacctgttggaatacccactttaaatgctgctttagcattgattttactgtattgcgtgtagcctgttacggacaattttacattgtcttttgtagccggatcattcatctctacattcgcattcaggtcttgatacacaggaatgttatccttgttcaaagctgtgttaatgtcaaactgtttcactgtcaagtaatttttcaactcatccagctttttgctaacttcgctggtgttggattgcaattctttcttcgcttcagccagctcttctttctttacttgaagcatgccagcatattcatctttagacatcacatcaaggactttaggaagcgccttagtgataaatgtattggtagcttgcttcacattgtcgttcgtaattttgaattgaacgacttgtttagcttcaacgccttgtggcaatttagcgtctttaggatcaatatcaaagaagtacgtagcttgatcatactcgttcataatagcagcaatcacttcattcgcaaatttctgcgatttttcctgatccatggctgcaggattaaattcttgtcctgattgtttagccagttcttgtggatcaatgaccaggaatttacctacaacatcctgtggaagtgggtaaaatggaatattaggaattttaacgtacagtttatctttagtcattaccattggaatcgtgaagctggtggaaagatcacctttcaaatgaatgccgagcgtcatttcagattggaaaggttctttttggtatacaccatccagcgtaatatcagcatttttcagcatgctagttaccattgcactttgctcacttggaacagaagcggatgtaatggtcagttccttaatcgtgaattgacttttggattcataagagttcaacttcattgcatttgcagtaccagtcgtaacagcttccttcggttctaacttcttgctacaacctaccagggctaccgtcaaaagcaacaccatagtgagtaccaagacggataactttttactcattgtgtagattctctcctctcgtaattaaccccttttttatgctaacaaaaaaaatacacacctcctattttaactcatattctcaaacggcgaaacacttattggaaaattttcttacaataagcacaaagacaccctggctctcttaccagggtgtctacactacgcaatatattttaggagaaaggtctgcctgcttatgagccttctctattatgatgatccacgtgattccgctgtttcaccttcttggaaccggataacggctcttgctgatgactacgctcccgcttttcgttacttccaccagaatcctgtgcttcggggacaggaatggctttaggcttgcccatttatgcatcctccattctcagtctatatttgtggtacatcaacgaacccgtttattaccatttaaaataggactatagatggtgtaaatcttccgttttatcgtgatttagtgaatcctgatgacggcgatcattacgatcctgctgcacttgctgtgcctgatgactattaactgggcgttgctccaaatcatcaacaatgttagacaggtttttatccagaccgtttttggcttttgtcatgtagtcttcctcctcattccttcatgacctacgagtgcgtcaatgactgtaatgtttgggcacattggtgaatatgccgagtataatcggacactaactgctgaatgatatctgttcgttcatccacagactgtccgtcccgttctacatcgactaagctaacctgtacttcccgggagtctacataagtacatgcaaaatcaaaggagtacatttgtcggccttctacctcgatatggatccgtatagcccggttgtcagcttcatctgcctgtacctgtgatttgtcccctgaattcaaaagaatcggcagttgttcctgccaggcctctaccagcttttgctgatctactgtcatttctcgattcatgccagcacctccacatctgataacgtgtgaaaaaaacgagctttttatacaacaaaaaagccactctccatgattcctaatcattagcttataaaggccaatgtatcagctatcgtatttgaatggcttggtttattttagaatatggcggagaggatgggattcgaacctatgtgggcttgcaccctaacggttttcaagaccgctactacctatgaaaagccgccgagccttggtatgactgggtttgtgaagtctaatgcaagaaccgctacaactgctggcctgtctgcaacgctgccgtgtcccccttgccattatctggaggcaatcaggtgcacggagctgccccgatagctcatttttattgcaccaaaactataataactgattgagcttgctttcaggctcttcaccattttctacacgttttatattgtttataaagaaatcatatctttttttatgaaattttcgaccatcaggcattcctgctgtatggggagtaagtatcacattacccagattccggagctcactgtcaataggaagcggttcagattcaaacacatccaagcatgcgcctgaaatatccccgttttttaatgcatcaatcaagtctctttcgttgacaatcccgccgcgggctgtattgataaaaagagcggtattcttcattttcttgaatgccgctttgttgatcagttgtttggtttgttgattcaagggtacgtgtacactgactatatccgatgtgcttacaagagtatcgaaatccgtcattttcacaaaaccgtcagattgtacaagagcatttctcgcataagccagcacattcatatcaaaaaccctgcaaaatgcagctactttttttccgatagcgcccaaaccgataattccaatcgttttgccttttaattcactccctgtatagtccaattgattttcatccatcctgtttttcatgaaagtatcaagaaacggtatgtttttataataagacaatatcagtgccattacgtgctcggccactgcctgtgcattcactcctgcagcattggccacccaaatgccgagctgtgtacaggcagggacatctacattatcaaatcctgcacccgtctgtaccaattttaatttttttgcgatagaaagcaggctgtgatccactttaatatgttcaggaataattacctggcaatcttcaatatgatgcagcatttcttttccgggcgggacaattacaacattccagtcttgaggaaaataccttacaatatttgatttcgaggtctcgctaaaatagccaactatgagaatcttcattgctaaaccacctttcattacctataccatttcttcgaagaaaacccgtttgatgatcttcattttatccttttgaagaagaagtaattatttccatattatagacttcgtcggcagtaaaacctcttgaaaggtcattgatcggtgcatttaggcgctgcaggatcggaccatatgcctcaaagtttccaagacgctgcgctattttacaaccaatattaccggcatgaatacctgggaatatgaaaacgtactataataaaatttgacccctcgtccttattaaagataattttaaacatagagaataatgttgtaaaactcaaatattttgtgaactatattaatcatttctatatattgaggaggtattctatgtattttcctgggattgaagcgtttttagctatcgtacggaccgagagtataagcaaagcggccgaattgctgcacctgtcacaagctacggtgagctatcggttaaagacattggaacaggaaatgggtggccttttggttgagcgaagaaaaggggcacccaaaaccagtctgaccccaaaaggggaaaacttttttagcattgcggaaagatgggatgctctctggagggaaacacaaatcttgcaggctagcggttcgcagttaagtctggcaataagcgctgccgaaagtataagtcaatttgttttgcctcctgtatatagaatgcttaatcagcataccccgtccatccgactgcaaattcgtacgcagcatactcaggaagcttttgatagtatcgagcggcgcgagatggatgtggcgtttgtggtgcgagaaatcgtgtcgcctagtgtcactgttaaaccgttttttactgaagaaatgatgctgttgcgcctggctgtgtcggggcggcaggccggagatactgttgaaatggaagaattggcggcgcaagacgaagtcttcgtaaattggaatagagagtttcaattcagacatgaccagtggtgggaccctctttgcccgtcccgtgttcatctggactcagcgggactcatcactacttttttgaaggacgctagacaatggtcgatagttcccgcttcgattggcgcacatatgatgcggatgggagattctgttcttcagaaactatcggtatcggtgcctccaagaatatgctataaggtaactcataagtttccaaaccaagctttacacgagccccttcgtattcttgataactatctgcaagatatatttggtatacaatgatctgacctgtcgagatattagttgcaattgattataggcctgcaaactgatgtatgaaaaaaatagagtatgcggtgtaatagcgtttgaacagcccctccagtgtcagaatctcaggcgatacgctcgctctctcatcctgcgccacccgagacgtttccaaaaccgatggactcagacggtcgagaaaccgctggggaatgtccaaactattcttccgctgcccgcgtttacgcggtttgccccccgtgtttgtattcataatcctatacctccgtcagatgtttatccaacggtcacgaacacaaaaaaacgcaccacaccgctatccaacggtaaagtgcgttttagtcatacttgctacaaatccttatgcagcaagtaaattattaaactgacggagaggatgggattcgaacccatgtgagcttgcactctaacggttttcaagaccgccccgttatgaccgcttcggtacctctccaggtggtaaatggataaagctgcttccctttcaaacatactcaggcgcaacaaaattattttaccacagaacttctaagaatgcaacacttactgtttaggagcaataacctcaatgcctcgcatgtatgaacgcaacacttctggaatcacgatgcttccgtcctcttgctgatagttctccaaaatagcagccacagtccgccctacagccaatcctgaaccgttcagcgtatgtacaaattcaggctttgccttcgaatctggacgaaaccggatgttcgcacgacgcgcttggaagtcttccgtatttgaacaggaagaaatctcacggtacatgccactctcaggcaaccatacttccagatcgtacgttttggcagacgtaaaacccatatctccagtgcaaagtgccagcacgcgatatggaagtccgagcagctgtaaaacacgctcagcgttattcgtcattttctccaattcctcataagaggtatccgggtgaaccagcttaagcatctctaccttattgaactgatgctgacggatcaggccacgtgtatcacgtcctgctgatcctgcctccgagcgaaagcaagagctgtatgccacataatatttcggaagctgctccgcattcataatctcttcacggtggtagttcgttaccggaacttcagccgtaggaatgagataatactcagtatcacgcagcttgaacaaatcttcttcaaacttcggaagttgacccgttccgtacaagctgtcccgatttacaatgtatggaggaagcatttcttcataaccatgctcactgctgtgcagatccatcataaagttaatcagcgcacgctctaatcttgctcccagtcctttgtagaacgtaaaacgagaacccgttaccttggctgctgcctcaaaatcaaggatatctagatcctgagccaattcccaatgcgctttgggtgtaaaagaaaactcgcgcggttccgaccagcgacggatttctacattatcctcttccgatgcacctacaggtactgtatcattagggatattcggaatagacatcaccaattcatcgatctgaacttccagttcgcgtacttgctcatctaattctttgatacgatcggagacttgacgcatttctgcaataagatcatccgcattttccttgttcttcttcaacttggctacttcaccggataccacgttccgacgatttttgagcccttcactttcttgaagtaactcacgacggcttacatccagatctgtaaaaccattaatcagatccagagatttccccctgttctgcaaagctttctcaacccgaccaagctcattacgtaaaatctttatatctaacacaggtaatccctcctacactacaaacctgactttcactattcgcggaccatatccacaaaatattgatgtaaccggtaatcgtctgttaactccggatggaaggatgaagccagcaaatgaccctgacgggctgccacgatctcgccgttatactcagacagcacatctactcccgttccaacagactgtattaatggcgcgcgtataaatacagcacgtaccggttcctcaatccctttaatgttcaaatctgtttcaaagctttctctttggcgaccaaatgcattacgcgatactgtaatatccataagtcccaaatgtgcttcttcctgtccttgaatcgttttagccagtacaatcaatcccgcgcaagtgccaaatacaggcttgccttgattggaaaactgacgtatagcctctatgaaatcatacttgcgcattagcttaccaatagtggtgctttcaccaccgggaatgataagaccggacagctcattgagctgttcgatcttcttcaccgctatacattccgcacccgcacgctcaacgctacgtatatgttcagctacagcgccttgcagcgacaatacacctattttcatgccggtcccttctttcttaccaaccacgatcctgcatgcgctcatgcggtgccagtttggaaatttcaatgcctttcataggagttcccaaattcttggagacttctgcaatcagcttgtaatccgtataatgagtggtcgcttccacgattgcacgtgcaaacttctcagggctatccgacttgaaaataccagaacctacaaagacgccatcagcgcctaaatgcatcattaacgcggcatcggcaggtgttgctacaccacccgctgcaaaattgaccactggcagtttgccaagctcatgcacttccaacagcagttcatatgcaactccgaggtttttcgcttctgcatacagctcgtccttcgacaagttttgcaccttgcgaatttgaccattgataaaacgcatatgccgaacggcctcaacaatattcccagtccccggttcgcccttcgtacggatcatagatgcaccctcaccaatacgtcgcagcgcttctcccagatccttggctccacaaacaaatggaacggtgaactcacgcttatcaatatggaaaacttcatccgcaggtgtcagcacttcgctttcatcgagatagtcaacaccgagagattccagtacttttgcctctacatagtgaccgatacgagccttagccataacaggaatagaaacaaccttcataacttcttccacaatcgttgggtcagccatacgagcaaccccaccagctgcacggatatccgaaggcacccgttcaagagccattacagctgtagctcctgctgcctctgcaattttagcctgctcagcgttcatgacatccatgattacgccacctttttgcatctctgccatacctctttttacacgcgaagttcccgtttccatgtcgttgcctcctataagggttacgtttagattctaacttaatattttaccgcacgaatgccaaatacacaatcatttcaagctgcaaaataagtaatgaaaaacaaggtagatcgcttagcttcgcttttttagaagaggttcttaattccctggaacagatctccgaagaaatcaccgattgcccggaaaagcattcggaaccagccgccctcttctactgccgtcgtagtaaccagatccacggttttcgtctgccctttatccacaccgtctgtcttgtacgtgtacgtaattgttccgactttggccccttgcttcaaaggtgccaccagagagcttgctggtgtaatgttcgttgtaaaggttaccttaggattgctcgcacccttaggtacgataaagcttactgcatccttggtgacgatcggtacttctgtttccgtacctttggtcactggcacattctcaacacccttaaccaccgtctttggagcaataacctgcttcacttcaaaattatcaaaaccatagttcagcactttagctgtctctgtaaaacggtgtgcatctgaatcagctcccataactacactgatgagacgcattccgttgcgttcagcggttcctgtaaaacagtttccagcattagccgtgtggcctgttttcatcccgtctaaacctgggtaagcaaactttctaaagttagtaatatttttgtttgcttctagcatccagttatagttaataattggcgccttgtcagtaggacggaatttgtaagattgaattgtcgtaaatcgtgtgtaatctggatgatctttaatgatgtaaccagccagagtagctgcatctctcgctgtcatcacagtttcccggtctgtatccggctggaagcctttcggcatatcaccacggtccaaaccagtcgagttgataaaatacgtatttttcatgcccattttctgagctgtttcattcattagttttacaaagtcctgctcagttccagatacgcgttcagcaagggctactgttgcatcattagcagaacctaccgccattgcaatataaagctcttctaccgtatgttgatccccttgagccaaaaaaatacgtgatccaatactcttagaagcattctcgttaaccgtaaccttatccgtccacttgagtttaccttgcttaacctgctcagccacgatgtattctgtcatcattttagtcatactagctggtggaagtggctcatctggattcatagacagcaatacttgtccagtggaaggctcgatcaaaatggcggaacgtagtgccagactaggggggttaatagaacctgtccccgtaatattggttgcctgtgttgccgctccagctgcaaaagtagccacgctcggatcgaaattgcctaccacaggcaatgccgacatatacatcatattaagcaccatgactgcagtcacactctttttaatcatgctgcgttttttattttgctttaaaatgttcgctttcaaatgaatacaaactcctctcatacctcaacccgatccgctatgtataacgagacggtggttatagcctcaacttggccaatgtaattaatgtttaagtgttataaaatccagtttcacttcgtttgcttagttgtatcctgtcatgagcattttctgctcgaatcttcttcactggtaggaatcgtccaaaagacctacgtgtcctaattcgtcaataatttcgtcaaaaaggcggacacttgtctattctatcacaggggtatctctaaaaaaagacaggcagagcgaaatacgctctgcctgtcgtcaaatctactacagccgaactttatagagagtaatttggtgcttctttcgtaatttgcacatcatgcggatggctctcacgcagaccagcgcctgtaatacggataaagcttgtatcattacgaagctcctcaatattagctgtaccgcaataacccataccggaacgaagaccgcccaacagctgatgaacagtgtcggaaagtggtcctttataagcaacgcgtccttcaatgccttccggtaccaatttcttgtcgtcatcttggaaataacgatctttactaccttgcttcatcgcagccatagaacccataccacgatatactttaaagcggcgtccttgataaatttcagattcgcctgggctttcttccgtacctgcaaaaagacttcccagcattaccgcagaagcgcctgccgcaatggcctttgtaatttcaccggagtatttaataccaccatctgcaatgatcggaatattatattcacgtgctactgttgcacaatcataaattgctgttacttgtggaacaccaatccctgcgattacgcgtgttgtacagatggagcctggaccaataccgacttttacgacagatgctcctgcttcaatcaattcgcgcgttccgtcaccagtagctacattacctgctacaatcgtcagatcaggataagcttcacgcaacttgcgaaccgcttcaataatgttaatatgatggccgtgagcagagtccacaacaatcatatccacaccagcttttacaagtgcttcagtccgatcaaatgtatccttggaaatgccgacagccgcaccgaccagaagacgcccttgtgcatctttcgctgcgttcggaaattgaatagctttctcaatatctttaatggtaataagacctttgagataattttcatcatcgaccaaagggagcttttcaattttatgcttttgcaaaatgacttccgcttcctgtaaagtcgtacccacaggtgcagttaccagttcttccttcgtcatgacttcactgattttaaggttaaaatcgtgaataaagcgaagatcgcggttagtaataatacccactagtttgttttcttcatttacaacaggtacaccagaaatacggtatttacccataactgcttcagcatcagataccaaatgatccggagtcaatgagaatggattggtgataacaccactctccgaacgtttaacccgatccacctctactgcttgctgttcaatcgacatatttttatgaataataccgataccgccctcgcgagccatcgcaattgccaacactgcctcagtaacagtatccataccagcactcatcaaaggaatattcagcttcacgttatcactcaaacgagtcgccacgcttacttctttgggcagaaccaccgacttgcgaggtaccagcaaaacatcgtcaaaggtaaggccttccttaccgaatttatcttcccacaccaagatgatcctccttcaaattgtttagtctgtattggtcttgttgtctgtccgacatggacaaatcaaggctctctgaaaatatattattgcaatcttagcaaagcggtataggggtgtcaagccttcatcaatagccctaacctttagtatttccctgtacaaacaactgtactcctacgaaggacaacctttaaaaataagcgtttccaaaggtaatagctattcacaaaagcatatctcctctttgaatgcacagcatagaagcaattatatatgtggtttgtaccgtaatataccaaagaggaccatgatctcaatgagatcatggtcctctttacttgttgcttggcgacgtcctactctcccaggaccctgcggtccaagtaccatcggcgctggagggcttaacggtcgtgttcgggatgggtacgtgtggaacccctccgctatcgccaccaaacatgaatttacatcgtaaattcttccgcatggttattcggttcatcacttatcgtgtgaatgaatagccatgcgcttgtcgtatgtcacttgtacatactttcaaggttacaccctgaaaactggatccgaaactcatttgcgtttttttaggataagccctcg

SEQ ID NO: 2673 - DNA, 1278 bp, Unknown
  Kingdom: Bacteria, Phylum: Firmicutes, Class: Bacilli, Order: Bacillales, Family: Paenibacillaceae, Genus: Paenibacillus
cccttctagtagacaagagagaaaagacatctggtaagatggacttaatcttgttgaacggaggggatttttcatggctaaaaagggacaatcattccggcaatactccttagatgtgaagatggaggcagtccggttggtgaacgaagaacatatgagtattcgtgaagtgacgaaacaattggacattcgtaataaatcccaagtgcaaagctgggtgatgaaacatcgagcgggggagaacctccagccaacgaccacaaggcagggacgacccaaaacgaaattttccagtatggaagaagagatggcgtatctacgggcggagattgaatatttaaaaaagcagtatccaaatctacacaaggagtgacgaggaaagaagcaaggtttgaaattattgaggaaatgcgaacacgatattcgttgaaatggttacttgaattagcccatgtttctcgggcaggatattataaatggagaaagactcagcaaacaatccagcagcgtaagcaagaggaagagctcctagaatcgcatatgttgtcgatccaccggattcatccctattttggttatctgcgtatgaccgttgctttacgtagagaaggtatcttggtcaaccacaaaaaggtgtaccgcctaatgaagaaattggggatccgttccgtcattcgaaagaagcggcgctttttcggcaaacaggcatctgtggtaaatgccaaccgattagatcgacaatttcaggcagattctcctttatccaagctggttaccgatattacatacatacgagctggagagcggtttgtatatctctctgtcattcaagatctgtttaacaatgaaattgtggcttggcgtctttcggaacgaaatgaccttgctttagttagcgagacgctagacgttctaagtaagaacgtgaacatggagggtgtcattctccattcagaccaggggtttcagtatacctccaagccgtttaaccgcaaactcaagcggcttggaatgcttgggagccattcaaggcgtggaaattgcctagacaatgcctgtatagaatccttcttctcccatcttaaaacagagaagatttatttaacgaaacccggaaccctagcggaggtagaacaacacgtacgggagtacatttcattttataatgaaaatagatttcagaaaaaattaaacaaccgttccccgattgaataccgagaaacggttgccgcttaaagatgtctttttagttctgtctacttgacaggggtatgacca

SEQ ID NO: 2674 - DNA, 4761 bp, Unknown
  Kingdom: Bacteria, Phylum: Firmicutes, Class: Bacilli, Order: Bacillales, Family: Paenibacillaceae, Genus: Paenibacillus
gtgcaacggaacagacccagcttcaccagcggtccttcggacagattcatgttattttgaatttcagttgctttcgtctcaatcgtcgcgctcagcatggatttatctgtcaaagctctaaagtccagcacgtccagatgatacagctcgccttcctgtattccgcggttccacgcttgatagccttgctcggtcttcctgaacaccatccgcagtgcatcgtggtgctccgtcagcttgataagcgcctgacgcaaagcagcttcgtcaaagccctgctcccggtgcagcataaccgcctgattaaaatgatgcgcatccacttgctcttgttcaaagaacccgtgctggatcggaagcaacgctgttttcccgctcacttctccctgatctgccgtatgacttgcctcgtgcatgtgcggtgccaatgctgcaacggttggataccgaagcagatccttcatgtccagcttgtagcctgcctggaacgcacgagatacgatttgaatcgccttgatcgaatcgccgcccagatcaaagaaattgtccaacattccgacgattggcacgcccaggactgactgccagacggctgcgagtgcccgttccgttgcagtgcgtggctctacataatccgctccgctttgcaggctgccttccggtgctggcaaggacttacgatcaattttaccgttcggtgtcagcggcatctgctccaattgaatgaaatacgacggcaccatatagcttggtagctcccgccccagctcacttctcagttcgctggctccgagttcttgactcgccacatagtacgccacgagttgtttttgacccgtttcgtccgtatgggccacgacgaccgcttctcgtaccgattccacctgcaatagctgcgattcaatctcgcccagttcgatccggtagccccggattttcacctggtggtccatccgtcccaaatattcaatgttgccgtccagcgtccatctcgccaaatcgcctgtacggtacatacgttcatacccgactttgcctccggcaaacggattatccacaaatttctcggccgtcagttcttcgcgattccaatatccacgggccagtccttcccctgcaatacataactcgcccggcacaccgactggctgcaattccccactcgcattcatgatatagatttgggtattcgcgatgggacgtccgatattaatgtcttgagcatgagtcagttcctgtacggtcgaccaaaccgtcgtttctgtaggtccgtacatgttataaatgcggggaccgtttatttcttgcagtgctgcgagcagcttggacggaagggcttcacccccgaccataatttcctttacgtctcgcagcgcgcggaaacctgattcatgatccatcagcatttgcagccgcgatggtgtcatttgcaacatatcaatatgatggtgagcaatcaactcaccaagcgcctgagggttcacctgatgctggcggtcgccaagcacaacagtcattccactcaacaggggcaggatggtttccaatacgaaaatatcgaatgaaatggtcgtcagtgacaaaatcgttttgttcgcttcaaagtcgatgatttcacgcatcccggtaataaagttgagtaccgagcgatgctggagcataactcctttcggatttccagtcgaaccagaggtatagatgacgtaagccagatgctctgggcgggcaaacgcctctaggttgccgctttctccctgatacaatgctgcatcctcaagaaacatggtattggcgatgtaatgatgttcttctgccagatcacgactggtcagaagcacttcggccttgctgtcttccagcatgtattcaatacgagatgacggaaattcgggatcgatcggcacatatgcaccacctgcttttaaaacggccagcagacctacgatcatttccaatgagcgctgcaccatcagaccaaccagtttgtcaggtcctactccttgtgcttgaagcattcgtgccaatgaattcgcccgttcattcagctcccgataggtcagacactgatttccaaacataaccgctgtttgacccggtgtacgttctgcctgttcctcgaatagctcatgaatccccacattgtgtggatagggcactgctgtcgcattaaatacatccataatttgtgcccgctcttcgtcactcatcagtgacaactcctgaatccgcttctgtggccctttcaccatatgctctaccacactcaggaattggcgaataattcgggcgatctcctgctcgctgaacaactcggtccgataatccagttgcaatacaagtttatcgtcatccagcatgtctatcatggcaatatcgaagtcactcaccgtatctccgcagaaatcggtatgcacctgctgaacggcttcatcaaaacgggagaagctcagtgtacggtattgaatggtaacgccaaacaggcggcgaatatccgtgccgctttgctgttcacgcaaatcctgcatgattttgttgtacggataacgctgatgccgcaaaatggacgcctgctccttgccaacaccttgcaggaaggtgagtagctcggattccggctcaacccgcagacgtgtagccacagtgctgacgaacatgcccattgtatttttttccttcttcaacgtacggttagcatacaatgtacccacggttaaatcctgttcccctgtcattttatgcaaataaatatacagagcagccaggaaaaatgtaaaaatactgatgttattcgcctcgcaaaaagccgtgacaccacgatataattcgtgctccagtgtatagttctcccggcgtgcagccgtactcaccgtaagcggattgtatgattttaaacctgtaacctccggcaaattggcaaatttctccgtccagtacgtcttgtccttttgatagcggtccgattgctcatagctttgctccacctgaataaaatcgagatatgaattcgctggagccaacgcatctgaacctgtaccatgcacaatattcatataatgccccgtaatttcattaatggcctgctccatggttacgccgtccgaaataatatggtgcattttgaaactaaaccaggtgtcttctgcccccaaccgcaaaataacaaaccgatacagctgcgaatccaacaaggggaacggctgtgcgttatgatggctgacccatagctcagcttcctccggggtaacctgaagcgtttctatgctttgagcagcaaacggctccacatattgataggggatgccgtcccgagccgtgattttgatacgaaaagaatcgttttgtgcaatcacctggttcattgcctgctgcaatgcatctattcgaactgttcccttgattttaacagtggtaataatcgtagacgtgttgcgattgggatacacaagctccgtgtaccaaatacgttgctgtggttggcttaatgcaaacaattgaacattgtgctgagtcatacgtatctctcctcgcgaaatagatgtgggtaaaaagtaactcctcataaatgaccgtccttgtcaaggaactggtcatgcgtaccttttcaccggcattaaattgccaatgacagtcggcaaaagcgaccactcctgatataccattgagatatgggtgtcttcgaaaagctgaatttgaatagaaacaagcacatctctctttttcatcactcacactttcgcagtgcaagcttttttagttgggcggacatagtgaaataactctgactctggatgtatgaatatgtgcatggagtgagaacatttttgaattatgctgagagtacatcttggtggtgggttgtagaatggttgccgcagtgttaacaacgtaatgtatcatgctgtgtgctgttagaatcttggctggagggtatcgatgctgcgagatacatgagctgctgcagcgtggttaggagcgtaattctaggatgaaaggacaaaaaaatactcacgactgcgtttataacttccctgattttgtacatggatgaaaaatgatggtcatcggacgagccaacgggattccaaggctgtttaggatatatttcgcataccttaaaataatagagttgacttttggaatacggaaaatgtgagacggatttaccagatatgatgctatggacaggaaatcttgcagttttgcctatacaactgccatgctgtttcaattacaatcagtgctcccatacagtgtctaaaaaagaaaacagcttatgtacttatgaagccatttcgggaagccgttgagggcatattgttctgcttgatatccatggagcttctgttgaacaactttcatgttctgtaagccattcaggtttaaagcccccatgtcgagcgaaacaaaataactggatcttctcagtcagatggatcacgtttttaaaaccaagtcatgaccgagttgacatataaatttctcatatcctcttactgtccaaaatctcacaataaatccttatatcccttttttcctcccaatactttctagctattttaaatatacaaactttaaaaccgattagcatgggacataagttccaaattgatggatttcatgaaatcaataaataacccatattattctattatttttatagattcaaattcaagaattttacttttttattaaattgaatactgaccatgacccgttaacgtgattcaaaacaaattttttgattttatcaattgataaaat

SEQ ID NO: 2675 - DNA, 27354 bp, Unknown
  Kingdom: Bacteria, Phylum: Firmicutes, Class: Bacilli, Order: Bacillales, Family: Paenibacillaceae, Genus: Paenibacillus
attttactcacctctttttttaattgatatgtatcttttccataaaacaattatagcattcatcttattttatatcaatatatttcattatttttgtttgttaaaataaaaaaacctccataataggaggctttgcactaactaatacgcaaatgctttttgtctgttactaattcaacaccgtcaacaacttcaccctgttttacggcagccaataaccccttggtatcaatcttgtccggttgcggaattctgtatgtattaggaatagctctttcattcacaatattaatggatggaggattcttttgtagtctaaccttaaatagacctgcgtctatcttgtcaatcttatttacttctaatacagcttgagtgtagctctttaatccttctactttgttctgaaggtatttgcgttttttagctaatcgatcctcttcttcttttaaggctttgatgtctccttcgatgtttttcatgaacttggcgatattctctgccttgttactcagctcatcttcaatagattctagcgtctcaatgtacagttgcaaatcatcttcagttaaatcgtcattgtcccaagctgaatctacaaaattgttaaatactctatattgttctccaagctcatataacttactcatcctttatcatccttttctatgtattatgagaaaatctatgttttatactagtaaatagttcacaaaacttttccttgatatatatttttattcatattatactttttcagtaagttttttcgggaagtaatgctggccagcttactatataaacccaatatcaaggaggatatactatgttaaaagtagctaaagttgctttatctgttttgctcctatctgcatcaatcccttctttaatggcaaatgcccaagaaaatgacacctccaacaactatgctcagtatattaaagaagcgattgaacaagaactcttgctggacaaaggcgcatctagtactgcaaaaggcatgtcaactttgagcaataaggagttcgataaaactctagataacatcacagaaagttctagcattagtcaaacaacaaagcaaaacatcgaaaaattggaaaatgctgaagttattcttctagactttgattcagatggagaattaattaacgcaacttcctccgataaaggcgatatccgatcaaatttcgaaacaaaagaaatcacaactacagaatctacatacggaactgaaccacatgaaagaatctctacacaatcttacttaggtaatcaaggaaacacagcaggcaaagaaacaggggcattccatcgccttcaaactcctgctagtaacgctaataaaatatataatggcgtagttgcagactctgttgttttgccaacttataatatcactgatgctttgaaatattcagaggcagcctatttatacactggtgttgatggagtcgctgaggttggatttgaaggcatagcttctcagtttactccagctgggtggtatccaatgttccatgcaaaatcaaatcatactgttgattcaggtaataacaatggcataccacaacctagtagtgggaaatattactatgatacaactaaaaagttctatggtggtgacaaaattaacggctataaagtatattattactcaacagactcaacgctcaccattagagagcaaataaattactcggatatttatgttgttagatttaatggattaggaagcacaggtagatcagttaagcggctaactgcaatagctatgggttctgccacttcaaccaccagcccattccactatggatacactacacctgctatttggaacaatatgaaatttctaactaacaatagttccagttcagtttacccaagtagtgtctccggattaagcaacgatgtatggactcatggaggaaaaatagattataccacgtcagggcagtcagaaagatatgtcttttcagtaaattgattgtactttgaattaaaaggagaaagacatcatgaaaagattctttatggtttctgtgtttcttattttttcacttgcattaagcgtacaagccagtgcaacaaaacatccttataattacacaattaatgtggaggtaaacaatgttcccgttaatttcggaactaattcagatgcgcctccgtatattgataatgctacaaatacagcttttgttcctcttcgttttgtttctgaaaatttaggtggcaaagtaacagattggaataaagctttgcaacaagtcaccatccaatcgaaagacggaactgtaattaaattagcggtcggtagcaaaactgcgtatgtcaatggtgaaaagaaaaccttgcttgttgcaccgcaaagtccggcaactcgcattcaagttccattgcgaattgtttctgaagtattgggagctaaagttgatgctaaaaaaattgatggaacattgaatgtgaacattacaacttccaagtaacattttttaatctagaccacctttttgataaggtggtctttctcatgttgtttttgttcgacttaggaagagttctccattattccagctttttgaaagataaagttcaaaagaatcaaattgttgtttaattttgactcaataaaagtcctcttttattcggttgaggccataatcggcctcatttttgaattgttaaagcaaattctaccgttaaattttccacatctattttttctaccaattggactgaataaccaataaactcgatatgattaccttcctctaatttaaaagaacttataacatttttgattgtttctttctgttcagttgatagatcatcgattatcaataaaatttttagggctttacgaaatgcatcaataagcattttttcaaattcatatacatgtcttctttctggcatgtcagggttaaagttatatagccaatcagaaaccttaccaagttcaaactgttcaacatattctataatcttttctgcccaatctttaatattttcgtctcgtattttgttgtcagttacaatactgaaagcggaagcaaatcttattagttgagggattatgtgaccatttaaatagttgaatctttgcacggaacgcttcttagattctccataacattcgtactctaaaatatttatttttaaaggactcgactgtgaattattgaaccttataattaatccatctggtattccgctaattccattaactttattatcattagcgtccttattagaagtcttaaatattctgttaaatggaattaaaattgtcttatcttctggatattcatctccaaacaacttatagaaattctttgtcactagaggctcaagtccctttattttatgcgtctcgctaataaaatttaccgttttgaatgtacccataatctctaatccgtcggttgaattctcttctttaatctttttagaaatatctttggcttcgttgacttttagctctaaccccacctcagcatcttcaaatttaaaaagagtctcttgttttcttttcataaaattatcatctaaaatacttaatgctgtttcatcatttattggttttggtagctgcataaattttaaagaccagttctcgattacggaaaggactcttaatggaaaaggttcacaaaattcaattttctcaattttgtaccagtataaatattcttcggctccagcccaaggagtaaaatctattacgtctactacgactcccctagcgccgcaataagattcttttgaatctgccttaactgaaaagtaaactaagttatttatttgagcgaatcttttcttaaaccctgccaccgaattttctatacattggtaatagttctcttttgaatctccacagctaagtatccttgcagtcatgaatgtcatcgtccttttcgtttgttgaatacttaattctacaaattaggacgatagaccttctttaattgactaaaactatatatgtatttaacttgctttcttatataaataaagtttttctgtatcttttttacggctatttttgtctaatgtggtagtcaacgttttttcaaaaataatctcaaaatcttgtggtgcattatattcactaactaatacaatattgtgcttggacatttttctaacccatctccaaaacctatcatagtcaaaatctttacatgttccatactgagttgtcccttgatatggaggatcacaataaataagacaatctttatagtcagagaaataagtataatctacacttagaaaattcacatcaataagcctatctttttgttttagtatatttctaattgcttcatcgtaataatctctatatgtacctattttagttcttactgttcctgcataaccaccaaaccatttggagttgtaagtagcacagaatccagcaattgaaacaatctctctattatacttctctttgttatctctaatatcttcgtattcttctttggtcaacttttcgggaggtttccaaccattttgtatagatttccacatttcaattaaatactcgttattgtctgatccaatcctttttttacaatcaatatgttcaatcatgtttgctccaccaacaaaaggctcaatgtatgtatcaatattgtttttgttaataagttcatttatctttggccctaaatcttttgccaatcttgctttacttcccatgtactttattataatctactcctttttttgatcagattgcgattttatattgactttataaatgaaaagcgtataatcattgccacaatataggaggcgattaaattgtttggagtctttgctgttgaaaaattctggaaccccaaaaacaaatactttcacgttcatgttgcatcaacaattaagcatctctcttggaaaagcgatctctctaaaattgaaagtaagtctgggattataatcttttactcttttgattgtgacaacaagctagttgttaattatgtaagcacctcatgcaatctaagtagaaggatgactgaattatcaaacgagcattcccattatttcaaaaagtgttatattgcctactcttatgaacagagcaggactcaaagatacataaagcgcaacctgcttcatgcattaagaatgcctaaagagaaagtttcctaaccgagtcatgctcggttttttctatgtaaaattcttatttgatgataatatttgtgctttttcaatttctatttccccagttctttctttaaaagaaacacaatcaaaacacttggaatgtccattacggtcggccttaccttctctgtctccaaaggcgaagttacaacaatgactccccttgcttccatccgcatattcataaattattaccttgtcacatatagggaatctttctttgtaagccttaatttgacgaggggaatacataccatattcttcatactcttcatcgctcaattcacctcttgcttcacgaatccaaatatctgttggtaaatcagcattcgaaccactattatgtattttttcctgtccttctattgcaaacgtatctacaattccacataaacaatcatcacaaattgtaaattcaacatcacatccatcaagtgagctgccatatcccattcttccaagattgactgtgtgccattgctcttgataagtaaatgcccaatcgtcttttacattccaagtttctgttttaccacatttatagcaccatcttgtctcttctggacaacaatttgcttcgtgggtagcacaatttccctcatctgtaaaaacctcttcacatttttcacattgaaactgttgatttattttcattaaaccacttcctatgtatttttagttgctattgccctcattctttcagcagcagcttgtttctgttctggtgtccagtttcgtccactactctttttgcggaatgaaacttgttcgtaatctactctatagtatttgttaccttcagaatcgactttataggcttcaaatcccgccttttccattctgttctgaagtttaccggatgaacaaaatatctcccatttatttgtttcgtcattgcagacgcatacagcttcgcgctcaaatgctgtcagactcatcgtttcactcttttcttaagtaatttcagaaggatattttgagattttactggctcagggattatgttacatgtactcaattcactgctcatttgaaattccatcttacttttctcttttctctcaagctcgatcttccatccttttaaaaaggcatcgcgcaactgaatttgcttctgtgcttccaatttactgtcttcatcattgatctcaatattcacatagtaatacattgttccatcagcaccatgtttcacctttgtaatcacatattctttatcgtctacctgaataaagctacctacttgtagtaattcatgaaaatcataagtttctttaataacaatatcctcaagtttcttagtcttagtacgcaaaattcccggcaagtcagttaatgcataatcatatttcaacacctcttcattcttgggcgataagtcgccataccagctaattaatggtcgttgaactcccatgtaaaactcattcttgtgtcttttagctataacaattgacttcatttgcaattccccttttagtgtaaaagtttcatttcatcatcttaccgaattctttaaagtctccatactgaaaatccatcttaatttcatctacaagcgcattgaaggtttctttgtcttcctcatgctcatagagaacaaagttataaacaatagtttcatccacagtatttaatgcttgatgataaaggtcggctaaatcctgagaacagtttccatcctccacttcaacatctaccaccacaatcaattttgttcttctcattaaatcatttccgttcctctcatgtgtctttatcttctggctctacccgtaaacgattatttaaatgaccacaaatcttacatcttttttcgtgagtgaaccaattaccttctttgacttcaatcaattcgtattcatgcttatgattacttttcttagttgacataacaccctccatttcaatacctaatcattatgaaatgctgattttacaaaaccttaacttcttgcatttcttctagaatataagttaaatctgaagctttttctttataaaaactaattttttgttttagaagttcatacttatattcgttttctttgcattcgttttctagctgtggaatgtacttatcataatagtccaagtgttttttaattgttatttctgcttgctcgacacccattgccattctccttttctatttaaaagatcgattttacttgcttacatatggtgcattctcaaaatattctttttcaatttcagtcagtttaatctgttgttgtgtaggtagcattgaaataacttctagtaacatttcatatttatgtataagtctaattctctcaatgcattcatgttcacgatatgcacaacttgaatcaccgtagagtcgctcataatatctatacttttctttagctaagtaatataaataatcgtacacttactcacccctaatcactaaagtcacctttatcgtcaattattcattcctcaattattttgttcatttgattatcgacaccatgagagctgcgaacgacagtgtaatagatatgtataaaagcaaataaatctcaacgacactttttaaatattcttttttccatagatactctttgaatttcttaaacgtaatcatttcctcctttctatgtaaaatatcaattttactttgacttcttatattctttaatccagcccaccaagccttttgatttaacagataattctcctccaacaataccagtccacactaaggcgattccaaacaaccatgagagaaaggctaatgcccaagcgaatcccccagttagagtaatcgttacatcggggaaaataactgaaaacataataaatggtatagcgagtaaataaattagccagtttcttttaagatgttgtctcactctccttcctccaacatagcaattgcatcttcccatcccgaccaattatctactccgtgcgcttctagacatcccaaaagttcactgtcatttaataagcgtgtgtattctgatttagaaattgttactgtttctgtgttcttcattatttaatctccttaattgcagtcacttcaacttcttcgtcttcgctttttacaccaataatcaatccgtccgttgtcttttcccattcatttgaatcaaatccaccagcttgaatcctaacttttccatacccctcaataaaagagttggttctgttcacatttcttgctctttgaatagatatattttctgcatgttctcttaaagttttaaagtcataaaagtcttgagcaaaattgtctatccattcttgattgacaatctcttcgtcaatttcaataacatatgtattaactgtagttacttcgacttcatatttcttcatcattttctccttttaaaatctttattttatcgtcctatatttccttagaataaataaaacgcttagtatcccccgtccttctccaatagccactcttttagttccacttgggcctttgcgaaagctaattcaatatcattgctttgaacatggattatggtctgcccatgccacgggtggccgattctgtatcccacagaaatacaccaaaataaaacgtctgaatgatatacttctagtacccaacttttatgatacttttttattgaatcataaaagtttatgaactcttccatgatttcctcctcgttccccgatcaaattcaatattcattggtatttgtcgatcaatgtattgatgtctttaagtaccacattaacttcattgattgacccccaaattgaaccaccacttgatttaatctcaattttaaattgctgcggatcagttactggctcaactggtgaaccatgataaaacaatgttcctttaggaaaagtcttttgataataagaatcggtatattcctttgttagttcagtcagtcctttacagcctttcacacgcttttcttctttcttactgtgtatgtgatatccaagagacttatatttatgaatttctactaatagtccttctctaattcgccagatgtctttaatttcatgagattgaatctgttccatttatcctccttataaaatacaggttttactaaatttctaataccaacatcaggtcaatatccacgtctatctttggatcataattacataaagtatcaaattctatatgattatcttttagatgttccaaagctttatcatacgatgcccacatatcgtcattatgtttgtcgataaaaagaatatccttaggcatagttaagccatatgctatccacttatacattatcctctacctcacctagtcgttcgataaattcctgtacctttaatccatactcagttctcgattctttggctgcttcaataacctgatcaatgtttgactctttagcttttacctgtttaaccatctcgtcaaccgtagtttcgtttatgtatttaatcgtcttagttctgctcatcaatatacttccatcttatcttcaacaatctgcttcaaatcataaaccttgtcacgcaactcctgaagctctccataatcgatgtcgtcaatttctagataaccatacaactctgacagtcgttcaaagttaagcggtagcattggtatacctcctttaatcgtttcgttcgattttgataatttgatctattacatttacagctttttcaagctcatagttaataacttgataatcaaatcgcttctttctaaatttagtaccatcttgatgaatacgcttaagtcgcttatctacatcgtctccacgtttaatcattcttttgtatctcgtctgcttgtccacttttaagtagatagttacgaattcaatatctagaacacgtttttttagatcctttatcccatcaggatcaataacgtacacatcagtttcaagcaattgttctttggtgctgaaatagtgattattgtcaaaatagctatgagcgacaattcgattttccctggcgagctgttcaaagttctccacagtggtaaaaatatgcccccattcactctcatgtcttggttgacgtgttgtataggactggaggatattatatcctcgtccttccaatgctttagcaacctccgttttaccagaacctgaataccccattagcaaaaatacttttttcatttgttatctccccgcttaatcactcgtacttttacatgtttctttctaccaaattgtcttgcttcattttctgttctgacatacacatcaatcttatgacctttaatggctccacctttgtcctgcactactcttctacctacaccatctatatagactactgtacctttaggcagtaccctccagtcggcagctattgtttcaccagccttagtcatcttacctgatgctgttctgccatagtctctactgtgtacacttctaccttgattgttagtgtacgctgttaactcaaatcgttcccatttatatgtatctttctcattcttaacttgtttgatcttatccagcttagcaacctttacttcttgcttaatggtcgtgtttttcatttctcgtacttgattgacactttgtgcttcagtgctgttgcatactgatagcgccaatagcagagagaggattagctcacccaacgtatcacgctcctgttttagtatgaagccccacttttatgtgaggctattactcatgaaaatctataaattaaaattcataaaatttaattgaaggtttaaatttatctttttttatcaagtattgatttatcctttctattcctcaaaaggtctactgtattcaaaaagttcgatacctctttactgttaagaatcaactcattgctatatgtatactcaataacataggagtctaattccttctgtagattactcattaatgtctgtccatatttcaatgattcttttaattcctcgctcattattcctctttgaataattaaagagaaatcgtacacgcaatctttttctccatcagtatttataaaattcatctttgtgattggtcgaatactcaagtcgctttttgcttcaaaattcttctgttttaagattccaatagccaaatctttgctcattcttatcatttaaaaactccttttaagtccatatgtcattgtaaaacagttgacttcgtacatatggacttttatttataataaaatctgtcttttacaacgaactatgtattaagctggtaactggaactcagtaattactttaagtgctttagcaagagcatccacatctgcaactgttggatatgctgctgttccaagaattgttttgaactctggaacaatgtattttactagttgatcgttagtgtatctttctttttgttggttaatcttatttatcaaatcttctgcatttagtttttctacttcttgtgttgcaaactccttagctcgttcgttacgctcttgttcttgttcgaccttcagctcttcaatgttcttctttgtttttttgagttgtcccttaacagcatcttcaaacaccttcatgaagttttccgcactatactctactggctcttcgggaagatctgtgtagcttcctccagcaatagagatatactcagttggtctaaagaccattaccgtacgagtttcatgaaagttgtgccctttttcttttcctgctttagtcttaacattttctgaaacttcactaccagctttatctgtaaccacaacttcattaaataggcagcaaatcaatcttgcttgagattcaaatatctttcttcctgtttgatgcatcataagttcgacagaattatatttcataccattgtacagagtagtttctttttccttagtccaagccattgccataattccatatttggctgctttgagagcgtcaattggctttttcatttcatcatagagtgcagtgtatccattctctgctccctttgaagcttcagttagttcctgcaatgaaacaagtcgagcgaccccatattttttagctctatcttttagcaaccaagctgttgctgcatcaatacaacgatctgccgtatcgaatccaatcaacttaacttttttgttttcttttgcttcttgtacgagaccgggaaccacatcttttttaaaaaactcccattgcttccaagcatcttcgtccgacccttcttcaaaaataggtagaacattttcttccaattcccaagtctcgaatcccggctcccacgcgataagtagcgtttcttctactggatttttgtagtgcatttcagttagttctttccaaagtcgcgtttttcctgttttatacgtaccagcaaccagacttgtgatagaatgcagctcaactttaggcgtattaccaacaactttatttctccaactcattaaatgaatctctccctgttatatgtatttgtgttcggtctgcgctttgacacacagaccattttctaattaattgaaactatctactctcacgcaaaaggatcgtcgttatttgttgcaaatgggtcatcggatggattggctgtttgattaaacggatcatcacttgcaacactgccaccaaatggactttcatttgtcaaaacagcagacttcttgaactcttcttctgtaagcagttcacgcataaggcttccctgtacataactggttacttcaagtccttttttgtctccatttgtcacacgttcttttcttgttactttttgagtactatctacactgctaaaaggatcgtctgaagctagttcttccactacatctacgtaggcaaatgttgcccggttattatcttgacctgttgcttcgatgaaatcatatgtattcaaacttgcaaatgcatctgccattgaaatatttcctgctgctgcctctgtttgataacaaatcaattcaacatcttttggttcagaacgctcttttccgtagtcaagaaacagtgcgtttatttttgtatctccgctttcttcttgataagtgcttcggatgccaagttgcattgtaaagtaatttacttctctgaaattttcatcattaaagtctgtgatgtaatcgaattcttctccagaatgtttaacagtttgagttgtaccatcatcattaacaatcagaccatctttaattgggcgaacagaattgatgatgcgttttaggtaaaccttttcctcgccattgtctggagtaaaaacatcgaattgatattgccctcttacttcataccactcgtctaccttaaccaactcaccgagccgctctgttttatcccaatctacttcaatcggatgatatgtattatctggaaaagcttctttgttatttctgtcatcccaagctactttgtgaggttttttatgtgtactactataaggataagcccattgctgttccatacctgacaattccactcgaaggcgattgctcaacgctgtttcaatttcaaattgcagcactctacgctgtttattcgttttagtagttgtttgttgataaataggctgtttaatccaactgtctgtttcttgatcctttttactaatctcgcttactttcccgataaaccgaaatgcgcttttaaattctttgccaccgtgtttcttgttaactttagtcttatagtctgccatatgtatttatatctccttttttatgtttgatattttatttgattaatctaagtctgatcaatcataaaaaggagggcttctcagtttgtttttgattcatatcaccaccttgcaaagtgaaatgtgttgcatctatataatcgcccttggcgttattgttgtatgtacttctttaatagttattgttagcttcttcatttaaaactaagtaaacccgctgtcgtaagacctgttcatgttctaacatctcctttctgttaaacttcatctatataatcacacattgctgtgtgttattttttggtgaatcttgtgaggcaaacgttttaacttgattgagttaaagtcttttattcattgccttttggcaactgactttcttgataaaagtattcttttagtaatattgatttgttgctgctatataaatatagcactcctttttcacttagtcaagtatttatttatttttatattttgaaatctgtatgtagatttgccgagtctatgtcggcattttacttctaggctaggtaagctaatcttatcattgctgagtattttccgtttttagtgtaggcatcataaatcttttcgggatcattagttttaaatttaactaatatacattcttccgctttttgttggcacaatttctctaaagctctaactttgtcctctaagtactcaataacaaaatcttctttatttttatatccgtattggtcaattaatgcccttcttttcttcccaagaaactcaagctccaagcctttttgtttacaacagtaaaagaacatttcgtttctatcatcattagaattcaaaaggaaggtcattaaattgataactatgtctgctttgtcaggaatctgtaatgcttcaactagctcttcatgctgcataacttttctcctctgtaatattttttctatacattaattatatgatatttccagagttaggcaactgaatttcatatcatacgaatagttcttgacatcatccttaatatggaacgaactacaatatttatgtcgcaatatgtcgaaaccacgaaaaacaggaacgtttgttctgattaattacattataccaataccaaaaggcaaaaagcaagaagttaaggctaattctatgtattattgatgttttgttttaccttttgaagtaatccagtattttttttaaatgaactgctgttacatcaacaaaagaagtcttaagcttattcacataaatcttatagcttttttcatcaatgtgttcaatttttccaatctgaaccatgcttcctctacttgctttttcaaatcccggcagttcttgaaataatctcattgtttgatcaactctaatctcatctacatattcaccgtcatcggtcaaatatacgagtatagagcgaccgttttttgtttctggtttgaaagctctgatttctcccacctgaagcattatcgcctgatcatgtattttcttaccttctctttttactaccttgattgtatctgttaacttcattggaattcacctcgattcgtttactcgccttgcaagcttttattctgtacaaggcgataaacatttgtttcacttaattattttaattcatcgggcactggttcactgcataccagcgtccagctagccagatttacttctgctacagtcagcatcgtaaaaacgaagccgacgaacataatcaatttgcttttcattcttccttttcacctcccttcaggcgaaaaagaagaatagcttgaaccaatatagctagattacctattggattatttattaaataaaatactgatactatcagcaaagagataattttaaaccaaacataattttcttttttaaccttcgtctgcttttctatattactcggtgcataaattagtactaatatcaaacttactataaacattataaaagtaaaatctgcaaaatagtagccaagtttagagatgaggataatcatcgctgtagaaaaaataatacacttttctggagtttgaaaatgaaatcctccagaaaataccctcaatagtgaaaaaccaagtattgctattaagctatcttttaaattaccaaagattaaagaaaatataactattaaaaaaatcggtattaaatttgtaattataaactttaaagcatatctaatgactgcatacgatggtagttcatttgggtatttatttttcaaactgcgactcactttgtcaacaaaataatcaattatcttcatctctcatttcctttcttaattctatcattatcataactgagaatattaccaaccaaaaaaggcagcttacatatatattattaaaaattgacttactcataaatgttactcccaatattgatgcaataaacaaaataatattagaaaagttcaacttaaattttaaagaatattgataaggtagtgtagtaaaccagatagatttttttctgagatatagactagtaaggattacaatactgtcccccacaatctgtactatgtatccatatgtaagcaatgttgaatctaatgattttgatgttgttaccataaagatgactgcaataattgtttgagcaataaatgaaaacaaaaagctaattccagatatccgtagagatgaaagtagggatatcttaaacaaaacaataagaaaggcgatcatcaaacctatatttacaatcggcgcatagttcgctgcaaagccataatctttgtaaagagatgtagcaacggatatacataagcttgccactataaactgtatccagtactctcttagcttaacctgatacataccaaaaccaaatgtaaaaatcgctaccccatctaacattgacaataatatgtatttaattgtttccatttcgctgtgtctctccctaaatacaaatataattaatttatataaaaaatatatcatgaggattcaacaaagtcaacaactaaacacaaaaaaagtagaataagaaaaacttattctacttcaagcacttctggatatattcttattattgtttctacatttagaaagtcttttgtgtacattgttgtataaaatatttccccatctttactgcccacattaaactttttgcttatttcgtgtatatcacttctctccaacttgccttttttatcatatatgtctttcgccatttttaacattcctgaatttcttatgtctacaggagatagtttttccatattcaacttggcagcgaactttgtgatagtttgcgatataagtgtctgtttaactttttcatctttagtgctctttataatataagagctgtctttaagtgagctgatttttttgttactgagacttccttctccaaaattcgaactgtaggctgtctcttcatcggctcttagcattgcttccaagagaaagtcgctaacaactatttcacgttcttccacttctccgtatcgtccaacgttagtcagttttacagcgttagttatttgatctatatcctgcttttttagatttctaatttcggaacattctcgtcctagaatcccctcaaatatactctgaattataactacatctctactactatcaatttgaccgagagctaactcaagatcatcatctctcaaaagaatctgctttggaataaacttttcataaaattcctttccattaacaacatcaagtggattcagattgtcaactctaagatcttgagatatagcccactctatatatttcttaagaatagagccatatatagtagctgagcttaatttatttggggccagcaaatataaaacctcttcaatttcggacaaattaaaattgtacaaatctttgttgtatttcatctcaactttgcttgcacgttttaatttgctttcataattatctcttgttgtttttctgtatccatctaaaaatcttttttttatgtctgggttatatagattgtctccatatatacgattcatcagtaagacacctcttgttattttatagtgcgctcaaaatatttaataagttctccctgtaattttttactgtcatatattttctttgattctagaatttcaatcaattcattatcctcaaaatcaatcgcatcgattacgctcttcaagcttttcaaatctctattttcatcgtaaaaacgcttagcaataaccgtatagccaaggaacatgaatggattgttgatgtaagtgtttttattggggctttcaataaattcgtcgtaataaaaaccaattaaataaccaaaaaatttaattagatattctgaaacatctctatattcaacataattaacaggattaaatgttttttcaattccgaacgataaaatactaaaagtagtaagttgcccaacttctttattagcttttctgctagatgcaattcttattcctcttaattcactatttggattattttgcagttcttttaccacgttatctgatttcttttccgcttgcagctcttttcttctttccttgctcaatgggtttatggtgtttatttgaccaaaatattgctctgctgtggtgttgtcatatactcgtattgaaagaggagatacaaaattaatgtcttcttttatattcaatgctttaatttgaccctgaaaacgatggtacccatctagaatagagattatacttttctcatttattgtaagagtataattttctttgtcatatgccacaggctgttgctcgtatgcgaatacattaaaagtaattgtgtctgcaagataactttgatttaaaattttctgggcaattttcttcacacttgtttggttaactatgggcgattccacaacaccatcacgcgtattacctctgtatttcatgccacgctgggaacgtggatcataattaattaattgagaattgaacatctgtaccaacatctgtatagtaatttttgtagaataagatctctcatctacttgtatcacatcttcaaatgttataggcaatttcaaataatttttctgatagatcaatttaatgttttcttttgcttcgtttatctcattgtgactgtagtagtccataacatcaattactgtattgccaagtacactttgtaatacttcagtaattacacaaataagtgaaaaatcagcatcttgtagtagttttgtgttgattattattttattatattctccgtatggaacacctaatgcactcaaccgatcattaattttcagagtacttttcttatcatttttatttgattcaataatttcagcaagatactgctctaattcgcttctctcttttttcaatatcgtcaccctttataacgatttattgtattctctattgatatattttcattataacataaaaaaataataaatatacatgactatagtcgcctgaattcgttcagtttttgatgagtgttgccaaataaaactaaatcgattgccattttccttatatcgtttactgagcaagtttgaattttctttataatttcttccctaatttgtttgtagcagctatcacaaaataactcattattaactggcgtgaattgcgtatagcacctctcattgttgcaaactttatcgtgtgtttttgcgcctttagcattgtattctgcctttgccatagcgccttcccaagtcatattgttatttgttaatgtagacaaagagggcttaagtttaagatcgttatattgttttcgtgttggtatatatcccaacttttttattgtgtgtctcaaatcatttattatggcatcgatgttcaaatatctattttttaagtttacctgagctatttccgcaagattttctattccaaaatgttcagatatataatcccaactaggactatagccctccttttcgtatccttgtttatcaatatatccttgcgttacatttaataacttcatattgctgatcgcttttattctattttctttcagttgaaactcctctttacttagtatctttgcattcttcaaaaattccttgaaccctactttatgttttctattgtaagtatcccatgttacagttttatccttgtctctgtatttatcaaatagttctgttgtcaaatacccaccagctttttctgctgcaaggcgggcttgaataacgatatcattttccacaaagatcacctctcaacaaaatacctgttggtcatataccaagccttacccttctctgtttccaccataccttttttattatccaagaatacaatatcaccacaatctttgcagccccatttgcttctcttgtatgctgactcatctatataggaagctccacatttacattctacctgaattaatgttttatactggctatatgcatttgttaactgttcgctagccttacttgcggctgtaggttgaatagctgctacatattccctttgctcagaaaattcattatgtactttgaaatctgctacaagctcaggattcaatccaaagtattctttacccactgttgttacatatttacttcctacacgataacattctatccagtcctgtatttgttttgtgaacagattgacagttcctttaataccgctatttagtgtgtatgtcatagtgtaatactgagtattaatcgctaacacctcctatgataaatatactacaagcgataactattatcaaaacaataaattaaaaaacacaaaaaagcgaacgacttttcatgtccgcttttcattataaagacagctcattttatttaattaaaattatgtgttacgacgttttctttcttggtacttactacaaggaaatcagatacagtcttcagcgctcttatcttccttgtgccacattaagttgccaaaatcaatattaacatatttatgcggatttgctactaactcttttctaacaatgggtagacaaagatcgcataattttctgtcttcaagagttgttttaaaattccccctacaatacatacatatcatcaaaagacctccttgttttttaaatcctcaacagtcttctttatactatttaaattaacttctttaatacttttgtagtaattaatatgtagatcaacagatgttaaagctttactgaagtgttcagctccatagtctttatgaatattgactagaaaatatctcgtagcatctgtcttcatcgttcttttgtacacttttccctccatcattaagcggaagtcagaaacatatgcaagcgctgatcctctatgcataccagatagggatacaatttcgttgagcgcatgattaagttcaatctgatcgtggaatactttcttagcgtaatcataagatgtttttatcattaaatctgatattacttgacccattgtatcactcctttggatgagcctgtaaccatttgtctaaatcaagatttgttttaaccactctatttcttctagagtcccaaatacgaaaaccatttgccaagaagttattaagtgtgtgttcactttcagcatttgtgtttgtaaacttccatgtttcaagcttatgttgtctgtcatactcagttagtttcattagacaatatctttttttattcatagatgtaatctccatgttgtgaattttaactgtctattgtgacattaatctgatagaataaaatgaaaattactccctctacaaaagtagggagattttgttatgtcttctatgtggaacgaaaatcgttccacctgttcttaatttattataaaaggggattatttacatgtcaacttcttttttggtgaaatatgtggtggtttgaaattacactctctcacgtacttgatagaaagggtattagtagaagggagttggctcgaagaactggaattagacctggaacaataaatcaattatgtagtaacactgcaaaacagctatctttcgataacttagctgccatctgtgaagttttgaatttagatattgatgacataatcgttctacataaagaagagaaacgggattaatctcccgtttcttatctcattgccaatgagactgttaatgcatctacgatttcgtgactatatttatcaggtaattcagtgattttaaaatctaactgatccttagatattgtcataatttgttctagtaagataatactatcactatacagccccgtgtcagccccacatacttttacatgagtaggcatatctttttttacacgtgatgttacaggagctactataactactggagaatacttattgcccatattgttacctatcaccacacaaggtctttcaccactttgcacacttcctttattgcttcccagttgtacattccacatatctaatcttttaatttcttttgtcattctttccattgctaccgccattatgtaatcactcctcgttaaatattcctaattatttttaacttctcattatttttgattttgctacttgttaattctatatgtaaatttctaatattcttattcttgctctttctactagtaattatactaacaaaaataattaaaaacaagatggaacgtttgttctgtcaagtttttttcgtatcatgcgaatattttcatagttgggcgcataatcctattgacaactggatatacataaaattaaggaataatttcagggaggaatattgatgcgacaagacgcttggactcagtctgatgatgatctgctagctaaaacagtgattaactatataagtagcaacaaaactcaattaaccgcatttcagaaagttgggaaagagctaaatcgtacagcggcagcttgtggttttcgttggaacagtgctttaagacataagtattacaatgaaataaaagcagcgaaagaagaaagaatgaacaataagataagctcaaaaagcagtattactgctacacctcaaaagactgaaataaatttcatgaacgaaatagacattgctattcaatctttaaataatttacgagtcgaatatcttaatatgcaagaaaccatacgcacacagaagaataaaataactgaattaactatagaaattcaagaaagcaataaagaagatcgacgacctattgccagtgatgatttagacactttattaaaaatattgcatagagcggatcaaatacaaaaaaacatgcctcaacacaaagaacctgccatgtaagttggcaggtttcttaataaaaattatattttatctataaaaaagaaaatagcctatctcttggcggggactaggctacttctacggataatcttataaaacggaagctgtacgttttgccattacggcttcgttctttgttgatttaattatacttttcgttaaacacgaaatcaactcatattttgattttgttgatccaacaactttttgatcaattcgcttgcctttagaccttctccaataccaattaaatatacagcctccctaagcgcttctcttgccttctcatccattattccgtttcccttacttgtatgtattttatccgttacattcatggaggatatgcttaacatgttccagcacatcctcaagcttcttaccgcacttctcacaatacatttaacaattcacctatctcttagttaaatctatatttaacactgccattcatcaaaaatctaaattaaacttctatacgcttttgtctttttctatgcgctctttatttttctccttcttttcttcatcccaaggcttatactctaaaatattttcagacaaatataatctcactactaattttccacttaccattctttctactgcatatttgtccttaacatcacaatatccctttatccatccaatactagcacctcttagccatatgcgttggttatagctccatttattttgtttagattttaagttatctattaatctatttgataccaacctacttttctcccttccgtttagaatataaatatcaagagatgatcaaacatgccttttaccatatctaaatcccgtacttttctactaagtatctctgctcagctaattcttcctccattaaactccgatgcatctcagcaatttcatcagtgtaatcatctatggtaatttcatatcttgcatcatcaaacaaatccctaagatcttcattgtattcaacaaaaaactcataagccaattcataacctattcgtaattttaagagaagctcttcaacctcttcgctagagagacttatttcaaaatgcataaattgatttcttattttgtttaagtactgaactactgcttcgaaatcttccgatatctcatagccacataaatacttggctcgtctaattccctcatttaatgtaacagttttaagaagttggtttgcctcaaagacattagttaaaccttttgctatcattgtctttcttgccgtcatatatttatcaatgtctgcaaatataagatattcatcataacttttcaaaaacagcttaaataatatttcgattccatgatttaaagacattacagcatcttttaaattatgtactatgccgtcttctagcacttttatttttttcattgttaaaaaagcagctttaaaagaatctactccattttcagctaaccccatgtttagcatttaaatcactcccagtcagtctataaagaatgtttttcatcaatttcctgaatacttgctcatcgttattgggtaatgatatatctcaatatcctcatcaataaatcctctccgttgagctgccaacaaagtctcatacatgttcttgcgtcccacagggttgtctgtatgtaaataaatcttatcagccctcaatccatgctcacagaagtacttcaccaagtcatatccgttaggcagctctttgccatcaacatcttcgcctagatcgtggtctaacgtaagaatgccgacacttctggtttcaaggatatgtattgcttcataggatgtacgagcgaccacaaagccatctgggcagtctctgaggtcgtctacgtagagattgatcttatcgatcacagctatgctcctctcgtaaaacacatcttttactttaactcaaaggtatccaatataaatttaacttcgtctgctgaaattgaaattatttttcttacaccttcagtcttttcttcttcgtttgccatgatcacaactattcctgtaagctgtttgcccccaacctctatattaggtcttttgtcatcacttaatacagtaggtactgagtgagcacttagacttgttcctttgattgacattccaattggatgatttcctattatttcagctaggctatctatgcgattatccatccatctaacatcaaatcccaagtcagggtctaagaccattattcttgttttctcataaacaagcctcttcttcttgaaccaaatcattatctacattccttccaattaaaacagtcatttgatcagtttatatttgtcccgatgattacagatagttcttattgtacttgaacaagcttcttttagaagcgattgagattcatcactaagatcagacctcccataatcccttttcttccttttatataagataagttatcttgtagctattttccttagtaactccttgtaattttccatcattggtttttcgcttgagtcacaataattttcaaagaattcacttttctcaaacctattaatcatatattcaattgaatataattgataaacgctctcgataatttcgccctcacatacaaactctattgaatcgaccccatatgtattcagatattcaattgcgtttttaacttcctcattatatttttcaacttgatacacttccgtaatattatcgaatgccactattaccgtatacatatttgtcctcctttcaggcttcattgacaatagattttcctttctcagttaggcgtaatacttcttcaaattcaattaattcaagagccttcaagccttcaatgatttcgatatcgtagatagtttgaagggattggtttttagttgcttctggttgatttaatttaattagcaaatcaatttgttcattaactagattcattgggcttattaacctccttttagatttaaatcaaatagttatttcatttccatgtacctaaaacattgttatagtatttatttgtttttgcatcaatcgacccaaacccactaagacataattttgtacttttactataatttaatatagatttgagttcatatactaaataatcacggtctcgtagcagaaccattccaggtttaagatcatgctcaagcaacctctgaataactcgtttagcgccattacactcaatgtttacatgtaatttcactccacaatcaggacagcaccaatcttcatccaatagtaaagttacatcttcataagaatttttacagataggacattcattcacttctccattaaaataagtaatttcaaaatatatctttgcactattaggttgtgaaccgatcattttctcactccttgttgtgtcaagataaaataaacctttactacagcataatgtattgattgccatcacccatgaaagccaccaacaatgacttccttttaatagtcctagcttgaaaggcgacaatgcgtgaaacatctacttccatttcctttttagttgcttcgtcgtatacgaatatcttctttttatcctgactcattctgtatcacctctatacaatattcttcaaactctacaatactatgttactagtttctttacaatgtttccctatcgataaataatcataacatatttctttatataattaaatgtattcattatttttgtttattgaaaagaccacattacggcaatctttgttatgtatgtttcacatttctatgctgttcatattgtttcgccgctacatgtaactcaatccacttgccctcataatttctaacacacagcttattgtcttttaatgctccagctttaaacataatgatactcactccccgttaaagaactatagatgttcacattagcagaaaaaccactccaatgatagaaacgatcaattaacacaaaactcattgcttctttggaacgtccaacggtttcgatttcttcttttacttttccatctacaactatcatgtatgtatccatctaatattctccttttattatatttttattagttagacagaggtactacttgttctgttgcttctgtaatatcttcagcatcatgccaacttttaaacttgacagctagatcaatgtcgtgcgtatatagttgaccgtgatgcgcttcccaatctgctctaaggtattttttagtttctatattgatcactgtatacattttcattcccccgttgttatatgaatttcgataatttttagtcgtgcattccagtgataaagccaaatgcgaatgctatcacagtagttattgctacatagacacttttatttcatgctatttctcctaaaagacttattttatcgcaatttattccagtataaaatcaccttcaaatatacaaattaattaatacaataaaactttaggaaggtgacaataaaatggttaaagtttaaacaagaaaaattaacaaaa

SEQ ID NO: 2676 - DNA, 1388 bp, Unknown
  Kingdom: Bacteria, Phylum: Firmicutes, Class: Bacilli, Order: Bacillales, Family: Paenibacillaceae, Genus: Paenibacillus
atttgaatgtttccattgcaggaaacgattctccatagaaaggaggtgatccagccgcaccttccgatacggctaccttgttacgacttcaccccaatcatctaccccaccttcggcggctggctcccttgcgggttaccccaccgacttcgggtgttgtaaactctcgtggtgtgacgggcggtgtgtacaagacccgggaacgtattcaccgcggcatgctgatccgcgattactagcaattccgacttcatgtaggcgagttgcagcctacaatccgaactgagaccggcttttctaggattggctccacctcgcgatttcgcttcccgttgtaccggccattgtagtacgtgtgtagcccaggtcataaggggcatgatgatttgacgtcatccccaccttcctccggtttgtcaccggcagtctgcttagagtgcccagcttgacctgctggcaactaagcataagggttgcgctcgttgcgggacttaacccaacatctcacgacacgagctgacgacaaccatgcaccacctgtctcctctgtcccgaaggaaaggtctatctctagaccggtcagagggatgtcaagacctggtaaggttcttcgcgttgcttcgaattaaaccacatactccactgcttgtgcgggtccccgtcaattcctttgagtttcagtcttgcgaccgtactccccaggcggaatgcttaatgtgttaacttcggcaccaagggtatcgaaacccctaacacctagcattcatcgtttacggcgtggactaccagggtatctaatcctgtttgctccccacgctttcgcgcctcagcgtcagttacagcccagagagtcgccttcgccactggtgttcctccacatctctacgcatttcaccgctacacgtggaattccactctcctcttctgcactcaagctccccagtttccagtgcgacccgaagttgagcctcgggattaaacaccagacttaaagagccgcctgcgcgcgctttacgcccaataattccggacaacgcttgccccctacgtattaccgcggctgctggcacgtagttagccggggctttcttctcaggtaccgtcactcttgtagcagttactctacaagacgttcttccctggcaacagagctttacgatccgaaaaccttcatcactcacgcggcgttgctccgtcaggctttcgcccattgcggaagattccctactgctgcctcccgtaggagtctgggccgtgtctcagtcccagtgtggccgatcaccctctcaggtcggctacgcatcgtcgccttggtaggcctttaccccaccaactagctaatgcgccgcaggcccatccacaagtgacagattgctccgtctttcctc

SEQ ID NO: 2677 - DNA, 13181 bp, Unknown
  Kingdom: Bacteria, Phylum: Firmicutes, Class: Bacilli, Order: Bacillales, Family: Paenibacillaceae, Genus: Paenibacillus
cacttcgagggagcttaatgtaaaacggagcagctgctgacagcaaactgctccgtttaaatttaaaataatgcgtcccaatcgtctaataattgccgcatataaaaaatgagttcatcgatgatagaataacttcacgtcttgaacaatggagatttatctgaaccaccaatcaaatcaactgtgaaaaatatggagatgaagtgtcctctgggggctactgtttttactgaacttgaagtgagacgaacaagtgagggggcgttccccactttattcttaactaggaatagtatacttgttctactttatataatgtatgctcgatagttggacaaagttcggcatctactttgtgaaatttaactcgaaagtacaaacttttcaagaagttctttatattatttttttgcttaaaggcatgaagaaattctggatttttctccacgtcaccaaaactttggatccatttctctacataggtctgactaagtatttttctatttaaaacactaattacggatttcaccattctttcatcttccccatcggagtaaactcgatctgatatggtcatcttttcataaaccaaatcgagtatggttaagaggtcttttttgtccagttcggaacattgggccagatcgtccaaagcatctgctgcatgagctatggcatgagcccatcctttttcttcatcatacccacggtaatctcgctccttatgtatattacaaaatactttctctttgatctgatgaatatgctcacttgagagaaatggtgactccctgtgcctcataaggagaagcggtataactagcatagagaaagatctagtgaagacagagtctgtatttatttcatcaagcctgaaaagcaaatggtttttatccaaaacaacgggtaggagttgttccaattcgtttacagttagagcattaccaggaatccaattggataaggttgtataaattagctcatcacgtaattgggcatctaaagaaccgatgttattcatcatctcttgtatcaattggaatgtatcggaaggtgcttggtagtcatttgcttttatcaatatcaacttttcttttagattcattttacacactcctactatattgctattcattttaatcatctctattttagtaacattccaagctagttcatgtataactgaacatcatacttttgagcacctttgtttactttgtacagacctaaaactcttccaaaaccttggatttgtcgccatgaaccttttccaggtgatcctctccccaatagcataaatggtctagcgcgggctttaatccccagccgtaggaagttagctcatactgcactttgggtgggatctctttataaacctttcgtgcaacaatctcattcttttccaggcctcttagttgagtggtcagcactttttgcgtaatgccggggattaaccggcgaagctcagacgtccgtttctgtcctgtcatcaaatgatagatgattaaaggcttccatttccccccattacttctaatgccgcctccactccaactttatacttcttttgaacgctattttccctcttttcagtcatctcttattcctccgttaaaaggctgtgtttttcctacataacattcattcacttcagtccattattcaggtaagtttctagggcatctatctagggcacttccatgttcctaagggacctgtatcatcctatagaacttgaaagtacgtacttccagattattttagtactgttataatagcatcagccattgatcatggctacaagttagctgttgagaaaggtagtgaagaatacaagtatgagagtattaagcgttgtttcgcacccgataaaaattccctgacctctaaggttgccgatcgtttcgtacaaggtcttgccgaggctggccacgattacgagatattggatttacatgggattggctttgaccctgttttaaagggagtagatgaacctgactggtcagctgcggaacagtcctttacccctgaaaaggttgaatttttatacgagactttagactccaatcccaagcactatgagatgctgcttaaccaagctcatcatttagggttgaattatgccaaggaacagtagccttaagttaagtctgaactctatggagtctgtccaaggaaatgcgataaaataataatacgaaattgcaccttatttgagcagagaatttcaaatttattttgagcttattttgtcagaacgcccggagcgcccgcaacgttttgggcgtccttcttccttttcattggcatttgttcgaacggaaatgtaggtattgcgctaatcctcatccggatgttcgagcagcctcagctttggcatatgcatctctggaatatacttcagggattcctgacgaatgatatccacatcaccggagtctaccaagctccgcgtcagggcaatagtctccgggttcattattgcaatcaagctggttacggcacgaccagacaaagaatgaaagttgcccgatcatgcaactggcggtacagctcatcatgagacatgccaaatggtaaaaaggaaatctctcccgtaaagcaagtaatacctctgtggatatgtccgcccaccatcatgcctgctcctgagaaacaaacttcaataaatgtcgcaaccgcaactgacttttcttcatcatatccctgcttctgatagaacccatacacggtcagattcatgttgttatccacaatgacttccatctcatgcttttcacggcggaatattagattgtctctcctgccaggatggcaaccgtataagttagagaatgactcttcacttcagccttgatgatgatgcaggcaacataagaaacactgcatcctgcaggacaacgggctccccattgacaaggtttactgtataaatcgatttctgtgctgcgacatttacaaggctgacatgatgatgtttgcaagttcatcgttgctcacattgacgttttgataagatgcgtagccgccaaatacatgaagtccaaagtggccttctgcaaaagtaccatccattacatctatgactttttgtctatccacataaactacaatatgcggtccattcgcttctattttcaccttataagtttgacatggctgaatgaaagtcggtactttcgcaagaacctgccgttcttcaaatcctccattaattttatagaacagacggatcgccttcatgttagggtctagattcagatagtaaccactgcgcccatcctcgctagccctgaacaaaatagaacctgctcctcctgtttcaccaagcatcatgtctgcttcatacgtaaaattcccagccttctctttagcgatataattcgcatcgctgaaataattaccacgaatcccattctcgctaactaaccatgaagcagcagacagatctttggtccatccactcaggtttgtccggaactcaccacctgtgactttaacgagcacactagcggatgctttaccattcggagtagatacggtgatcgtggactccccttcttttttcgcctcaataaccgcctgtgaattgtctaccacgtctatggctattacttctttattgctggactcccacttaagcggttgaacgccaaaacctggtctgtactcgaccattgcctgcagtgtgcccgacccccctatacccagttcccgaaccctcgtatccatctttatctgagcttttgaattaatgtcctcattccagacggattgaagttgatgcactttcaaggaaacaacgttcacattcccgcctttcacgtaaaaactcatcgctctactggctggattcggaaatataacatctgaaaagacgactttgccgccgttaccaaaggcttcaacggaagactcatccacaagaatacgcatcttgacccgattattctccatttgcatcggcgcttcatgttttttattgaaaaggctggaaaagtccgttactccagatgcagttcggtccacaaacattttactctcgcttgcggtataacccacaaccgtcttctgatttgcaccctcacgaaggttaaagccgaactcggtcactgtgctggcttcagggatttcaatttcagcttcaatttcgtaagcacctgaaataatgccttttagcaggttcccggaagaaggactcacccctttgttagaagcaaagtacaacggtttacgcaatgattccaattctttaattgggctttgtgccatccgaattccatcttcggtcgttaccaatgatacttctctcggaatggttagttcacctttccaattcgtcgttgggaaagcgaacggatagtcccaattcgtcatccacgccatcatcactctgcgatgatcaggcatgttagcaaaagacatcgaagcgtaaaattctttaccaaaatctgttcttagcaccttacccgccggattatcattcacgaatttaccattggctgttaaatgaccgataaaatactcggcatctgatccacctgtttttggattcgctcccgtactgatcatcataacccacttcttctgtgacgttccgtctaccggaagctggaacaaatcagggcattcccatacacctccgcggacgtaatccccgtatccccaattatctgtcaatgtccagtcaagtaaattcgttgacgtatagaaacgaatatgatctcctccggacacaaccataacccatcggttattctcgtcatcatagatcactttcggatcgcggaaatcccaacccccagggtcttctccgctcttacctgggttctcgatcacgatcggacggtccttcgaatattcccaagtgcgaccttggtccttgctgtatgccatacctatacgctggttcccattcgggccatccggattataggaagtataatatgcaataaggcccttgcctcctgaatccccgaataaaccggatgcattcgtcatatccgcaacagccgatccagaccagacatgtccgtgatcattccacggaagtgcaatcggaagccgcttccagttcagcaaatctttactgacagcatgcgcccatgtgcctccatcctgatggaagagatgatattctccttcgaagtagacaagtccattcggatcacttgctgaaccacgtattggcgtgtagtgatactgaggacgatatatttcgttataatattggctcgattccgtcacataagtatcctggaagtaagccgtcccctgtttgacgacgattccggtatttccattcgtgtaggttgaatctttcacgtcaatcgcggccgtagtgtatccgtccaggaagacctgaattcgatttccctttgccttgatctccacatgatgtttggctcccatctgactcggataagtacgcagtgaacttgcaattactgttcctttcgtattcgtcaaacttacacggacctgatctccttccttcgtaagagtagcttcatatccatcagctccatcggcggaggaacgaaatgcgagagccgcaacagaatcaggaagaagggtaatattcccttcatacacaatatcagcagcctgtttgttatagatttgctgtgccttgctctcatgtgctatcgtccctcttttgccgctgatatcaggctgccattttcccttacttgcaaccactgtacccaaattacccttcagatcgctcaccacgatgttcgaaaacaaggcggatccatcccatacatgaagtcctagctttccgcttcgatacgtaatgtcctgaacatcaatcaaaggtttatattgattgccccaatatacttttagcgaggaacccactgccttcactttgagatgatagatctgacccgcttcaacagaaactttacgctcctcctttaatttcccatctccattccttgcatctcttaaccgaatcagacctgtacctggaatgatttggagcatgtacgagctaaagccatcctcattagaacggaacaacaacgttgagactgccttcgtatccctgatcttgacatcagcttcatagataaaatcatcggacaccgtctcggagatggccgttacattttctttaggctgcgaagtcagcaagattccttctgaagtatactctaataaccctttccctttcacttgccagcctgtcaaattggtgtttgatttgatagcgttttcaaaaatagaaagctcctcctttgcctgtttacttgcttcctgatcagcgaacacagcccaacccgtagccggattagatgtaaaaacgcccattgaagtcagagctaaccccgttgccatcagaagacatattgcgaatttagatttatctttcattccttaccctcttttctaatggaattgaaagtagcggtcagcaactcgagcttaactggacgagtcctggcagcacaatataatcaacaatgtgatccagtatgacactagagctgacatagccgttcaggttatgtagcacagcctttcgaatcaacgggaacagctcttagctgacttaattcacttatgggtgtttggattaagcaaattccctccgaatacgtcctaagctagtatctctcgggggattgacatgtgaccacgccattcttctgaaggaagagtggaagcataacgccaattgttcatccagccgacccaaatctttcgtacgtcctcgttcggaatgccatcccaggtcacggccgcctgccggtggttctgaatcgtttggattcacaccatttctatccccgacacttagcataagaatccacttagtgatattgggatcttcatccacttggattttaaatgcctcagaacattcaaaaatatcctcgatggatacccggaatatcagagctgaaatcgcttgcaaaaaaccatgccttaagattggaatacgtataaaaattttacatggtctcttacggcaagaaccattacccacattgacgattcgtcataccaaaacaacttcggatcacgaaagtctagcattttcgttgggaacaaaacaggattaccttgcctgtgtatcataaggggtatgttggtagaacaggtggtactctccttcatggtaacccatgccgttgggatcattcatctaattttccttcggctaatagtgtaattgggactgtatttatttttataaaaaatattcactggttccttttctgctactcatctcaccagataaatgtatttctttaatgttactcaccctccttttaggttatttaggatcttaatagaagtgattcaactagcttggcaactaaattggaatgcgtgcaaataactgcttagtgtacctgaaaaatgcatctcttatgaaccaaaataatccaatagcgtgcatttgtcaatttttttttacttcattccaaatatttttggatgaatgagcttgttgattttacatttgcacaaaatatattaaatcactcgaaaatggcaacttttatttaattttatctaatcgtccttctttattttgtaaactaaatgtatctacaaatgttcacaagttcttgttctttccggcaaaggaaccaagctcttggtctggccgcggcagctgcaacacgtccgatcctcctgcagacggtccgatttcttccctatctggaaccctcccttaaaccaagcctaggttgcaaccaggaacgaaaaaaggacgctcattaatccatgaacgcccttgcttcagaactcacaactttatttgacaccttagtcaccctattttgataaatggtgactaagatgctcatgtttattttattattcacctctgatttttacaattttatgcttcttcattcaagactaaatatccactcatatatgaactgcaatcttttcatcgagttattcagcttgccatatatctttcaatttccaataggtcaattcatctactagagcctctccaccctccgttatgatttctatgcctagcaatttctcactcggatagatgcgacttgtcatcgtagcttgtccttcattcgcaaacatttcaatggatgagcgatccagatatacatgcaatgtcagctgccccccagcattgaaggctgtttgacgtactccatctgtcttcttacctgatttagaacaattaagcataagtttctgctccggaatagaatatgtgataaccgtttcttctcgacctgttccacgaaacttcaagcctaccatgtctgcacttgacttcgtgaggtcgaacactaccttaagttcaagcaggtcggcttcaacttccttgaagtaacttccagaaatggcgccatattgacacaaaatatgtttactttgacgaagcaacttcatttcttctactggattcatcagtactttattattgtcacccaacgtaactaaacgtgggatcgtcattgctccacaccagccgtctgctttcgtcggcatatccgattcccacatatccatccaaccaatcgcaatgcggcgaccttgatcatctagaaaagtttgaaccgcatagaagtcatgaccattatccaactcgatgaactctccatgcttatattcattactatcataattataatcgccaacataatatcccgtctggaacaagttattgtacttatctccctgcgcatcaataccttgtggggagaacataaatatatgcttaccattcagttcaaagaaatcagggcactcccacatgaagcccatattcttatctccctgcagaagcacaccatgataggtccaagttctaagatcaggagatgtatatagaataacacgcggcagatcttctttcgtgctgttacctaggatcatgtaccatgtatcctcatgcttccataccttcggatcacggaaatgctgggagctatctatcggaggttcagcgattacgggattctgccttagttttgtaaaatgaatgccatctgtgcttactgccacattttgattttggaaaaagatattgtttggttgatcaatatagtgatggccagtatagatcaatgtcagttcgccgttattatctactgcgcttcctgagaagcagccatcaagatcacacgcatctccaggtactaatgcaatcggacaatgctcccaatgtacaaggtctttactcttcacgtgaccccaatgcattggaccccagttctcatcataaggatgatgctgatagaaggcgtgatattcacctttaaattgaattaatccatttgggtcgttaatccagtttgctggtgccataatatgataacctaatcggtactgcttgttcattttcgcttctgcctgtttcaatgcttcctcagcttgcttcgtattgttattatatgtgttcatctgtcttcctcctatgctgtttcaataagcttgttaggcttgggattcagctttttcggttctttctttaaggtaaagattgagattgttgtaaaggcaaatacgaaaacacccataatcacgtacgtatttgcaaagcctctaatgtcataagacataccggcgattggcgagaagatcgaagctcctacctgactcgtaaactggtatcccaccagatataggatcgaagacagacgcgtatcgaaattagcagccaagtacttaaatacggagatcagcatgattggcagttccaatgcgtgaatcaatttcatagctgagataccataaggtccaataactaagcctgaacccatgatccggaacgccatcaagaaccctgccaatatcagccccttttttgctccaattttgttgacaatgaaaggcgctaagaacatcatgcctgcttccaagaatacttgtagggaatttaagtaaccgtaaacttgattgcctaaagcaaccgttgagaacgtcgatgaaaagtaattcgggaactgctggtcatacacattgtaaacacaggtaacaccaagaacatataaaatgaagaaccataaatgcttatttgcaaacaaatagccgatttgcttaaagttaacagattctgctcgctccatctcggaatctgtcatttcaactttaattgtcaccataatgataaacagaatgacagcagatacggatgcaatccagaagttaatgttagggttgatattgaagagctgaccagcgaaaaatgttgctgctgcccaacctagcgagccccacatacgagattttccgtattcaaagtcatattttcggctgactttctcgacataagattcgatggctccgattcctgccaaaaaagaaatacccaagtataatccacctacaatggcgccgagaaatacattgtattgaagtaacggcccatagatatagatatagaaaggaccaacaaataagagtaaagaactgattagaaataaaatatacttcttcaatccaattttatctgatatatagccataaagcggttgcatacatagcgcaaagatagcgtttacagtaaagataacacctgtttcagcaccattcagactaatttcttgccctagccagatggagaacaatgagtaacttgctgaccaagtaaagaagaaaaagaagaaataggcacttagtttccagtacaagctctttgactttctcatatcgaacgctcctctaagttaaacatttaatgtaaatgaaagcacttccgtatttacagatcgattatatgtcaaccgctttcatatgtcaaccgcttgacatatttctaaaaggaaaagagctctcctctttgatttcaattactctaataaggatagctccaccttatatcacaatgctgaaactatggaaattgtattaagctgtactagcttcaataagtttcactggtagataggtttctcgcgggacatcactgaatccaccttcaatttctttaataagtaactctatggaagatctcgcgatctcctgtattggttgctgaattgtcgttaattctgggagaagattgcgggttgtttctgttccgtcatatccaattacgcgaatatcttcaggaacacgttttcctctacttcttgctttagcaataaaagacgcagccaccaagtcattactcgcaaacaatccatctacttcaggatgttcatcgagcaagcgtttaatcggttcatcgtgattctgttggtggaagggatcatgtacttcataggtaattgcctttcgaccatactgctccatcacatcttcatatgcttttcttctcaagcttgcaggtgtttccaattcaacagggccatttatgtgtaagatatgcttgcaccccttttcaataagcagttctgacgccagttttccacccaaataattatccgatcctacaactgggattgaatcggatagaaagtgatcgatcgcaatgacggcaatattcttctgttcgtaatttacgatacctcggttgtgtgtaccaacgataataccgtcaacttgatttcgcataagcatatccacataagattcttctttatccagctgattcaaactgttacaaagcaacagcttatagcctaatgacgcagaaatattctctatatgaaaagtcagctctccgaaaaatgggttgcttgtagttggaatgattaatccaattagatttgttcgtttactaaataatgaccgagccacatcatttggtaaataattcagttcctgcatcgctttatgaacttgatccttcgtttcttgactgatatagccacgattattaagtacgcgagaaaccgtagtcggtgaaactccagctaattgtgcaacatcgttaagttttggtttcattgattcaacctgccttctctccatgccaagtctccaattattctattattttaacatggttaaacgtgaaaaaacatctgaccctacgagcccttttcattcaaatctgtaatatcatccatatacagtggtatttgttttgtaggttgctactgcctccttgaaccatggatattcgcggcttgaatgattgataacaaggtccatgacatcttactccatttcggtccgcttcttccatcaaggtgcgaaaatcatttagactcccacacagcgggtatacctgatagtaatcagttacatcatatttatggtaacttggagacggattaggggcataagccagaggcagttgacctccaaatccaccccgaatggggtttgccctcgtttaagtaatcaagtttttgtgtaattcctttcaaatcactgtgtccgtcttgtgaatatacttggttgaattattatcttgtggagtatggataaatgtatccatttaagtgtatacatcccgagatttttgccattttatatggactaatatatgaacgtaccataatggaatgaatctcatgtgtgatttcgtagaagaagatggggctgtgttaccgcttttgggcggcatgctttacatgtagaaactggtagtatacaacaaaaagcgaatatgattattgcatatagcgtctccatccatgacaatggtttgtccagtgagataaccaattttcggattggcaagttggagcacaagctccccaacctcggattttttacccaggcgacccagcggcgtattcccgataatccctttcatcacagcgtcatttaatgaatctgtcatttccgaagcgatcgggccaggcgcgatcacattcacactaatattgtattttgccagctcacgggctgaggatttggttaatccaatcaatccggccttggaagcaccataatgagggccgaagcttcctcccgttaaagccgctacagaggaaatattaataattctgccttcttcacaaaggatatgtgataattttttgcatgtaaatatgaatctggaattaaaagcccagctcaatattttaataggacaaatcaactcccgctatggaaatctagcacaagctctgcttcacttctttttagctcgcaccatatatcaacaaaagcaagcgcacaaaaaaataagcgaattgtatatccttatagctgaagcttattatcaccaaaaagattttgagaccgcatcgtattactacagacaaggccttcctgatcaataacaaaaaacctcagggctccttccagatggaggaactgaccccataacg

SEQ ID NO: 2678 - DNA, 1501 bp, Unknown
  Kingdom: Bacteria, Phylum: Firmicutes, Class: Bacilli, Order: Bacillales, Family: Paenibacillaceae, Genus: Paenibacillus
tcagattgtcgagaaaccccgtctttttaagacgcgggttctttttctttacataataatggtctggtatctgggagaaacggggtgttacccctgtttctccaggcgatccaggtggatcgccatcttcttcatgttctgcacggttgccgtcatgagggcttgttccctgacgttcggaagtccgcgcaaacggcaatagcgaaacccatggagctctttggcatccgcgaagcttcgctcaatcgtctcttttcgtttacggtacagctgtttcccggatgggctcagtcggttgctccgtacccactctttgctgtcttcccagacatgccgagtcaccactttgcggtggtttcgagactgggtacactggcccagcagtgggcaatactggcactgagctgggtcagaggcatactgccggtatcccttacggtccgtcgttcggtagggcagttcctgttgggctgggcaaatatacacattgcgcttggcatcgtattcaaacttccatttcgggaacaatccttgcttcggatggaatcttcggtgggcaatcacagcaaaaatcttacggctttgcaaaccacggcaaatcggcgttgtcaaataacccgaatccagggcgacggcttccacctgaaaaccaaaacgctctctttggcggtccaaacgcgacaaataagggacggaatcatgtacattccccggcgtcacgtgcacgtcggtaatcacattgtatttggtatccaccgtgcggtggtccaggtaaaaaaagccttcaggtttgccgtcacgaatcatatagccactatcgggatcggttttgctcactttaacctctttttcttcgttcacttcctctcgggattttagcgcttttttccatggtttctccggttttccgtcaccgctgcattgagctcgtccatgtagtccttggtattttgcagtacctgttctttggtgtactggtgtttgttcgcattcgcttttacgtgcgtcgaatcggtcaccagaacgcgtccgcccaccatccggtgtgagatcgcctgcaggacaatttcatcgaaaatatcctgaaagatcgtggcgtccttaaaacgggtccggcgattccagctgatggtcgtatggtccggaactttatcggttaaacccagccccaaaaaccagcgataagccaagttcgtctgaatttctcgctcgagttgccgttctgagcgaatgccatagaaataaccgagaaagatcattttaaacaacacggtaggatcgatggcaggacgaccgttgtccgcacaatacagcgggcttaccttctcatgaataaaggaaaagtctatatatttatccactttgcgaagcaaatgatcttgcggtaccagttcttccagggaaacgaattcaaaggattgttgtttgtctcgatgagatcgcagcatacgaacaccgtccgttctatacaatagttacctatattatacaacattaacgc

SEQ ID NO: 2679 - DNA, 1606 bp, Unknown
  Kingdom: Bacteria, Phylum: Firmicutes, Class: Bacilli, Order: Bacillales, Family: Paenibacillaceae, Genus: Paenibacillus
cacaaacgggggtcagtccccaataaacgcgggtcttctttatttagcaattgctggttgaattcatatgcagtttaaacatcagtttgattaaaacatcattttaattacgataattccaatcaatgctagaactaaaccgaatatctcttgacgacataggcaaaatagatactccgtaaagtaaagcttgtttcgaggaaaggtctgtgaagctatgaaacaagatggccagcacgctccattgctagcctcggtaatgtcctacttgcagatctcgcttgtatctaacgacgataagcgagaggataatgatgcagaatccgactagctgcactaaagtaaacgtctcattccaaagcagctagcaggacaacaagcacaggcgttagtcccgaaaaaaatgctataactgaagctcgaccaacagcataacctttgtataggatcgtattgtccataaaagagaaaatacccattaaaagccaagccaggcctcacaactccaagtttgatttgcgtacagattcattattaatgctagaattgtgctggatacatacaacccatagactgaagatcctttagtatgaattccaagtgttctctagctgattgattcaatggttgtaagggcaaaggaagactgggacttgagatcaagccacttatttctgctgctgctgaaacaacacgaaggctaccatattgataaaataacgtccaaataggttcaagtagcgccgaaagtcgtttcgcttcgtcagcaaaaccgtcctgggccaaacgggttatgtttaggcacgcctttggaaacaaaccaccgagaactgagtaccatgcttcacagcctgcattcaagccggtgactgcaaatgaatctccacttactcctatagttatatggggaggaatcgactctcgtagttttttgatgcgtatcttggctgcttcgggatcagtaggtactccgggaatcttaatagaaccaacatgaggtaactcagcaattcggccgtgcaattcgtcactgaaatgaaaatgggaggtacctggattatcatagacacaaagtggaatggagagtgaatgggttacctgttcatagagtgaaaatacttcttcattcgttagtgcttgataggagataggggctagcagcactgcacttgctcctgctctttgtgcatcttccgctaatcgaagtacttctaaggtacggatcgcacttatacttgtcatcacgggaatcccgtcggctgagtggacagcaagttgaagaacacgtaaacgttcttctctattaaggtatgcgtaatttccagttgaacccaatgcaccaattgagtctacaccagcagcaactaatcgttgaatcagtgctacaaatgctttttcgtcaatgcctgtctcattcaccggggtgagtggaaaagcagataatccatggaacataaagttacactcctttatgaattgaccttcaaaatacaaacacattataaaaatgaaatagacacaattaaagtaccaattaagagacaaataactgtaccaattcttctagagaaacttaaagttgaataagaaagataaaaagcattct

SEQ ID NO: 2680 - DNA, 20889 bp, Unknown
  Kingdom: Bacteria, Phylum: Firmicutes, Class: Bacilli, Order: Bacillales, Family: Paenibacillaceae, Genus: Paenibacillus
gggggggggggggggggggataaacagcaacggaatggacaagggagtagggtacgtgtactcacgctttatcagttctaggggcgggataactcgctaatacttgaatccgactctctcttggatctactttttaatagaagcaaccttagcacggtgcaaaaccgaactgaggttgcttcagttaacagttaactaagacatactgccgtttacttcagataggttcccgtttctccaattccacctctgccattcaatacatatacccttgcatttcctttgccggagcatgtcagggtaatcttgccatcagtaacggttttggaatcaccggtcactgcatccacataggttccgttcggaattccggtaaacgtggcgtttcctgaaatcgtgaccaatgcaaagctgtcaatgcctttggcactgtcggtatatcttcttttaaacgccagattgcccgatacattctctgtggaatactggcctttttgcaaggcgggtacagctcttctgattaaattaagctgtctgatatgtttcgccagaggatggttgagcgattccgcaagcgtgccagtagcatttgtgtatttgccgtaatcttgtaccgtaacattgccttccatgtgatcgccgaaatatgcccgtcctgttttgcttagcggtgcgtttggacctgtatcaatggttgcccctttttgaaactcgatttcggagccatagaagatagcgggtattccgcggaaggtgaacatcagatcgagattctcggcccaagtgtcctgtgtgcccgcaaatctttgattttccggagcctggtcgggcgcatagtcatgcgagtcgacataggttacattccaggtagcatcattatagtattgatcgccacctttcatactgaatgcttcctgtgcagtcttgaatgcccaatgcattggaaaatcaatcacatccatgcccgatttcatcgaatagtcaggcgtatgataagtatttccgtttaagaaagcattgttcgaggttggctgtcctgctgtagtagagttgtccgcccactcttgttcaactgacgttttattggaggcgtagccgttctttccatcgcctggatacgattttgagcttttccaagtatagaatggcgtcgagatcgctggaattccactgttccagacatctctgtaacgagtggctacttcaccaaaaatatagaaatccgagccgcctcttgtcttccaggcaggaatatagtatttattgaaaatataccggcttacatgcttcaccgtatcgacacggaaagcgtcaacacccatgtctatatagtgattgtaggtatcaattaaatatttgttaactgcagggttttccgtgttcaaatccacgcaatcgcccgctatctgaccggtttgaacagtataggattcccaggagagacttttctctgtatggtaaatgttattgttcgtcccctctgacttcattaaggcgagccttgcctgatactgctgatcgggtgtcatggaatcatagtttggcggcaacttatccgtagtcttcaccaagttgttagcggtatcgggattagctggatctttcttgaacatgggatacagattctcttcaccgaaattacccgtatgattgacgacgatgtcctgaataaccttcagccctttggcatgggccgcattaatcaaatcctgataagaagctcccgccgattcataccgtggatctactttggcaaaatttaaagcatggtaaccatggtaatcataaccgctggcattttgcacaacaggtgtaatccagatggcgctgaatccgagggctttgatataatcgagcttttgaatcaaccccttaaagtcccctctccaagctgggtccgaatctggattgcgcgcctttccatcatcccatgcgtgcacgttattgctcgaatcaccgtcatagaaccgggaagtaatcacgaagtaaatagtatcttcccgaaaatcccccttagttccaatattataaacaaagctctgtttggtttgattaccagcaccgtctataacgagaaattttaatgtcgtggtcttggagataagaatagacggtccagttaatccggccagcgcgttgccgaggatatagacttttgagcttgtggttggttctgtaccatcctccgtatagtatgccttggtcgttgccgccttgttatctttcaggttaaaggatacagtcactgaggaatcggaatgccctgcaggcaaattcgctgtgattgtcggagcttgcagatctgcatttaggtcaatcacataagcgaaagaggacggatttccagtttgaccgattgagttgacaccgaaggccttaatggtcaaagaggaagcaacttggattggagaggtatacaaggtcgaggatgtcgtaggtgtcgaaccgtctatcgtatagtaaatcttatcgtcactgttggtgctggaaagcgtcaccgtttgggacgaatcataagttttgggtacaggagaggcggaaatcgccggcattttaggcatttccgggctggtatcataccatgtgttatctgtgtaataccagccctctttcacactgcgggacaagtcggccgtctgtttgccgctactgtcattgaagatgagacttgagcctgtcgcctcggcaatggtgtagctgtaccagtcgtttccatccggcttcatcaggattcccggccacgccccgcttatcggaacggttgtcggattcagattccagtaatggattcgaatcgctgaattccagcttgaaggtttcttaaagtgaaccgttaacccagtttgagttgatttaggtgttgtggtaggtgcatacgttgcggttacggtagacgtgatagaagcggttgtcgatggaagggcagttgctgtggaattcgtgtaggtggatgtataatcggtgttactggccgaagctacgccggataaaccgaagaagttgaagcaaagtgataaaataattaaccaagaaataaaactcctagtttttttccttagcaagttaacaacctcctgataatatttagtgggggagataatgcaatcggttgcattaaaagtaaaaaaaagaaagacatttattttgataaaatggattcattgatcgcctcctccacggtatatatggaaaataatcattgtacgcgcttacaaaagaaactatgagaaaagcccattaacacagggccctatatcaatggttttttccttttatgattatatcatccatactttcactggtcaatgcattgctagggccatatttttaaggttttaagagtttatatttttagtactaaaaaggggatgattcctttaatataatagcatcgcgagaacttattccatatattcgaagagtttttgcaagaagctagtcagggaatggctaaaaacagtgaaaagatggattttcagagaaaagcgtatgtttaaacgaagaatgtggagtgaacggatcaaggagcagatggggaagccgttagaaatttatctttaatataagcattgacaaattgttaaataaataaaaccatgtctctgagtataattatatgcaaacgattgctcctttgaaaacgtatacattttgtttttttaccctcttttatttactcctaatctctcaagagaggttggttgtaaaataaaatcaagtttagtatgaggaggaaggcaagccccatcttgagacgtacctggagtatcgttctcttgcttctttaaggatgttattacataagatcggatcttaatgcaatcttaatgctgtaggcaaattcgtaatacggtactgattttgctcatgatacactaaggattgagagagaatataacagaaggtgggcagaggatgacattatggcaacgctgagaaaaaaatagaaaaaacatcatctcaaacaaagtttattcaaacacatatcggagttggttaccgtatgcttcaggttggagatgatggctaggtaacaataccattatgtaattagagatcatgctcttatggaggtctctttatttttcatctgcatctaaatcttaagatgatctttatacctattttggcacttcctcatcggaacgataccgatggtggatatcttgcctttatcaaggctgtaaatcgggtgctgggacaagaggtttacagctaaacctcagaaagaaggaaaaatatgaatcgtcaggccgcgttactggtgtctgctcccaatctggccggagaacaattttattgaaatcgatattaaggaaaaacaattgccgacaaaggagttcagcaaggatatatttgaagaacaacggagggagccttttttgtatgcagaaaatttaagtagaatggcagacactggaaaaacgagaacaggtagagcggaaaacagaagaaaacacgtaaagacaagaaaaaaacttagttgggattttgaacgatgtcgcttctttttttggttcatgatgaacggaaggactacaataagcaattaaacacgacaaatcgatgtctgcaaagaggaagagagaataagttctatgaattccatgaaagcgtttgacatatttgaatatcaatctataattatgaacagaattggacctcacagagatggaagtatcctgatttttccaatatgaaacggattgagatgtcaccaattttcaaataggtcgctgcctatgaggaatacgataattgatagagctgttgttcataaacagcaagctccataaccaggggcttgctgtttcatttacctaaggagaatgggtcggaatgacacttaaaaaaagaatctttctattgttttttctcagtgcgtttatcccctttattagtatatttgtaatttcttattataccattgattccatttttgcgaataaaatcaatgatggaattcggagcaatctacagcaggtaacttcatcactggagaattcaattaacaacctgaatcatgtcactcagcaattgtcatatagcggtacattaggcaagaaactggatgaagtcttgaagccttcctccaatatatttgaattgattgaggctagagatgaattaaagaatgagttgaatgttgtaacgtttactaatccgaatataggtctgaccttatactatttccagaaagaaggcactacacagttcgctaactttcccatcaaagatcgtttttcccccgagtctttgcctgtgctattcaaatcatatggcattgcgtactatggtccccatatcagtatgaaccgatttgatgatcagctcgttttatctgctatgcgaaaggtacaactgcctcaaagggacgatgtatatatttacgtcgaatccggctttcgacttacacaggatatactggattacaatcaatacaaaggagctttatcgcatttgatcctgaatggtgagggcaacattgtttacagtgaaattccagaaacgatgaaggtcggggagaatttctccagcatatcgaaaggtactgcaaaagatggaatatcccgtgattaccattggtttaaggaggactcctctcagaattggagcgtcatatcggtaatttcgcaggctaagtatcaacaggagaaaaaccagtggctgcttcaaatattactggtcgctttattttttttcggctttaccgtatttcttgcttggcttctgtggaagaccgtctacaaaccactcggtctgttccattcggaaattaacggaatgtctcagaatccacaaaaggcaggcagccagatccgcactcaaattcccgaatttgactttctgctgggggaattctcaaatatgcagcatcaaatcggcgacctgttcaaggaagtgcagcagaaagagaagatccgtgcagatttggaagtggaaaaattgttatatcagatcaatcctcactttctgatgaatacgctggatactgtgcactggctggccgttatgaacggacaaggggagattgacaagttggtgcaatccttgaacaagctgttatattacaatttgggtaaattagggcaagtatccacgatggaagaggaaattgatgcgctaagacagtacctaatcctgcaacaaattcgatatgactttgaatttgacgtgcgtatttcagcggatgatcaagtgctacaaatacctgtgcctcgttttattctgcaaccgttggttgaaaattcactttatcatggactgagtgacgaaggttttattcaaattgaagttacactcgccaaaacgctgaatattttaatacaggataatggaacaggtatgaccgaggaagcgattcaaagacttctgaacaatcgtatagctgaacataaaaaagtagggatgggcatcggactcaattatgtccaccgcatgttgagggcacagtacggagatcaagcacaactggtgatcgaaagtgaattgggtacagggacaagtatactgctcatactccctatcaaaggagaagatatctgaggatgattaaggtgttgattgtggatgacgataaattggtacgaaaaggaataagctccgcgatgccgtggaacgagttcaatatggaggttgtaggagaagcaagtaacgggttgaaagcactggattttctgaaatcccaaccggtcgatctgatgttgacggatctcgcgatgccggtaatgtcaggtattgaactgatgcgagctgccaggcagctctatccagaactacatattgtcgtattaacactgcatcaagatttcgattatatccaggaagcgctcaggctgggagccatcgattatatagccaaagttcagctcgagaaagagcaattcgaacacgtgctgcatcgaatacatacccggattgacgagctggcgaatacaagacgaaagctgccgctgctaagtgagaccaatgtcctttatcgccatgtgtatgcacttgtttcactggatcgcaagtcaggacagaactggccgattgaactgacatccaatgtagatgagatccgttgggaggttgaacggaacagctggatgtggacggcacccatggacgtagaggatcagctgttccgtaaactgaaggaatacctggatcaagttccccaaggcgctttgctggttctgtccgatgtacaagagcgaacatggtcgcaaatccaaaactggattatgaactatacagaaacgtccttattctatgcatacaatccttgtgatcctgtcatttccgtttcgatgaatgtggaggactcatttccaatagaaccgcaggatgaagacatggatcgtattaaacaaagttggttcctatcaccatggacccacaacgacagttactacaaccaactgattgaacagttcaaatcactaagactgcataaaggccagctgatgggtttgctatactctatagtaatggaatggaatcacctttttgctcagaccacgctgggtagaatctcaatgatccattcttttcaatcctggtacgaggtagaagattggatcaagcagacctctgtgggcattcgtaaggcagatgaacagacttcgtattcacaagaaattgtagacgccgtgaaaaaagcgattatgatcatgcaaaatgatttggaccaagcttttacagcttcaggtctgtcccaacaactgaacatcagccgaagctatttcagtcaatgcttcaaggatttgatggggaaaacctttaatgagtactcccgatttatacgaatagagaagtctaaagagtatttattgaatacaaccaacacgattttctggattgcggagcgagtgggttatacggatgaaaaatatttcagccgaatttttcgcgaattgacaggtctgctgccaagcgaatatcgacagctcggcagaggggataaatagcgtattctcccagatgagtcaataatccgggcgaaagaagggaaagcgatgattaagaagatggctgcatgtgttcttgtcgtcagcttaattgcagtgacagtaaatttcagcaacccatacttccgggaatcaccaatgggaccaacgaaaacaatctcggacactgctgctgctgatccattggggaaatatgaacatcccgtttccatccggctgggatatgtggtagacccaacaggcgcggatctatccggaggagaaacacttgagaagaatatgtggaaaacgatgattaaacaaagtcttaacattgatgtccaggtattatggcaggtgtcgaaggaaaatctgggtcagaaaatcgatctggctatcgccagcaatgatctgccggatgccatgattgtaaatcaggtgcagctgaacgagatgatcaaggctggagaaattgaagatctaaccgaggcatacaatagcagcgcatcaccggaaataaaaaaaatcatcgatagcagaaacggattggctatggaacaagtgaccttcgatggcaagatgatggctgttccttctgtgacagcggaagactttagcatgctctggattcgacaggattggctggatcgtcttggactgaagccgccgaaaacggtcgatgatctggaagctatcgccaaggcctttgtggagaatgacccggatggaaacagtaagcgggatacgattggccttgcttcaagcactggactgtataacgatttcaacaacagtgcttttgcttttgatctaacgccgatcttcgcagcatatcgatctttcccgggatattggctgagcaaagatggaaaacctgtatacggttcggttctaccggaaacgaaggacgccttggtaaagctgcgtgaaatgttcgccaaaggccttctcgatccagaaatgggcatccgcaaagaagcggaggaaacggtcattaacggtcaggcggggatgttctttcaaggtttctatgctgggtactggccccttccgagcgcttggcagaacgagccgaaggcgaactggcaggcatacgcactcccgctggatgcaaacggagcataccatgtgaaggtggataatccgtcaagttcattcttggtggtacgaaaaggatatgctcatcccgaagcgatcattaaaattaacaatctgtaccttcgtgatgagttcaagtatggtacgcgttttatgctgagccgcaatttctttgctccggcagatgaggcaagatatgaatcgaaggccgcgcaggatattctgatgggaaccaaaacacccgccgatttcaaagacaagtctgaatacaaattactggaaaacttggtttcgacgataaaacaaaccaaattgaagccttatgatcaacatggtatttcctattggaataaacagagcgacagctttatgcggagttattcgcttcttgtaggcggaagaaatttcttcgatccaaacatccataaagttcgaagccttacctatatacgaactccaacgatggagaaggcttggggtgaactatcgaaactggaacatgatacatttttgaaaattattttaggcgctgaaccaatcgattcatttgatcaatttgtcgaggaatggaaggaacaagggggcgatcaagtgactgtggaggtgaccgcagcccataatcatcgctgaagaccatcatgaatgtgatacgataaattctacacgacacttttataaatccattaatcaagccgacggattcctgtttcaggagctgccggtttttttgttcttcactttgattagtaagtaaggatagacaaatgtatgtcggtaggtaggataaatgcttacaagccaactatggcttcatgatcccgaatgaaaccgtatacatttctctatccaaacagacgttcaatccctatctcgatttgtcttctccgagtcttataatgaaagcgcaaacaacaacgatagagaaatattcagaacgaaggggaatcgaatgtgatgagaactaaatggttcataaaaagaaacatgttgacgagacgtctggccgtgctgtcgatgtctgccctgatgatttcaacccttgcagcctgtgggggttcctccaaccctcccactgcggaggaagcgggcaagtatgaggcaacaccgggagacccattcagtgcctataaagacgaaataaccgtaacgatgggtcgtgtgactacagccaacccgaaactgccggctggagatacgtatgagaacaatgcatatactcggctggtcaaaaaaacgtttaacgctcagattaaagaccaatttgaagccaacggagaagattacagccgtcaggtttctctcgccatcgcctctggggaactgcctgacatgatgcgtgtcgattccaaggatgaactcaaagaactggttgataatgatctgattgaagatatgacggaaatttacaaacagtatgccacagataacatcaagaacatttacgaatcttatgatggccgtgcattagataatgcgacgatagatggacgtttaatgggacttccggctacttccctagattccgcgccaaccatggtctgggttcgtcaggattggctggatttactgggtatccaacttgacgcagacggagacggggccatcaagctgggtgatgtggagaaaacggccgaggaattcctgaaaagagatcctggccaatccgggaaaccggtaggtattccctttgtgaacaccctgaatacaagtgactataatggttccgcctataccatgctgggagttgcctccaccgagggtgcattccctcaatactggatgaagggaaaggatggcagcattgtttatggctcgacaacaaaggaaaccaagcagatgttaggcgtcatggcagattggttcaagagaggcatcatcgacccgcaatttggaacacgcacatttgatgatattacggcactgtacaccaacggccaaagcggtattgcttttggaccatggcatattcccgactggggtttgagcagtgtgaagcagatggataagaatgcgaaattcacggcttacactttggaggatgcagacggaaaggtacacgtggcacacgccaatccagccaatcagtttatcgttgtgagaaaaggatatgaacacccggaactcgccgttaaaatagtaaaccttttctacgataaactggcaaatgataaaaatgtggaaacatctatgccagaagccgccaagtatcaagagaacggcgtagacggttctaccagaccttttaatattgaagtcaactcggctacctcgctgctggatgattactctgacgttgttcgcgggattaaaggggagattagtctggatcaggtccggacaaccgaatcaaagaacaatattgaaagtatccaaacctacttgagcgatatggatacggataacataacagcttggtcgaaatatcactcgcgtatcaacggagtgggactcatcgacaaactgacacaggaaaacaaattcgtttggatgacacctgctttctctggaactacaccaagcatgaaacagacatgggctaatctgaccaagatggagcaggaatctttcatcaaaatcgtgactggtgcagaatctctggattacttcgatactttcgttagcaattggaagaaacaaggcggtgaccaggtgattcaggaaattgaagacgaggccgcatccgataaataaataatcatgaactgctagaagggctgcgatacgcagcctttcttcaggaaggggtccatctatgaaacagggaaatgataaagcaaaaggtcggttgggcacgggtgccatgtatcatctgatgatgcttccgggaattttgtttttgctggtattcagctatgttccgatggtcggtgtcattacggcgtttcaggattatataccagccaaggggatgtttggctccgaatttgtagggctgaagcattttatttatatgtttaagctgccggacatcgcacaggtttttagtaatacgttggtgattgccattgccaagattctattgggaaccatgatggctatcgttttttccatcttgttaaatgagatccgcatcaaattcgttaaaaaatccgtacagacaattgtttatctgccacactttctatcctgggtagttctagcatccgtggttgttaacatgttcagtttggatgggattgtgaatcaaattttggcttttttcggtctggagaatattaattttctcggcagcaacacctggttccagccgttgattattgggacagacgtgtggaaggagttcggttacagttccatcgtctatttggctgcaattacttcgattgatccgggtctgtatgaagcggcaggaatggatggagccagctggtggagaaaagtatggcatattacgttgccaggtatgctgcctattatcctgctcatgggagtgatgagtctaaccaatattttgagtgccggcttcgatcaaatttataatctgtataatccggttgtctatgagtcgggagatattctggatacttatgtatatcggattggactcgttgggcgacagtatagcttcggtacggctgttggcctgttcaagtcagtgatcggtattgttttgctattgtccgccaaccatttggccaagaaatacaccgaccgaaaaatattctaaggaggcaaagcctatgccgtattctgtaagcctaaaagatcgaattggccggtttgtcatcaatgccatcgtcatattgctggcattgatctgccttcttccgttatggaatatcgttgcgatttcattcagcagcagcgaggccgtgtcagctaatgctgtaggtctcgtaccagtcaattttacaacagcagcgtatacgaaaattatcgatgatgctcagttctggcgttcctttggcatatctgttctacgtgttgtgcttacacttattctcaacatgattcttattattttaatggcatacccgctctccaagtcgaaaagggaatttagaggcagaaacatttatatgaatgtcatgatttttgccatgctgttcagcggcgggatgatcccgagttatctactgatcaaaaacctcgatatgcttaatacaatttggtcgcttgttctgccgggtgcggtccctatattcagtgtcatccttgtcatgaacttcttctccgctgtacctaaggcgctagaagaagcagcattcatcgatggggcgaatccgctccaggtcctgttcaaagtgtatgttcccgtgtccatccctgcgctggcgacggtagcactattcagtatcgtgggaacgtggaatgatttcttcagcggtttgatctatatgacccaagtcagcaattatccgctaatgacttatattcagtcccttaacgtggatattgcggaacttcttcaatccggcaccaactcagcacaactcagcaacctgactgaaatttcaaacaaaaatctaaatgcggccaaaatcgtagtcgctgtcatcccgctgctgctgatttatccgctgcttcaaaaatattttgtgactggaattgttgtaggatcggtaaaagagtaattgtatgctgtgacttgattgagataaaaacagctattcgtgtattggaagggttgtaatgaacaatgaaaaataaaaattggtggaaagaaatcgttgtataccagatatatccacgtagttttcaagatagtaatggtgatggaatcggcgatttgaaaggaattgtttcccgtctagactatttgcagcaactcggtgtcggagcaatttggctatcaccagtttgtaaatcccctcaggatgattttggttatgatatttcggactatcgggatatcgatccgatgttcggatctttggatgatatgatgagcatccctggtttcaagaagcaaaaaaagtaaagaaaatccgtaccatgactattatgtctggagagatggcattggagaaatgccaccaaacgacttgggttccatatgggtggttcagcttgggaatgggtacccgagataggacaatattatttacatcttttttctgtaaaacagccggatctcaactgggaaaacccaaaagtccgacaagagatttacgaaatgatcaattggtggataagcaagggtgtaggcggttttcggcttgacgtaattgacttaatcggaaaagaaccagatttgaaaattaccagcaacgggccgaatctgcataagtatatcagggaactcagcaaggagacgtttcaaaaagctggagatctgctgacggttggagaaacatagggcgctacgccagagagcgccaaattgtatagcaacccggacggcagtgagttttcaatggtatttcaatttgaacatattagattaacaaggcttgagctacgaaaatattgtgcattatggtataaatggataatttaggggaatgggcgaagtgattactaatatatcattgagcaaacgagaaacgttagttgaaaatagcatggagcagtttgccggttggttgctgctccatttttgataaactaacgggcagttatcttcaatcagtatagactctatttaaacctattatttaaccctctatagacttctctccaataaggctccaacttgttcagccatgatttgtggcggatacggcatttcatttctaatccaccattctattacccctacataagcggtaccagcatattgcaacataacgtcttcatttaaatccacatttcttccactttctctatcaatctcacctctgaatcctcccataacataatcaagaagacgagttctaaaagagggggctcctttactggctaacatagtcgaaaaaaataaataatttttctcaaaatactcaaaaaaaggtacaagtccattgctccaatccagcttacatgcccattcatccatttcgcctaattcattcatgtgtgattcgatcagtttatccaacaaatcatatttgtcctgataatgaagataaatcgtaccacggtttacgtttgcctggtctgcaatgtcttgaatggtaatgtcatcgaagttttttacagccatcagttcaataacggcttttttcaaggattcttgcgtttttagaattctccgatctacttttatcatttagtcttttccccctgaccaactcaaaataatgaacacttttcgtgatgttgttgttatttcaacaaattgcgcttttttaaccattgaacttaggcttcttttttataataatagacgttagttgataaaacaacaagttttgtttatccgctctttgtggttcactaatattacctaaaaggagaacttaaatttagaaaggagggatgttcacttggtagttaataaaaaaatgtgaataatcattactaatttctaaaaaaggactaacagataaaattgtattcactggaggttatatatgattaatgctaatgcacgtgctgtgttcggtccggaaggtccgttcatactaactacaattgagcgcagagatcttaagcagcatgatgttctcattgagatcaagtatgtgggtatttgccactctgacatccataccgctcgtggggattgggggccagtccaatatcctatcgttccaggacatgagatcgccggtgttgtcgcccaggttggctcggaagtcacaaagtatactgttggtgaccgagtaggagttggctgcatggttgattcctgtcgagagtgcgagagttgccgtagaggagaggagcaatattgtcttaatggacatacgggtacctacgcagctatcgacagatatggacaatatacacaagggggttattccacccacatcgtcgtaacggaagatttcgtggttcgaattcctgacggcattgatcttgatgtcgccgctccgcttttatgtgctgggatcacaacgtactctccgctgcgccattggggtgctgcttccggcaagaaggtagcagttgttggacttggcggactcggacacatggctgtgaagctcgctcatgctatggaagcagaagtaacggttttatctcaaaccttgaagaaaaaagaagatggtttgaaactaggagcggaccattattatgccaccagcgatgcggagacatttaagaagctggccggcacgtttgatctcatcgtgaatacggtgagcgcgaaaattgatttgaatgcctacctatcactgctggcagtggacggtaccttggttaatgtcggtgcgccgccggaggcattgcctgttcaagtattctctcttatcccgcatcgtcgttcgtttgctggatcagcaatcggcggtattcgggaaacacaggaaatgcttgatttctgcgctgaacaccacattacgcctgagatcgaggttatctccgctaatcagattgatgaggcatgggaacgcgtacttgcttcggatgtccggtatcgatttgtcatcgacatcagcacgatggagaacgaatagggattcattgcagcaaaaaaatatcaagggcacgccgggtggtgtgcccttgagttggataaggaaaagacatatctccgaaatttatctaagaccctttgtatatcggaggggtatactgtcacagggtaataaaacgacaaaacctaaagcaaatgcgttggcttaaagaatgtgcatttaatcaatcataggagttaaaggaatgaaatataagacccaaaaagattctctcggttttgctctaatattggccacattctcggcgctggggccgtttactgtcgatatgtatcttgcatcacttccgcaaatcgctgttttttttggaacaagtgcaactgccgttcaagcaagtttaaccactagcctgttaggattagggttaggacagttgataatggggcctttaagcgacatttatggaagacgccggcctttgttgatttccatgatattatttatcctttcctcgattggatgcgcttttgcaccaagcatagaatggtttatatttttaagatttattcaaggggttgctgcgtccgccggactcgttatttcgcgcgctattgttcgagatcggtttagtgggattgaaatgactaagtttatatcgttgctaacgatgataagcaatgtcgctccgttaatttcccctacggccggaagtacggtcatgtcatacagctcttggttaggtgtatttatatttttaggggtgctaggtataggattaactgggataaccatatgggggttaaaggaaagcttaccagtacagcaacgtgctccaagcagtctccgttcgttgatgaaaaattataacagcttgttccaaaagaggtcttttatgggatatgctctcgtcaatggcatattgttcgcaggtgtttttgcctatgttgcaggtaccccatttatttatcaaaacatatacggcgtgtcgccgcaactgttttcgatcctgtttgcgttgaatggccttgctattatcttgggatctcaattcgtcaagctgcttgcaggccgggtaacggaaagtcgactatttttgatcggattaatactgtcatttatatcttccgctgcggtcttatttatagtactagtacatggagcattatcagctatgtttatttcgatcttcttattcgccttatccattgggatcattggccccatctcttttacattagcaatggagtcgcaagggcatattgcagggagcgcttctgccgtgctcggcaccttacaattcgcgttaggtgccgttacgtctccgcttgtgggaattgcaggcgaaaattccgctataccttttggaattattatattttctaccagtttgttatctataattacctatatcattctggttaaagggataaaaaaattatccgtttgatgcactccatatcaaaggagtattggcgctcactctatgtatgcacctactaagagcataactcccattggtactaggcgacagtcaaggatgcaccgcgtgaaaccaacacctaatgtacatcaataaaggcgctcattggactatttttaagaaaagaaagggaggaaccatgaaatggattatacgaaacttggaaatagagggaaatgtatgaaacgaattgaaaagaatcaagtgacgtataaaaagctatttggcgatggagtgtcagcggcatacgctactgatcctgattttcaggacatcctgagccgcttcatttttggggaagttttttatcaaggtgaattggacgataaacaacgtgagcttattactctggtggtgcttgcaacgaaccaaacgttgccacagctcaaggcccatactcaggctgcactgaacgttgggctgacaccggtagaaatcaaagaggccatttaccaatgtgcgccttatttaggattccccaaaacgttaaatgccatcgcggagattaatgaagttttcaaggccaaaaatatagtgttacctctcgaaagccaaaagcaggttgaagaagagaatcggttagacaaagggcttgcagtgcaggtagagattttcggcgatatcattgaaaaaaatagggagaatgctccatccaatcaaaggcatatgcaggactatctttctgccttctgttttggcgacttctatactcgtggaggtcttgatctgaagacacgggagctgctgaccctctgtatcttaagcagcctgggcggttgtgaaagtcaagtcaaggcacatgtgcggggcaatctgaatgtgggcaatgacaaggatatgatgatcactgccatcactcactgccttccatatatgggttttccgagaacattaaacgctttaagttgcttaaatgaaatcattccggaatagctggagaaaatttagtgaagaaacagatttctctatcccttgtttttttgctgacccttaccctcatggcttgtggcggtaataccaatggaggaaaaactgtggccaatcaaacaactaatataaaaataaaattgatatttaacaacgaggaagtaatggtaagcatgtacgataatccgaccagccaagattttttacagcgacttccaatgactataaccttcgaggattatgctggtaccgaaaaaatcagcaggctagagaaaagattgtccattaaagctgcgccgtcaggcatcgatccttccgttggagattttacttattattctccttggggcaatttggctatattttatcaagattttggttattcaagtggacttgtaaagctaggtcatattgaggtcggagttgaaaagcttgtaaaaatgaacggcagtttcacgatgacgattgagcaagcccaatagcgttaatgattcctaaaaagtaggaagtcgatagcatcgcgttggataataataaaaatataagaaagtagggataaaaaatgaagaatgagcacttaagcaatagcacactcttcccattgggtcaaaaagtcgaaaaaaattttatcggtgacgcatacttacaaatggtgtttaccgatccagcaccactcaatacagcaattgggaatgtaacctttgctcccggtgcccgcaataactggcactctcatcatgctgggcaagtgttgttggttactggcggtgaaggatggtatcaagaagatggaaagccagcccaattactcaaaacaggcgatgtggtaaacattccaccaaacgtaaaacattggcatggtgctacgaaggacagctggtttgttcacttagctcttacaccaggacaaacagattggttagaacccgtaatggatgaagattatactaaactttaataaatgaagtaacacacagaaacggcagacatcaatgttgccgtttctattgaagcttctcataaaccaggaaccctctgtttctaatctgcggatattcatcaaacgaatatgaggtcagggaatatttgaagctagtactgagtgattcgagacagtattatgcaaacgatcgatcaacaaatacttactggagaacgatcacttttcaaattacaaattctatttttgcagatggcgagtccccactgaaggaaagcaacgatattactatcgataatagcattttcaaatggaagtatcccttatggtattgcaataatattcgtgttagtagcagcactttccttgaaatggcccgatcaggaatatggtatacacatcaaattgccatcagtgccagcgtaatagaggcaccaaagatatttcggcgttcgagcgggatccgactgacaaatgtcgatctacccaacgcgcaagaaaccttatggaattgcgcagatattcacttgaatcatgtgaccgcaaaaggcgattattttggaatgaatagcgcaaatatcatcatcgacgatttcacattagcggggaactacgcattcgacggagcaaagaatatggagattcgcaatgcaaagcttatttcaaaggacgccttctggaattgcgagaatatcaccgtttatgattcattgatcatcggagaatatttaggctggaattcgaagaacatcacgtttatcaactgcaccatggaaatgctacatggaccgtcaaagattggacgattgattcaataacggttaccggacactcctccacgaaacgaatggaaaatctgctttagagatacgtaaaaaattcgtttagttagcgatcgagaagttatatattatgatcaaactgaaatcaatttgacctctttggcggccacaatgtggtcatcgttattaagcgttttgagccataagtgaaatataaatgattaaaccccagggaccttatccgggactgacccccgtttgt

SEQ ID NO: 2681 - DNA, 13027 bp, Unknown
  Kingdom: Bacteria, Phylum: Firmicutes, Class: Bacilli, Order: Bacillales, Family: Paenibacillaceae, Genus: Paenibacillus
tttttcacgttgtgttctagaaacaaagtaattatcttttgaaaatccatccaccattctgtttaggaacccatagaaggataagctaaattgtttcttttcatggtcatatcggattataatttcatcaatcagattttccacaatccttctttttatctctggtgctaattcattgtttaatacttcctgatatttagataccatcactttaatgacatcctcagacatcgactgccgattcaataaagatattttttcctcaagtcgtccaagttctccttgaattctttttacctctttatttaaagtggtcatatcagtttccaattcatcctcctcaataacacctttcctaaacataaactttattttctctctttccttttccttctcttctatctgtttttcgaagatatttttcaaattcatgagttcatctgtagcatggctatccttttttgaaagatcattttttaggtgttcaggattgttcagaacatttataattattccccatatatactcatcaagaatttcagttcgaatcaccggaatatcgcacttttctaccccttcaccatacctcttggggtatttgttagcacatctgtaaatgggataactcttcttctcaccgtttttagctttacccggatagcttgttgcttcccacacacgtccacagtgactacacttgattaacgatcttaacaaataatggtgcttaacattccgacctgtacgtgtaaaattagttcgcttctttttctgggcaagttcaaaagttcccaaatctattaatggaggcacatctacacttatccattcttccttattccttatagtgtaagtctttttagctttacctgttgctgttttttcacctttaatcttcttcgttgatctacggttatagtaatatttaccgatataaatttctgaagtcaggacgcgaccaatagaactggcactccactgcttactttctgctcgtttaggaacagcgcccatcaaatataagttctcaccaatctgcttcatcgttttggaatcatgaacataccaatgatagataaattgaacgaatttagcttcttcttcattgattataagctgaccatcaacaagatcatatccataaggtgctacacgcattggcataatttttttgtctttttcaactgctctgagcctaccacgcacagtacgctttttaattagggataactcatactgagcaatagacgacatcatgttaaaaaacaactggccttcaggtgtgtttttatattctgtatctacgaaaataagctctacatcatgtttttcaagctcgcggcaaataatgagtttgtcggtcagatctcttgtcagcctgtcgggatgcgtcacaattagcgatttgattttacctagcttaatgtcttgcatcaaacggttaagagcaggacgatcaatgtcctcccctgtaaacccttcttcttgatagacctgtagagtattttcctgaattcctaatttacgtgccttattacaacagatctccacttgaccttccaaacttgtaccctcggaagcttgcattcctgtagatactcttggataaatagccgttatgtaagcattcaattgtgtacacctcactttgttttgtgttcattataaatcctatgctcattattgtatataaataaagaaaaaaaacgatgctgttacacatcgtcttctctttttgttgattgattacttatttgttcaagtataatttctaggacattctgcaatggtttatcattatttatgtattggtctgatactggattaaaaacagggacaaaggtgaattcattcttcttcattgttatacaccacccgtctttaagctcacatggatagtgtatgaacgatgagattgtccctatgtcacggctatatccttgaataatctgatgtataaatatcacattcctctaagctatgtatttttgtcaaagtgcttactatgtgctgctatatgtataattcaagcgttctatttttaattctaagccttcctaacttgatacctatacttcttttctcccgaactctaaaccttcttaaacagcctttaactttcgtctgaagcgacttttatgtatgttcattctgctataggttcctttaaagtgattgccatttgttcaaaagtaaactgctgacgaactacttttacttgcttatctccaactggagttacactgacaggaaaccaccccgaataacttaaatccatattcatctcgtaatcttcaagctcttttctgccccaagtaatgtcatcgctctgcaccaaatatagagaaccctctacctgatagaaacgtccagtatcgctatgagattgtggtagcccgattgattttagcgcttcttttttagtttcatatctacaaaatgattgggatctatcgggatttatgctatcaaacaccttaaaaacgtagtgtggtttgcgagttgcttttgaaacgttctctgcattcgtcaatacttgtatattttcgaaattataattcatgtgctcagaaattctatcaatagtaggtctaaatgattgcttatagtcattatctatgtattttactgttgcttctttccaatcaagccaaaactgttttttatgtttcactagctctaaaaatgttttgctttcatcttcccattcgcattctacatgcttgtaaatgccagcgttatgacgacagttaacaatacgacagtatatgctgccatgaagaagatacactgcgaagcgcttttctgtactactggaatccttcgtatagtagcgctctacgaatgcaattgcgcggcgcttgtagtcaacgtaattatgatctccataggtgtctatccaatcctgtataacttctaattgtacaacacgatttttactcaataatatagcctccaatgtgtttgaaatgttgattttataaactatccgttgaaaactaaccagaggaatccatacattaaagcgattagtcctataataccgaacaagcaaaaaagtaaaagcataagaacaaattttttaccttccataataaccacctcatttatagaatataaaacctgtagaagaagtcggctacgatccaatcaattttacataataaaggaatatgtaaaaggatactatagattgttgtatccaaacacgctaaccaatcaagcgcattacctccccaatgtatcaaatccttagatataagcttttgtctacttaaaccaatcttaaattcggcttattcggtgtcatatccacaatgtttccaaactcatccactttacttgtaaatgatggtaagggttcaccaatgatctcctgaaccatatccaaaacatcaaagccctgttgtttcatcaccttaatacattcgtgcatgaggtatttcgatacagcacgatcattcaatagaacactatcagttccagcgaattgtaagaatgcacttccatcaatcacatctggcaaatccttaattgcctcatttgttcctttatagttcactctgctccaatcatccctatctttgtcccgattaaaggagaacaatccaaggaactcatcttttgtaagtggacacatatcaaagaagattgtatagtgtcgcaaatttggatagttcatctcaaacccttcttttaagctggagtcaatatcgagtaccatagccttctttgactcaaaatcattcttaatcagctttgtcaccgcgttcagattatcacgcacatatgtacaaatacatttagctttagttgaagcctgtctaaatactctttcatatcgatctactttactaatcatattgttcatatagatgatggcgcttgtcgtttttatttttggtattctataagatacatctgtcattaattctatggcttccttggacgttctaatcaaaccagactgtgaaattgtaaacatacgatctgcctttaaatcctcaaaagcactaatcatctgcatcatacagtcatcaagctcgttgagcttttgtttaatctcaaagtttttgttcatttcatttctcctcgtatatgtattaattacttgctagtacttcctagattatcaaattattttccacaaaatttattcattaaatctaagtaatcatctatgagcttttcttgttgatcaatatatttatcaaatactcctgtaaaactctccaaatcgcttagagttaaatttaaatcaattgatcctttaatcatcttctttaattgaactgtcatgctttctgccacttgtttctctttgttgcgtagcatttgcaattcctcattaatagaaaagtctaccttttgcataacgtcttctgttctttcgataattttcaagaatctttcatacattacacctgcatcgacctgcatttttacagggatatttattttactattcatttaatcgctgctctttcttatatgtattattttatataattctggcttacttcatgtgacaatccaacactagctcaatccacatcacccctttcatatccattctgacgctcataaccctatatatttatctataaataacaggtgttgtccttacccatacaaataccttgtctatgaagaaatatcttaatttcataatagaatattcagagaaaaggatgcactaaagacgagtcaataataatccatcttgaccaaatacatcctattctgttatcccatctgccaactaatctgacaccctgattcccataattcatgtaacaaaacacagaaatcaaaatatagcttccaatctttttgctacttatgcaactatacgattagaaaactccccttatcgggtcgtgttccaacatttacagcatggcatacgccacattgtttatttgtatacttctcaatctcgccatctgatttgcaagtttcagcctatttcacgctaatttgagccgtaacttgcaaaaccaaatgtgcaaaaaactcaatgatatcaacacttttttatcaatctcgccacttttctatataatatatatagggagaatggatagattagtattcgatcaagttcaaaaatcccaattagtataccctcgtatgaggagagacaaggtattggaaatgttttctccaatatccttctctcgcataagtagcttgaacattacaatctaatgatggaacggtattcaattcgaatctgctttgtgcttatgtacgtttgaactaggcttaaatccttattgaagtatcttgaaaaatggctactttttatattgaattgcttggctatatctctctttgaatatgttcccggtggctggcttagtaaccaatccataatcctctctgtcattgttgcttctgtagatagtcctgagtcactgctttcgtgcttgctcataaaatcatctataaccaatggaattggcttagctatcttaatcccctttaattgcttggctactttattaaacacttctccgctactggttactatgtatatctctgctttgggtttaggaatacgctgtacacgtttaacagtctgatacatctctgatatgatatcgcactgtctgattttctctaaatccctgtttttgaaggctctagccttctccttctttataatatctaacgatactctccagtcgtgtttatctgtaaactggcacaaatggatgatatgggactcgaaacgttgattaggtgttccaagtaaatagcaacagtcaaagtcacgccaagtattttttccaattagattcccataccagttaacactgatagattcgccattatattcatcgcctacagcaatatccgtgaatccaatttgtctgagttgacgaataaaatcaccttcatcaccgttaacagataacacgaactccttatgtaagacaaccaaatagcgtttatcaaacttaaagttacgcttaatgaaatttgttatcttttcaaagtattcattctgattgatttctgtgttcagcttcttatgaatgctggttttgctggtgctgaatttaatgtgcgttatcgttgagcctgaatggtcaataagcttggattgtttatccaaaataaatttgatattcccgttcttcacaccgtataggtgatctatctgcccgttagcgtctagtattacattgttgtctagacaaaacaatctgtgctttctgttatatgtactgagcgaatgataattgtaatagcatgtatttttataaaataattccagtttctgcacaatgcctttgagattattatagactggtaatcctttgtcacggataatctctgctttgtttttatttatgaccttacacaactcatagacaggctccaagctatctattttgggatgacaccttaaaatcccactgcttgagagctttttcccttcacttgtcttcattcgctcacatgcattaacctgatcaagcaagcctttggtcgcatcatacaacaagggatgaagagtatgcggtaaaacagaaaataatttgttatactccgacctactgaaactgacaatatcgaagtcaatgcgttcgtctatgatctgtgtgtgtctgccctctgtgaaccatcgtcttagttcatcgtcttcacacagcattttatagcgtgaatgcgtaataatgagaacatccgagtcacgtacagcatcaagattatggcgataatgcttctgccaactttcacttgtaatcccaataacatgctgacctttgcctataattcgttcgctactgtttccaaatccttggtacaatctgtcaatatttttacctatgtactcttctgaatcctcaacgtccttagcaaaccgcttcaccaacaaaaacttcctgtatggcttcctataattgataccagtgaactgataagactctatgtattccctcaaaatcttattcgtttccacggacttccccaatgaagcctccaaatcaataactacaaacgtatttgggtcagtttcactttctagtatcctacgtttcatatttgaaattttatttgtatacttctcgccataaacgtcatcaaatgttggaatagaatgattggaatgtattattttagccccttactggcattctgctggcatactcatgaaactcatgatcggttttataatctgccattgccttttgtaagcgttcactagagcaaaacaaataaacattcctctcactcttcaaatcatcaccaatcgcaaccaacataaatccctttaattgaagataaagagatagtttccgcgaatgaatgacagttgtcccaatagaaatatagaccactcccgttgtttttttaaattttcaaagatcgcacaacaaataaaatcaacgatccatttcagatagaatgaataaaacaatattaagttgccaatcctaaaaatattttcatttcttctataccaatctagtattcatctcatttacttactgtgttttaaatctactgtgttaattgtattcgtggtaatgaaatatgtattgtcagctacttaacttttattccctttgatcccggttcaccttcgtttcaaatttacatcccctttcattttattattttatctctgtcaccattttagtatagcatatgttccaccagagtcaaccccttccttttatttatttttcaaccatgtatatttttagtcactaaaatacacatatataaaggaagcggaaaattcgagtcgctattttgtcggtagattgatcctactccatccgttttcaccaatagacccagctacatccttgaaagtatgaattatgtatagacttttttggcctacccaacaatttgccatgctttggtgcacggtgagttaattttgacacaccttcgttgaagctaggtgtatgcaaataccatccccctatattcagattggacaactataaaaaagctcactcccattttattgttaaaggagcaagcttaacactgactatataacgctggatttgtaatgcaacctattcttcttcatcattaaaaatagcttcaaactcttcatctgtataatctctattgctaggtacatgataacgctgtggtagtccattatgatcaagtacatgatccacaaccccatctctgtctgagacaacaaaagtaatctcatcatcaccttcataactctttggtgtgatatcagctaaaactaaccatgcagcaccctcaaccctatagaattctgggtaaaatttgacggactgctcagtatcatcatttattacaccatatagcttatatttctcttgataatcccgagcaatttttctagcttgagtagctgttaatttagtatccactttttcatccattattcttcataccctttccaattagacagaggccactgtccgtttctcactttataaatgtacctctgtgcttcgtatatttctgaggaattaaattggtctttatttttgatgatttcattatacacatactcttcttttgctatagtggataaattcatatatttttcttttccaagttctccaaaatgttttgcatggtaagattcgtgaattgcacttagataggaagcatcaggtcgtaaaacaatctgtcctgtactaggattaaagccacccacagcatcttcaggaagtattgcgccctttttatcaattataacttttacatcaatagcattcatttcttttttaaaagattttatttcactaacattcattatttttaatccatctggtgttaaccttctctgaccacttacaggcatctcttcccacgatttcaaatctagatcatggcctttgggaaatggtctaacttcaccgtttaactttattgtactaccaatcccaattttaggcttaattactgaacttactcctccaaataatccagctgtaccaatcatattagcccagtgttcctttgaccaagcactgtttggattaaacgctccctgaatcatacccgttattccaaatgtaccgaaattgagcatgtcattccatgaatcgttttgtttagctgcccgttccatgtacccttggtacattccttttggaataccatatgacatataatctagaaagctccagactgaatcaaactttttctcatagcgtactgaattagcgtctacaaaatcctgacctagttcagttaagctatctactgatttctggaatgcatttcgtgtatctgttgcaggaacagcacatgaattaggtggaggtggtaaacaacttgcgtcaatgttacctgcttccatcaaatctgctaatctgaatttatctgcatggtgacgtaattccctagcaatagaatccgtcaaggtaacaaagtcattcatattcttctgagaggtttggaaggaatagtaaaagtgctctttagtcagtccttcccacaattgccccatagatgaaatttgttgcactaaattgctattcatttgagttgccgtttgctgtgctaactcaaactgtttggagacagacataagctgttctggtgtcactttaatggttgtcataatatacctctgtttgagttcgttatgacataataacactattccgatttatggaaaacgaacttaattcctaattgttatgtgaaataagacacctttgtgcctgcgtctaaaggcttaagtcctcaaccatatcctgcaactcagggataagagttagaagttttttgtaatttctaagttgctgagtggtcatgtttaaatcattggcaataccctgttgagtttttgccagagcaaaattattttggtcaccaattccatgcgtgtgttgattgcttatatatatatataaaaatacactccttagaattttatcggctaaacctgttttaggttcctccaatatccatcctagggagtgtatttttaaagccgggctttttctttccttattcgtttgaaatattaagcccccccatgttgatcataaagcacgatattctggtgttggctatgagtctgaacaggcgcagtcatgataaacaaaaaactaattgcgaagatcaatagcaccatttttcttaacatcatctatccacaccctttcaataaactttaaatatgctgccttagtttcgggtactacatagtctcgataacgctcaaacagcaccatacattttataaaataagtctcattatttagtatatgatatttctccattgaatacatcaaatgtttaaaaccattactgtacatcccccgatgtaaataataataagccaattcgtatcccagacgtgcaaactgttctggaattacatgttgagtatatatatcattaaattgaggcaattgcaaaagtgaattaacatccgtttcaaaccgctgaagtatatcatttacgtctatctggtatcggtttgccgtcatcataatgttcaacagttgggtaaccctatcttggtcagttgtatctgacgatgcagcaatatattctacataatcatttaaggccttcatatctccagataaaagcttatttacaataacgttagcttgcgcccaatgttgaaacaagttaatccagtgttgtgtgtcctcgtcagtctctttgacccaatctaaatcagcataggcgtatgtaaattgtagagcctgttcgtaatcttcccgtgattcacatacacctgcacataataaatctgcatagctaatgtacacaaacatgggacgactcagcttcttttcagactcattatgctcacgtttcttctgctgatgtttgatcgaatattggatttccgcttttcttctcattttccttgccatttcatcaaccttgtcccatttacgcaaagacctgtacacgtttgccaagtcctttaatgcatcgagctggtctatttcatttagacgctcaacaaaagcttcaaatatcgaagccgccctgacatttcggctttggtcatcaccaacttgaattgtgaatatacgatattggcagactgccaaacgttccgaatgttgatatctctccgcttcagctactccctcatagagtatcaatgccgcttctagtcgtccctgcgccatcaatccttctgcaatttcaaatagcttaggcgaatacagtagattgtccatgatggctcccaccactcgacggatcgcatccaacctgtccaactccgcacagcgaagcaagaacggctcaattcgcctcatattaggaggatggtcaatgatgtagttttctatgaacaagtcataaaagtgaccctctggtaagcccatagcttcagtaattcgatcaagctgattaatagacatagatttgttacctgttacaatgctacttattattcccctattcatccctgtaatttgtccaaattgcgataatgttaagccttcttgttgtagaaattgttccaattctgctctaatcgtgggtgtaattttcatctataaaccaccctttcaacgtagactaacaatacgatgcatagttaaaattattatgtagttgtgaaacaagtagtaaaataccctaacgattttgattgtaccatcttttggcataaaatcatatacctttcatatattcacttaagataccttttgggatagtttacgatgatttcatcattaaaagtatcgtctttatgttatgtataatttatttagaaaatcataatacaactcatccaatacaaagttaccagatttatagttacattcgtattcccttgtaattaatctatgaattgagcttaaattggatgtatagcatccaagcaaccttaatgatattagggatggtatcgagtaaaattcaggctctatcgggaaatggatgtgctgtacctatatttgtagaaagtgaatggtcaattgattttaaccatccccggggtatatttattagagataaatttagaatatatcgtgattgcgctacttaaattccccgacatcggagaaaattgttcataagcctaaccatcataagcaaagtaacttcagtgtggagggagatgtgctgctgcattattaggtaatttaataggcgttttaggtgtaaactatccccccttattcaaattacatatcctaatatgtggttattaataaacaaataaacctagcatgcttacactaggcttgtgagtgtgtacgtagtgtacacatgattattattttatcctacttgtttctgttgctcatattcctttaccctacgataaaatgtgttaggcttcatttctacacgcttcattgcttcaactgctgttatgctcccgtccttccattccttataaaccgcaatgaagtcattacttattgcctgtttaggccgaccaaataccacaccattattttttgctgctgctataccttcagattgtctaccgtttatcttctcacgttcacgttctgccatgtagctgagtaattcaagcacaatactggatataactttctccaagccattatggtattgtctagtatcaaggataggcatatcaagaataacaatgtgtgcgcctatctcgtgcgtaatatcttgccattcacgtttgatttcttctgcattccgtccaagtctgtctagttccttgatgaacagaatgtcgccttttctaagtacactcttcaatgcttgatattgtggtctatcaaaattcttgccgcttttcttatcaataaagtaatctcgttccatgatacctaaaccttgcattgcttccaattgtctagcttcgttctgatctttcgtcgatactcttatgtaaccatagtgtctaatctcactcatatggatcatcctttgctatttcactgattatattatagcaaaagtatgtcaaaatgtatatgaacacatatgaaacatttcaaaatattttatatactatttgacatgtaccattaccacttatgacatataatagacctctattgcaaaaggtatactttatgac

SEQ ID NO: 2682 - DNA, 6596 bp, Unknown
  Kingdom: Bacteria, Phylum: Firmicutes, Class: Bacilli, Order: Bacillales, Family: Paenibacillaceae, Genus: Paenibacillus
tatcctaaaataaaacgcaaataagtttcggatccagttttcagggtgtaaccttgaaggtagaatttacgatgtaaattcatgtttggtggcgatagcggaggggttccacacgtacccatcccgaacacgaccgttaagccctccagcgccgatggtacttggaccgcagggtcctgggagagtaggacgtcgccaagcgatatccttcaaaggataatgaagttttgcatgttagggcctttagctcagctggttagagcgcacccctgataagggtgaggtcggtggttcgagtccactaaggcccaccacttccagaataacaaaaagattggggccatagctcagctgggagagcgcctgccttgcacgcaggaggtcagcggttcgatcccgcttggctccaccaatattccctgatagctcagttggtagagcactcgactgttaatcgagttgtcacaggttcgagtcctgttcggggagccatgttttgaatatttctgaattttatatataaggtggcggcgtagctcagctggctagagcgtacggttcatacccgtgaggtcgggggttcgatcccctctgccgctactcggagagatacccaagtggctataaggggaccctctgctaaggggttagactgcgaaagtggtgcgagggttcgaatccctctctctccgccataaatttattgaaaccagaacttattttgcaaggcccgttggtcaaggggttaagacacctccctttcacggaggtaacaggggttcgaatcccctacgggtcatattatggaggcttagctcagctgggagagcatctgccttacaagcagagggtcgggggttcgagcccctcagcctccaccataagaaaatttgagaagtgccttttaatgtcgcggggtggagcagttcggtagctcgtcgggctcataacccgaaggtcgtaggttcaaatcctacccccgcaattaatttcctgttggaaatgcctctggaactgtggtgtagaggcctaacatgcctgcctgtcacgcaggagatcgcgggttcgaatcccgtcagttccgccattttaacttcatatataattggcatataaagtgcggattatatgatgtagtaataaaaaaaatatggctcggtagctcagtcggtagagcagaggactgaaaatcctcgtgtcggcggttcgattccgtcccgagccacctttcaagtgggaaatgagtaatgtgccggtgtagctcaactggtagagcaactgacttgtaatcagtaggttgggggttcaagtcctctcgccggcaccattttggaggattagcgaagtggccaaacgcatcagactgtaaatctgctcccttacgggttcggtggttcgaatccatcatcctccaccagtctttttataatcatatggcggtcgtggcgaagtggttaacgcaccggactgtgactccggcattcgtgggttcaagccccatcggccgccctttattcttaatctattggggattagccaagcggtaaggcaacggactttgactccgtcatgcataggttcaaatcctatatccccagccattaagagccattagctcagttggtagagcacctgacttttaatcagggtgtcgaaggttcgagtccttcatggctcaccatttataattattttgcggtcgtggcggaattggcagacgcgcacggttcaggtccgtgtgggctaaccccccgtggaggttcgagtcctctcgaccgcaccatattttgcggacgtggctcagcggtagagcatcgccttgccaaggcgagggtcgcgggttcgattcccgtcgtccgctccattatccatacggcgccatagccaagtggtaaggcaaagctctgcaaaagcttcattccccagttcaaatctgggtggcgccttgactactcattatggaatttaatatgcgcccttagctcagctggatagagcgtttgactacgaatcaaaaggccgggagttcgaatctctcagggcgcgccatttcttaaaaaaaatgtataatgtcgggatgtagctcagcttggtagagcacctggtttgggaccagggggtcgcatgttcaaatcgtgtcatcccgatactgatttgcgggtgtagttcaatggtagaactccagccttccaagctggtagcgtgggttcgattcccatcacccgctttttgctatagcggattcttgttgcctcagtggtgacaccttataaataaagagagcctgtctggggacagagctctctcttttttttgtatttatcctcatgtaatccacaatgtgttgattatccataatcttcggtatcggtgtatatcgttctgatcatacaacaggcatacaccgataaccgatttagtggacagtttttacacgggaatggtcagctggatggaggttcccttgtctggagcagaggttatgctcataaatccccctacccctctagctcgttcttccatactgaacaatccaactccctctccttgggactttccagagaatccaatgccctcatcccgaatggtcacttgtatcatttcattttgatcctcaacgtcgacatatgcctctgctacatctgcgtatttggctacattcgttaatgcctcctgtacaatccgataaattgcaatttccttgcgaatatcaacccgtttacgtagattgcattgaaaatgcacctcaatcccgtaatgagaacagaagttttcaatataggttcttatggctgggacgacacccagatcatccagaactgagggacgaagttcccacgctagaccacgaacatctttgatgatgtcggtcacctgcgaacgaagattttccagagtagcactaggttgttcggcaagttggctatccaattggataataagtgaaaacaagctttgtcctatcccatcatgcagctctcttgaaaagcgtttacgttcttcttcctgtatttgcatgacttgcgtcatcatagactggagttctgcttctactttcttcagtttagtgacctcattgcggatcgctaagtactgatagggtttaccttcctcgtccataaacggaacgatcgtagtattcacccaatagtagctgttatctttagcacgattacgtatttctccttgccatacctcacctgaacggatcgtagtccacaggtttctcatgaaggcagaggtatgatagcctgaattaataagacgatgatcctgaccgatcagctcttcacgactgtattgcgaaatctcacagaacttgtcgtttacgtactgaataatacctcgatgatcggtcaaagcaacgatggaagacgtatctagagcaaatttcagattggataattggtggagtgagttacgcagcgcatgaagaaaaggggattctggtatataaatttccagatcattcagcagtttatcggttgattcaccaaaggcatgctgcagtaaagggttagaaggttcattcataatggagcagccccttttttagtgcgaatttgactagctcaggtcgtgttttcaagttaagcttctccataagattgcttttatgggactctacggttttgacgctaatcaccaggtgctcggcaatttccttgttggcatatcctttggctacccacgatagaatctctttttcccgctcagacaaggattcatagggtccggctatgccttcctgtttgattttgtccagatattcactcatcagtcgtttggttgcattcgggtacaaataggcactaccttcggccacagactggatggcagcgagtaactcctcgtgaggtgcgctttttaaaatatatccggatgctccagcctgaatggctcggaacagatattcttcatcgtcatgcatcgttaaaataaggacttctgtatcgggcaactgtttttttaattcagtggttgccgtgagaccatctttgccaggtggcatgctaaaatccatgagtacgacattaggttgtagctctactgctttacggatcgcctcatccccgtctgctgcatctcctacgaccttaataccatttttgccgtccaatagggccatgaggccagaacgtacgacaacatgatcatccactactagtatacgaatcaatttgtcatcccctcgaacggtaaaaaaaccgtgcgttttgtcataatcatagcaaattttagggatttcaatcaacaaagatagttagggacagccatatcaagtgttttatgagttttattatctacagtaacattgttgatctatggagtgagaaggtaagcacatagttggctaaggcgttgagcgacttgagtggcctcggccacatcagactctgtgaacgtcctcacatcacgattaccaagaagcagcacaccgttaggcagatcccctgtgctggaaaagggaatagcaacagcagagtgaagctgctcggccagcattagtgcacactcctgacgcagacgtatactacctgatagtaaagcacttacagtcacggtacgtcccaagcgaacagccatcccggcaataccatgaccaatcttaaaagaaataaggcgatagcgattgcttcggctgccggaggcgtaataccaatgcagtttaccacccgacttggacataaatgcaagggcagtgagatcaccataaatattatctctcaactggttcagttcttttcgcatttcatccgttatttgtagcatagaagacacatcctttttcataaccaactatatctctaattcattgtagttccgacagttacaaaagtagatcagggaaccccctgatctataggcgcaggaaacactgagttttcatgaggtcgggtaaggagtaaggaaaaggtcgataaatggggccttagcttacctcggaaagtgatatttatcacagtaaatcagggagtaggaaggtataaaatcaggtgttctcccgataacaacccaggcattaaaacattatgatatagatatcaggtaaacacgaggaggacgctaacatgcaagccacttgtatggaacggtttggggacgaagcggaacgcacgggaattcagatttatttgacagaagaacattttgttctgctaaaagatattatgtcctggaagaaggtaaaggcaggcgttatgcttttccgagaaggcgatgatgcagagcagctttattatatacattcaggtcatgttaaacttcgtaaatcgacagaagatggtaaagaactgattctgaccattcagcatcaaggcgacttaataggggaatttagcgggatagatggagaagagtatagttgcactgcggaaacagccgatgtgtgtgagttaggcgtcgtgcttgttaaggatctggagtcgctcttgtccaaaaatggggaaatggcacttcagttcatccagtggatggcgatgaagcaacgcattatgcaatcgcgttttcgggacttactgttgtatggtaaaactggagcgttagcatctacattgatccgtgctagcaatacatgtggcgtggctgtgaaggatggcattttactaaatatgaagctaagtcactccgaattaggtgagatgattggagcgacgcgagagagtgtgaaccggatgctgagcgcgctgaaagagcagggaaccctagatacaagggatggaaagattgtcattcacgatcttaaggtattacgtggcatgtgctgctgtccttcgtacggccaatgtgcccatgaaatttgtcgcctctaatatatgaataccattaggcggggtccaagagacttcgccttgctgcatgttttctaacaatctagtacatggggtaacgaacaacatagattataaaaaaactaatcaacgtcgtatagcggctaattaccaataaaatgtatttatattaaatggaactgaacacatgacattttatgaactagctgttttgaagtaacagtggagctaataatggttgactaaaaggtgggagggattttaaggttaaaaaaagggattatttacaagttgatttctattgctgaaaatgatatattatttgagctgacaacaaaacagcagtttcaaaagcgaaaagcttgggtgaaaatgatcctcaaaaaagaaaaaaaaataacccttgcatttttgaaacgaacatgatatgatcttatagctgatgaaaaaatgcggcgaaagagaaatgtttgatctttgaaaactgaacaacgagtgagtaaaacgattttgttcgcaaaatcaaacaagagatatttttatctcgtcagtttcaacatgagcttatcgctctttctataaaccaacttcggttggtctttaatggagagtttgatcctggctcaggacgaacgctggcggcgtgcctaatacatgcaagtcgagcggggttatgtagaagcttgcttctatataacctagcggcggacgggtgagtaacacgtaggcaacctgcccacaagacagggataactaccggaaacggtagctaatacccgatacatccttttcctgcatgggaga

SEQ ID NO: 2683 - DNA, 8124 bp, Unknown
  Kingdom: Bacteria, Phylum: Firmicutes, Class: Bacilli, Order: Bacillales, Family: Paenibacillaceae, Genus: Paenibacillus
ctagaacacaacgtgaaaaagatgtgaatacaaaacaaagtaaatacaatgagcagttagccctttatttccaagggatttttgaaattgaggagttgcctaaaggctcaaataaaccaagaaagcttgtgccaaaagaggacaagttcattatgatttagtaggacgagcattagatttaaccgtcataaatctaaaatataaaatataggtattaaatataaaaggggacaacttatgctagaaataaggcagagtacacaacaaatagttatagctgttattatgttcgcaggtattgttttattcttcgaacatcttagcaaaaggatcgagtatgtttgctaatgtgtttacaaatttattaagctcattagcaaataacttaatgcctgtgtttaattagcaatcactctaagccatccaataaggatgatttttaatttgtgttatttataaatcacttcagttctcccaaatccgacataacagccttaaaacgaacgtgagagtgtctaaggggatgatgggagatggatgtctgctatcgtttttaatatatttttcgataaactcaatttttttgtggtatattattcctattgttaacactatagacggaggaataaataaaattgaaagaaacaatctctgtaattgtagggctgatttcaatatttttattttggtatggtatctatctatttatcactaacagtaaagacagaagatattatggtttagcttatgttctaatttctgtgtttgcaatatatatacttacttcaattgataagagggaggggaacgatgaagggagcacgtattatagcaattgtactgaggctaggcttgcaggagtgacccccatttatcgaggtgaaagcggttatagaagttcattggatcgtgacaatgatggagtagcatgcgaatgattattcggaattataaaacaccaattttaccatccagttgcctccatattgacggtgactggattttttgtatccaaatgcgacgacgtcgacgcatttgagattattggatttcaccttgatattaagaagcagatgaacattagcccatctgaaataatggcggtcaaagcgaccgaccattggaccagcggtcaatgaaggatgtggctgagtcaattggagaaaacgaacgaactttgtggaatgttttacacaatgtaatgatgctataccgatacggaaaattttccggagggaccatagttgatagtatagtttaaataacgcaatgagtgtcatcaagtgtcacccaaagagaatatcaaattgtaatgtcgtcactattccatgtcaccaagtgacacgattcctactccgcgaaattgcggaaaactcctcccgaatgagggtgcaaaattgtgctgtctcacttttattcttcgctggacagaattgtccaatgtaacgatgtcgttacaacttgatgtctggtaaaaataaagttgtagattggtcgctggtattaagctaacgggtaggagagttccaaaggactgtctttacaaactcaacactatgttggtaaaattgaacaaatgcaatgatgagaagagtaggtaaggtgtacgtttacagagatctccggtagctgaaaaggagtaaaggagaccttattgaaccaaatctctgagcatcacatcggaacttgagccatttcaggggatggtgtgacaggagctcctgttacagagctagagtataagcatgtatatcatgccgtactcgataaggttaatctgaagacagattagcgaactggggtggcaccacgacgaaatctcgtccccaagacattgttcttggaggtgggattttttatttttgtttggtttttcaaagaattccaatttgtattgaaaatcatagggccttttcaagcggaacgaagtttaatgtaaaaaggagcaataaaatccaatgataaaagcttactggaaatatttattatacatccttaatcacaaactgaatgtcctaattgaatgttggaaggaaggcctgtatattcaggggattattcacgattggtcgaagttttcaccggctgagttctttccctacgcaaaaaaattttattccggaaaacctttgaacctagaagatgagttgaattggaaatacgcatggctccgacatcaacgtaaaaataagcaccattgggagtattgggttattaaccccaatacaaaagaggcattacccatgccaaagaggtatgtcatcgaaatggtatgtgattggcgttccttttcaaggagatgggggagaaaggtaaaagaatcatctctaaaccttactgatagtatagtggttcatcccgaaacgaaaagagaacttgagcttctgacatctcctcaacggacaggtaacccattacgctaacgggcaggataacgagaagaaaggaattaaccaaaatatgtcgaatacgattgattaagaaaatgaaaggggggtttactatgtggttttacagttacagaaaaccaataagaatccgtcacctccctcaatattaaaaaaattgaggaggattacaatgaaaataaatgatgaatatttgaaggaacaattaaagcatgtatattggttaaatggtggttgttgtgcagggaagtccacaatgacaaagaaatttgttaaagagttaggatttcaaacactggaagataacgtgatgaagtacagaccattcaccaatccagttgaataccctgccctacagtatcctcattcgggtttagattgggataaatggttcaataaacccaatgatgaacatgttcattggctttttcaaatagtcgaagagatgatgggattttttgttacggatttgttaaaaatgcctactgataaaccaatcattatagacttaggaattatgcccgagcgtatattaccctttattccaaaagaaagaatgatttgcctttatacttctgacgaagaaatagaaaggctatatttctttagagaagaccataagatgattttggatgttattaatcttacatcaaatccagcggcaacaatcgcaaatggcaataaaaacatggttagattttctcatgatataagaagcgcttgcattcgaaatggcatcaaaacactggaaagaacacccgaattgagtgttgaagaacagtttaaattagttcgtgagcattttggattatgagatgaaaaaaacaattatcgatttcattggtaggtaacacaatacatgctgctcttggttggcggcctgttgaactaacgggaaacgttagtttaataaaacagcagtagtttaggactttattctcttcggatacttgattcactcatcgtaaaattgcgttcaatcagggtacaaaaacaagcctagatgattaaatatgtctaggctctttgctatgtctatgtagttaatttaatagaatgtaggtttattcttctgtttcttctgctatatcgaacaaatcctctaagccgatacctaaataaccacaaatgttatccatcattgaggtagaaagacgagagctatcacccctctaaatattaatcaagtgtctagcaataggtgccttttttgttactatagacccattacccaagacatggtaaactattggtattatttgagaggtgggactgttttaaatgaactcgtgtattaattgcaataatccactagaagatgaaagtttattttgcaacaaatgcggagctaaacaaaaagatgatcggcagtttaacgataatcatgttgattcagtcgataattcagttattaaaaataaacggaaattatctaaaaaaattctatttatcactgcggctatctgtgtattgtttattgtgtcagttgttatctatttaaatactcctgaacaaaaggctagagcaacagtggacaattacttaaatgccatacaacatggtgagtctgtaagtaaatttaaaaatgaatattttactgattatgtaaatgtgttggatttcaaatatattaacactagagaacatttaagttatgacggtaagcaaactctcacccttgatgaagattggtacaacaaatatgagaaacaaaaattttctagctttatgggttttttgatagttaaggaagctgaatatagagaaaatacagattacactattctagagagtaatagtgaaaaattagttgtcagagacaataaagttggacattcattttccttcttatacgatatgcaagtaacaaacacctcaggtactcctatctataaaagggttgtatttgatgtcgacaacttctctggtaaatataaaatctctgatatcatagaaaagtactagtacgacacactataattactcttgcgatcttatattaactgatgcgggtagttgcttttccgtttgtttatactatttatagaaaatgaaatcgatttcgaaaatattaagctggatgaataagtaaaagcgcctgtaatgggcgtttttttggatttatttaaatatgaaacaaaattcttccttattattggtacattgtgctaatatactaggtatataataccaaaaggggttgtggaagagtgaaaaataaagtattagctagttcattcgccttagtattgattctttccagcgctacagcatatgctcatccgggtagaactgattcgaatggtgggcattattgtcgtactaactgtgctaagtgggggcttcaagacggggaatatcattatcataatggcggaggatcttcttcaagtagttcctcatcttcgagttcgagtaaatcgactcctaaaaagagcactgcaaagcctaaagcagcgaagccagcttataaagaatctggattaagagtttacgtgaacggaaataaattaagctttagtagcgagccattgatttatcagaatacaaacttggttcctcttcgtgagattgctgaaggtttgggtgctaccctgaactatgataataatagtggtaccattggcgtaactaaaggaactagcaaaatgacacttaccattggaagcaaaaaagtattttacaatggatcatctgaaacagtaagcgcagcacctaaagtaataaagggagttacatatgttcctgctcaggtttttgctagaggattaggtgcaggaattgaattagacagtattaataactctctaaaaataacatattagagccatgtaaataagctagagaagttttttgactaccttcaatacaccaaaaaaagtatcacagtttttagaaagttacataaaatttgtgatactttttcgcttgtatattgataatgagttgtaagtaaaacgatgattttataaggagagtgagatgctaatgagtactaacgataagttgtttgaacggcaagtcgataggaatctcaaaggaatcaaactcgaaagagaaggtaaaatggaggaagctattctgctgtatgaagctaacgtttctgaatgttttgaagggaatcatccttatgataggctgcgtactatttataataggctcaatcgatataaagatgtaatacgagtacttgaacaagcagtatatgtatttgatgcaaaggtcaataaactaagggctgatagactaccgaaactgactaagtttattgaccaactagaaaaagcgaagaataagtatagctaaatatgtatctcatggcatatagtcaactcatcaattttcaattattacgcatacttagtcaggagaaatcaaaatggcagagaagaagaaccaacattttgtacctcgattttatttaaagtatttttcatgcgaaggttcagggaagtatctaggcatttacaatatcccgaacaacaagaagattgccagaggcggattacagggacaagcatcgaaagattacttttatggaaaggatcttgaaatagaagatgctttggggaaaattgaatcagaagcatcaaagatttttaatgcaatgattataactggagaagttccgatgcatgaatcagtggctcattatattttgtatgtattcatattttcattatctgctagaaccgagcaagctggcgacagcgtaaatgaaatggcagataagatggcaaaagaagttttaaaacataatagagaaataaaaaaatatttagaaggaataagctttggctatgaccatcctactctgctttctatttcagcagcaatgcaaactctgccattaattgaagacttgaaatttaagtttttgtttaatggaactgatattccatttataacctcagatcatcctgttataaaatataatcaattttgtgagaaacgcaaaaaatttggtggtcatactggattagctactaaggggtttcaaatctttttcccaatgtttcctgatctatatattgtattgtatgattcagatgtttatcgacttggcaataagaaagatgaagtaataaatatagtaagcaaaaaagacgttcaatcattaaatctacttcaatttattaacgctcacagaaatatttattttaatgaaggctttaaaaacgaatatttagaggacttgaaaaaacgtggaagcaaattcagaaaggagttcctttcttcagttgttgaatacaaaagagccgatggattgcggcatgaatcattactgcatatgtattcaaatgatacaaagattggtcttaatctatctttcataaaagaagtaaaaaaggcaaaaaaatatgatttaggctccaaggtagttcattatcgagataaaagcaaagtggaaagtttcgagtcagaaataaagtctaaaaatttcaatgaaattagccttatacgaggagattaaactatgaatgataaaaaaattgtttccattggtatcgattataatcaacgtttgaaaaacaacaagggtaaggggtgcgttccatgcgaggtatcagaaagatacatattatttgatgatttagttcatgagaatggaatggtttttgctcaggtgagaaccacaaatgacgatgtagacagattgttgtgtgggttaacaataaaatatgatgatcttgtagctgctatagagaatatgaaaagatcgtaaaagaaaaataatacaaagacaggcgtttgaatcaaacgaaaatttctatatagtcgttacttaaacaaagaaattagaaagtattagtgaggttcaacttgttaaaggagagaaaaatggaaattatcacgaagtatttgcctgtagttggagccggttccttaattgcattaatcgttctattttttaaaggtatagccttaattaattcctctcacatcgaaaagttactgtataaaagtaacaaaaaatatgtagcaacaacattgagtattattctatattcctcaatctctacatttttatgtgtaagcatgagtgttatctttggtggaattaaaactataatagatctgaaggcggtattaataatctctttagttcttagtattgtagcctattcaattgtggccgtaattctttatcttatatctaagaagaaagaaagggtatattatattaaagaaaatctaaatggcacagatattgagctttacttattgaaaactactgatgagggctatattttattatctgatcaaccatatatttattctagcactggatttaaaatattaaagaaacaagaagacatacttaataagcagatttattcaaagatcatttcatagcaaacagaggtgaatactttaatatgagttcaaaccagcatcacacaatgacctacacactaaacagcggtattaaaggaactgccaatctatccaccaaacaaatacaggactggatagaatcttatcgtgtaggcagtaaatatgtaaccacagttggtaaagaatactttggattgaatcctgagcttgttgcagattttaaagtacataatgaatttagtgagcaaagggaacatgtaacagttattaagcaatccacagtagcaagtaaggccactgaacagttagcagatgcaaatacccagaacaaggtattgattcaggtagaatgtaaatgtggagcttcctatataga

SEQ ID NO: 2684 - DNA, 9503 bp, Unknown
  Kingdom: Bacteria, Phylum: Firmicutes, Class: Bacilli, Order: Bacillales, Family: Paenibacillaceae, Genus: Paenibacillus
gtgcaacggaacagacccagtttcaccaaagggccttcatctagacggatactgctttgaatttcgctggctttgttctccagcaaatgagcaaagtcagactcatttgtaaaatcaaccacttccaggctgtacagttctccttcttgcacgccacggttccatacttcatacccaccgtccgcattttggcggaatacgatgcgcaaagcatcatggtgctcgacaatgcgttgcagtgcctgatgaagcgccgtttcgtccaaacgatcctcacggtgcagcatcagagcctgattatagtgctcaggattggatggctgctgctcaatgaaccagtgttgaatcggtgtcaataccacgtttccactgacttctccttgatcggaaacgcgggtcacccgctgcacccgtccattcagctcagcaatcgtcggatactggaacagctctctcatttccagcttgtaaccattttgcaacagtcttgaagacacctggatggccttaatcgagtcgccccccagatggaaaaagttatccagcacaccaatatgctcgataccaagtacagattgccacacggacactagcgtccgttctacctcattacgggctgctacgtaatcctcaccggaatccacgctgccttccggttgcggcaacgcccgacgatccactttgccatttggtgtcaacggcaattgctccagctgcacaaaatatgacggtaccatgtaacccggcaattcttggctcaaggcgcttcgcagctcactagccgcgatatccgcaagggtgactacatatgcacagagctgcttttgcccctgctcatcctcacgtgcaatgacgacggcttcttgcaccgcttccagcttcaacagctgcgcttccacctcacccagctcgatccggtagccccgaattttcacctgtgcgtcgatccgtcctttgtattccagcgccccctcctcattccagcgcaccaaatcgcctgtgcggtagcagcgctctccgctgcggaacggactatctacgaacttttcagccgtcaaatccggacggttccggtagccacgtgccaccccgtcgccgccgacgatcaactctccccatgccccgacaggctgaagctgcatgaaacggtctacgacatacgctgtggagttgtggatcggacgcccaatcggcaccgcttccaattgcacgctggcaatcgcatgagttgtagaaaaagttgtattttctgtcggcccatagccgttaatgatccgcagggacggatgagcctccagcacccggttaatgtgcggtacggacagcacatcaccaccgaccagcagttcttgtaccccctcgaacagctccaagtcctgctgagatagctggttaaagagcggtgcagtcagccacattgtcgtgataccatggttacgcacggcttccttgagctttggagcgtccaaaatgacatcctgacttaccagcacgagctgtccaccatttagtagcgcaccccaaatttcgaaggtggacgcgtcaaagacaacggcgccagtttgcaaaatacgtgtatcagcatctaattgcgcatagtttgtacttttcaccaaacgtacaacattgcgatgttctaccataacccctttgggctgtccggttgtgcccgaagtgtacatcaaataagctagtccgtttccaaatttacgttcttgttcttcagcggtgctgtctacgacagacgaggatgattcatttaaaatctcatttttcagatttgtataatcggtataacccgcacgataagcctcattttgctcccaatgtacggtattcaagccttggttattctctgccccgtacaccttagcatcgctcagatcaagtacgattccggtgtattcctccggttgctgttctgcgcgctgcaccagcagcaacttcgcccccgaatcttccaacaggtaacgtacacgttcagccggataatcaggatcaatcggtacatatgcgccgcccgctttgagaatcgccaacatgccgacgatcatatccgtggaacgctcagcaacgatacctacagtttgctcggcggtaacaccgtgtccgcccaacgtgtgagccagtcgatttgcttttacattcagttcaccataagttaaacgggtatttccgaacacaactgctgtctgattcggtgtacgttcagcctgttcctcaaacaactcatgaatgcctgcttcgtgtggatattccaccgctgtagcattgaatacgtcgacgatttgcgcccgttcttcctcactgatcagcgacaattcctgtatccgcttgtgtgggccctgcaccatatgctccgccacactcaaaaattgtcgaataattcgagcaatttcctgttcactaaacagctcggtacgataatctaggtacagcacgagtctatcatcatccagcatttcaaccatgtgaatatcgaagtcgttcaccgtatctccgcagaaatcgttatctacctgctgaatcgcttcatcaaaccgggagaaactcaaggtacggtactgaatggaagcaccaaacagacgctgaatgtccaggttgctttgctgttcacgcaaatcctgaataattttgttgtacgggtaacgctgatgccgcaaaatggatgcctgctccttccctacaccttgcaggaaagtcaacagttcggattctggttcgactaacagacgcgtagccacagtgctgacgaacataccgatggtatctttttccttcttagacgtacggttggcataaagtgtccccacggttaagtcctgctcccccgtcactttatgcaaataaatatacagagccgccaggaagaacgtgaaaatactaattttatgttcctcgcaaaaagccgtaacaccacgatacaactcatgttccagtataaagctctcccggcgtgcagctgtgctcagtgtcagcgggttatatgatttcaaacctgtagtctctggcaaatcagcaaacttttccgtccagtacgttttgtccttttgataacggtctgattgctcatagctttgctctacctggataaaatccagatagggattgcccttggtcggcgtatcttgacctgtaccatgcacaatatccatataatgttcggtgatttcattaatggcctgattcatggacacgccgtctgagataatatgatgcattttaaaattaaaccaggtttcttctgctccgagctgcaagataacaaatcgatacagctgcgaatccaacaatgagaacggctgtggattatggcgctttaaccattcctttgcttcttccggggtaacttggagcgtttctatactttccgccgtaaacggctctacatattgatacggaatcccatcctgagcagtaattttgatacgaaaagaatcattttgggcaattacccggttcattgcttgctgcaaggcatctatacgaacagttcccctgatttttactgttgcaataattgttgatgtgttccgattaggatacagaagctccgtataccaaatccgttgctgtggctggcttagcgaaaacaattgaacatcttgctgtgtcatccgtctctctcctcgcaaaatagatattggtaaaaggaaattcgcatatttatgcggtttgttcctcgggatgctttcgaaattgaagctcatacagctctgcataatgaccgccctcggcaaggagctgatcatgggtaccctgctctttcagctcgccatcggcaaggacacagatcatatccgcccgttcaatcgtagacaatcgatgggcaataactaatgtcgtacgatccttcatcagctcatttaagccctgttggacttcatattccgattctgcatccaaagccgaggttgcttcatccaacagcaaaatcggtgcatttttgagcaaagcacgagcaattgcgatccgctgtctttgaccgccagacaaattggctccgcgttcaccgacaatcgtgtcgtacccctctggcagctcggctatgaagccgctggcataggctgttttggccgcagcctctacttcctcatccgtggcagtcggtgagccaaaacggatattatccgctactgtaccgtggaaaagcgtagcctcctgtggtacataggccatcaaatccctgacctcatccaacggaaattcttctgccaagcgaccacgaacccgcagtacaccttcgtccggtgggtaaaatcccaacaacagcttcatgactgtgcttttgccgccgccactcgggccgacaagcgcggttacctgtccttctggcacaaccaagtttaacctttgcagcgttggatggtcaggctgatagccaaaggtgatgtcgtgcagctccagcgcagccggagtctgttcaatggcatggtctgaacgcaaggtctcaacatcgccatagaattccccagattcacgggctgataaagctgccgtctcgggatcgataagcctagtcagcggtcccttctttttagccgcggggaactgctcttcttccttcgactcatccagaatttcgcggatacgcgccaagcctgccaaggagttttgtaacagtgttacagccgcccctagctccaaaaacaccgttgaaataccggtttgcagctgcacaatctgtcctagtactcccagttccatttgcttctgcgaaaccagaattaatccggcgacaagcacaccgcccagcgtaatgaactcaatgacaaaattgcacatatcctgcaagcccatatgacgtccctgccggatgctgatgcggtttatgtcctcgcttgcaacattacaaagtccgcctacctttgtcctcaacccaaacaacttcaccgtctgcaaaccggaaagcaaatcactcaatcgttccgtgaacctgctcatccgtccctgtaactcttcactcgtctttcgcattttcttggcgaaatgagcattgatccaggctgaagccagcccaagtaaaaccgccataatcccaaatcgccaatccagcgtcatcaaaatgaccaacgagcccaagaaaagcgaaatttccagtataatcgagcggatatgaacggtgtaagcctgctccagcgtctgtacatcgttcgtcatgcgggatacaagatcacccgaatggtgtttttcggctttttcgtacgatagcttgacaatgtgaccaaatagtttcgttcgtacattggcaatcgccagctttacacaccgtttatacatatagctgcacaggggggaaataagacttaatgccaaaaatgtaccactgaccaaatagaccgctcggtatagctcctgtacatcgccattaaccgcgaaattcagcaaataatgcaccacaaaagaaagtaaaatcgtgatgctagcattggtcagactattgccaaccagcccggtaaaataccattttcggtgcggcttcatcagggacatcaactgcttaaattcataaaacccctgcttgaaggtcacgacgctcacccctttcctcaggcaacgaaaacccgttttccgccgtatgctgttcttcttcaaaatttttcaaatacagctttcggtacacaccatcacgacctagtaattcctcatgagaacccgattccacaatgctcccctgatcgagtacaataatgcggttcgcctgacgtacggttgacagtcgatgagcaatgaccagtaccgtccggttttgcattaccgcattcatcgcattctgcacctgagcctccgactgactatcgagtgctgaagtcggctcgtccaatagaagcagcggagcatttttcagtaatgctcttgctatggaaatacgctgtttttgaccgccagacaatccgcctccccgctcgctcaacagggtttcatagccctcgggaagttgaacaataaaatcatgcgcatgtgccgctttcgccgcctcgacaatttcttcccgagtcgccgctaaacgtccatatccgatattttctgcaatggtggccggaaaaagcgacggctcctgagataccatcgaaatatgactgcgcaggcttgttaaattccaatctgtcaaactctttccaaatagttgaatggttccagcatgctctccaggttcattaaatccgcaaagcagcttgaaaatcgtgctcttacctccaccgctggcaccgacaatcgccaccatatccccttgccctgcctggaagctgatatccttcagcactgtgttcccttcatcgtagccaaaggtcaaatgctcaaagctgactacagcaacactatcaacgtcatcatcactttctgctccgccttcactcattcggttggcttccccatttgcttcgtcttttacatgaggcgcctcattctctcgcttctgatctaccaaggtcatttcgccatcctgacgttcattctgccaatccagtacctcaaacaaatgctttgcggctccacccgcttccttcatttgcgaaatgatcgtcggcagcatggcaatcggctgcaatatgaacgaaatcaggtataaaaaaagtacaatgcctccagcattcagctctccatgttgtatcaggtatcctccgtatacaatgactaaaataatcggtgttgctagcatcatcacacctaccggagtaatggctgcatagcgcttttctagccgtaagccgcgcttgacgacctcctccataatcaccatatacttcttcaacagcacagcttgcatattgaatgccttgacgatagggattcctccgattgcatcttgccccacagcgttcaaatgagcaattttctcctgaagatccgcggaatatttttcaatcggcttgctcattagcgatgttatgatcattcctattggcatgagcgcaagacttgccaatatcagtttccagcttgtcagtaaaagcaatatgagtgatgccgtaaacacaagcggtaaataaaacagattggcaaactgctggataaaaaagttctgtaatactgccgtattattggttagacgggataccaaatctccggtaaatttcctttccacgctggaaactggtaaatcgcaaaacttatgtacgagatcccctctcaagtcgcgcagagcactaacactaaatcgcgctgaagcgtacctcatcacaaacttacagggcattccaattagcgtcataccaacaaccagatagatcatgttctgggtagaggagaatgtcccctgtgccatttgttcaatggccttacccaaaacaatgtcaatagctgccaaacacaaggaggcgatcaccgttatgaaaacccatagattatacggccttacataacgtgcgagtctccgaaatgcagaatttaatcgaaacaagggcatccctcttttcgttgcccacactttatcagtgcgaactttttatattggctgtggacgtcgttgagataaactctgagtttggatgcatgagtatccgtgcagaataaaatacgattttgaactatgctggaatttgcatcttggtgtgggttggttgttgattgttgctgagatggtaataacgaagtgtatcgtgatgtgtgggacattcaactctgtctgaatcgtggttgtagggtgcttgtgttgtaagctgtatgagctgcctccgcgtggcccatcggcgaggatgtagaaagaatgttctcgactgcgctcataacctcttgttcttgttcatggatgaaaaagtgattacctgcgaacatctgaacatccataggtgatgtcgtatgttgttgccaggcatggagtgaatctgtgctaacctcaaaatccttcattcctcctaaaacggtcatcgggcataccagtggatttcccggctgataaacataagtttcacataccttaaaatctgcacgcagacgaggcataataatttgcatcaattctgcattttgcagcacctcttcaggggttccctgcattaaacgaagctcttccgtgaaagaatcgtctgctaaatcatggagtcgttttttggagtatggaagatgtggtgcggatttaccagatatgatgatatgcacaggtagctttccagttttgctgtacaactgtcgtgctgtttcaaatgcaatcagtgcccccatactgtgcccaaaaaaagcgaacggcttatgcatgtatggagccattgcgggaaccaacgattgaacgatgtcttgaagagtatccattggagcttctgttgaacggctttcacgtcctggaagttgtataggcagaacggtaatgtcaggcgcaaatctggacttccaagagttaaatatgtaagcaccaccaccggcgtaggggaagcaaaatagttggagcttcgcagtcggttggacctctgttttcgcgaaccaagattgcgatcgagtcgtcatatgaattcctccatcctctatgcagttcataattttacagtaaatccttatatctcttttttccttccaacactttctaactgtttttaaatatacaaactttaaaaccacttggcatgggaaaaaagggctaaatcgatagagctcataaaaataaaacaaaatccatattatgttatttgtttccaaacttcaaaagcaacaatttcactttttgtattagttatctgtcaatcatgatctgttaatttagtttaaaacaaaattttagattttcatgaattttgtaaaactaaactcattatgatttacattgaagctccacccccttatcctacaacaattttatctttacatgccattaacataaatgtaacaaattcaacctgatatcatccgacaaattccgcctttttccgcaactctctttaaactcctaaatagtggattgaatttgtatcaagctcacataagccaaaattaataactctttaattttgtaataaatattgttatttcatagtcctaaaggaccatattttgcatatttttttctgactcttcgtctaaaaaattcagttcggattgagtttttctctcccaaagctatgaattttcttttcaaactctaatagaagcgtttctatctcgattcaaaagtacctgttctctagaaatttatagccttacttttaatctttcagtaacggcaaacagcaaggctccctgttgttggagcttgctgttttataaatttcattatgtttgacttcactatcggtcgttatgcagagcgttgtaagctttattgtagttatcccccaatcttattaatttagtgggatggagtatatgtatgggtttcttgtataatttccaaaacgcgaaagccttatggtatacaaaaagagcacagcccattaaggctgtgctcttttatcttgcttggcggcgtcctactctcccaggaccctgcggtccaagtaccatcggcgctggagggcttaacggtcgtgttcgggatgggtacgtgtggaacccctccgctatcgccaccaaac

SEQ ID NO: 2685 - DNA, 777 bp, Unknown
  Kingdom: Bacteria, Phylum: Firmicutes, Class: Bacilli, Order: Bacillales, Family: Paenibacillaceae, Genus: Paenibacillus
acgggggtcagttccgtgggattgaaggtttcttttttattcccttatattcatttggatatagttttaataatcaccatgcattccgttctctcagggaagtaatatgagctgtgtgatgcttgccatgccaggcatagatgccgatgtttcgttccaggcggatcgtctggcccgattcaggatgaataaatgttcggtgtagctgatcctctcccaacgatcgtaacacggtcacccaccgttcatgcagtccttccagcaattgcaacgaaggttcaagtggaagctccctggcgtctggtatttcggcccaacgcccctcatcatatggcttgatcgtcggcgtatcctccgtcagtgccagcttaaaacggatatagctgttcatatggctatctcccacatgatgaactacctgccgaatcgtccagcccccttcgcgataaggcgtattgagctgctgctcattcagtccttcgaccgcctgacgcagctgtgcaggcaattcagcaatgtcgtgaatccatgcgataagctgttcttctgtaatggtatctggaacaacgaatgatcctatcggatagcgcaagtctttgtccaaaacagttcccgcccttctctacatttactgcctgtaatgtcagttgccttatgttataactatgcaggaaaaaaagcagactcgcaagagtctgctcaggctgtcgagaaagtctcgacagcttttttatgttgattttgtttaagacgacaccgcgttaatgttgtataata

SEQ ID NO: 2686 - DNA, 15140 bp, Unknown
  Kingdom: Bacteria, Phylum: Firmicutes, Class: Bacilli, Order: Bacillales, Family: Paenibacillaceae, Genus: Paenibacillus
gtgaatatgaaggggatggttatttgacaattggattagttgatactataatgtctgacattttcatagtcaaaagtttaattaaaaattattcataatagccgattctaatccgtccaaaagacggtttttttattgttttaatatacaaaaataaataaatatattgaagtaatgacttgtttgtgctataataagtacataaagaacaagagattaacgaggtgaaaacacaatgagtcaaacaaaattagcagtattaaagagccagtggcaacgtaagcaagcgttaaaaggtcaaactgtgtatggtcacttgatattaagataattcctcattcctcattcttcaaaaataaataaaaattataaaggtggttaatcaaatgaagaacataaatagtatgaacatggcagaaaaattagactggctttctgaatctctagcaaccgttattacaaatgttgcatatacttcatggaaacacttaagtgatgaacaaaaagagctggtaaaagtggcatttcatgaagatttgaaatctaacaacattgatgttaccgacgaacttattaaagcagtaaaagcggagttcacaggatctcctatggcttcaatgcttgtcgaatacataagtaagtttgcaaaggtaacgaaacagcttaaatcggagtccaaagcaacaatcattaaatttaatgaattcggtttccctgtagttcttcatacagttattaaagggttcgaaattgaaccttacgcacaatacaatgattctcttgtaattgagcataagccaaaacaaaaaagaaaagtatgggaaacaagggttttaccatatgaggaattaatgatatatgacggatggattgaaattgacactgacaaagcaatacacaatataattaattcagatgagtatgtgacaattaaacagtctagatataaatgttttgataagaattttctgagtgatataaaaggtttaattaatcaacaacctttaataatagtataaataaatcagatttctatatacaaaaataattaaatgtgttataattaatgtataaagaagaagaggtgattcggatgtattatggtgacaagagagaggcaaaagtaaacattgctatggagctggttgaaaaaggttggaagatttatggatggaaaaatgatgaatctgatgcaatgacggattattatagtcctgctgattgggatggagttgccgagaaaaatggatatgtattatgtattgatcaaaatagtttgcgttatagcggattggagagaaaagaatacataggcggtaacgccacatataagtcaaatgcacgtattcaaaaactggaagcaatgatgaatgatgaggcttcaacagaaaatgaaaaagcttcatgtgctgtactgattgagaaggaaagagaaaaagacgcttctgttcaaaagtgggcagtaactgagacgtatcctaaattctcttttgctaatccacgtggtacaagctggcacattgaaaaagatggtcaaataattgcgaagggtaaaggtgtattcgcagtcaatgactatgattgggagaacaaagagaagacagagaagcagcaaaaagctgagaaagtagaagcattaatcaatagatttgaaaaagttattaaggatactgatgcattgcaagcagaagtaattcaggtgcctgttacagtcacaaaagaaattgaaaagacagttactgaggtaacagaaagtgatattaaagatgggttcacttttattatgaaagttggatatacacatggtaagtacaaaggaaatagatataccttttcctataaaggtgaacactataacgcatttgcacaattaaacaaaaataataaaccatctacgatcatgggaaaatcatggagtcttacagttgacagaataaatgaattacttaaaaagggacacattgcagtaattgaatttgttgaagtgacagaatataaagaaaaaacagtatatagaaagacagcaagaaaacaaactgtttctaatgttccagctattgaaaccacagaagaagcacaagaaacagtaaataacaacacagaagaaaacaaagttgaagaaccagctacaactagacaactatgggcattacattgcgctaccaaacttgacactagaggaatgaaaattagcaaaacaaaagcgtccgaattgattacaaagtcaaaagcaggacataacattatattagaagtaaaggcgtatatgaacactaatgaaacaattgcaccagataaagaaaatggattaaatggtaaatcaggagaggtaacggaaacaaacaaatataacgaatcacaaacctatgaaagcattgatattgaagatctggatcagtataccgtttctgatgaacttcaagcgcgcttacattcttccagtatgtttcaagtggattataaaaaagactgctataatacctttttagagattcaggaaatagctaagaagacaattgatgaaacaaatgatacatctattcagtaccagattaaaaaataccttcagtcatttaaaaaacgatactatgaaaaatacatcaagattttaagtcatcgtgtaaataatccatcatgggccgtcactggtcgtggagggctgaacgtcagacgctataacaaaatgcaagacagatatgggaatatgttgggtgagttttcagagatgagacaaggattcgaaaataaaatgaacagatttagggattcaattagacaagtagagcaagataaaattaagaaagcagtaaataatgttacgactactctagaatttaaagtagaacaaaaggaaattaatgttgctgggtacaaagagaaagtaagaacatataactataaaaattatatgatagcaaaatcatggggaatgtttcgggtgtttaaggatagaaaagagatagaaaccacacttaagacaacaagcagattagatgaagctaagcaatttgtcacttatttagttggaaaagaagagcaggtaacagatgaagcaataaataacagcgatgataaaagacgaattttacaagaagaatcagaaagtaaaaatagcaatcagcagcaatatattagcaagatgaataagcaaatcgagtcagcacaaaagaaagtgaatgccttgtctggtgattatttaactaacacatggaaacgccagcaagaagcagcaagcagagaagagaaaaaagataatttaaacttagaaattaagattttggagcatttaaaagaaaaggcaattagcaacacaatggacgaattcgacatagttttattggtaggtagctttagagaagatatgagaattaaatataaatcaagaggtaaaaacaattatgaagtaaaatatccgactattaatccagatgccgatgttaacggttggtggaatcaagaggttccgaaattgcagaagcgcttgaacaaagcagggatacacaatacagagcaatacaatgaagcaatagataaatatgctgcacttgtaaaagctatagaaagaccagtcaatccagtacaacagaagattaagaaaatggaaagtgaagttaagctcagtaaaattgatggatactttccgacacctaaagctattgtacaacgtatgattgacttggctgatatacgagatggtgaaaccattttagagccaagcgcaggcaatgggaatattttagacggtgtaaatgagtatatacaagacaatgacctaagtgcagaattacacggtatagaatggaattattcgctacgtcagattcttgagttaaagcagtataagttagtttctaatgattttatagaatttgttccatttaccaagtatgacaaagtaattatgaacccaccttttgagaaagggaaagatgttgatcacgtattaaaagcatacgactgtcttaaggatgggggaaggctcatcgctattatgtcgccacattggacatttgctagtgattctaagagtattcattttcgtaactggctaaatgacaagggttattatgagaagttaccagaaggttcgtttaaggagtcgggaactggagtcaatacagtattagttgttattgaaaaatctgaagaagagacagcaagagcaaattaggtgatctagcattttagagggaagttggtgatgacatgagaaagaagaaggctaagaaaaagccatctagtgtatcgcggctatattggagttatttagtgggtaaattagatccatcagaattaactccaaagcaatttaatcaaatagtactggagcaatacatacagtataagcagcgtggaggatataagtcgtttgaggagtactaccagtatattaagtctaaagggttataaaactgatattttactgaaatttataggggaattatgtacaaattcaatatacaaaaataaataaactattgaatataatgaaatatcgtgatataataaacacataagataagttaatacataggaggcggttcacaatggaatgggattatgagcgctctgaaagaattaaagcggctaaacaggagagacttgaacaagagaagtgcgcgaaatatacagaggtcaaacttgagggaacagcagctattcaaacaggatatactaagctcggtaaaaaagttgtatttgaatcttgtatggggttttcgtctcaaagcaagtacggtgctggcactttgagtgtttatgaaggagacgaaagaaaaatagttttcacaaaaggatatccatctaaagctcttgattatatgatgaaacattaaaaaacaattgaaacatggtattgtgcaagtaacaatgtactgtaacgatcttaaattttcattatatggcggcggccttacgcgggaggtatcggatatgagcgaggatatgagaattaaattatctcacatgggtattaattttaacaatacactcaaaaaatgtgagggcaaagattatgactaccgccttttcatagctatgtacaaaaacttagttgatgcagtagaagagttttacagattggaagctaaaaactcaataattcacgtagctttcaatgatatgtatgctaaaaagttcgacgaattaagggacctagaaaaatcgctgaaagatcgaggcatgatctaaaacggggctacgacccctctatcgtttatatgtcagacaaataggactttgtaaaatactcattttatctaaacccaataagaaggagggtaaaagaaaatgattaaaaaaggtgacgctgttaaggtcgtatggggtatatacaagggcttagaggcaactgtaacctacatagatgggaaaaatattactgtgctgctggctcttgggtttgaagatcaactaagtatagatcatgttgaaaaagttgaaatacaaaatctcgttgttgtgcgtgttggtaatggaactaaaacgcatgttgcaaaagttttcgatagtgggtttttatcagtaggatgtggcgcaaagaggttaggtggatcgcttaccagaaaagtatcagatatagtgacatctaattcaataacatgcgaaaaatgtctagaaagatttaatcttaataaatgagtgattttatacaaataaaaagatatggagttgattcaaatatgaatggattattttcaattgtcaccgtattcccgaatggaggaatgaaaatggctggcttttcgaaagaaatagcagctttaaaagaggcttataagcttctgtgcacaataaaagaaaacaatgtaaaggatatacatgtttttctttcagaacctgaatacgacaccaagagaaacgtaataacaggtgatttaataaataaagaatctttaatcttattcaaaggcaactcatattcacctagtagtattcgtgatatgcacattccaaaaacaattgcatattttcaagaagtatacgaagagttgctaaacaggtacaacataaaaaaagaaagaggattttcaagtgaatatgacttggatgaaatacaaacatataaaatggtgttatctgcaatgggtagcaattaactttaaataaaattcttgttttacttaaaagtaactgtatgaatattcaattttagaagtataacactcgcatttgatgatatttttatccattatactgcatatttataaaaaacttatgataggagaatgaaaataatgaagattgataaattggtgaatcaaattactaagaagcttgattctgaaggattgtattatgaagtgtcaggtgatcaatatacattcgttatctctcctacatgtacaatacatactgatcattgcacaattgagatccataagaatagtattacggttaatgagcagcctgtagcagatattgaagaaatgatggaagaagtcatggaaattgaaggtggagtgtttatcaaaaagaatataattaaagtaagtaacaattttgtataaaaccgtttttcatattcagtgagattatatttttttacaaagtttccaatgtataatccctttccaagtggtataataaggaaaagagaaggaggtacttataatgagttttgtttctatagtcgcatgtgaagattttctatctgttgttgctgacactagggcgtacaacactatcaccaacgagattgactccgaaaacgaaatcaaacttcatcaaatcggagacaaaatcttttatagtaatactgggtatattgatccagctaatgaatttatttatctttctagcttaaaggaagaaattgtatcaaatggactcctaaaaggggaagatgaaattagaacatggtatattaaaatcaagcctcttataaacagtaatcaattctttgaaataaaattcggtgggcgttctgtaaataatacatttgaggtttatttaatcagcagtaatgaagaggatataaagaaaattaactacagtaagggcggaataggatactttctagcaggcgcttccaatatggacaaagagttggtaaaaaggtattttgcagagagatataccaacctaagagtagagagtctttcggcaattcgaagcattcaagaatctcttaacgattatgttgctgacaacgatccttctgttaataaaattaaaacatattttgcattagaaaagtagtatctaaaacttgagatcggggtaaaatgttactttgatcagaaaaagaagcgctgagaaaatacctcaaacgcttctttttttattaactatgccaattgttatacagcacccttgataatatataaagcacaattaatataccaagtactattcctacaattgaatatattttttttcttctcattgtaaaatcctttaattatgactttgaaaatgatgatccgtaagtaccatcggtaaagccccaaatcgtatgtgtgccaactcctactactgccccaagcgaagaatgtataaagttccaagtgaagtaagcagtttcgtaagctctgctcttatctgaattaatgtatggtttatcttcttttatgctgatatttacaacagggaaccagtttctagtaactaatccaccaccatttagtatttcagttattttgcctccactaactctgtactgtacatacacttgagttgtaattatattgacgcccaatgttgaagccacagtttcagcgtaaggtttataaactgtagcaaaaggagtaatggcgtgttctggttccttttggtttaccctcacttttatatctccattgtataggtctacattttcgccattttgcattgcattaaaaatagctttaattgcttcaggattgttcatgtaatcaacaaatttctgttgatcttcttttgagagactttggaactgctctagaacaacagatgaatcattatcattctgcgcgcttagacctttattattggactttagatagttaatatagtcctctggggtgttaatggttgaatcctgtgcgttaaccgagtaaggaagaacacctaaaaataataccaacacaacaaacaaacttagcaactttttcactttattaatcactccttagtaataatagtaaaacaaaaccatttggtaccttcttatggatttgatttacaaggaatatcctaccatgtgctaaataaattatcaaaaatcaagagagggtatcaaaaacaaaaccaatataaaaaaataattaattattgacaatatataaattggatgttactattgttttatcagctattaaagatttttttaaaggaggcgaccgcatgactttgagagaaaggacgcttcaattaatttgtgacaaaggaattaagaagtgttttattgctagtaaattgtctataagcaactcgctattttcgttatttatcaatggaaaacaaccccttcaaaaaactgaaataattaaactggaagaattaattgagtcttacaaataataagataccaaaggagaaatgaaaacatgggagctatttcaactttacattcggaagtatttattgaagatcaaaaaactagagatcaatacatagaaaaaacttatgtgcttgataaagttaaaaaattatcaatgttgccagataacaaacatatgactgttaaggaggtagctgcatattatgaagtaggctacactattattggtaatacattagctcggcacaagagagaatttgaaaatgatggtgttcacacaatcactaataaagatgatgcttttcacaagatgagaaaagcctttagtagcaatcaattcatagtaaaacttataccaagaaaagcaattttaagaattggaatgttattaagagatagcgaagtggcaattaaggtaagagattatttactaagaattgaagagacatcgactaatgaacaaaagagaaatgtttggtctgatgacgatgtaataaaattaaatgatatattgaaagatgaaaaaagtaaggggaatagtaaatggggagctatcaggaaagctgccaaggtattcaataaaaatcctcacgctgtctaccagaaatatctttacgtaactaagaaacatggttctttggacgaatatataaataaaaataatttgttgtttttgaataaggaatctgaagaaattcataatggagaagttgaagtaaatgaccagactcctaaacaagaaatagagcataatataacagtaggtgcgttccagaccaaaataaatagaatgttagaaagtatgaagaatacttatgagttagaggcaacaattaacgaattgaggttggaaataaaagaccttaagcataaattagaaattagagatttagaaatagcgacgtttgatgaaaatacagcaaagaaagataaaattataagtaagctcaaaaaagacaaactaactcttgaagccagtgttaaagcaatccgtaagatagttctaagcggtgtaaagccgagcagcagtgaagaatataataagcctgatgggcttatctatacacatgataagagtggtattgtagagttgaaaaactaataagttagaaggaaactgggtgaacatggctcagttttttcttttattcattcaatatataaaaataaataaatattgtaatataatagacggtatggtataattaactcaacaaaaaggaaacggtgtattgtaaccagcaacagcgtattgttaaggggtaaaacaacgattttattagaaatgtgtgagtaatgtgggagcaaataaggagaagcaaaatataagatataaagcagtatctcgtagaattgacaagaaagttcgatttgatggctttacaccagaagaagtaaaaatcataaagttgcagaagaattatgaacgctttgaaaaagaaataaataatttctgggcaactgccccaagatacgatagcggatcagtagcttgggaaagacttagtgaagatgaattaaatctctttgaatatattgataagcaaaaagaaaagtattataaacaaatcgttaagtatgaagaacagggctttgtcatagatgagattatgaatatgtttatgaagcttaatgtgcagagtgtttcttattaaataaaaacagtatttcattctaaaactgaggagattgatttatgaaaccatttgaacgtattgaatttcacccaacgccttacaattccattcgtgtgtggatgtactataacgaagatgaagatattacaagtaaaaacgttcgaggaacgaaagagtttgatttatttcaagcactatcgatttggggcggctacgataaagtagaattcgggctttactcttgggaactttcaaaatcattagtaacatatatcaaagagaggtttggtcatcgctcagattcaattattaagtttcagtgaaagcaggattttaaaaggggtgatttgcagtgaagggtacatataaaaatagtgagtactttggaaagattattcgttactcggatgataagtcttgttttatgtgtgaaaactcgtttgaattaaatgatggtgatactgttgaaggatatattgataatcataggatgtttatagtcgagagaaaactttgaataaaacagttattttacaaggaggcgagaaaagaaatgcctaaatggtataatgacccatattgtattttcgccttctgtgttgcgactctgattgttattgtagtgatgatgtttaaatatgttttttaatagaggagacgaagagatggatttgaatagaacattattacatatgggatatggtattgattctttaggctattaaaaacatcgagaacgaaaagcaagagttgatgttggatattgcaattgagttatcctccacattatggaagtcaaataaattagataaatttgatctgatttcttttattgatagtactgttgatgactttatagatgcattgtatgacgaattcgagattaattccgatatatcaagaacagaatttatatatgtttggtataaagataaaattcataagaacttgaaataagaagtgctcaacaggagggaaatacatgaaagtgtttgtagtacttgaggatgcagaagaagcgtatgtcttcagcgtcaatggggttttggtggatatttttctaagtgaagaagcagcaaaggcattttgtgatgaaaacaatcgagatagaccttattcagaatattactatgaagaacgagaagcgcgtaaaagttgaattttacaatgtaaaaatacataaggagtgacaagtttatgaacccacaagctatgcaagaggctatgacgttaatggaaaaggcaaggaagtatgacgaattaatcacttttccagaaagagactgtgatttgcgttgctcattttgtggtaagggtcaatctgaagtagataaaatggtgacagcgaagaatgtctgtatttgcaatgaatgtattggagtgtgtgtagaaattattgctgaagatgagaatgaagaaactaaataagtagtttcatgacagcttggtataaataaaaaatgatgtgaggatggaaaattaatttcccgtccaagacacaaggcagattgaaatagaggggaaaattgcacatcccctctgtttaagtgaatatgttattttacattgattctgtataaaatagtatctccactaggcaagtcggctactactgtacaaacaccttttttgagaccaattaccaatccttgctggtctaaatatatactactatcatctccactaacccaaaaattcgaaccacctaaataacgttgttcacctacatttaaatcaatagttactacatagtcatctgttggagttattacattggaagttcctgacgggtcagtactaggacttggcacagtagtactagctgcaaaagatgtagagccaagagtgaagcatgctacgacagttagcagaccaaccataatcttctttttcatcgttatcatcctttcataattggaatacaattctattatatagaatatatatccatatgtaaacattatatggggtataaaaggcaggatttgatattactcatttgaaaaacttgttaatttgaaaagtaacatttcaaagaaaagaatcgataaaagattaatttgaccaagatcgcttaggcggtcttttttgttaaacaaataaatataatgaaatacgaaaaatctatatacaaaaataattaaatgatatataataaacacatagaggaagacgatacatatgaggtgataagcatgtacaaggtaacagtgtttgagaaggtattgggtaaatttgaggcgaatatgtattcgttcgatgattaaatttgctgcattgtgtgaaaatgaaggtgcaatggttgtcatgagcattggtttaaaacaaatcgagtaaaactatatttttataaggagttgtttaggagtgaaattacgcaacaagttaattaaaacagttactcttgacagtcaactaaaaagcaaaatttctttatatgcaaactacattgaacccgatattaatctgaccagatacgtaatgaccgacataaacgatattgtaatttataatcaagaagatgttgaaagttatgttcaagcaggtttcattatttttggcgctgctgattcggaggtagatcttcaagaaattattgcaagagcagaattatcatgagatttagtgaaatgatccttttatttttaacgatacgaaatggacaggaaagtggaatgtataattattggaaattcgaaaaaaataatcccgtatctaaattatttattttggagggattaaattgagtatggagttactttttgaccaacaattttcaagaacaaatgccgtgaattgtgattgttctcaagcagaacagagtggttttatcaaagttctcgtaacaggagaaatcgcctcagaaggagtggatagacgcttattgttgcgtctgaatggtgctagtagtggctataagagctttgctcgatttggaaacgaaggtgaatggggggatgatagtggtctgtacgttgggagaagcgcttggaatacagatggtacgttttctttagattacaatataggttactattctggtgcacagaaaattactggaagcggcttatgcgtctttgcttcaagcaatgatttagttggctttgagactcacggttatatggtcggtaatggtccagttagaactatcgatgttttaattgccggagggatggccaatggccacgtaaagatttataagctgtaagtagtatttactgtttgttaaccctttgtgtttttgaaggtgagacgaagggttaacaaactggtaactagatcggattaacaaaatgaatattttaaaggaagatagagttaggagtgatacaaatagctgatatggagaaaatgatgaaattggcaaaagagcaagggataaaagttacagagaatagcgatcagccgggtttctttgtaactaaagatggagttaagaaaagggttggcactaaagagttactcagcatttgttttgatcttgaaagccagtaaaaagattatttcatagggagatgagtttttatgggtaaagaatttttgagttacgaggaacaatttaaagaggttctaaataatgaagaaatagatcgtattgaaaatagagaacttagagaaattagaatgaagtattggcatttacagcggaatgcctttcttgatgaagctaatataccggatcaagagttaggtgaaatttcagacagtttgaaacgaaaagaaatggaagaaatacagcgattcaggaacagagagtagtggattgttttaaatgatttaatgaggaggtgattacatttggacaatatcaaattaagtggcagaatcatttcccaaaatagtggggctgaagcaagcttaataattcctatgggtaaatataatatcatggttgtttctgatgacagttgtggtgaagggaaagggaaggtcgtaaggagctatttatttgtatatagtgatttgccgagtaacaacataaatgaaaaagtctttggttatcagaatgtgacagcagatacggaaacacttttcgaggctatgcagttttgtcaacgacaattaaaaaagtctgtgtaaaaggattctttcgtaaggagcaaataagcatgaatgtggttaaaataaaagagaagtaagtccattatggagataatgcattgatctacaaagttgatacaccagaggatgcaactcaacttcacacattaaaaatcaccaaagtgtttatgaaggaagttaaacgaaaaaactatgcagacgtaagaaatcaaatgaaagaaatatttatcatgaaaatgataaaggcgctcatataagcgcccaaaagcaatctcatctgatatcagtttgttacagtaacttagaatccataaaaggataatgagatatcaatgaaaccagaccatgttttatttttatctgggtttcttagtagcccaaaaacataaataaataactcttggttatcagggttccactcttcaattcttgcgcaagctgtaatttgttgcaacattcttggttctactccatcgtgtttaagatcaaatccaacaacatcgactgtgataaatttaaagtcttcgctttttagagtagtcaattcttgagggacaatttgataatctaacccattgaggcttttaaaatccactctaaagtataattttttataaaggataaatcgtagtgctgaattctgatcaacacttgagtgatatgcgtaatttatatacttttcagggttaggttgggccgtgttgttaatttttattgttaaatctttagccattttattgtcaccttcctaaagttttattgtattaattaatttgtatatttgaaggtgattttatactggaataaattgcgataaaataagtcttttaggagaaatagcatgaaataaaagtgtctatgtagcaataactactgtgatagcattcgcatttggctttatcactggaatgtacgactaaaaattatctaaattcatataacaacgggggaatgaaaat

SEQ ID NO: 2687 - DNA, 1758 bp, Unknown
  Kingdom: Bacteria, Phylum: Firmicutes, Class: Bacilli, Order: Bacillales, Family: Paenibacillaceae, Genus: Paenibacillus
gctccctcgaagtgattaagttttctcactcaaactcatgaattcgcaggatttcacctttagtttagcgcgagataagaagggaacagaggagccggtagcttggaacaactgaaagggcgtgcaggaacaggggtgcgggatgaatcacccaattcacttcatatcctgcacgtctccatgtcgcccctagcgattttcactcccatgtctcaacgggtccaagccctttcattccttcgtcacatctactaaggggtggaggtcggtttttctaacggaacgggtccgagcccttttgcgtaatgtctcccgatactccgtgctttttggaatcctgcgaatgcatcagctggtgagaaaatgccggttaagctgcttgcggaaaaactttgttggagtcgtaagcctcgctgctcttcgccagaccgacaagcattcgggctactttaccgcataatttcataatagatttcattttctttagctttttcacgtcgacattgtggtggtgcagcgctctaacatccggattggtcatgaccatgcacatcgtcatgagatagagaaagcgtcggagacgagggcgcccacgtttgctgagcaccatctttccacgccatttcccggaactggcttctgctagatttagcccggcatggcggagtaaagcattgccgtgtgcatagccgctcagatcaccggcttcacctagcacaccagctaagctcgttgcatttacgcctcgaatggcaagcaacttctgagcgtacggaatacgcaccaggatgtagtgaagctcgtgctcaatctgctcaagctggcgctgcgccaagtcgtattcttcgagcagttgacccaagtgcagtttgtaggcgtgcagcgcctgcgtggcgccaacactgcgtttagccagggcaatgagctgctcggctcgatgaatgcccgcatggcgtttcacgtattgcttccagccggcaatgacttgttccgtcgttaactggctaatgtccttcgggagaggaaacagccttaacgtggctatggcgctggtgcaggtaaggattttaaagacgtgacgaagttccggaaagacaatatctacccagcgatgaatctggttaacggcgctgtttagccgtttggcaaccgtgtcgcggttggccatgagaatccgtagttcctcgtaagcttccgggttgaagcgcacaggggaatagtagccgtttttgaccatatccgcgatgacgagcgcgtctttgcggtcgcttttagatggcgtattgtcgcggttttccttgttctttttgacgagatggggatttacgagaacagcctcaatgcctttggccgaaagccagcgagccaggctgaaccagtagtgaccggtgggttccatgccgacgatgactttgctcagcgtgtacgacttgagcagatcttgaatccagcggccgaacagctggaaaccctcgtcatggctgccgaactctagcggcgatcctaaggcaattccccgaaagctaaccgcacgagcgacgtgagcctcctgtgcaatatctacgccgacaactaaatgcgatgaggaaatgttttcaatgcgttgattttgtttatcctgtgatttaaacttcatagtagagcgacctcctagatgatgggctttttagggcattgacccgtgacgtaaccccatcgtaccgaggcgctcgtttttgtgcaaagaccagattattcgttttacaggaattctaacgg

SEQ ID NO: 2688 - DNA, 1898 bp, Unknown
  Kingdom: Bacteria, Phylum: Firmicutes, Class: Bacilli, Order: Bacillales, Family: Paenibacillaceae, Genus: Paenibacillus
acaaacgggggtcagtcccgtttgtctcccaggcttttatccctccgtggcacagtacgacgactgtgagttttctctcggccagccgatattacatcgcggaaccctagaaaacattttcggattcaattatagttatcaacctaaacttatattattgttttgctcattatgaaatcaatttgttcttcatcacccatataaaaagagtgtgcgccagtttgaacaaaccccattttcatataaaatgcaatggcgttttcatttttttcccatacgccgagccagattttctttttattatgctccatcgcaatttccatagctttatttagcagatatttaccaagcccatgtttttgaaatttgttttttatataaatcctctcaatttcgagtgactcatcacccattttttcagattgggcatcattcatatttacttttaaatatccagcaagttcttcattgaaatagatgaaaaagatttctgaagagacgttagacaattccttctccaactgttgaaagttaaatgctctttctagataggctttcatattttcaggtgaattctgatctttaaaagtatcgttgaatgtttcaatacttatttcttggagtatttgtaaatcttcacggctgcactttataatttttacagtcacttaatgtatcgctccttcatgtaaatcaataatttcttttgttccccttttttacaaattcccagtctttccctatattttctctcactctttgaagaagattgaaaatggtttctacctctctttccgaaaaaccctctaatgcaacgttattggaataatcattttctctttttataaaaggataaacattgttccctttatctgttggaaagagttttttaattttttggttatggttatcttctttcttttcaataaagccattaattacaagtttttttatagcacgagatgcagttgttcgatctacttttatcatctcagctaacttttcttgaatgattcctgggttttcacatattctcacaaggtacaaatactgcccttttgtaaggtcatattctttaaattctatattacttatagaatctaatgcccttgcgatcattctaatttcacgaagtacttccttcatagttaactccttcgcacctattttattgcaaatgcaacaaaaatgatatatattgaatttaccttatttttattgcatttgcaacagaaaattataataaagaggtcgagtaaattgaaatatatttttttgtattgggaatttttgtattatcccttggaatttcgttcactatacaatcagaccttggggcttcaccttttgatgcacttttagtaggactgtctataaatgtggggcttactgtgggaagttgggaaatcataatagctataatattgataggttgtaattcgcttttaaaaagacaagcaccagaagtattggggttgttaacagcatttataacgggtattggtattgatatgtggctttttttattacacaatttgataacacctgaactatggtacagcaaagttgtttgttttggaattggtttagttgttgtaggattaggaactgcaacatatttgcagacaaattttgcacccattccagttgaccgattaacattaatcatacaagaattaactggaagaaatctatttttttcgagaacattcatctaccttatattcttgatcatagcagtccttttaaacggacccattggcattggaactttgttaactgtttgtttagggggactaatactcaattactttatgccatttactaaaaaaatacttgaccgcatattaacacactctgctacatcaccaaatcatgagaaagataaaaagcattct

SEQ ID NO: 2689 - DNA, 2712 bp, Unknown
  Kingdom: Bacteria, Phylum: Firmicutes, Class: Bacilli, Order: Bacillales, Family: Paenibacillaceae, Genus: Paenibacillus
aatgtgacggaagcgccggaagtgaagcattacctgatcggtggcgaagcattatccgtgcagctggtaaatgttttcctgcacaagtggtccgggtatcgtccggtcattaccaacgtgtacggtccgaccgaaaccacggtagatgcgactgcttatacgattgaagatgtggaagccctgaacgcactgctggaaaaaggggagcatacggtatccatcggaacgccgatagcgaaccagtctgtatacatcttgaacaaccagcaacagctggtgccgatcggtatcgctggtgagctttatatcgggggtgcaggtgtgggacgaggatacctgaatctgccggagctgacggcagagaagttcgtcctgaatccgtttgctgatgcggcggcagccgatcaagcggacagcactcacgcaaaccggatgtaccggacgggcgacctggcacggtggttgccagacggcagcattgagtatttgggccggatcgaccatcaggtgaaaatccggggttaccggatcgagctgggcgaagtggaagcgcagctgctgaccgtggatggcattcagaaagccgtggtcacagcatgggaaaacgaagacggacacaaggacctgtgtgcctacatcatagcttcagagtccctgagtttgccggagctgcgcaatgcgctgcagccgaagctgccggattacatgatcccgacgtatgtggtacaactggatcgtttcccgctgacaccgaacgggaaaatcgaccgcaaggcgttgccggcaccggaagcacgtctcgaaggaggcctggagtacgttgcaccgcggacgccgctggaagccaaactagcccaaatctggcaggatgtcttgaaactgtccagcgtaggagtcaccgactcattctttgacgtgggtgggcactccctgcgggcaacgacgctagtggccaaaatccatcaggaactggacagccggattacgctgcgtgaggtgttccaacactttacgattgagcagcaagcccagctcatagctacgcacggcacagatacctatacgatgatccctgtggcggcgcaacaggcgtactacccggtttcctcggctcaaaaacgactgtacattttgagccatctggaaggtggggatctcagctacaatatgccgggtgtattaaccgtggaggggccacttcaggccgatcggctggaagatgcgttccgtcagttaatagcccgccatgaaacgctgcggacttcctttgaaatggtggaaggcgaggtcgttcagcgcgtttacgatcaagtggagtttgcagtagagcgcctgcaggctagggagtccgaagccgaagcttatatcgagtcctttgtacgcagctttgatcttcgccaggcaccactgctgcgtgttcgtctcattcaaactggaccagagcgccatctcctgatgtacgacatgcaccatattatttcagacggtgtatcgtctaacaatatcgtgcaggagctggtacaactgtacgaagggcaggaattaaagccgctgcaaattcagtacaaggactatgccgtatggcagcagcaggagacgcagcgtgagtcataccaacgccgggaacacttctggctggagcatttagccggagaattgccggtactggatttgccaattgcttatcctagacctgctgttcgcagcttcgagggtgcgatgtatgaatttacagtggacgcgaatgtatccgagcaactgcaccgaattgcggcacagaccggaagcacgctgtacatggtgctgttgagcgcctacaccgttctgctgtccaaatacagcggtcaggacgatttgatcatcggtacgccggtagcaggccgcttgttgcctgaactggagccactgatcggaatgttcgtcaacacgctagccatccggcatcagccgaagggcaaccaaacgttccacagctacttgctagaagccagagatcgtacgctgcaagcctttgagcatcaggattatccactggaagagttggtggaaaagctggatgtagcacggaatgcaagccgtaacccattatttgacactatgtttgtactggaaaatatggagtcacaggaagcgaagctagaaatgctgtccttcagtccgtatgttcaggagcatcgtatttccaaattcgatttgactttgtctatgagtgatgaagatggggagatcaagggttcgtttgaatattgcacgaagctgtttggagctgacgctattgagagattaagcagggatttgatagcgatcctgtcccagattgggatcaatccagatttgctgttaagcgatattcaggtgaactcggacgagcaaccggaaggcttctcgccggattccatcgactttgttttctaaatccgttttctaaaatgcaatgaattcactttgcgtgtgcagagggcggtggcttgttcgcctgcccttgcctgcattgaaaaaacagcgaaaataattccatttgaaaatttaagtattataaaattcgtcaagtttaggttgattatgaacattatatattaagggaagagtataagatggattagctccattttatgttacgaattgttttgattatttaaaggtactaccttgaataagctcaatgaacttaacaaaagaagacccgtgtttcaatggaactgaccccataac

SEQ ID NO: 2690 - DNA, 704 bp, Unknown
  Kingdom: Bacteria, Phylum: Firmicutes, Class: Bacilli, Order: Bacillales, Family: Paenibacillaceae, Genus: Paenibacillus
aacggcaaaatcgaccgtaaggcattgccggcaccggagcagatttcccgttccacgcaggaatatagggctccgcagacagcagaggagcaggcgctggcccatgtgtgggaagctgtactgggcggcggtcctgtcggattgacagatcaattttttgatcggggcggggattcgatcaaggcgattcaggtatcctcacgcctgctgcaggcagggtataagctggatattaaagacctgtttaagtaccctgaggttgctgagctagccacgcatctgcgtgtgtcggatacccaattagctgatcaggaagagatcgagggagccgttctactgacgccgattcagcagtggtttgtggagcaagggcagcctatgccggaccattttaatcaggctgttatgcttcatcgggagcagggattcgaggaagagctgctacgtcaggcattgacgcagttagcggtgcaccatgatgcgttacggatggtgttccgtaaggcggagcaaggctgggaagcgtggaaccgcagagtgaaggaagggaagctgtatgatctggaagtggccgatttcaaagacgtgccgatcggtcccgtattgggtcaagctatagaagcccgtgcgagcactattcagagtagcatccgactgaatgaggggcctttgctgaaagcgggcctgttccagtgcgctgatgg

SEQ ID NO: 2691 - DNA, 3320 bp, Unknown
  Kingdom: Bacteria, Phylum: Firmicutes, Class: Bacilli, Order: Bacillales, Family: Paenibacillaceae, Genus: Paenibacillus
gcttatcttaatgacattggccttgggctgtccttttttcggtatgcttcgtttaatttcgcagcgagtgtgccagctcctccttggcagagatgtctgatacagaatgcttgccattgatattgataaatacgcttgatttcttcattaatagacatataagttaaaacattcaattatcatttagaaatttaggggttgaacacagtgaaagtggatcagggccaaatacaagattggcggactgcttggcctcctcgatgaccttcatgaccttttcactatgttcaagcatatccgaaactttttccaaatcgttttctcggatgatacggtcaaattcaacgaattcgtcatacattcgatgcaaatgatcttttagatccacccgaattggtgtttccttattcgcagtgtaatcaaagcagtcgcatatattagctgaacttgccatgtgtatatagcccttattgccttgaatgttcacggcattgggagcagtactatcttttgaaccgatgcagacacacttgaaatcaccgtaatcaagcagcagcatacctgaagtatcaattccacgctccatgttcgcccaatactccactttcttagggctcccgaagaatccaacaacaaaatgaatattatataaattaatatccatcaaggctccaccagacatttctggattaaacgcaggctggattattcctgctttgaatgcttcataccgagatgagtattgagaatagttgcattcaacgattttgatctcaccaagtttagatagatactccttcatggacaaataatttttcaaatattgatttgttatggcttccaccaatatcagttttctttgctgagcaatttcttttagctctaggaattcttgcaaattggaagtaaacggcttctcacaaatgacatgtttgccactcaataatgcttctttagcatatgaataatgaagatgattaggcagcccgatataaactgtatccacttcatgattcatcagcatctcgctgtaatccgaataaatctgagagattccatatctatgttgccaatccagtaatttttcctcatgactaggtctagaacaaattgcctttaataaaatagtcgggatatcctgaataaagctcaatagatcccctacgatcatccctgctccgacaattcccaacttcattttagttgcactcctctatacctttttcaagtatttccatacaaattatcgtttcttcgtctttaatcactttttctttaccaagtacgatcgactgatagatatcgtcatatactcgagcatagtctcccttttcagaaacgactttttcttcatgatactcgcctttatcatccagatatgttaagatgccgtaatgctcgggctggtcgatgccgaaatcggagtgtcccttaggcagatagtataatttcagatgctcctcctgacgatccttcgtttgctttataaaaacgccttttttgccgtgtacaacaaaacctggccgctcttttaagcgaaaaaagctggatttgatggataccttgagcgagggataataaaaatccagatcaaagtaatcattcattctcccagtacccagcaattgacgaacatcataatggattgtgtccggctttccaaaataggaaagaacctggtcaatggtatgaatgccatgtccatataggtaactgttatatctggaaaaatgagaagtggagttcgggatctcagggcgataataatcgtaatgcatctccacctccagcaaatctccaagctttcctgattcaataaccttctgggtagtgaggaaatccgaatcgtaacgtctattctgatagcattgtataaccagatttttctctttagcatattggaagatcgacacggcttcttctttggttaacataaaaggtttctcaacaagtacatttttcccgtggtctagcgccatttttgcataagagtagtgggattctacaggtgtacagataacaatcaactgaatctccttatcgttcattaaagattctatattatctgtatacagcacttcaggtattttttcccactcccttttatctagattacgagcatatatcgtcttcactttcaattcagctctgttcaatgaaaaaggaagatgataacggttcgtgcttttcccatttccaatataaccgatggtaagcatattatttcccccttaggctctttttcatttattataaaagaagaacgttgatcgtaaaggattcgccaccaaaatggtacattcaaccgattatttttaaaaatggttgtttatttttaaacaaaatgtttatttcatattatttttcgaacgttttattcaattgagccggggtgaacctgttgaaaatactgatacaattatcagaaatgcaaaactttacaccaaacgaaaaaagcattgcatcctatattttgcttcataaggaaagtattctgcacttaaatattcaggagcttgcaaaggcaacgtatacttcgcattccgcaattaatcgattaacacataaacttgggctatcgggcttcaaggagtttataatcaaacttgctcgggagtttcagcagaacacccagaacatttccaatgtagaccccaactatcccttcggttatgatgaatccccacttcaagtggcgaaagaaattgcagaattaatgaaagaaacgattgaaaaaaactttacattcatggatgatgattcattgtcgcaaacagccctattgctggatcaagcgaaaaggatctttatatatgcgttgggcgattcacaaatccgtgcgaaaagtttccaaaataaattggtaaaaataaacaagtatgtggttatagctacggagctgtctgaatgggcttaccatacggctaatcttacgacacaggactgcgctgtgtttttaacttaccacggaaagtcgccgatttttttaaaagcagcacggcatttcgcacatgaaaatatcccttttatcacaattacagcaaccaatcaaagtgaattggccaaactcagtaatatctgtatccgggtgcctgatgacgaagtaaaacatgccaagattggtacattttcgtcgcaaattgcttttgactatgtattaaatgtgatctattcctgtatctataaaatcgactacttgaaaaacatgcaaaccctaacacaatcgttggagaattcgcatctcaatgacatgatgaacgacgtataaaatgaatatgcactaaaacaaaaagtcgccaatatggtcatacccctgtcaa

SEQ ID NO: 2692 - DNA, 1226 bp, Unknown
  Kingdom: Bacteria, Phylum: Firmicutes, Class: Bacilli, Order: Bacillales, Family: Paenibacillaceae, Genus: Paenibacillus
tttttcacaatatgggccaccagccgtaggttatgttcaatgagtgtgttacgggagtgtgcgttgccttcggcaaacagctttaggtgtcgagcttcctctttctcagtcaatggctgcggaaaggcgttgtttttcacgtaggaaacgagcagcgtcaattccttgatgaacagagcgatagcgctaaatagtccgggcacggatgacacctcctgaggtagttgcgaacttaccggcctttgttacttaccgggcttgcggtctgtttattgtatgtaggcaggtgcccatccgtgcctgtactccgaaaactgctccgtaacaatttgccagatacctttctggagcaacctccgatacttaattcgaaacgtagagatctcttcgacacaaatcaacgcactccatatagccatctcccaaataataagtgtatattttcatattctatccatttccattctcgcacctcaattagttatttatattctaaacatgcaactccccgcccgcaaatgagcttgctattatgatgttggaccgcttaaacactagtatgcattccatcatcaaggaatatattcatagagagttccatataaatgatataaatcaaccttttcaacacattcaaaaattaaacttaaggaggaatttcaacatggcaaaattcagccaaaatccagacaactatactttttctgtagatcctcttgttatagcagaggaaaatgtttcaaccaacggagattccaaaaatacttttccgaaaaatgttttagtcgataataatctctattgggagagcagtttaagcggtaaaggtggagaaatcatcttcaaattagatacaggtaagacgatcaatgatcttcttttagcccagccatcttctcgagcttttatactttcattttcttttcacggctctaatgacggagaaaattggtttaggttaggtgaagtcgaaactttgccaaccactgcaaaaacaacttatcaatttagtaatgagattcctttttcatattataaaataactgtactttcatccggcttgagtagtacaacctcctattatggtatacgatatattcagctaagaaccgcactcattaatggcgttcctgcctacagagcatccaacataaaccccgctattgcagaataagttactacacacaaaaaaggggctggccaacgcccaatgtcattaagataag

SEQ ID NO: 2693 - DNA, 909 bp, Unknown
  Kingdom: Bacteria, Phylum: Firmicutes, Class: Bacilli, Order: Bacillales, Family: Paenibacillaceae, Genus: Paenibacillus
atcttggtcaaattgtcccagatagttaaagctgatttcaggttcggttacaaaacgctcttgctcacgtgctgcggacaggtatctcaacataccgtagccaatgcccttttgcggaatgcggcgtagtccttctttcacatgtttgatgcgctgtgaaaggtcttgccccacgctcatatccagcacaaccgggaattgggtcgtaaaccagcccacggtgcgcgtaatatccagttctggcagaatggactcccgtccatgaccttccaggctcacgagcactcgttccaggcccgcccaacgatgaatcgttagtcccaatgcggtaagcagcaaatcattcatctccgtgttgtaggcacgatgcgcttgttttaacagctgctccgtttcctgagttgtccacgtaactgtaatgttctcgctgtccctatttaaggaatgagaaggggactcgtcttttggaagcggctgatatacgccttgttccatttcctgccagaatgcgagttctgctgccatggccggactgttcgcatattgagactgcccatccgcccaggtgcggaacgaatccgttttgtgcggaagacgagccgcttgtccgttcaatgcctgctcataagcggtcgtaatatcctcgaacaaaatgcgccaagatacggtatccaccactaagtgatgaatcgccatcagcaaatgatctccatcgggacaatggaacagccccagcttcaccagcggtccttcgcttaaatgaatacccgcctgaatttcattcactttggccgcgatcgccgcagatacctcagactcatttctgaagtcggcccgatccagcgtatacagctcgccctcaccgaccgcgcggttccaagcttcatatccgcgctccgtaggtcggaa

SEQ ID NO: 2694 - DNA, 2239 bp, Unknown
  Kingdom: Bacteria, Phylum: Firmicutes, Class: Bacilli, Order: Bacillales, Family: Paenibacillaceae, Genus: Paenibacillus
aataaaagaatatatccaattttacaaccaatgtcgaccacaacgaaagttaaataagctgcctccgaaagagtatcggaagcagcttatagcctaggggcttttttcagtgtctataaaatgggggcttgaccatgtgctggtggggtgtttttacgtttagggggatgaaaattgaagagtttcagaggattaatagtaagcgcagtattggctgttactatgggggtggttgtctataaggattatcagcccctcatcatgttactaatgctaaaaaaagtatgagtaaggttgtttgaccagtcgattatgaactcccaagcatatattgagttgtaagacttgtgaaaggaggtcatggttattccaatttccgacttgttcaaccttcagccaagtgctccagttaccttggatgggcacggagaagagagcgtcaatctagaacttcaagcctcgcccagcacctccgttggtgtggtgcagggaacaatcctcctgcctaatgggaatccggttcctttttctacagtgcaggtatatacttctcaaggggtgccatatgagcatgttaacagtaacccccaggggctatttgtcatacctaacattccagtaggctcttatttaatcactgcatctgaaccaggctatctgacacctgtccgtattccattaacagttacacaaggcagaccaacacaagtatctattactttacaacccgatctctccgcaacgacgggagccatgtttggtatagtaaggaatattaccaataatgaacccgtgaataatgctttggttagtctattccaaacagatgggactacggttactccgatcggaacggtgacttccaacgcatcagggcagtatttgtttgctgagcttccgagtggtacctatttcattcaggcggttctacccggatatttgtccaaccaaagtgtccctgtaacaattcaaagtcctgagtatgtcccccttgatattaatctgacagccgatccggatgccaatacagggactgtaagtggtatcgtgacggaccaagcgaatggtgttgctatacccaatgcgctagtggcactctatactttgaccgcaggagtggaacagatcatccagattacgcgtacgaatcaggggggactctacctgtttggcgatttgccaccgggaatctatcgtgtgaaagcgacagttcaggtgaatacaggatgaaggataaaaatattctgacaggcagttctgttttttcaatcggttccggtgaaagtagatgggtccctctggctctgcacggcaggaatggttccgtcaggtttggcttcagccctgtccgagtaactttttgtctgattgttagaaaaaaaagaatcgtctataagcagcggttccagctctatattcgcagtgaagaaggttacagaaatgcaataaaatggagcagtaaaagaaagctatactcatctcctaagtcccgtaaaatatgcccggtaaaaatcgaactgggggtgtccgtgagaaataaaaaacgggcgaaccgcaagaaatttaatgctgttatttaagaggtgtcttcaaacatccgaataaaataaagctaagggcgttctcggataatcatgggaacgtcttttttggttttcctgccttactaaaaagatcttgaaagaaaaattgtcgcttcaataaggcaccaaactgataacgatgaaaatagggattatggttggcggggattatttcattaaattacaacatcattcatcgaatgaattattgaggtgatcagcatgaaccatacatatagagtgttgaagtcggatatcgaactatttgcagctgcattgagtcaagcaagagtgtacgttgttcagtcgttgagagaggatatggtgtcggttgtagattatggtggcactatagaaaagttttcgcctgattcagtcaagattgccggagcgtattacatacggaatcaatttgaatttagagtggacaaaaagctctgctaaccttaaggtccgcatagccttttagatgaaaattgtttacagatgtgcattcaaggtgctctgaatccactttttaaatgttcgcagaaaataaagttttgataactacaataaaagaaacaacggtaggctaggacgagaaaatatgccctagactgtcgctgcttcatctgtttcattgaactaacgtttcccgttagaattcctgtaaa

SEQ ID NO: 2695 - DNA, 8240 bp, Unknown
  Kingdom: Bacteria, Phylum: Firmicutes, Class: Bacilli, Order: Bacillales, Family: Paenibacillaceae, Genus: Paenibacillus
gtattgaagtagtcaaaatcatagttattgaaataatagtaaattctaaataatattaaagctataatacacatctttagaggcaaaaaagtttgatcagatattatctttttcatcatttgtctcctattgtagagtatcatgcaattggggttctaccttttttttggttaaaatcttatagtcatccaataccttactgcctaaactaagcctagtttcttaatcactccagccaattcatcgggatactcaacttctactttattaccgggattcacccagaaccgaataaatttcaaattgttgatcgccaaggaaatatcatctattacttttctgatccttggaatattgggatttgccattattaaaatagtcttttcagatgaatattcaaattgtttcataagataaagaacctgtgctcctgcatgagtttttaactgtccactatcaaatacagtatcattttgattatttttcatagaacctttcgattcaacaatgagtgaatagcctagtatttcagcatgaacatcaaatccttgttccctatctactgcaattctcaagatatttgcttttttacctttaagaaaactagcaacagctatattcacttcgttctcggtcattacaaaaggatctgggcatctcaccattaggataggcacttatcaaaactcctttctatgaaggattcgttttacttactattcctatctccacaattcaagatttcggacacgactatctaagtcgtctacatttgtatccatgtctttaatatgagattctatatcgctcaacctcatatctaaatcttcagtgtcatacatctttgctttttcttcggcatcttcaactctagtctttaagctttcaaattcctccgatagccccttcaatgctttatcctgctggtaggtagcataaaactgataccctaacgagccaataatcaaaacacctagcaaactacatataatttttttgaacaagcaagattcctccaataattttttatcctatcgaatttctatggtgtataatcgaaactcaaacaagtttgatctaagggtatatactactgacttccttagagttccctttttcacaaaagaccaattttattttaagtatccttgagcttcaaggtctctgagtaatttttcgatatcatctatatcttcatcgcaatactttctaaaatcatttgcaggaatcccagtttgtctgagaagttctttagcatccatgttatatctagttagagctgcaacacaataagccacacctcttgtaaaacctatgtcctgctgcgttaatcgtttctttcttgccacacatcattcacctttctgcgtaaatgtgttatttcatttgtagatatcaatcctcatcataaacaatatcataatctgaggcatcaacatctctaccattctttcgtaaaaagtcttctgtttctctaattcgcactataatagcatcgtcctcatttagttcttttcccaattgttcttttattctacaaagcatgtacagctcactctctgctgagtccagttggccttctagatatcccttttcaaaatcagattttttagccatacatgccacatctccttataaaattatctttttactctttctaatctaagcttgtttgaagtagtttggcttgtctcctgaacgcatcaggaatccctgtagagctttctattagagccaatgctaacattattccattttctaattgttttaacttcacaaaattatcggcgcgtattttggcaccgccatattcatattgatgtgacagcaatgttatcttgtcttcgtgactaatttcttcattatttaaaatatgaaagtagcatataaaagctctcttcccaatcatattcaggagcttacttaatctatcctcttccatcttgctgtcacctacctctgcatcatattatacaacattttcctatgtacggctgcaaattcacttgttatctatataagtaattttattatttttgtttatttaagtcaagctgaattattccagcctgaccaatttattcatatcaacttccatataggcagctatcctcacctccacgtctcttctaatcttagaccaaagaaatcgcatggtgtgagtatatccacgacatagatactcagttaccaaatctttgtctgacctaaccccatcaaaaaccttaattcctcgctgcctcattttttgacggacaacttttaaatccatcaacactctactttgcaagccctctagatacaacacgaacaattccttcatttttaagtcagactgtttaatcttctttaagtttagctctaatacatctaatacataaggtagctgtataaagtcaattacaagctgagtgtcttcattagatgttatacgattactcatagccgcacacactcctagaacgtttgttcttatagtgtacaactaactaattaactattcaatggtgtcatatttaaacatattcctatctgcttcaataagaactctttgtccaacatagtcgccatctatatacaattcaaattcttttccttcgtgtccaaccaatagtttatttgaaggtatgtttccgtagtttcgtgtgtattcctctccagttggcaactcaaatctaattacaatcaaattgttcaaatggttcttcttgaggtaaatgcgaaatacattgtctgttttggatgggaattgatactgatcatttgttttctgttttgccattatgtattctcctatcttggtaaaacgatgcttttacagatttttagcttctaaataatcttctacttcaatcatcaattccattaattcttcatactctgcaccactcatggtacttttgccacgattcaatacagtacataattcaagatccagagcacttgctactttataaatctgctgaagcaattctaaattactcttcaatgctcattagctcctttaatgccttttcatatttctttattcgctcataatccttctttgttggctgctcaatcctactcaaatccatgttatcttcaatatcagcaatcttaacttttcgcgccaactcattttgtttacaacgtgctataaactcccagtacgtttcgttctcttgtcttgtcaaggcaataactgcttcaataatttgactcgtgaaatctttcgacagtttttcttcggtcatagttgtgtcttctaaaatgtcatgcagtactgccacaatttgttcttcatttgatttcaaattcatcattacacgcaatggatgtaagatatatggattgccacccttatcaagttgaccattatgcatagttgcagcaattgagattgctttgtttaagttgtttaccatctgaaaacagtcctctctgtacaaaactgtatcaattaacaaccatccttttttataatactgagcgctatattcttgtccaagtaccaattcatcatagttattatgccacttagaatatatgactttcattaacagtagcctcctcgtcatttcattcctactaaaagcccaattttattaaataatcttttaactatttaatggtataatatacttaaactatcgtaaatctacaaaaggatgagttctatggtgccttataattttgagttaaagatagacctgctttatgattggaatgaacacttacgttcaaacttcgaagcattctcttttttaaacaaaaaagactatatgagaattcccacaaaatacgtagatattgtctattttaattgggaaaaaagattaataaaaccatctaaacgttcagtacattactctaagcaattcaattgtccaaataatctgactgaaaacctaaagaacttaatttctaaaattgaaaatggtgaaattttaactcctcacctaacacgtaagataatgaatattcaatttaacgactacctattaagcgattggggtatacatcacctacatctaggaacaacaacagagtctgatggatttgttgaacgtggtaaatacttgctgtataccctatttgacgatcacaatgcatattttattcaaatgatggatcatggctcctttaataaacgtgaattagtaaagacgatccatgaaaactggccagaaattattgcgcattgtagagttaacggaatctcgttacagcccgatccaaatgatagagaaaaatctttattaagaaaaaacggcatcaatacctttgttaccattgacaataatattatttatagtcctattggtggaggattaacttcagcttctacaagcgtaatagcatcatctaatgctttaaaatatcgtaattatcttagtagaattgaagattacatcgaaactcatattcatgaatataccaacttaataagaaaaagattaggctatataccaaaaaaaattaactttaaattatttgtaaatcccaaaggagtattttatctatttgaaacagaaaccttaactttttttgagttaaataaagtatagcttttgcattttccatctaacaagtctctaatataagggacttgttagaaattagtttaatcaatttccattagagtgctatcttgaactttgtaagtagaatattcaaatctattaactggaacactaaaacttacattttctccagatcgaataccatctccgggaattggtatcgagtctcttgaataagttatatttccattatcatcataaaaataaatcgcaaaataacctttaataccttcgctaccattgttggttatttgtccaacaaggtcacccgtagagttattccataatactttaacatctgaaaactcaagctgattaaaaagcgaaccactttctgcttctatgctcttctcaaatgtatctctgggatttgtatctctggtatattctcttccttccattatggcattcatttcttttagtacttcagttgcctctaagtacttccctttagcagttaaagaatcagcttcttttcttagatcctctatcttaccttctttaattgattgacttataaagctgactgtttttggtatagcaaaagcaagtacaagtaccgcagccaccacaatgataacatttttccttttcaacattatccctccgtagtaaaataatagcgtgttaaatattaccacaactattgtcttaggtctatagtaacaaatacgagagatagatgataaaatatgtattttatctcaattgtctagtgcgaagccagtacactctttgatttcatactcattttcaaacctgtcttgaatgttctaatcttgattactgcatgtttcgaagcaagcatattcctcttgttgcatcagatctccacattcatgccaaaaatgtttacattttaaacacacactgtttgtatttactttcactctatatcccccaagttattttctgttttctcagactcttttcatttttccatgcctacaatgtttgcatgatatttttttaaattctttattagttgagagaatgctattacagttcaaacagatgtaactgtacgacagaccttgttttttgatgctatttattcttcttttaagctcatcattttttctcttttgtctgtcttcttcatccaatacacatagacgaccattacttcttgaataatagaaactaaatttctttgtgtcgctgaatgcttcttctggtttgaaagtcaccatattatgaggaatatgaattccattttccaaaacagatgttggttcaatatcaattactcttgctacccctacaatctctcgatcatttaaatatactggcacattttcatcaacattgtatttgtgtttcgcttctaaaacgaatttagtcatttcaatactaatctcctttatcatttcaactaactatttgatgttcacgtaaaacacgcattttacaatataattaaactgagggaggaatctcacctccctctttaaacaactatatattttgaactaaaatttcgttaaccaattctataaatttttcgccatcaataatctcactattaaaatctgaaccaaatacattcaattctgataatgtcttttctaggccattaaactcaactgcaaatggctctttaatgttactaggtatttgacggaatgaaccaattttatttttcataaaaaaccatttaccataaatattgtccgcttcctcaaccagcaataaattaaaaccttgcccatcgtaaatctcaaaataaccccacgcaattaccagttgatctctgagtttaggacgtataacaacttgatatttactatcccaaaacctatcttctctaattttataaaaatcttcatcaaacaacactcttagtcttaagttgacttttttaagcgatggtaatttgagttccaaattaatatagtctcttttcagatcgttaaacgaatccaagaccatctttgagccagtgtatcttgtattgaactcattcacatattcctttagtggttcgtaaatacattctttgaattgatagttaattcttctcacatgatcctgtttttcgttttcttctttttgcttcagaagttgctgggtcttatgcgactcatcttttacgactttaatgttaacaagattatcaattaaacttgttacggaagttgcaggtgtctcatctaaaccaatctctctttcaatctcttcccagtttttatatcgcgcgccaacattcttctcaatcatcttattgacaacttgtacaatactgttggtaatacttggattaatctgttttattggtgttggattttgaaaagtatgagcttcctgccacatagtcatatcagcctcattttttacttcataaggatgtctaagtgtggctaactcataaaacaagattcccattgaatagatatcattttggattgtattcttttcgcttctccatctctctggagccatatatttaatatgaccaacacctttgaaagtgagttgcctagtcccttctgttgcaactttagcaagaccaaaatcagcaatttttagtgttcccttatgaatcaatatattatctgtctttatatccctatgtactaagagatcatttatatgtttcattccctgaattagctgactgtaaaactctttcaatagttcgtttgaaaagaaaacaccttcttctttttgtttattcaaataactcaataatgtcccttggtctgcgtattccataattaaatacggtggcaaatttggatatttatccttgtgtatatagaagtattttactgcattgggatgagaaacttttgttgccatttggcattcatttataaatgtgacataagcttcttgtgtaggaaatgttgttggtagtgtctttaaagcaaagacacttttatccgacttcttttgaatcttaaaaacaaacccaaaattcccatttccaatcatttcaattacttcatactcctcttcggattcatcaaatacagtaacaccctgagcaatcatggaaagtcctccctaaatttttgtaactcaattatacaataatctgttgttatatgtcgtccctccttctcataatgaatataaaagaactcttttaaagcctttaaaatctcaaacttatgataagtgcagcacacagcacaaaaaacaagatttgttggatgtccccattgctcattaattttttttgaatatgtatacgtgccttcatggttgggacaattccaactatattcctttaaatactcgatgacttgattatttttagatttttactgtttgtagattatttaaaatttcctgtttctttttttcttctttttgttgtctctctctcaattgtctttctagtttctttttcttcataattatcatccccattcatgattttcaataatttctatgatcgattgtccagacaacttctttgtgattttgattttgtgattgaaatttccatccattgtttgtcatttctacggcgtgttgaagatactcttcataattctcatattcataagttttaatttcatacagaagttttggcaaactgctttcatcctctatattttcatttttcaattgtataacttcagaatgattagcttgttcgctaaccagcgactctggaattaagtatcctctacaaatcggacatttgtcataatcaactaccca

SEQ ID NO: 2696 - DNA, 913 bp, Unknown
  Kingdom: Bacteria, Phylum: Firmicutes, Class: Bacilli, Order: Bacillales, Family: Paenibacillaceae, Genus: Paenibacillus
gtgaagtagtctgattgcacgtatacttttttgtctcagtatagatgcgaacagctctaccgcatttttcaaagtaaataatgtcatctgcatttaaaacgagcttatttcgttcacaactaaactcaaagtaactgtgcgtgctatgtaaataatggtccgctctttggagaatctcataaaaattacattcatttattggttttagtatataatcaaaagtttgtactttaaatacatctggcatatattcactataattggtcacaaaaataattacagctcttttatcaaactctcttatctttttagctagactaattccgtccatatcgggcatctcaatatcaagaagatagatattgtactcaactttattttttgttacatattgaagcaaattttcaccatttccaaaggtatctacttctactttggtaaaaggatattttagtgctaattcttcaatccgacccaattcaacattcgtatcatcacacaaagcaatgtttaacatcctcacacatccctgcataatcattattaatcgcaaagtatcgtctataaataaaattgtgaacttcacataaatgaattaattctgagctgtaaggaataattcgaatcctgaataatcgtaatatgtatcaaaaacaaaaacaattaataattacacatatagcataccatttcaaataatatacattcaatactttctttctaaatatatacatttttatatatttatttaaaatgaaaaatataggaagcattaagctgctgcgccattaaaagactacttaaaactaaatatcaagcaagtactaagacagaagattatgttattagctaatcctctatcttagtacttgagtaaacaacaacttcttccaaataattcaatagcgtagaa

SEQ ID NO: 2697 - DNA, 11717 bp, Unknown
  Kingdom: Bacteria, Phylum: Firmicutes, Class: Bacilli, Order: Bacillales, Family: Paenibacillaceae, Genus: Paenibacillus
cgttatggggtcagttccaaataaaagagggcttgataccgctacttctcattattttccgttcctataccgattttgttaagccgatatgggtgatcatggtgtcatacggatctaattccatggtttgtttgccatattccgtttcaatcgtcgttctttgaagttgatcgctattgttaataacaaccaatattttactttctggataataagcacactctgtatataggttatctgtaatgtacttcgtttcatgtaactcattgcctgcaaaccgaattatattcagcagcaaccttgtgttttcccagctgaattcgaaagaaggaaggtagatcccctttcctttaccaaaggcatgagtagacaatgctatcataccactcgtttcctccactaccgcagctgacccatcagtaagataaatgctattctttggcgttatactggctccttcaggcaccaaaccatgctcatccctaacctcataagtccattttccatgacctactctggagcctgtatcctcatccagtccaagaacatgtgccattctgaaaaagctgtcgtggccttcgaccgcagagggctggttgatgccaataaaggtaccaccctcataaacccatttcgtcagtaagtccacacacttgttgtcattccagtgctccccaccactccatgctgaaccagcagagccggcattgatcactacatcacaatcctgtagaattccctgacggatatcttcaaaatcaatgaattgcacttcaatcggcaatccggataaagcttcattgacatgaatcaaatcatgcatatacgtttcatggaaatggccggacaatgtccacgatctcaattttccccagctatgcagaatagctaccttcgtcttcatgtgatagggtttgccttcatgatgtagttctttaatttctctgaactcattggcaatcttttcgatgtaatcgcaaaaatccgggtaaggctctacaaggtgcaaatatccgcccaatccaatccggtcaataggctcccgcagcaaggcgcgccggatattaatccaatactttttggcgtccagcgtggggtttcccccttccataaaggtaggaagcccgcctaagccaactggaaataagtaaggatgcagccgaatctcatgcgtattcacttttacacctgaacagagtctcgcctcgtaacctgagaatacacatttaatcaacccgtcaaatccaaactcttgaaaacggtcattgtaaggctccatgccaacccaactgtcatcatagaaaacataggccagcttgtcgtgcctatgcacaatgtcaattaatttcttgccaaattcgattacaaaatcattgataaatgccatccaatccagcttgcgctgctcagccgggatatgactgacgcggtatttcccgccattcacaaaatcctcggcagtcatcgaatacccgtatttcttggcaaacagatcaagcgctcttgaacttaccgtaaaatcgtatgaaccccagtcagagaacagatggcgattgcgctcattactgccccagatccaggcgaaattataaaataaggaggtaaaccgaacaaccgtggtttccttatgatggagacaccaatcttccatccaatccagcagatatttttgcgtttctacatagatgggatcaatctgcatcaaatgctctttgtcccaatgattcgttgtgtgattgtacatggaaatctcttcccagatccggtaggccataaagcttaccgtgtatttatgccaaggaacaattccggtaatgaccacatttccggattccctttcataattccactgttctcttggaacttcctctccggtcgttctgtcaaaaacctgccaataattaaacgcctctttggaatcattaactttgaattgttcagcaaaaaaatcctccatcagatagatggatacataatcttgtacagctaccttcggatttgtaattaaaaaacactgctgcagcttatccagatggtgggacgcccactcgttatgatctctgatgatacagattgtcgaatatatgccgtacccagcgttaataatctcatcggacaattgcgtgccgtcactatcacggatgacatcggcaccccaccgttcagctaattttagggtcagcgcctcataaccggattctcccggtagtgtaaagttccccgtagtttgtttggacaacttggttccctcctaattcaacatatcagacagaaaggccaatgccaggccttgaccccagccctgaatccagtcttttggaatattgcgatacccatcccgatctttcataaccgctgtgccgcccgacacacctagtacccgtccgtcctcgctaatatggttcaagatgccctccaatgccttttgcacgtatttggtatgcagcggattgccgttattgatcatggctgccgcgattccgcaagatgcagacacttcttcgtaggattcctcgtcatccagtaccgtccgccacaggccgttctccgtttgaacccccttcagtgccgccagttgatcccgaagtgaacactccacgtccatgcactgcggatataaataccagtctttcaaatgaattttaacttgcgacatggtataggctccccaagcattcgctctcccccagaaaaatccggacatatggtcctgcttgacattattgtagccatggtaccagagaccgctactagggtcttgcaggtatttaatatgccagtaatactgatttaaggcatcttggatcatttcctcatcttttaatttggtacctacacggagcagaaaaaatgccgccataaacaacgtatccgcccacgcctgttctgggaaatcattagcaacggataccgtatgctgcaaaacatggtctccaaacctgagagcatggttccgaatataatccaccttgctcatcacaatatcccaatatttctggtcccctgtttcttcatacaatgtgatcagcatatggcccatagcacatgtgtttaccgtccagtgcggcagacccagctcgatatattcatccgcccactgcttaagcatattcaaatagtctttatttcctgtttttgtataggccgtggatacaccataataagccacaccgcaaggccagtcccacgtcaaatccatcgccattgtttttctgacgactttgtcgataacttttaatatctcttccttgtcacaaatcaattgaagcatctttattcccctctcctagcgcacacgcccccaaaggcgcttgagagctgtttgtcgccgttttgaaaacgctttacttacttcattgtacgcagtaaaatagtctccatctaagcatattcgcaacaaaactgcgcaattctaatcatttatgtatatctgctggttaaaatcaaagtcatgggggtattgaatatgcccagaaaaaagaagcccgttatagaatatcggcactacagcttgcctataaatttccctgtcttgctattaagcggtgagcgttggaagatttcagatattaaaagtgagcatctccatttccataatcatttggagattggtatatgctattcagatagcggcatcatggagatcaaaggagaatctgtacccttcaaagcgggcgatgtgaccttcatccccaggtatcttcctcataccacgtatagttcgccaaatacagccagtctttggtcttatatctttttttcaccagaggacctctttcaacattcatttaaaagtgcttacagcaacttcgagccgaatttgtgggtggtgaagggaatgaactgtatattgaataaggagcaacatcccaaggtttatacacttgcgacttcaatcgtagaggaattaaagcagcagaatccttactatcaggaaagtacctacggcttattgctatccctttacatagaactccttagaattcattccaggaatgaactgttggcagatcaagaaacagagcatagcctgaaaagcgattttgtcatttctccagttctggagtacatcactaaaaactatatgaaccccattaccatggattttttggccgatctgtgccatttaagtacaactcatttccgaagaaaattccatgaaattatggggacgtcgcctctcgacttcttaaacagcacccgaatcgaagaggcttgcaagcagttaaaaagcacggaggattctattctttcgatctccgaacaagtcggttttcactccatttccagcttcaaccgttgcttttccaggcttatgggaaagccgcccaaagaatggcgtaaaggggcacaatccgaagcgcaatctgcgaaagcgtctatactggagtttacggggtgggtttagcattacagcagaaataaacttgataaaacgaactcaatattctggatatcaaactagccattttctgctttatatgattaatcacattttgcaatggatctagaaaaagcataaaattcaaatcttttaacaactccattccagcaagccccgtcatatagccatcttcgaccttgaaaattaatttatgtaatagcaaagtgcctaaaaataaacgtaatgatgaaatcggtgaatctcacaatatgacaacagatgttatattatactttggttgaagttaaacaaaggagatggagatgcttatgatgaatcaagaaccaaatcagcaattaggcgagattattgagcagttcatacattcattaatagcagaaaataataacattcgatctcaaaaagtaatcaacattgcagatgaggatacgatagctcatttaaggggaattggttttccgaaaaaaggaagaccgatacaagaggtcgtcgatgaaatgaggaaaaacgtctatcctcaccaaaccttcatgcaacaccctcgctttttcgcattggttcctggtccaatgtctctttactcgtggttaggagatatcatgaccagcgcctataatacccatgccggaagctggatgctgagttcgagcgcaagccttttagagggggaagtgatccggtggatgtgtgaccaagcaggatatcccaatactgctggaggcttatttctgtcgggcggatcgctgtcgaatttgaccgctttagcagctgcacgcaatgcaaagttatccgagcaggaatatgccattggaactgcttatgtttcagatcaaactcattcatcggtcgccaaagggttacgcatcctcggattccgcagtgatcaaatcaggaaggttccaagtgatacaaattttcgtatggatgtttcagccttagaaaaaaaattaatggatgatcaagcggctgggatgaagccttttgcaatcattgccacggcaggcacaaccaatacgggaagcattgacccattaaacgaaattgctgacctatgtgaaaaacataatatttggttacacgtggatggagcttacggtgcgtcgattttggcttcttcgaaatatgagtctcttttgagcgggatatcgcgttcagatagtatcacctgggatgcacacaaatggctaatgcagacctattcctgtagtgtggttttagccaaagaaaagcagcacctcgaaaattgcttcagcacccatccagagtatttgaaagatgccgagactgatgaagaacatatgaattattgggatctgggtcctgagttaacccggcctgctcgaagtttgaaactatgggtgacactgcaagctttaggaacgaatgctgtcagtgaagttatagagcatggagttcaactcgcagaatgggctgaagatgaaatcaaaaaacataatcattgggagattgtatgccccgcacagttagcgattgttaattttcgatatgcgccaactgggctatcggatcaggaattagattcactcaataataggatctcccaagaaatgatgacaaacggatacgcctctgtgcttacgacacaactcaatggaaaaactgtcctccgaatctgcgcaattcacccagacactacggaacatgagataagaaatacaattcagcttttatcgaatatagcaagatcattaaatgagaaaaaagtttttttgcgatgaaaaattttgaaactaattgctacgatttctgtaaataaacaaaaattatcagcatcacaaaattaagaggggcttgtcgcccctttttactgtttctcccatacatttttcaaattgcagtgaggacaaccctgacacgacgtgcccccatcaatggaagttatttattttcataacgtactacgccttagttcataaaaatactgcacactgggatgctttaacttcatcttctcggtcatgtttaaaattcgcttttttcctactcgtctgtccactaaagctagaatattcaataagatatcattactctctaagctgtcctctatagaagtagttaaaaacttattagctacaacattaaaattagacttgcttaatgaggcctgtgctgacaaaagctcctttgcatgctctgatatttttctacctcttgcaattacttgtagacgatcctctggaacggtccctttggtatcttttctgaccgcttcaatttcttcattgctgataggaacttggatattgggatcattcttgatttccaactccgtctgataccattggattggactagtgatatcattcatattgagtatgttcttcttatctacagttatataacaaattccagacttatcagacaaataacggtaactggtcgctcggtattcgacccttccgtctaacgcaggacagaggaagctctccagttgttgcttcaatttactccaggacatatatcctcctatgttttcaatgtctactaacagcccgtccccaacttggcaatttaatttccacgttcctctacctcatcatgatccttgcttccaaactcatcaagcaatgtacgcacttcacttgttgatttggcgttcattaagctgtttctgagttcacttgcccctcggaatccacggacatatattttgaagaagcgggcaagagggctgaacgaacgtggctcctgcgctgaataatgatcatggagatctagatgaagccgcagcagttcaagcaattcctcactgctgtgttccttcggctccttctcaaacgcaaatggattctggaaaataccacgcccaatcataatgccatccactccatattgctcagcgagcttcaagccggtctgacggtccggaatatctccgttaatggtcagcagtgtatctggtgccacctcatcacgaagtttcttaatctccggaatcagttcccagtgggcgtctactttgctcatttcctctctggtccgcagatgaatagagagattaacgatgtcttgtttcaaaatatgggttaaccagtcgcgccattcatctacggcagtgaaaccaagccttgttttcacactgacgggcagtcccccggctttggcggcctgaatgatatccgctgcgatttcgggacggcagatcaggccgcttcccttcccattctcggctacattcgctacaggacatcccatattaatatcgatgcctttgaagccttctttcgccataccaatgctcatttcacggaaatattccggcttatctccccaaatatgggccaccatgggctgttcatcctctgtaaaagtcaaacgcccgcgtacacttttgttcccctccgggtgacaataactctctgtattcgcaaactccgtaaaaaacacatccggtctggctgcttcacttacgacatggcgaaacacaacatccgtcacatcttccatcggtgccagtataaaaaaaggtcgtggcaaatcacgccaaaaattattcgtcatatcaaaaactcctctataaataccaggacaaatctttggtcccaaaatggtaaagctaacctgttcatgtccttacttcttcttcacatacaacatgtttaagcaacgtagttcaagcggcagtatatgttaagcatagacatctaaatgagtatatcatactcagtagaggagcatactccccaaaagactcgcaaaaaaaggaagaacgccgcccctcctactatttccgccattatatctccaaattagttgcccctccgtaccagcaacactgtacacttcacatgccattgtaaataaaatatgttcccgcactcaaccttaaagcgattttctaaatgcaggaacataaagttgttcttaaaccctgtacatcactgcttcttatgtgcattttctaaatagtcgtatcatccatgtcaccttcgccccaccgctgctccgccttacagccacaaggcttcacagcctctcactcacgctcccacccaatttctgcctgcaataatagtcgtaagaagaaacagaggaatttctgagtcggaacgggaaaaatcggggtcaaaaaagcaattaaagtcgaactaagagtaggggaaatgacaggaaaaatatggggatatggcaaaagaaaatcgaaggaaatgatcgaaaaaaaataggagaaaaaccgcctctgttcaatgattagcggagatttgggcgaactttctatgtattgcggtggaaataggaaaaagagccgaggaaaacaggaacggaacccctttctcactcggctcgtaacacgactgtttatgctttagtacgactgtttatgctttgagatgactttgtgtgcttctacatatcatttcgatatattactactacgcactccacatgtgtcgagacagtgacaacaaaaataaatcattatgtgtcccaaggaatagtgtttgctcaaaataaaatattgtcaccatatcgaaccttaatctgatactactaaatagtacttttccaaaatctctaaaaaccctgttttatttcttaatgatttcaaattattatgatttttcaataaatcaagcaatttctttctatcataataacaatcaaaaaatgaaggtttaattttatcactattatttaatacttccaatttctgtatgccttcttgggaaaaattagcactcgtaatataacaaccttttattttcgacttatcatactcggagttcttttcgtaatatgctttggcgattggatatgtcttaccaaaaaaccaacgtatagagtttggtgtattggtatctcctaaattaattattgtggaattctttaaaccctttaattcaataatcacaatttcatcttcattgttatcacgaacgataacatcgaattcataggattttttaggatcgtcaatatttttaataattttagagtgttctatgtgtgctcctttaaataaatttgataaaacagtatacattaatgtctcaaacaaatctccctttagattttgtaaattatccgtttgccctgactcctcaataactgttagggattctccgatcttttcaataactgaactactagtttcttcatctatcatgaatgcttcatcaattattcttttcatatctctgtacttctcaataacctgaacgatattacttcccattattgacttaagtgaaaagttcagaatatgcaaattattcatttcccttttaacgttttcatctacatcaagataaaaaataatcggcattactttacgagcgctttcttgttttgtgctatgtcttattgattgaatacgctcataaaatgcttctaaatcgatttttcataagtacgataaatcagaatttctataacaacaattgtataatcctcatctattttacctgtatttatggtaaaacccgtggtcttagaaatggttgttgcatcaaaaggaaaatcatttctaatagcacctaaattgggattatcttttctccgataagataccctatcggttataaatccatgattaatcagccatctaataatatcgtttataaacatgacatcccgcttcatgttagcaagatgagcttttattttttgtcttataacagcagaatcttcaacatccatttgatcctttaataatactaaaaaaggaattccggtctccttatcttcaatcttcttaatgatcttgttatcatttaatcgttttatatcatcttctaacgaaataacgcgatacttttctttattagtcattggcgttgctgtaattttgactgcttcataataagaacaaataccacctgtacgtgaaagaagcgtaagtaatctgaacaatggcttgcgatatttttggctgatatcaagcaatgctcttacatcaacatttctattttgattcatataaaaatattgtcttttttcaaagctaaatggctcgctagattttatgattttttctttaaccgctcggctaattagttgacgtgcataattatcagaaacttcaaactgagttactaatttttcaattaaatcatgagcaactaatacattagaatgctccacaaataaatcagttagaaatttattgtatttaatcatgtaacacagcccttatataaattttatcttctttaaataaaaagagacaaaggattttttttaaaaaaggttgataataaaggtttttgggaatcaaattaaggtaataacatgtaacatagctaacgtttctcaaagatataatgctagcatactggatgattttcattacttttataaaagttcgtctggaataagagcattaccatccctaaattcttgatcgactaagataacattatttaaattggcagacttccatattgactctggaatgtgttcaaatactatcatctgaaatgattggccatataattcattaatatgagttataaagtcgttaagtacggtaaaagcaatcgttattttggttctatcatcttgtggtatctgtgaccatttttttgtgtttttcttgtttccttcctcaccgtaatatggcctactaggctgatcaaagattagaagacttggaacataaggagcaccttgttttattatcaattcatgtattccaagcatgaaacaaagatgcatgaacatatgatttgaactacttcctacaacagaagggacaagtgcagtaggttttttcaactgtaaaaccttggttttataatcaaatacagattgataatccttgtagattccaagtgcatcagaagatttgtctagatatctttgaaccagttcttctagcaacctgataactaaacttctatcaatattttctgtctcaagttttgatttaagttgttcaagttcatctttctttttatctagatcctcttcattgaatatctcttgatctccatgtttaaataaccttaatttagattttatttcaccgatgaatacgaatttttcaatttctgtgttaaaagattttttgttttgcggaactttatctatatctttttgaatttcatcaagttgctttgttagttttttaagatcatcatctaaatttatgtcaaatggccttttgttacttatatccttcttaatcttattcatttcagtttcaagaaaatcaagcaattcagtaagaataggatgttgtataagatgtccgtaattttctcttagatgatctactggtttgagactttcaaatgtctccgactgaagttttttgaatccactatactcatttttaaatttatataac

SEQ ID NO: 2698 - DNA, 1608 bp, Unknown
  Kingdom: Bacteria, Phylum: Firmicutes, Class: Bacilli, Order: Bacillales, Family: Paenibacillaceae, Genus: Paenibacillus
gagaaacaactattcctgctggtggacaaaaaactaggaatttcgaacaattagttggtactggcttatcaggtaactatgaagtatatatatacaacaatgatggctctctctatgaccttaacataagtgctagacaatactaaggtacaagaggttcgtctcctttgtgagacagcctctttttttctacattctgacgttctgaattccatttcgtaacatgtatcgaagctcaatcgtaaattagaccatatgtgcataaaacacttattccatatagctttttgccgtgttcgagccaaatttagtatcaaataaaatttgtatcgtgccgtatcgataaagtacctaaaacatagatagaataaggacttttggtaaatttgaccaatatcgtagtggcaatcgtacgtatcggagaaaaatgttcaaaaaagcttgatggatcaaggggtttttaagtttttataaattaaattgcaaaaaactgaaattgaaaaatcctttatttatctatgtttagtatcgtacctcaatcgaatcgtgaatcgtaacaaggatagcggagaggaagtgttataatcgtcatttcgatattatcaataagtaaatcgattcaaacactctatcatacttactcaactcatatgtaatagctgaagcctaagacaaattgtctcagcgttgaatcataccgcagctcatgaacagtcatttcctccactgtcttctgctcaccagtcgatgggacggtgtgttcctgatcaataaactctaaacggtctacagattcaggtaaagataacatttcaaatattttactgactggcagttgcgacgtcgcattcccgaattgttcaaatgctttaatcattctttgtgctgttctgggagtaaaatcgactgtctttagccacttctcccactccccatgcaccaagtctttctctttcacatgcttcaatcgccgcccaatctcaaacacagactaaccacaagaaaccaacctttatatgatgagttttagtcaatggattgaagagaattcactatttgctctttatgatatctatcatgatgcacaaacatttcttgcaaaaagttttccattgtatacggactattattaaattgacttataagaatcgattctgaaaccatttttagtttttcaatcattcgcttacgttgagaaatagcttcatttaacaaatcatgtggtttcatgcttctaccaaaatcaacggatgcatcattaaatgcctgtacaccgggattttcttggagcgttatttgctctttattatttatcttatcaagagttttaatgaagtctttatcccaacccatgatatgactgataagatcttgaatagaccatgtaccaacaatctttttgcaaagtatatcctctgagtatggaaataaagtagtaataaaaacagtccaattttctaaatctttagagatttcagcaatagtagccaagcgaactcctcccatctgattattataggatagctgaaggtatacgtatatttcaatatgaaagaagcctcatcacctctccacaaaatacctattagtcatataccaagccttacc

SEQ ID NO: 2699 - DNA, 2682 bp, Unknown
  Kingdom: Bacteria, Phylum: Firmicutes, Class: Bacilli, Order: Bacillales, Family: Paenibacillaceae, Genus: Paenibacillus
gtattacagttggattatatatattttctcacctatgtagtttaatttctgaatttgtatttgcagaattaggaaaaagaatatcttacaatatgaagaagaagttattagaaaagatgtttgttttaccaggagaaattataactgctaacaatgataaattattatctctgtttatgaacgacatcgggataatcgaaagattgatatccaatggtattcctatgctaatatccaacttactttttctaattgtgatttgtatcgtattactgctttacaactacaaattatttgcacttatccttttgatcatgattttcactttaatttgtcaaatatcccttaataaaaaaatcactcaaaagactaaattggttatggaagcctacgacaattcttttttttatatcagaaatacccttgtttcactcctttattccatcggaatggacataaaggactatattcttggaaagtatatgcctttggaggggaaatcacttgaggctaatagaaagagagtaaacacacttataattgcctccactgttccttcaatcattacctctgttggaagtgttcttcttttaggcgttggtgccattttagtaatggatggtcaaaccagcatgggtatactaacggtatttgtttattattcgaatcagattataggccccattaaaagtgtgacaaactatgtggctgcttggaagcaagcaaaagtatctatcgaaagaattgagaccattatgaaagcagatgaggtgatttaacatgaatatagagtttaaagatgtcagttatagttataacggtttggaaatggcactttcaaatgtctctttcgttattcacggccatactattttttgtctatcgggtcacaatggagcaggaaaaagcacgttactaaaattacttataaaaatcaattgtaattacaccggtaaaattataatcaatggccgagaattaagggattggaagcgtaaagatattatcaaaaaaatagcaatttgtttccaagaacctgtaatgtatgtggataccatatttaataatataactttgggccaacagggtatctcggttgagaagttaaattattacatccaattattagataccaataatttcattcataataatgaccaacagcaaattattggtaagaatctctctttatctggagggcaacaacaactaatctcaatactgcggaatatctataccaataaagaagtattaatctttgatgaaccaacttcaaatttagatagtgttgtaaaaaagaactttatttcgctattagatgatctcaaagagagtcatactattatattaattacacacgacagtgaaattgtgaataattatgagcaggtactgctgtaagctcagatcaagctacagtcctttcccgtataaatccttctctcctaaaccgcttagaagtggtaggatatttgtacataatttttggaatcaatacgggaagactgcccctcttcactgctattacagatcccacaatacaatattaacgtaaaatttatgttcttcgattcttatgtctatgattcctgaattctcattcacaatcttcctaacactttttagaccaaagccatggtttttcctatccttttttttagttactagactgctatttaaaaactttggattataggaattcgaaacttctaaataaagttgcctttcatgatacttaatttttatatcaattgatttttcaccttcaataatcttgtcacaggcctctattgcattatccaacaaattcccaaatacattagctatgacattattgctcaaagaaaatttttctggaagaaagcaatctatagttactaatacattcttctcagtagctaaacttatcttttcagtgagcaaataattaagcacatagtttggtgtatatttctgagttacagtatttctaatatctgaaagaatttcttttataaaagcatctgcttctttgttcctttgatctttcaacaatccttgtaaagtcaataattcatttttcatattatgcctaatcacacgaatttctttttgagatttctccaggttatcataataattattttttttcgcattattgagattcactaattcttgctccatcatttctccataagccttgtttagtttctcatgagtccattgcatagcgatgttaattgatagcactcccattacagaaatcaggcttaaaattgggttaggacgctcaccagattttagaattaactcacaatggctgcccagcataataagagtaactataggaagggaaatcaaaaatacatctaaacatttagatgtatttctctttcgataatcatctactctatatatgaagggtatccataagaatataaaaaacttaatgacttctgataacataacttgcatttcataatagtaggatgaatgcttagttataaaaagtaaatcaggaaaacaaattttaataataacaaaagatagcccatgagatgctatacctactagtataacgtttaaaccccaccaaaactttttctttagagagtcatagtaaaaaaaaagcactgtgactattaaaatagtatttgagattacattcgaattcatattcagaaaattattattcactaatac

SEQ ID NO: 2700 - DNA, 630 bp, Unknown
  Kingdom: Bacteria, Phylum: Firmicutes, Class: Bacilli, Order: Bacillales, Family: Paenibacillaceae, Genus: Paenibacillus
attatttactaggtgaaatagattctgtacctaacataaatattctaagttataattttttgagttcaaggatcatggcttctttaacattaggaaatataatactttgggctttgatcaccatcttggtttacttgtggattttgatgaaaaaagctaagcacataatatggttttttacttgtaatattttcactttagttttatttcttgtagtctttgtcctttatactcatactttttttcgattgggaaatttcgggaagagtatttctgactatgatttagactatgtatgcattgagtatgagttgaatgggaaaaaagaattgaaaggcctcagggtttatcaaggggacggacatatcgttatacgagattcgtctaatcaaacacatgatatttcttcggatacgtttcatattaagacaatatcttcaatgagtactaagtgtggaaaataagtacttgcacttgcgctatgctctctggttctaacaaaagtggataagagaacatttgacaggtcaattgtttaatttgtgaatatgagtctaacataggggataaaacgtctagactcaagttataatgtatatttttctactagcaaatcttctaccgaaatac

SEQ ID NO: 2701 - DNA, 2136 bp, Unknown
  Kingdom: Bacteria, Phylum: Firmicutes, Class: Bacilli, Order: Bacillales, Family: Paenibacillaceae, Genus: Paenibacillus
gacattatagtatcaactaatccaattgtcaaataaccatccccttcatattcactatctgacgtatgttatgtaattccagttgcgcattggtcacagcgttcactgcatagggatagtttgttttattcgttaacacatcgcttctcttttattgttccatgtgaaacaatttttatttatatttatatattaaaatcaataatagattcttactataacgacgacccataacgaaacacttaataacaaagatattttatccttcattctccatttcatcaacttatcaccctttcagatgtatatagacatgcttgccttggtactcaactctatccatttgaaacgcagtagatagttcaagaatatccatatcagttccaagtgtatgtatgatagttgatccgttttgtctaactactcttatatgcttcatttagtttctacccctttgaatttgtatttaattatatctttattataaatgcgattttcgcattcgtcaataaagaaattcgattttcgtaattgcacgtatagtagtcactccttataataagaatacaaagggaacttctggaggtttattgaaatgaatattgttatagaatgtcatcttaattccctgctgaaacaacgtggatgggattttaagacagcacataaagaattggggatacgcgaggcaactattagtgaatgggctagaaatgtaaacaaaacattttcacgggaacaaatcactactattatgagaacgtttgaactaactgatttagcacaattgattaccgttaaaattgaagagtagaccaattgaggggttgcctgcaattgaagaaatgaatatgaaaccgagtaagtgaattatttatacaagtttaaacagtaagcaaaaaaagagcctagacataattcatctaggcttgtttgtgtatagtattattagctatgaatgatatatagcattaatgagcgcaactattgcaattatccacgggatgacttttgtcatagttacttgatcccaatcaaagaatttatattctttcctggcatctgtaacgagttgctggacttcattgcgacattcctcatcatctatctgtggaacgattttttcaactgtttcaaaaaattcatccacgtcatgagtagttggtatatcattattgactctatcagttccgttattagttgaagttggtatttgattaaagaacttttttgtcatctcgtttattttaaaatattcagatggtatatctttcaccaattcaagagatggttttatttgttttatatgttcaatggtaggcttcagattgtcatacttagcaaccatatcaaatgcagtcttgtaataatcgctatctgtaacctttttcattaaatttaaatgttcttgtagtttaggtggtatttctatttgcttcaatatatcgtcattcatagcatcccatcctatcatgagtaatagctatattgtatcacatgagacaagaatggtaattcaatactgcattagaatatcaggcttactcattacttattaattctatctcttatgatgtccaatacaccccatgcgatcattaaagccgctaatatccaagctacaaatcttattgaattaggatactcaataaataaagatgcaatgccacagataataaacaatacatttgctggtatacgtttaataaatcgcttcatagtcaattccctccctttcgttgcctatagtcaatgattatgttattatgtagttgggtctaagggaaccaatttgattcccctagagtgagaagctttaacgcttggagtgtgtttcctttctaggaggaaatgcactcttttcattttcagcttctttaagcttgtctaatcgttccgctttctctttgcgtcttgctcgtttttcatcaaagatgaatttgagaattcgaagcgcaaaaccgagaaagtttatgattagagcaatgtaaggtatgtattctagcatggtgtcaccacctttcggtgtgtatctcccttacatatattattataccataaacctagtataatgtatatagtttatttatttatttttgtgtattggaagctgtgatgtgtttgatggaataagat

SEQ ID NO: 2702 - DNA, 1669 bp, Unknown
  Kingdom: Bacteria, Phylum: Firmicutes, Class: Bacilli, Order: Bacillales, Family: Paenibacillaceae, Genus: Paenibacillus
cttcaatactatagcttacatatttgctgggttcatattttactctttactccgagtagttgccaattttttatcgtttaatcctgataaaatcaactcagatccctattttatgagtagtgcaattgacaaaagaataaaaaatgaattatcacaatatcatttgctagagaatagaaatggagtctttactcagagtgtaaagtatgatccaaattgtggagtccagttatattataatgagatcgaacatcctgagaagctattctctaaattagaagcatacgaagaaatacttagagcaaccgggacatattctgctgaattaattattgataagataagaccttataaagagcaacttgttgtaatgataaagtaaaacaaatatttcattataaggagtatatgaaaatgggacacgatattagtgggtataacaaagaaaacaaagaagttgtgtatactcgatacggatcttggaacgaaggtgcaaggcatttatatagagttctaggtgcacaatcatcagacggcggggttagtggtgtgggtgaagaaatttatttcgatgaaaatcaaattagaaatgctatttcaagagccgaaacaattgattggtctaacattgaacagaccgaacctgagtatgagaaagacaaattagcaaagtttctcgatggacttctatgcatagctaccaacgaagacaaggtaaaagtttattttggataaatcgtacattttatcgtatttatttaatgaggtgaagatttggtgaggcaatggcttgattcagaaaaagtaattgatcaaatacaagacagtggcaattacctttcagttgaattgggagttcaaactgttaatccagtcaagattattgggttgtcacgtaaattagaggacgaggatttgaaatacttaagacaaaaaatcaaaaatgaaggatggagagatattgaaccaagaggtatagggttaatccttattccacaagaggataaatttattgtttattacggggggaatcatagagctataatttgtaacgagcttaacataacagaaattaaagctcatgttacagcttacatagacaaaagaaaaatgaactttaaggaaaatatcataatacaagcacgaaaatcgcaagtacgtaagttatacaaaagaatgaggaaatataaagatattactaaacgaactgaaattggaattaaagtgggaaggattgaggaagagctagaagaatacaaaagagaggtatatcttcgaatcaagaatactggaaatgtacatcttacttaaaagaaaaaggttggctgttatgaaatataaaaaggcaacaaaaagttttattcaaacacggtattactatgaagtagtaataagtctccatgccgaaaataacgataaagaagaaaacattactcgtggcctaatcattacttcagaagaaaaaatcacaattgatgatttacttcaagaagcagctaactctattaatgatatggttgatgaaaaaagggatttttatcagtataatttagtagaacttaatgggttgaatgtagtaggagcatatgaatggaatgtataatacgatcaattttaccttttacagaaaggaggggtagtctatacaaaaactttgtccgtgcaggta

SEQ ID NO: 2703 - DNA, 1141 bp, Unknown
  Kingdom: Bacteria, Phylum: Firmicutes, Class: Bacilli, Order: Bacillales, Family: Paenibacillaceae, Genus: Paenibacillus
tccgtaattttctcttagatgatctactggtttgagactttcaaatgtctccgactgaagttttttgaatccactatactcatttttaaatttattataacttctaattttatgcttgatttcattcttctttttttgtaatctttcaagctccttcatattttcggaagtatttaaaaattgaacattttcaactacatgctgtaagttacctatatcctcatttaagctatttgtttcaagtgaaattaaatcgtattcttttgcctgtttaactatagatcttagctcactatcaaatacactattttcttttaagatagcattttttcgtcgctccaatttcaaaatgtctttttctaatgtattaatcttgtccttaattattatgttattaacggtatcaattccaatagctaggtcaaatattctatgaagggcttctttgtatttttcatcattttgtttatcgaagaaaacttcactatggtcaatagtatctccagattgtgtattaaataaaaagaaatatcgtagcgatattttacttccagcctttaattttttcccactgtatgggatagttacattgctatcaatcgaaaactccttttcgattacagcttttaattcatcttcggtaatgtttggagtaggctcatttggaacatcaccgattggggagaaatagtatgatgaacttacttttcgattttcacttaacgcccctctagcaattacatattgcttatcgtttatctcaaatttaagaccgtaccaattgatattctcattaattttttcatcaggtatttttgttttactggcaaagaaacaataatctacaatatcaataattacggacttgcctgtaccactttcacctgtaattacatttattttgttctcaaaaaaggggattgaacgtatctttttatttttgagccacaaattcatttcattaattacgaatctcataatttcaccttcaattgtaggtataggttcttgtcattgtcattaagaatttctgataattttttcccagctattgatatatggaacgctcttagtccatacgcctctttgtttatagcaagttttttttctgggttaatagaaatttcagaattctctattc

SEQ ID NO: 2704 - DNA, 2550 bp, Unknown
  Kingdom: Bacteria, Phylum: Firmicutes, Class: Bacilli, Order: Bacillales, Family: Paenibacillaceae, Genus: Paenibacillus
atcttgaactaattggcggtgaactaaagaatgcaatttaacgaacaacaaagtgaagcaattgaattttatgaaggtgcttgtgcagttattgctggggcaggcagcggaaagtcaactgtcctaattaataggattaaaaatttaatagaagcacataatgtacgagaagaggagattttagcaattagctttaccaaaaatacagcggttgaattaaaacaaaaacttaaaaaattgggatacataaatacaaacattggtacattccattctatatgttcaggattgttattaaaagaaggcatacggctagctccagataaaatgataaaggattggcagatcgaaaaattgtttaacgatggagaaagcaaggtggacgtagaggatataaaaaacttcatcagttatcaaaagaattatatgaaaacgtatatggacgaattcgtatataaagaaagcaagtacagcgaaatcgatttaaggttttatttcgagaaatatgaaaattacaagaaaaataatggattacatgattttgatgattatcttgtcttttgtctcgacatgctaaaaaacaatccgaagaaatatacgttcaaatttattctagttgacgaacatcaagattcaaatttagttcaaaatacattactcaaagaactttgcgcatcgggcaatatgttttgtgtgtttgactacaggcaagctatttatacctttagaggagggaatcctgaatactgtatgaatttcaccaacgactgggagaatgcttcggttatcaatttggatgtaaattatagatcttcaagcaacatagttcataatgctaactcctttataagaaagtattatggtgactatgaacactattcagatgctattgctaataatccaaatttaggtgattttaatagcgtcattagtttcaacagggaactggaaagtataagtgcggtaaatgaaattgaaaggctattagataaatacaaaaaaccaagcgagattgccttgttgtatagattgaatgcacattctagttatgtggagcacgaattaagaaaaagaaatattgaatatgatatagcaaatgatagtagtttttttaagcgtaaagaggtctctggtgtattagcgtatatgaagttaatattaaacccacatgatgatggagcttttttggagatatttaaattgaggaatcaaccattggcgtattttagtgataagctgctcaatgaaatcaagcgtttctcaggtgctaataatcagtcgatgtttgaatcgttattgaattttgattatccaaatcagtggcaagaaaataacgctatacagtttgggaactacataaacaaattaagattgcagaatgataaaaggattagtgcagtccaattggtggacaatattgtaaaagtatttgaactaaacgaatacatagaaaacaagtacactaacgaagaggaagaaagggaaagaaaggagtccctagaaattttaaaaacattcgttaaatcagatagcccagaaaaatttcttaaatatgtaggtagcacaaaaaagaaaaacaatgataagtgtattaaactaatgagtatacatgcaagtaaaggtttggagttcgacaatgtaattataataggcgtagaagatggtaaatttccacatgataaaagtgatctattggatgaggcgaggttattttatgtaggggttacgagacccaaggtaaatttaataattagccaaataggcttaaatagcaagtttgtggacgaatacataaacaactaatatcagaatataagacaagtaagacattcagaaatggatgtcttttttattttctgaggaatgggtggcttcaatcgttactacaataaactcaatcgataatgcaggtgaataggataaaaacacttatgaaataaggattattatgtatatagagtttaggagcacatgctgaatcgtaaaagtatagatggataaaaggaattttgataaattttaattagaaatagtaaaaaataggatggttacgaaattgtcatgtgaactaatacatagataaacaaaggggagttgcgattgagtttacgattgagatgaggtgatattatgattaaatagttacaaatatgtaatataaggaaggagcgaaaaaataactttagtgtgtgagtagaagagctacagcattatttgtaaattataggtgtgttttggatgtaaaatacccccccttatccctatctaaataccatataagtatagttgtatggtatttagagatcgactaacaagggtgaaatgctgtctaagactgagtttgccagttgataataattggtaaaaaaatactaaatatcaaagtttgaaatttaaattttttgtctgatagtaggggaaaggtgaggcgtaatgactcattgcaatcgttaggtaacatgaatgaccgtatgctagactttaaattaaaactaatcatattagtttataaactatcactattagcatttacactaacaaccataatat

SEQ ID NO: 2705 - DNA, 696 bp, Unknown
  Kingdom: Bacteria, Phylum: Firmicutes, Class: Bacilli, Order: Bacillales, Family: Paenibacillaceae, Genus: Paenibacillus
cgttatggggtcagttccaactgctatatgcagtattctctcaggcttttttttattattgctgctataaatccatgctacatttacagcattatcaaaaaggaagaagcacagaatgaacaagacatagttatcagtagtaattgcagcattacttgaagttggatgggtcatcggcttgaaacatgctagtggatggatagagtggggaggcactgtagttgctattttagcaagtttcatacttatgattatgacggagatatgaagaggtctttttcacttgatcatatcctcaccaacatatcgatttactggtttaccaattcgattgcttcttccatacgaatatatactgaaggcacccaaatgccactgcatttcaccgaaggtcagcgtgttactgttccaacaggggtctcttatttcccaaggagctgcccacgcctccccaaagctgggtagaacgcgtctataatattacgtactgggagaaagcgaataaaggcggtcatttcgccgctatggaaaatcctaaattgtttgccgaccatctaaatcatttttttcattcattaagcgtctgatagcctctatccttcggggagcaatgcggggggggggggataaacagcaacggaatggacaagggagtagggtacgtgtactcacgctttatcagttctaggggcggga

SEQ ID NO: 2706 - DNA, 2129 bp, Unknown
  Kingdom: Bacteria, Phylum: Firmicutes, Class: Bacilli, Order: Bacillales, Family: Paenibacillaceae, Genus: Paenibacillus
ataatagataatagatatgtatatacagtatttagagatggttatgctgcgcttacccaactcttggattctgatatttttgttggttgaggttaatgtttaacctgttgttaaattgacttctattgctcaatacactgattaatctatgggaatgaaattatttggtggttggctaatgaaatggtaagtggataaaagataaagaacaagtctagaaaataaatatggaaaagcatcttgtgttctatatacaaatataaataaataatatattataaataataaggttgatataattatctatacatattaaaaggagatgtgaacttgtcaaacgaaatagttttatcaaatgacttaaatattatcacagcagaaataaacagttataaacaaattgctgggcagtcggtttttgagattgggcgacgattgaagcatgtgaaggagaatgatttggtgcatggtgagtggatgcgatggttacgagatatagatatgagtcatcaaacagcccaaaagtttattcaggcatcgagtcagtttggtaacctcgcgacatcgcgaagtattcccgttggcaaaatattcgaaatgctttctctgcccgaatctgttgatcgtctggagtttgttaatcaggaacatactgtaccttcaactggtgagaagaaaacggtagatgaaatgactgttcgtgagttgcgtgaggttaaaaattcactcaaggaaaaagaaaatacaattaaagcacttgagaatgacaaaaaccaattaaatgacaaaattaaatctctggagaataaaagtccaaaggtggttcacagagaaattgtaaaagaagtaactccaaaacacgtaaaaaatgaattagatgatctacacaagtctctagattataaaaataaacaatatgatttattggttaagcgtgaaaaactactcaatgaaaaaatagaactatatgaatcaaatacagaaagttataatcaactcaaatctcagattaaatacttaaccaaagagaaagatgatgttggacgacaaattgaagcagcagtttctttatctggatacatagtagaaattgaagatttgttaaagaataaattatcccccatcaaatactctagagcattgttggaggtaaaagataatccaactgtaattaaaaatgttaaagacatagttgactgcgtagagtcatggtgcattgaaataagaacacatattccaaatacaagaataattattgaaagtgaggataattaatagtatgagtactaacttacaagattatttagaaatgaataataaaatgcttactaatatgtctgaaatgattaaacaaagcaaagaggaggccgagtttaatgcaattaataaaatatcaaaagtacttgatgaattaaaaaatgaggtggctgtcaataaaaataactacgatatacttattaataagcatgagatactagaagaggagcacaaacaattgtctgcaaaatgcgaaaagtatgaagatattttattcgtattaaatgctgaccgcgacaaacaaagaaagttaaccaaactgattcaaagtctgacttttcaaaatttcacagttaaccgcaataatataaagtataaattatttcattccgctttgatcagccattgtcatataaaattgaaagagtattttggtgtgaattcttataaagatattaaattgtcagattttgagaaagcgttaattataattgaagatatctataaaaataagcaaagtataaaaagatgtattgataaaagacttgctgcatacataaaagatcttagtaggggatatcttgaaaagcataaagagaaattggttaatgattatcttgaactaattggcggtgaactaaagaatgcaatttaacgaacaacaaagtgaagcaattgaattttatgaaggtgcttgtgcagttattgctggggcaggcagcggaaagtcaactgtcctaattaataggattaaaaatttaatagaagcacataatgtacgagaagaggagattttagcaattagctttaccaaaaatacagcggttgaattaaaacaaaaacttaaaaaattgggatacataaaaacaaca

SEQ ID NO: 2707 - DNA, 594 bp, Unknown
  Kingdom: Bacteria, Phylum: Firmicutes, Class: Bacilli, Order: Bacillales, Family: Paenibacillaceae, Genus: Paenibacillus
ctataaatcaattcatctggaaatttaataggattttgatatgctttaattatcgagagaacttcattcttagctcgactttgcagaattataaaaccaattgcataataagttttccatgatactaacccaagtaataaccctataataaattttaagaaaaagggtattctcagatatataagaagatacttagagagaggaatataatctttgtacttttctagcaataatattaatttcctaatcaatttattataaaaatctactaatttcatatgccgccccttttataaatctttcttttagtattttcttatatcgttagtttgtatatataattttatagatgtttacatgaaaaaactctaccagctacccagcagagtctttcacatttactctaaaatcaaattgattcctcatgaaaaagcttcctataatcttgatggcttccggtgtaatcttctcaacagtagtccacaatatctattaaatcctcgcccaacggctgaactaaatatactcttacctggcttaatgcagcagcaaatagttctaaatccgattttagcactttatatgtatggttca

SEQ ID NO: 2708 - DNA, 5962 bp, Unknown
  Kingdom: Bacteria, Phylum: Actinobacteria, Class: Actinobacteria, Order: Streptomycetales, Family: Streptomycetaceae, Genus: Streptomyces
tccaggagctgatccagctcgctctgcgcggtggcggcccggacaacatcacctgcatcgtggccgacgtcctggacgtcgacagcaacgacaccctggccgggcagctcaacgacacccccgtcgtcgtcggcgcggtcgcggagaaccaggcccaactgggcgacggcggggccatgcagacgcccgccggccgcgcggccggcctcggccgccccgtgcccccgcccgccggcggcttcggcccgcccggcagcggcgacgtcggctacgggggcatgccggacggctcctacgacgcctacacggacggggacttcgccaaaccgggcggcggccgtaaatggctgaagcgttccgtctacatcgtgctcgcactggccgtgatcggcggcggtctgtacggcggctaccgctggacgcagacgcagtactacgtcggcgcgcaggacgagaacgtcgcactgttccagggcatcagccaggacctcgcctgggtctcgctctcgaaggtcgagaagaaccaccccgagatcgagctcaagtacctgccgccgtaccagcgcaagcaggtcgaggcgacgatcgccgagggcaacatcaccgacgcccgcgagaaggtcgccgagctcgccgcccaggcctccgcctgcaagaaggacgcgcaacgccgcgcggccgacgccgagaaccgggcccgtacgggcgagggcgaggccggcggcaccgccggggcccccgccaccaggacttccgccacgtcctccgccaaggggaccaagccgaccaccgctcccactcccggccccagcctctcggaggaagagaagaagctggtcccgcagtgcggtaagcagtaagccgtagggggccttcagcaccatgagcgttgtcaccaacacgaccaccatcggcgcgatcgacgcaccgagccgccgcaacaccgagctggcgctcgtcgtcttcgccgtcgccatctcggtgttcgcctacgccaacgtgggcctcgccctcaatggcgaactgccctccggcatgctcggctacggagcgggcctcgccctgctcggcggcgtgggccacctcgcggtccggaggttcgcgcggtacgcggaccccttgctgctgcctctggccaccctgctcaacggactgggcctggcgctgatctggcgcctggaccagtccgaacgcttccaggccctggacaccttcgtccccgccgcctcgaagcagctgctgttctccgccatcggcgtggggatgctggtcgcggtcctggccatcctgaaggaccaccgcatcctgcagcgctacacgtacatctccatggtcgtggcgctgttcctgctgatcctgccgatgttcttcccctccgtgaacggcgccaagatctggatcaagatcccgggagtcggaacgctccagcccggcgagttcgccaagatcatcatcaccgtgttcttcgccggctacctgatggtcaagcgggacgcgctggccctggccagccgcaggttcatgggcctgtacctcccccgcggccgtgacctgggcccgatcctgatggtctgggcgttctcgatcctgatcctggtcttcgagaccgacctcggttcctcgctgctcttcttcggcatgttcgtcgtgatgctgtacgtcgccaccgagcgcaccagctggatcgtcttcggtctgctgatgtccgcgatcggcgcgatcggcgtcgcctcgttcgaaccgcacgtccagcagcgcgtcaccgcctggctcgacccgttcgcgggctggggcaaggaggccgcgagcgagcagatggcgaagtccctgatggccttcggctccggaggcaccctcgggaccgggctcggccagggcaactccgacctgatcggcttcgcggccaactccgacttcatcctggccacggtcggtgaagagctcgggctcgccgggatgatggccgtgctcctcgtctacggcctgatcgtcgagcgcggagtgcgcaccgccctggcggcccgcgacccgttcggcaagctgctcgcgatcggcctctccggctcgttcgccatccaggtgttcgtcgtcgccggcggtgtgatgggcctcatcccgctcaccggtatgacgatgccgttcctggcggcaggtggttcctccgtgctcgccaactgggccctgatcgccattctgatcagagtcagcgataccgcccgccgcccggcaccggctccctctccgtccaccgacgccgagatgacgcaggtggtccgcccgtgaacaagcccctgcggcggatcgcgatcttctgcggcgtcctcgtcctcgcgctcctcatccgggacaactggctccagtacgtccgcgccgacgagctgaccagccacaagtacaaccgccgcgtcgagatcgagcggtacgcccacgagcgcggcgacatcatcgtcgacggcaaggcgatcaccggctccgccgagaccgaggacagcgacttcaggtacaagcgggtctggaaggacgggcccctgtgggctcccgtgaccggctactcctcgcaggccttcgactcctcgcagctggagaacctggaagacggcatcctcaccggaaacgacgaccagttgttcttcgaccggacgctgtcgatgttcaccggcgacaagaagcgcggcggcaacatcgtcaccacgctgaacggcgatgcccagaaggccgccttcaaggggctcggcgagaagaagggcgcggtggtcgccctcgacccgaagagcggcgccatcctcgccctcgccagcaccccgtcctacgacccctcggtcttcgccggtaactccctcaaggactcggacaaccggcagaagctcctgaaggacaaggacaagccgatgctcaaccgggccttgcgcgagacctaccccccgggttccaccttcaaggtcgtcaccgccgccgccgccctggagaacgggctctacgacgacatcgacgcgaagacggactcgccgctgccctggacgctgccgcagtccaccacgcagctcaagaacgaggggaacatcccctgcgagaacgccacgctgcgcgaagccctgcgggtgtcgtgcaacaccgtcttcgggaaaatgagcgacgacctcggcaacgagaagatgatcgagcagacggacaagttcggcttcaacaaggaagtcttcacgcccgtccgcgccgacgcgagcatctaccccgaggacaacaagccgcagaacgcgatggccggcatcggccaggcgtccaaccggaccaccccgctccagatggccatggtggcctccgccatcgccaacgacggcaagctgatgcagccgtacatggtcgccgagcggcaggcgcccaacctggacccggtctacacgcacgagcccgaagagctcagccgcgcgctctccggtgagaacgcccagaaggtccagcagatgatggaaaccgtcgtcaaggacggcacgggaaccaacgcgcggatccccggcgtcacagtgggcggcaagaccggtacggcacagcacggtctgaacaacagcgagaagccgtacgcctggttcatctcgtacgcgaagaccgacagcggctcaccggtcgccgtcgccgtcgtggtcgaggacggcaacgccaaccgggacgacatctccggtggcgggctggccgcccccatcgcgcgcgacgtgatgaaggcagtcatcgacagcaagaagtgagacctgtcacggcggccgcccgtcataccggacatcggataccggtcggatatcggctgacgggtgcgggctgatcacgtcacccgtgcccggtagcgtatgcgcgaacagcgcaccgccgcggaccacacacgggtgcggtcgggactgacggagagggctggaacagttatggaagagccgcgtcgcctcggcggccggtacgagctgggctcggtgctcggccgtggtggcatggccgaggtctacctcgcgcacgacacccggctcggccgcaccgtagctgtgaagacgctccgggccgatctggcccgtgacccgtcgttccaggcccggttccgccgtgaggcccagtcggccgcctcgctcaaccaccccgcgatcgtcgccgtgtacgacaccggcgaggactacgtcgacggggtctccatcccgtacatcgtgatggagtacgtcgacgggtcgacgctgagggaactcctgcactccggtcgcaggctgctccccgagcgcactctggagatgacggtcggcatcctccaggccctggagtactcgcaccgcgcccagatcgtccaccgcgacatcaaaccggcgaacgtcatgctgacgcgcaccggccaggtcaaggtcatggacttcggcatcgcccgtgccatgggcgactccgggatgacgatgacgcagaccgccgcggtcatcggcaccgcccagtacctctccccggagcaggccaagggcgagcaggtcgacgcgcgctccgacctgtactccaccggctgtctgctgtacgaactgctcgcggtccggcctccgttcgtcggggactcgcccgtcgcggtggcctaccagcacgtccgggaggagccgcagccgccgagcaacttcgaccccgagatcacgcccgagatggacgcgatcgtgttgaaggcgctcaccaaggacccggactaccgctaccagtccgccgacgagatgcgcgccgacatcgaggcctgcctcgacggccagccggtcgcggccacggcggcgatgggcgccgcggggtacgggggctacgacggttaccacaccgaccagcccaccgccgccctgcgcccgaccgacccgaacaacgcgcagacctcgatgctgcccccggtcaacccggacgacggcggctacggctacgacgaccgtccgggccgccggcgccagcagaagaagagcaacacctcgacgatcctgctggtcgtcgcgggcatcctggtgctgatcggcgcgatcctgatcggccgggtgatcttctccccgaccagcgacgacggccagatcaaggccccgaacctggtgggctccacggtgcaggaagcggagaaactcgcggccagaaccgacgtcaccgtgaaggtcggcgccgaggagccgtgcgaggagcaggagaagggcgagatctgctcgcaggatccggcggccgacgcgctgatggacaaggacggcaccgtcacggtcgtcgtctccgccggagcaccgaagatcgagatccccaacgtcctggagaagtccgaggacggcgcccgcgaggaactggagaagaagggcttcacggtcaacgtcaccacggaggagtccgaggagaccgagggcaccgtgatcgagcaggaccccaagggcggcgcgaaggccgaggagggggccgagatcaccatcaccgtggccatgcagacgaccgatccgatgccggacgtgcggacccgtcagtacgacgccgccgtggcccagctcaaccagctcggattcaccaacgtctcacgggccgacgtggactcggagaagccggccggagaggtcgtcgaacagacccccgcgggcccgagcaagcaggccaaggacgtgcagatcgtcctgaaggtctccaaggggccggcgcagccggagcaggtccagatccccggtgacatcggcaacaggccgtaccaggacgtcaagggccagctcgaagggctcggcttcgtggtcgcgctcgcccccaactcggtcgacaagccgaacgcccgggtggtcaccagcagcccggcgccgaccacccaggcgcccaagggcagcaccgtcaccctcgtgaccatcgagggcggcgggaacggcgggggcttcatcggaggaatgggcgacgactgaaccgccgtccacccaccggcagtacgggaagggccccggtcaccactcggtgaccggggcccttcccg

SEQ ID NO: 2709 - DNA, 3305 bp, Unknown
  Kingdom: Bacteria, Phylum: Actinobacteria, Class: Actinobacteria, Order: Streptomycetales, Family: Streptomycetaceae, Genus: Streptomyces
gctccaggacttccggccgccgccatcagacagaccgcacacctcgtcgcccatgcggccggaagtcctggagccatgagatcagcgtcacatgggccccttcatccggcatcccggacgcggtatccggaaatccgcgctctgataccggtccgcggcggagatccgtggacccgtaacgatcaccttcggacgatccgtgacgctcgtcgtcctcgcgcgatgcgtcggcggtcagtgctcaggagggcttgccggtggagaccttcagctcgaagtgggcgccgcgctcgtcgaccgccgcaccggaggacgggaactggccgacgacctggccgtcggcgtacgtgttgcccggctccgcgatctccttgaccgtccagcccgcggcggcggcgcacgccttagccgactggatgtccttgtagatgaagctcggcgcgcggaccttcttcgggtcgttggagtcctcggacgcgttcgagcagtccgtgtccttcatcgtccggttgcgctccggcgggcggtacccctccacctgttcggtgcccgtcccgccgtccttgcccgcctcgtcgtccttgccgccctggagggcgatcgcggtgatcaggccgccgatggccagcagcgcgacgacgatcgagccgacgacgaccggcatgttccgcttggagccgccgcccgcggtggtgcccacggccgtcgtgtgctgcgggttgatcgagtacggcggcggggtctggtgggccagcgggcccggggcctgataaccctgggccgcctgcgggtagccgtagctgggcgtgggcgccggggtcggctggctgtacgggcccggctgctggtgcggatgcggctggtacggcgtctggacgctgtggggcgccggggtgctctggtcgaccggcgggaacaccgccgagccgacgccggagccgctgttggcgggggtgccgccggccacgatcaccggggcgccggtctggccgccggaggcgttcagcacccgggcgatctcgtcgcgcatcgcggcggcactggggaagcgctcgttcgggttcttcttgagcgcgcgggcgacgagggcgtccatcgccggggtgaccgaacggttgatgctggacggcgcgaccggctcctcctgcacatgcgcgtacgcgatggccagcggggagtccgcgtcgaacgggatccggccggtgagcagctggaagagcatgatgccgaccgagtacaggtcggaccgggcgtcgacgccgcggccgagggcctgctcgggggagaggtactgcggggtgccgacgaccatgccggtctgcgtcatcgaggtgacaccggactgcatggcccgggcgatgccgaagtccatgaccttgacgatgccgcgcttggtcatcatcacgttgccgggcttgatgtcccggtggaccaggcccatctcgtgactggtctccagcgcggcgagcacgtccgccgtcaccttgagggccttgtcggccggcatcgcgccgtgactgcggatgtccgcggccagcaccgagccgagcggctgcccctcgacgtactccatgacgatgtacggcatcagcgcaccgccgagctcgtcctcgccggtgtcgaagacggagacgatgttggtgtgctggagcttggcgacggcctgcgcctcacgccggaagcgctcgcggaaggactgctcgcggccgagctcggtgtggagggtcttgatcgcgacctggcggtcgagggcggagtcgtaggccaggtatacggacgccatcccgccctcgccgagcaggtcgcgcagctggtagcggccacccgcgaccgctccgcccgcgtagcggccctgtgcgccgtcctggctcatgacttgcatccccctcggcggcgcgcggtcgcacgcggtgtatctgtctgacgtgatcgcgtgcgacgcggttccgtacaacgcgattacgcgccaagtctgccccaggggtccgacacgtcaagccaggtgcccgttccgtgaccctacgcacaagaagcgtctcggaagcgttacaggaaacgcatcaaatccatgtgtaggacgcgccgggcggtccgatgttcctgccgcagcggaaccgtggtgtccggcggaggctgtagcgtgacgtggcaatgcagcaaggcaccgtgagaacccgcggacgcgcggacagatacgacggcgaggactgatggcacccgattccgaagcaaacggcggcggagtttcggatggctccgacgcctggggcgtcggcggcgtcgtcggtgacggacgttaccggatgacctaccggctcggccggggcggcatggcggaggtctacgcggcggaggacgtccggctcggacgtacggtcgcggtgaagctgctccgttccgacctggccgaggacccggtctccaaggcgcgcttcacccgcgaggcacagtccgtcgcgggcctcaaccaccacgcgatcgtcgccgtgtacgactccggcgaggacgtcgtgggcggccagaccgtcccgtacatcgtgatggagctggtcgagggccgcaccatccgcgatctgctcctgaccgcggaggccccgccgcccgagcaggcgctgatcatcgtctcgggggtgctcgaagccctcgcgtactcgcaccagcacgggatcgtgcaccgcgacatcaagcccgccaacgtgatcatcacggactccggcgcggtcaaggtgatggacttcggcatcgcccgcgcgctgcacggcgcgcagtcgacgatgacccagaccggcatggtcatgggcaccccgcagtacctctcccccgagcaggcgctcggcaaggccgtcgaccaccgttccgacctgtacgccaccggctgtctgctctacgaactgctggcgctgcggcccccgttcaccggcgagaccccgctctcggtggtctaccagcacgtccaggacatcccggtgccgccgtccgaggtctcggacgtggtgccgccggagctggacggtatggcgatgcgcgcgctggcgaaggacccggacgaccggttccagagcgccgaggagatgcgcgggctcgtccagtacagcctgcagatgctccaggtgcaggggggccacacgggcacgtggaacaccggcccggtcgcgctgcacgagggaggccagaccccgccgcacgggatgtccggctccacccgcgcgatgggccacccggtgcacggggacacctcccagggcccgatcctgccgccgtacaacccggacgacggggggtacgacggcggcaggatcgggccc

SEQ ID NO: 2710 - DNA, 7946 bp, Unknown
  Kingdom: Bacteria, Phylum: Actinobacteria, Class: Actinobacteria, Order: Streptomycetales, Family: Streptomycetaceae, Genus: Streptomyces
gccgtggccatacgctggacaggtgacccacgaagccgccggggtgccgaccacccggaatgatgaagaccggcagaacaacgaccggccggacgcgcgccgacccgcccccgaagcgggggacctccggggggcgcaggacgctccgggaacgccggacgcttccggtggcgcggacgccgctgccggggagcccgtcggcccggagggcgcccagccgcgccccgaggcacggctggccagggcggtgcaggtcgccgagcaggcgctgatcgagttcgagatcgcggtggagaccttccgggtggaggtcgagaacttctcccggctgcaccaccagaagctcggcccgatgtacacccgcctcgacgagctggacgcgctgatcgcggaggcgcgggccgcccggaccggggatccggaggacgagcgcaaggcgcgggaggcgcgggcggtcgtcatgccgatgcccggggtcgacgagctgttccacgactggatggacaccgacgggctgtcccccgaggccgcggcgatgctcaccgatcaagcggtccggccgccgaagcgggtcaggccgagcgaggaggcccgcaagctctaccgggagctggcccgcaaggcgcacccggacctcgcccaggacgagacggaacggcagcgccgggacgagttcatcgcccgggtgaacgccgcctacgggcgcggcgacgtcgacctcctcaaggaactcgtggcggagtgggcggccggtccggtgcagcccctggcccccctgagtgagagcgaggagctctacgcccggctggagtggctcagccggcgcaaggagctgctgacggtgctcgccaaggagttggaggacggcgcgatcggttcgatgctgcggatggccccggacgacccggatcagctgctggaggacatcgcggagcaactgctgggcgaggtgtcccggcgagaggccgagctcgcggagatggtgcagtagcgttccgggtgactctgccgcgtaggtacgaggcccaagatcgcacgagagaaggcatgacccatgaatttcgccccactgccctccgtggacgccgcggcggtgccgtcggacggcttcgtcctggacgtccgtgagaacgacgagtgggcggccggtcacgtcgagggtgcgctgcacatcccgatgagcgacttcgtgggccggttcggcgagctgaccgaatccgtcgaggacggccggcgcgtgcatgtgatgtgccgggtcggaggccgctcggcccaggtgacccagtacctgatccagcagggcatcgacgcggtgaacatcgacggcggcatgcaggcctgggacggcgccggacggccgatggtcacggacaacgaggcgcccgccttcgtcctctgaccccccgggatcggcggggcgtgctcggcggggtctcgtccgttgatccccgctgacccccgccgggccggttcggtgctgtcggtcagccgagcgggtgggcggccagcaggtcgcccagggcctcctcatgggccgaggccgggcccagggagagctcgatctgcttcgcccaggcgtggaagcggtgcagcgggtagtcggtgtccgcgccgaagccgccgtgcaggtgctgtgcggtctgtacgacgcggcggacgccgtcggaagcccagatcttcgccacggcgacatcggccgccgtgggcagcggccccccggcgtcggacgagatccgccaggcggcctgccagagcgtcgcctccatcgcccgcagatcgatgtaccggtcggcggcctggacggccaccgcctggaacgtggcgaccgggaatccgaactgctcgcgcttgcccgtgtattcggcggtcatcgcgagcacccgctcgcccaggccgagcgcgagcgcgcaggttcccgtggtgagcagggaccgcagccattcccagcagcccggcgcgtcgagcagttcgtgggcctccacccgggcgccggcgagccggacctcggccaggcgttcaccgctggtggagacctggtccacgagggtgacgccgtcgcgggtccggggcaggagggccaggaccgggctgcccccggcagtgtgtgcggggacggcgatccagtcggccgcctgggcccagggaaccgcggactgcaccccgtccagcacccagccggagtcccctgccgacgtcccgttctctccgttctccccgtacggccgtgcggtgacggcgagttcggcggggtcgtgaccgctgcgtccgttggcgccgacggtcaggatcagttcgccccggccggcccgggggagcagttccgcagcgagggtgctcccgccgtaccgctggaccgccatcgcgaccgcacagctctccagcaacgggatcctggccagcaccttcgccgactcccgcaggaccaggcagagcgcgatcgggtcgaggcccacgcccccgtggtcctgcgacagcgtgagaccgagcaggtccgtgcgcgccaggtcgctccacagctgccggtcgatgtcctccgccacggcgcccggggtcagggcgggactgggtactcggtcgggtgtgacatccgagaagacggccctggccgcctcgacggccgcgtgctgctcttcggtgaaggtgaagtccactgtcccggccctcccggtaacccgttcacgctctgacgggtcgtcaagatagaacaggttctacaggaagggaacagtgcggagacgcggggtctgtctgcgtcagcgacctcggcgacgttgcggcctcagcggcttcggcggcctcagcggtcgaagtccagctccacctccggggtgaccggatgcgactggcaggccagtacgaagcccgccccggtctcctccggttccagcgcgaagttgcggtccatccggacctcgcccgagacgaggaacgcccggcaggtcccgcacacccctcccttgcaggcgtacggagcgtccgagcggcttcgcagcaccgtctccagcagggattcggtgtcctgtacgggccagctgcccgagcggccgtggagggtggccgtcagcaaggcgtcggacggggcggcgaccttgaccaccgtcacgtcggtgggggcctcgtcgacgtggaagatctcctggtggacccgcgagcggtcgacgccgagtgccttcaaggccttctccgtgccccgtacgaggccgagcggcccgcacaggaaccagccgtccacctctgccaccggaagcatggcgggcagcaggccggtgagccgttcggtgtccagccgcccggaggggagcccggccgactgctcctcccgggagagtgcggtgaccagctggaagcggtccggatagcggtccttgaggtcggccacctcgtcgaggaacatcgtcgacgccgccgtgcggtcgctgcggatcaggcagaaccgggctgtcggctcccggtcgagcagggtggccgccatggacagcaccggggtgatgccgctgccaccgaccaccgccgcgaacaggccgggacgcggcttcagaacgaagcggcccatcggaggcatggcctccacccggtccccgacggccagctccttcagggcgtacgtggagaaggccccgccgtcgaccatgcggatgcccacccgcaggaccggatcgccgggcttctcggtggccggtgcgcagatcgagtacgaacggcggatctcctggccgtccacggtgtagcgcacgttcagatgctggccgggggtgtggcggaaggtctctcgcagctcggccggcacggcgagcgtcacggccaccgcgtcgtccgtgatccgttcgatcgcgctgacccggagcggatggaacatctacaactccttgaagtggtcgaacggttcacggcaggcgacgcagcggcgcagggccttgcacgccgtggaggagaaccggctgagcagttccgtgtccgtggagccgcagtgcgggcagcgcaccgagagcgtcagcggcacggcgccgccgtcggcgctgtgggcgcgcggcggggcgatgccgaactcggcgagcttgcggcgcccttcggcgctgatgtcgtccgtcgaccaggccggcgccaggaccgtgaccacggagacctccggtatgccgtggtcgtgcagcacccgctcgatgtcggcggacatcgcctcgatcgccgggcagccggtgtaggtcggggtgagccgcacggtcacccggcccggaccgtccacccgtacgtcccgcaggacgccgagctccgccagggtcagcaccggcagttcggggtcgagcacggagccggcgaggtcgcgcagctccgcctccagccgggtgtcggtcaccatgacgcccccggatggctgcggtgcaggtgctgcatctcggcgatcatgcggccgaacggctcggtgtgcaggccctgtcggcccgctccggccgcccagcctccggactgcgggcccgccgggagggtcaggccggcccgctcgacgacatcggtgacggcggcgagccaactgctccgcagcgcaccccagtcgacaccggactccggggagtcgagcccttcgaccggctggaacatctccccggtgaaccgccacagcgcgtccaggccgctccgcatccggtcgcggctctcctcggtgccgtcgccgagcctcagaacccactgctcggcgtggtcacggtggtaggccacctccttgacggccttggccgcgagtccggtgaactcgctgtccccggcggccagtcgctcgtacagcaggtgctggtagaccgagaagtagaactgccgggcgatggtgtgggcgaagtccccgttcggctgctcgaccagctggaggttgcggaaggcccgctcctcgcggaggtaggcgagctcgtcctcgtcaccgacgagcgagagcagcacccgggcctgtcccagcaggtccagggcgatgttggcgagagccacctcctcctccaggacgggggcatggccggcccactcccccagccggtgcgagagcaccagcgcgtcgtcgccgagggcgagtgcggcgctcacaggtgcttcaccccgtccgggatctcgtagaaggtggggtggcggtagggcttgtcgccggccggctcgaagaaggagtccttctcgtcgggggaggaagcggtgattccggtggacgggaccacccagatcgagacgccttccgagcggcgggtgtagaggtcgcgggcgttgcgcagggccatctgggcgtccggcgcgtgcaggctgcccgcatgggtgtgggacagtccgcgccgcgagcgcacgaacacctcccacagaggccagtcggtcgagctgctcatgccgtctcctccacagggtgcgcgggtgcgctgttcggtgccgacgcctgggtcgatgactgcgccggggcgtgcttggcggcgtacgcggctgccgcgtcccggacccaggcgccctcctcgtgggccctgcgccgctgggtgatccgctgttcgttgcaggggccgttgcccttgaggaccgcctggaactcggcccagtcgatcgcgccgaagtcgtgccggccgagctcctcgttccaccggatgtcggggtcggggagctccaggcccagcgcttcggcctggggcacgcagatgtccacgaagcgtcggcgcagctcgtcgttggagtgccgcttgatcttccaggccatggactgctcggagtgcgacgaggcgtcgtcgggcgggccgaacatcatcaaggagggccaccaccagcgattcaccgcgtcctgcgccatggcgtgctgggcctcggtgcctcggctgagggcgagcagcagctcgaacccctggcgctggtggaaggactcctccttgcagatgcggaccatcgcacgggcgtaggggccgtaggagcagcggcagagcggcacctggttggtgatcgccgcgccgtccacgagccagccgatcgcgccgacgtcggcccaggtcagcgtcggatagttgaagatcgacgaatagcgctggcggcccgcgtggagcttgtcgagcagctcctcgcggctggtgccgagggtctcggcggcgctgtagagatacaggccgtggcccgcctcgtcctgcaccttggccatgaggatcgccttgcggcgcagcgagggcgcccgggtgatccagttggcctcgggctgcatgccgatgatctccgagtgggcgtgctgggccatctgacggaccagcgtcgcccggtaggcgtcgggcatccagtcgcgcggttcgatccgctcgtccgccgccacggccgcgtcgaaggccgcgatgcgctccgcgtccaccgcgtcctccgtgccgagcgtcttctgcgtcgtctggtccgcagtcactgccgccatcccgggctccctaccgaccgatcgttcggttccttgacttcaatggtgagtcggaggcccgtagggtgtcaaccctgtggataactgagtggtgatcgacggtgagcggggcgggatggattcggaccacgacaggagctctgcgggcgggggaaaggacgtctggccgcaggcgttgaaccggccggcggaagcgcaggacactcccgaagccataccgccgacgtcctcggcgccggtggcggacccctcggtcaccggccggggcatagccgggctctcctttccctaccaggtggtcgcggctctggcgctgtccctgatcgggctgctcgcctgtacgcaggtggccatggtgttcctgcacgtcgccccgtccaacacgctgtccaaacagcatgggaagacgatcgaccgctggatctacccggagttcgagcagaactggaagctcttcgcgcccaacccgctccagcagaacgtcgccgtccacgtccgggccgatgtggtgggggccgacggccgccgtacgaccaggtggatgaacctgacgtacgaggacggcgaagcgatacgcggcagcttcttccccagccatgtggaccagaacgagctccgccggggctgggacttctacgtcaattcccatgacagcgagaaccgccccaacggcctgcgcggggacctctccgagcgctacgtgcgacgcatcacgatgctgcggctgagcgagcgcgactacggcggcaccatcgaacgcatccagctccgctccgccaccagctccatcgccccgccgccgtggagcaacgagaagatcagcacccggcccgtctaccgcgtactcccctggtggaccgtgacgccggacgatcttcccgagcgtgacgcggaccaggaccgggacgaggcgcacggcgtggaggagaaccagtgacgatcccctcgcccgtgggcccgcagaacgagggcccacagaacgcggcaccacagaacgcggcaccacacaatgaaggaccgcaccccgcggttccccgcccggccgtaccccgttccggcggtcccggcggcggcccggcccgtgctctccagcgcgtcaccgcctcggccctcggtccgtaccagagcgccgtcgtccggatcggcttcgccgccacctacctcttcttcctgctgcgcgagctgcccaaccgccacgagctgtacggcccggaaagcccgtggcactgggacctggcccgccagctcacgaacggcaacgaggccttctccgtcctgatgtggacggacagcacggtctggttcgaggccgtgtacgccctcacgctgttgtccgcggcggcgctgctgctcggatggcggacccggaccatgtccgtcctcttcatggtcggcgtgctctcggtgcagaaccgcagcatcttcatgggcgacggcggagacaacgtcgtccacctcatggcgatctacctggtgctgacgcggtgcgcccaggtctggtcgctggacgcacggcgcgcggcgcgcggcgcgcaacgcgccgcggcgggcc

SEQ ID NO: 2711 - DNA, 5446 bp, Unknown
  Kingdom: Bacteria, Phylum: Actinobacteria, Class: Actinobacteria, Order: Streptomycetales, Family: Streptomycetaceae, Genus: Streptomyces
cacggcgggggcggctgcggctccagttgcgggtcgagctgcggaggcgggggcggctgcggcggcgactgagcgcgtaccgccgccgacagctttccggtggcaccggcggcccgacctggacaggcttctggcggcctgggcagctccgcgccggggaccgccccgccgtgccgactaccgcgctactgcgcccagtcgaagacgtccgactccaggtcgatctgcgcgtttccgccgccgaggttgaacccgccgaccccgtcctccagctcgaagacgtacggggtcagcccttcgggcatcacctggcagggcatgatcgttccgcccaggtgcgaggtcccctcgatggacgaccagaactcctggagctgctcgtcctcggaggaccaggcggccacatagccaccctcgccgtcctccgacggggcgatgccggtgttcgggtcgccggtgcgctcgccgagccagaccgtggtctcgggggtgctgtcgtcccaggcgttctggccgcggctgtactcgtcgccgagaccggccgggcggatgtcggccgggggatcgatgcggggcgcggcgaactcctcggcggtgagccacaggagcgcgtgcgcgccgccgatgaggtcttccagatcccgctgctggggatggcgtgccgccgccgtcgcggccaccgccgcgaggaacggatcggcggcctgctccggggttggcgcggtgccttccaggagttcggcgacgccgtcgatgtcgtcggcgacatggtcgtcggcctggaagaaggagatggccaccaggtcctcgcccttgcgccggtagtcctccggcagttcgagggtgatgacatggatcatcggcagtccggtgacgggactccggggccacgcggccgtcccgatgccgggcgcgcgaccgccgcaccacccggcgacgcgggcaccgggcagatcgatctcgatggtcttgccgggaagggtcgtcagctcgtccgcggactccccgaaccccagttcgtacgacttcaccgtgtgccttccgttcgactgcgacggcgctcaacctacgcgagggcactgacagccccgccgtggttgccgacaacaggcagccggggccggtcaggtaatgccgacatcacccctgaaatcacctcggccacccgcctaccctgcccgtatccgaggaaacgaacgtcggcccggcgtcggcgggcatcacggacgcacgccaggcacgggacaggcgcagagcaggcagggggcggagtcaggtgggcggcgaagcaaaggggggcgcgtccggagcgcgcgcccaggtgaacgcgggtgtggcgaccgcgggtgcggcgggcggcgcgaacgggctggggccccgcgcgtcctcgctgatgtccttggctctcggcctgttgctggcggcgctgtcggcgctggtgatgttcccggcggcggagcacctgcgctctctccgggacggcgagcgggctcaggcgaccctgcacaccagtggtgcgtgcatggcgggccagtgcgaggtgaagttcgaggccgacgggcggaccgtggtggcggacctcccggtgggcagcgggggcggcaagcggtccgtcggcgcggccatgacgatccggtacgagccggacgacccgcgggtggtcgcacgcgaagacgatgtcggcggtggcggtgcggccctgctggcgtggatgtcgggcggggccgccgtgttcttcctggtgatcgcgggggcggctgccctctacccggcgcggcagaggcgaacgcgaaatcgatgatgtgactgatgtgtgaacgccgaattgccgggcaccaggatcttcgcaacgaggtcccggcgacattcggagccgggaggtattggtgaggtgcactgagaccgttgtgaagcgcaggcgcaaacgcgtctgaaccgacttgacgatgggaatgaaaatgatcgtccttggacttattctgctgatcatcggcctgcttgtcggcatggggctgctgacgaccatcggcggcatcctcattctggtgggtgccatcctgtggatcctgggcgcgaccggccgcgcggtgggcgggcgaaagcacttcttctgatcctcgggatcggaggaggacgaggccaggaattctgtcgaccggacggaattctgcgaaatgcgggcgggccgcgacgacttgtcgtcgcggcccgcccgcatttcggcttcctgccccggttccaccgcggtgcctacacccacgtgtccagccacatccggtcccgccacaggtcctccgggaccgacgtccccgtgaacagcggccagaagtagatgaagttccagacgatcaggagcaccagcacgcccaccgcgatagcccccagcgtgcggcggcgttcgccggtggggtcctcggtggtgaggcccagttcggcccgggtgcccgtgcccgccgccgggcccgcgatcgcgccgagcatcatcgtcacggccagacacaggaacgggacgaacaccaccgcgtagaagaggaagatcgtccgctcctggtagaagaaccagggcagccagcccgccaccacaccgcaggcgatcgcgcccgcccgccagtcgcggcggaagaaccagcgccagacgacgtacgcgagggcgaagcacgccagccaccacagcagcggggtgccgatggcgagcacctcgctggcgcacttgccggtcgcggactccttgcagccggcctgctcctcgtagaagtacgacacgggccggcccaggacgagccagctccacgggttggactcgtacgtgtggcccgaggtcaggccgacgtggaagtcgtacacctggttctcgtagtgccacaggctgcgcagccagtccgggaacagccagctccaggaggagtccttgccctcggtggccgcccagttccggtagtagcccttgtccgtgacgatccagccggtccaggacacgatgtacgtgacgatcgccaccgggaccgtggagacgaaggcggggaccaggtcccggcgcagcaccgcctggtacgggtgaacggcccctgctgtgcggcgcgcgccgacgtcccacaggaccgtcatcaggccgaacgcggccaggacgtagaggccgttccacttcgtggcgaaggccagacccagcatcacccccgccgccagccgccacggccgccaccccaggcgcagggtctccgcgacctgggcgtccgggcgcagcaccccgtcctcgtccaccgggagcgcgtcggccagacggcggcgggcgtggtcccggtcggccaccaggcagccgaacgcggccagcacgaagaacatgacgatcaggtcgaggagcgcggtccggctcatcacgaagtgcagcccgtccaccgcgagcagcagccccgccagacagcccaggaacgtggaacggaacagccgccggccgatccggcacagcagaagcacggagatcgtgcccagcaccgccaccatgaagcgccagccgaacggcgtgaagccgaacagctgctcgccgagcccgatgatccacttgccgaccggcggatgcaccacatagcccgggtcggtcgggatcgggacggaggagggatccttcaggatcagcttgtcgacgtccttgggccaggacccctcgtacccctggttgaccagcgaccacgcgtccttcgcgtaatacgtctcgtcgaatatcaccgcgtgcggctggtccagcttccagaaccgcagcagcccggcgaccagggtcaccagcagcgggccaccccagccggaccaccgcaccagccggtcggcgacgtgcggcgggatcgcgagcaccgaccacacctgccgtccgggccgcgtgtacggcgggtccagccggtcgcggagagaggtctccggccggggaacatggccgaagcggcgcagccgccgttgccaggaggtcggctgttcgccgagcgggtccccggcgtcttggccccgctgggtctcgggtgcggtactcgtcaccgcgccatcgtagggaacgcatctgtgcgaagggtgctgcccgtgctgcgaggatggctgatgtgactggaacgactggaacgctcgtgctcgcagggacccccatcggtgacgtggcggacgccccgccacgcctcgccgccgaactggagcgggccgacgtcgtcgccgccgaggacacccggcggctgcgccggctcacccaggcgctcggcatccacacctcggggcgtgtcgtctcctatttcgaggggaacgagtccgcccgtacgccggagctggtcgaggcactcgtcggtggtgcccgggtgcttctcgtcacggacgcggggatgccgtccgtctccgaccccggctaccggctcgtcgccgccgccgtggagaaggacatccgcgtcaccgccgtcccgggaccgagcgccgtcctcaccgcgctcgccctctcgggtctgcccgtcgaccggttctgcttcgaggggttcctgccgcgcaaggccggggaacgcctctccaagctccgggaggtcggggacgagcggcgcaccatggtcttcttcgaagcccctcaccggctcgacgacaccctcgccgccatggccgaggtcttcggcgccgagcgccgggccgccgtgtgccgggagctgaccaagacgtacgaggaggtcaagcgcggtccgctcggcgagctggccgtgtgggccgccgacggcgtacgcggggagatcaccgtcgtcgtggagggcgccaccgactccggcgacgaggggctggacgccgaggagctggtgcggcgcgtgcgcgtgcgcgaggaggcgggggagcggcgcaaggaggcgatcgccgccgtcgccgccgccgccgggctgcccaagcgggacgtcttcgacgcggtggtcgccgccaagaacgcggagaaggccaccccgccgaagccgtagccgcgatgagcgcggggaagcccgccccgccgaagccgtagcgcttacggcgactccgtcagcagtccgtacgccgtggccacgaacgtgtccgcccggtgcacccggcgcgtcgccgtcgccgccaccgcgaggccggtgtccggacggaaacccaggaacgcctgctggcccagggtcgcccccgcgtggaagaggaccgggccgtacggggacgggtggtggaaccacgtgagcgtgtgggtgtgggcgtgccgccggccgcgccgcagcagggggcgggacacgtcggcgagcgcggcgctcagcgtcgggtcccggggcgtcgggtcccgggggtccggcccgcccagatgcgcctccaggaacgtcagcaggtccagcggggtcgcccggaccgcacccgccgccgtgaagccccaggtgtccagcacgggcacaggcgtcccgtcgcggaggtggccgaccgcgtccgcgccctccggccc

SEQ ID NO: 2712 - DNA, 3753 bp, Unknown
  Kingdom: Bacteria, Phylum: Actinobacteria, Class: Actinobacteria, Order: Streptomycetales, Family: Streptomycetaceae, Genus: Streptomyces
ctgctcgtcgcgggcgacggcacccgggagtccttcgccgcgctcaccggcgacgagcgcgagtacgcggcctggcagcgcttctacgccatgacgcggcggctcgcgacacgggtcttcccgacgctcaccgagccgctgccgagccgggacgcgctgcgcgagcggatcgacgacgccgacgcctggcggatgctgttcgaggaaccgctcggggtggccgtcgaggagaacttcaccgacgacctggtacgcggggtcgtcctcaccgacgccttgatcggcaccttcgccgacgcccacgacacctcgctgctccagaaccggtgcttcctctaccacgtgatcggcggcggcacgggtgactgggacgttccggtcggcggcatgggtgcgctcaccgacgcgctggccggggccgcccgtgcggcgggcgccgagatccgcgtacggcacgaggcgacccggatcgagaccgacggcacccacgccgaggtcaccgtccgcaccccggagggggaacacgtcgtcgccgcccgccgggtgctcgtcaacgcctcgccgcaggccctcgccgccctgctcggcgacaccccgccgccgcccgccgagggcgcacagctcaaggtgaacatgctgctcacccggctgccgaagctccgcgaccggtccgtcgacccccggcaggccttcgccggcacgttccacatcgccgaggggtacgggcagctcgccgacgcctaccgggacgcggcggcgggacggctgcccgccgccccgccctccgagatctactgccactcgctgaccgacccgtcgatcctcggccccgacctcgccgcgcgcggctatcagaccctcaccctcttcggcctgcacgctccggcccggctcttcgccgccgacaacgacgccgcccgcgcggccctgctgaaggcgaccctcgccgaactggacgcgcacctggaggagccggtcaccgactgcctcgccctcgacgagcggggggagccctgcatcgaggccaagaccccgctcgacctggagcgggacctgcggctgcccggcggccacatcttccaccgcgacctctccttcccgtacgcggacgagggcgccgggcgctggggcgtggagaccgcgcacgacaatgtgctgctctgcggagcgggcgcggtgcgcggcggcggcgtcagcggggtccccggccacaacgcggcgatggccgcgctgggccggtgacgccgttcctcaggccccgaacaccccccgcagcgcgcccagcttgcgcggcaggtcgtactcggcgccgccctcgtgcccgttgtacgggaacacctcgatctcggccggtcccgcgtagcggtggtaggcggcgaacaccgtggaggacgggcagatccggtccatcaaccccaccgagaaccatgcgggcgcgctcgcgcgcgcggcgaagttgaccccgtcgaagtaggacagggtctccatcgcctcctcgatccggaagcggtgccccgagagccagcgggctatctccgcgtacggtccggcgtccgtgatctgcgaggcccgccggaagtggcagaggaacggcacgtcggcgacggccgccgccacgtcgtcccgcagcccggcgaccgccagcgcgagtccgccgccctggctgccgccgaggacggcgacccgttcggcgtccaccgcgtcgtgggccttcgccgcgtcgacggcccggaccgcgtcggtgatgagccgccggtagtagtgccggtgggggtcctcgatgccccgggtcaggaaaccgggcgaggacgaaccgtggccctcgggcccgatgtccggggtgtcggcggtgttcttgccgccgccgccctgtccccggttgtccatcaccaggtgcgcgtagccgagcgcgctccaggtcagccacgcgtacgggatgccccggccgccgttgtagccgatgtactgcaccacggcgggcagcggtccggagcgctgcttcggcagcagcagccacgccttcaccggctgcccgtcccatccccggaacgtcacatcgagtacgtcgacggtcgccagtcccgtctcgtacggcacgaaccgggcgtccacgtcgtgctgggccgtctccgcgagggtcttctcccagaaggcatcgaagtcggccggttcctgcggctcgggacggtactcccgcagccgctccagatccatgtcgaacagcaaggctctagctcctcttcagggtgaggtcgagggtcgctccgcgcagccccgaggtgtcggcggtgatccggatgccgcccggcgtgcgtgcggcgctcacccgggggccgcccgaggcgagcgtgagcccgcggccggccagctcgaccaccacggtggaccgcagttgtgtgggatcggacagggcgacgctcacgttccggcccttcgggtgcaccaggacggacgccggaccgtcgcagctcagctcccgcgccgagcccgcccgccagaagttggcggcgaggagcccgtccgcacggcgccgcaccgcgtgcacggcggtcgaatcggtgatcagctccaccggcggcgcggccgacagcagccgggtgcgcccggcggaggcggtggggagctggaggtagaagtagccggccccgctcggagccgggccgtggtcgtgccagagcgtcaggtacgggcgggtgaccggggtgtcggtgccgtacttgaggttgatctcccgccaggtcgcggtgcgttcctcgcgcagggcgtgcacggaggcgggccgggggaagacgtatccgccggttccggccaggtgcagccaccggacgtccgccagctcgtcggaccagccgggtccgtccggggcggcggagccgttcacgaggagcgcggcccgcgggtcgcgcagcttgcggttctccaccaccgtctcggcggtccccgcctccgcggtgatacccgagccgacacaggcgatgacatcgtccaggcagaaccagctcttgagcccgtgcagcgtgctgccgaaggcccgcagctccatcccgtacgcgcccagcgtcgtgtccgggagcgccgtgccgccggcccagtcggcggagctggtggtgcgctgtcccgccgcgtcggccggacgcccggcgatgacggtggtgccgggcagcctggccggatcgacggtgggccagtagtcctcgctgtagtggccgagatcgtcggtgtacagcagcaccatcccgtccgagaggtgccagccgtgcaggttctcgttctggatcgactcgtagttgtagatccgggtcgagtacgcggagatgccgaggccgaacgcgggacggtggtgggccgccttgtccatcagaggatgctgccggtgagcgaccagcgggccgcgggccgggacggcggaggcgatcgcacgctgcgcggcgaccagggacgcgaggtcggtcaccgcgaggaagtcccggtagccgtcctcggcgatccactgcttcaccagcgccgtgaaccggtcggcgggctcacccgggaagcaggggatcagccgcagcaccgcctcgatgacggtctgcgccgacgcgtgcccctgcttgctcggccgggcgatctcccgcccgcacaccgacgccatcacatcgccccggaacatcagcgggtcgaagccgtcgtccacccagccccgcacgttgtcgagatcgggatcggtcaccgtccacgccgttccggccagcaggttcagcagccgggaca

SEQ ID NO: 2713 - DNA, 19480 bp, Unknown
  Kingdom: Bacteria, Phylum: Actinobacteria, Class: Actinobacteria, Order: Streptomycetales, Family: Streptomycetaceae, Genus: Streptomyces
ttccggcgggccgctgtccttggcatcaccccgggcggcgttgcgcccggcggagcctcacctgccgaagaaggcgttgtggatcgtgacggtcgactcgttgccgctcgtgtcggtgacgacggcccgcaacgagatcgccttgcccttcgccggagcggtcacggtgatcttgcccgcggtgaccttggcgggcagccacttctcgttgtcgtacgacaccgtcacccgcagcgacttgagaccggatccggccgccgcgccctgcaccacgacggggaacgtctgcttggcgcccgccacaacggtggagtccagtgcgagctgcggctggaaacggaccgtggagaccggcagcgtcgcaggggtgtcggtgcgcgccgaggtgaaggtccacgaggcgtcgatccgggcaccggcgcgatagaccgccgggttccggttgatcgtggtcgcgaccttgtacgtggcggactccggaggcagcgcgaagaaccgctcgtcgatggccgcgtcctccttcgcgtacagcacgccgtcgcggtggatggtggtggtcgcaccggcgtaccgggcgaatccgggatggcccggcccgtcactgaccagtgccagcgaaccgtagaggttgtcgccgtcgcgcacgagcccgtcgccgggcttgatctgcggccccatcacaccggcatggaaggtctcggtgtgcgtcgtccccggctcgaaccgccgtgccgcgtccagggagtaggccgcttcgacctgccggttgcccgccgggtccttctcacccagcacgcccgcaacgatgttccagacggcgtcgtcgtccgtggacaggtacaccttccgggtccccgtcagggggtgcacggtgaaggccgggtcgacgcctccgttggccagttcgccgtacgccttgacgatgccgtcgaccccgggagtggacgacccgacccgcaccttcaccagggccatgttcttggtcgtgtaggtcttgctgtagcccgtggccagttccgggaccatggtgccggcgagtgcgttgtactcggtggctccctgcttccagtgggcggaccactgctggtagagggaggagtcgccggtcaccggggagccctggtacgcggtgcggacgttgtcgaagctggtgaagtcgctccacagcgtgatgcccgtctcgggcgtgctgagggagtacatcattcccgcgcgtgtcggcgtggccgtcgcgtccggcaccttgaacgacaccggccgggtggtgcgggcgtcgagctcgaccgtggtcgggccggtgaccgagaaccgggggttgttgatgaggtcggcccccttctccggggccgcggggtcgaccagcatgtcggccgacaggttgtacgtgccgcgcggcagccggaccttcgtcgaaccggacgacagatccgggaagaaccgcaggcccgaggcgatgccggtgtgtcccttcaggtcggcctgccagccggtgctcggcgcgccgtcgcgtccggtggccttgaaggtgacctcgtacgtctccgcctcacggtccaccccggtcgcggtgcgcaccgcctggccgcccccggaggccacgaccgtggccgagtaggagccgtcgaccgtaccgccgaggcgggtgtcggccgtcacgtccacggctgcggtgccgcccgccgggaccgtgacccgctgcgccccgagggtgaagaagccggccggggcgggctgtccgtccccgccggtcggtgcggacagcgacaggtccagcgtcacgtccgcactgccgttgttgcggtacgtcacctgctcggtgacgggggtgtcgtcggtgtggggccaggcctgggtgcccaggttcacggagaccggctcggcgacgaccgtctggtcgatcgccttgtcgacggtgagccggccagcgccctgctggaagaccgagtgggagccgtccttggccgaacccgtcagggcggccttgagctgggcgcccgtccaggtggggttcttctgcttgaggatcgccgcggctcccgcgacgtgcggagtcgccatcgacgtgccgttcaggctctggtacccgggcgggttctgccccgccacgcccgccgcggcggccgccgtgatcgacacgcccggtgcggtgatgtcgggcttgacggccttgtccccggtacgaggaccgacgctggagaagtcggcgatttggtcgtcgtcgtcgacggcgccgacggtcagggccgcgtcggcgctgcccggcgacgcgaccgtgccccggttcgggccgttgttgcccgcggctatcgcgaacagcacgcccttctccgcggagaccttgttgacctgggcctccagcgggtcgatcccgggagtgtcgaggccgcccaggctcatgttgacgacgtcggcgccctgggcgacggcccagtcgacccccgcgatgatgctggagtcgtcaccgacgccgcggtcgtccagcaccttcgcgttgatcagccgggctccgggggccacacccttgaaccgggcgtccttcgctcccgtgccggccgccgtggaggccacatgcgtgccgtgcccgtcacggtcctgggcgtccggggagccgctgaagttgcgctccgcggccacccggcccgccaggtccgggtgggtggcgtcgatgcccgtgtccacgacggcgatcttcacaccggtgccgtcgaacgaccgggcccaggccgccggggcgccgatctgtccggtgctgcggtcgagcgaggccttgcgcacaccgtcgagccagatccgtgcgatgccggacgcggtggccgccgaaccgtcctcccgctgacgcgtcagggcgtcccacagcgcgcccttgtcgtcggtggccgcggcactggtgacggcatcggcgtcgagggccgacagggtacggcggacggtggtgccgtccgcggaccgcacctcggcacgggcggacccggccgcagctccccggtagccgacgatcaccttgagcccggcccggtgggccttgaggctctccggctcggccagcgcggtgatgtcgaacagccgccggtccagcctgccgtcggcgatcagctgccgggcgtcacgcggcaccacatgggtgcggccgtcgtggatctcggtgaagaaggggatgtcctcccggcccttggcccgctggatgccaccgacgcggcccttggcgtccacgaggacccggtcgccggtgatcagggtgatggtgtcgacggtccgtccgcccgcgtccaaggccttggcggtggtcggggacgccgtgtccgggccgccggtcttccccgacgccggagcggtcatgcccgccgtcagggcgaccgaggccgcggcgacgagcgcgtacgccctcgttgatctttttcgcaagattgcccctgctcaggagtggttcgggcgggcgaaggcccggccgcgcggggcgcgttcggatacgcgttcgaccccggattcctgaagtatgccgaggccgttcggacgcactcaatgatcgttgtgtaacagccgagcaccctgatccggcttactcgtgggggcgtgcggccgttgatcgactggacggcgtggcccgacaccacacgcccgaccactggtcggcgccgtactcctcgaaccgggtcacctcggtggacccagtttccgcgcgagcgcatcgagggctgttggcgatccgggttgcggagcaccaccggttcgccgggacgcgcggcaccgaaccagccgagcgcggcggcgcagggcgttcgtcaccctcgcgggtccggcgtcagccgaccgcgtcctgcaccggtcccactggcgacgcggacgccaacaccaagcccgcgtctgcccctacggacgacgcggccacacaccacccgaacctgcccgaccgtcacaacaaggactgttgcggtactcggcgcgccgcgtgggacgatggtgaaagccggtccaggtgaaggtggggaaaccgaaaatgagtttgcgcctctttctggacagcgcccggcagccccgtacgccggacgggtcggcgggtgaatgggccgatttcttcgacggggcgatggaactggaggccaagaactggccgccgctgctgtggtgggtgatgttcagccccggagacctcgtggaggcgaggatcgccgacaccgaggacgcgggtaccgatgagcacgcggagttgctgagccagtggggcgaggccacctacccgtacctggtggtcgaccagcgaacggccctgtcgcggctgcgcgcccggcggcaggcactgaccagccggctcggcacgcagttctcgcctctctacgacgagttcgtcgcgctcatcgacgtgcggttcggcccctacgtcctgctgcggaccgaggcgctggccgacggcggtgaaggcggcatccgcctgctgttcgaggagaccctggccgacgtggagcgcctcgacgccggtcatgccacagcggccggagggcaagtggacagcctgatctcggattttcggcggtggcagcacacggatccggtctggctgctctcaggtgttggcaacggatggccgggcgtcgcgctgcgggagcactacgctgccactgaggtgaggcggtcatccagccggagtggcgagcggtccaccgctgtgggctgggtgtggggcgttctcgtcgtggtctgcagcctcgttgcgtactggctcaccggaagtgtccggccggtcggcgttgcgttcggcgtggtcctggccgtgctggtggcagggttcgtccggcgacgggggtgagagggcaggtcggcgccacgggtcgggtgaccagcatgtgatcaacaccgttgcgtctacttccctgagtggttcgcaagtccgtggtggaagaacgtgatgacggtgttgaggggtgtagttctggctggtcgtagccggtgcgacgaccgctgatcgaagcgcttcgactctcctatggacagtggttgtgggtgagtctaggctccacgatgtctgtgcatgtcagagtgtgaaggggagcgcggcgggcgctgtcgaagcgcttcacccgctctcccttgtggtcgccatctgtaggggagaagccgaatggtcacgcttgccgaggtcgcccagcacgccggagtgtccgcgagcacggtgagctacgtcctcagcggcaagcggtcgatctccgcctccacccgaaaacgggtcgagcacagtatccagcagctgggctaccaccccaacgccggtgcccgtgccctcgccagcagcaggtccaacatcatcgcgctgatggtgcccctgcgcacggacatgtacgtgcccgtgatgatggagatcgccatcgccgtcgccaccagtgcccgtacgcacggctacgacgtcctcctgctcaccggcgaggaggggccggcggccgtccggcggatcgcggggagttcactggcggacgcgatgatcctgatggacgtcgaactgcacgacgagcggctgccgctgctccgcgattcgggtcggaccgccgtcctgatcggcctgccggccgacaccagcgggctgacctgtgtcgacctcgacttcgaggcgaccggtgcgctctgcgtggaccatctcgccggactcggacaccgcgaggtggcggtggtcggcgaggcggccgccgtctacgagcggcacaccggcttcgccgaacggaccgtggacggcgtacgggcgaaggcgcgggaggcagggatgcggatcctgcaccgtccctgtgagggcgggtacgccgcgatggccggcacactgggccgcatcttcgacgaacggcccggaaccaccggattcatcgtccagaacgaggccgcggtcgagcctcttctcaacctgctccagcagcagggacgagcggtgccggaggacgtgtccgtcgtggccgtctgccccgagcaggtggccacgcaggcctcggtgcggctcacctccgtggccatcccggcacaggagatgggacgccgcgcagtggaacaggtgatggcgaagctcgccggccggggtaccgacgaggtggaactgctggagcccgttcttacggtgcgcgcgagcacgggaccggccccggcctgagggtcgcggggcctgggcagaccgcccggtggccggcgggcggccccgcgacgctcggggaggaacgccgacacggcgcgcggacgccggtccggggcgtcctccggcccggcgtccgtccaggtcagctcgacgagacgttgaacccgttggtcgtgaagttcagcccgccggcggaggacgtgatctcgtagccgaactggacgtcaccgatggtctcgttgccccaccagcccttggtgtccttgatccacttcaggatcggcagaatgtcgacggtgccggcggacgagtcggaggtccgcaggaacgagaagacctcgttggcgccgttgtcacccttgtggacgtcccaggtgtgcccgccgagggtgaccgttccctggggagtgccgagcgggccgacggcaccgttgtggttgacccagagcatcacctcgtagtcgtagtccgtgtcccagatgtcgtacgacgtgttgtacgcaccggccgacggaaccgttacgttgtagccactggtcagcgacgagagcgacgcgatcggcttgttgacgatcttcttggcgttggggtacgacttgatgccgccggtgttcgggtggttcgccgtcacgccccagttgctcgacgagttggcccagatggactgggtgcccgctccggagccccagatgttgttgtagaggatgtagttgtcggacgtggtgtagttgccccactgctccgacgaagtccagaccgcggcgtgggcgggagccgccgcgaagccgatcagcgcggccaaggccgccgttggggccagcaggagccttatcggggtggaatgtgccatgggagtgttccttccatgtggggatggaggggtgctaccgcgcccccaaggtgaggacgcggtccacgccggccgtcagctccagcggagccggggggtttccggcggaggcctcggtgagggcgagcccgtcacccgtacgcagatcgacccgggcgtcgcgggtggggcgcagcacggcggtggcaccgtcctgcgaccaccgcaggtcgaggtgggctccgaaccgcgttcgtacgccacggagttcgccggcccggtacgccgccgggactgccggcagcagcaccaggcggccggacgtcgactggacgagcgactcgatcacggcggcgggcaggctgtgggccgcgtccgcgttgtagacgttccgggacggatagtgcgcgctcatcaacgagttgtggaagaagtcgccgcccagcaccgcgtccagtgccgccgccaccctggaggggtcccgcagccgggcggcgatcagggcgtggtgcagatgcccgtgggcggagtcgttctccgagccgcgcagctccagggcgcggtgtgcggcagtggccagctccggggtgtcgtacgggttgatcgcgtccagcggccacacaggatagaggtggctcagatggcggtgatcgtacgtctcccgcaggccgggccacgcccactccgcgagcgccccgtcctcgttcacgaggtacgccgggagccgggccgcgagcgaccgccacagtccggcggacgggtgcccgggggcgtgtccggcagccgtcgtcagggcgtggtgggccgcggcgatgtccatcgtcgcgttcaccgtcccccagctcgcgttggccggtcggttctcgggggagtacgagggcacgaccgcgaggtttccgaccgggtcctcacggctgaggaagtcctcgtagaacagcgccgcttcgacgagcgcgccggtcagagcggcgtccggcgtgcccgtcgtgacctcggcgtgttccagcagcggctgcagcagccagtcggctcccgccgtccacagatgcagcggataggcgcgctggaagtgccgtgtgtggcccgacgcgccgtccgtgtgcgacggcgcgacgatgccccgcgccccgaaaagcgcccgggcgttgtcctgccagtcggacaactgcccatgcaccagcgccgcgtgggcgtcggtgacctccgggagtgcggctgccgcggcggaggcgacctggaggttgaggttggcgttcgtggtgaaagccccggaccaggccgtgtcccagtcgccggtccacagaccggtcagccggggcggcagcacccccgaggaggacagcaggtggtagcggcccgccgcgaagagccgctccaggagcgccggggactccggcctgcgcagcagctcgctgccggacagctcccgctccggcgccgcgtcccgcagcgtgaaggaggcacgcccgtacgcggtccggtgcgccggccggtggcgctccagcagcgtggcgtagtcctcgcgaggcagagcggcccacagctccccgaggtcggggcggtcggcccccctgacgacccgggtcgtcagggtgaggctccgcgccccctcgatccggatgccctcgccggccacggagacacggccgccgtccacccgcgccacggtgacgcccgtgtacccgagtcggctgcccggatagcccaccctcagagccaggtgcgcaccgtccggggtcaggaccgcggagcggccgaccgccagccgcgcgggggcgccgggcagcgagtggtccaggacgatgtccgcggtcggcccgaggtccgtgatgtgctgcacgatcacgtcgtcggcccgtgacacgaagacgctgctgctccaggcctcgtacgacgcggttacctcgccggtagtgaagtcgacctcgcgccggtatccggcggccgcctcgtgcagccctcgtccgcggcgcacacacgtccggaacgccgggtggaagggctgcacccacaccagcgggcggccgtcgccgaagtcctccgcggccgtcgtgtccccggacaggagcgcgtcctggaggcggtggatccggtcggcgagctccggcgggcgcaggtcctcgctgccgttgggccgcaccagggagtggtggttgacgatcacccggtcgtcggccgggtctccgtacaccatcgccccgtggcggccgttcccgctgaggaacgcgtcctcccagcgggtggccggaaggggttcccacgtgccgtcgatcacgccgggatgcctctgagcacggcgacgccgtagcggtccagctccacacagccgtcggcctcggcccccgtgagcaggtcgaggtgccggcccggcagtttcaccacggccggtgcccggccgtggttcagcaggaagagcagctcgccgcgccgcaccgcctcgaccccggagggcagcccttccagcacgggacgtacgccggcctcggccgccgcccgaccgagcaggtcccgcagggactcgggctcgggcagcgtcgagacgtaccaggcgccgcccttgcggagcaccgcgggaaggccgttcagctcgccctcgcggtaggcggccaccgtctccgcgctgccgtcgggttccagctcctccgaccacagcgtgcctcggaaaccgtcgcacgcgaccgtcgcgcccgcgtccagcggccaccactcgtgcaccgtacggataccgaacagctcacgcagcctgccgtccatgccacccggcctgatccggtcgtcgacgtccgcgactccggtgaagaacccgcacacgagggtgccgccaccccccacatacgcgacgaggttgtcgatcgccgcgtcaccgaggagctggagctgaggcacgagcaccatccggtacgcgctcagatccgacccggggcgggcgaactccatgccgacaccgctgtcccacagcccccggtgccaggcctggagcagctccgtgtacgagacgagggaggacggccggccctcctgggtgctcgaccaccaggcgtcccagtcgtggagcacggcgacctcggccgagaccccggtgccgctcacctcggttccgatcagggcgagttccgcgccgatgcgtttgacctccccgaacgtgcggccgctctcaccggcgtggctcagcatcccggagtggaacttctccgccccctgccgggactgccgccactggaagtagcagagtgcgtccgcacccctcgccaccgactggagcgaccagagccggttgaggccggccggcttgggatggttgacgtcacgccagttcaccgacccggccgcctgttccatcaccatccacggcccgcgggcctgcgagcgggtcatgtcggcgagcatcgcgttgtactgtccggcgctcgggtccgtcgggtccgggtagacgtcgacggagacgatgtcctcctgctcggcccaggcccaggcgtcctggcccgaccacagcggcatgaagttggtcgtcaccgggatgtgcggggtgtgccgggcgacgatgtcgcgctcggaggtgtaacactccatcagggcgtcggatgtgaagcgtttgaagtccagctcctgggccggattccgcgtgtactgcgccttgcgcggcggcaggatctccgcccaggtgtcgtagcgctggctccagaacgccgtgccccaggcctcgttcagcgcctccagggtggtgtaccgggaggccagccagcgtcggaagtgtgcaccggtctcgtcgcaccagcagtgcgtgcagtactcgttgttgatgtgccacacggtcagcgcgggatggtcggcgtaccgtgccgcgaggtcctccgtgagggccgccgcacagcgccggtacaccggtgagctcgggcagaagtgctgccgggagccgtagttgacgacagcgccgtcctcggtgcgcggcagcgtctccgggtgcagggcccccatccacggtggcggtgaggatgtcggggtggcgaggacgacgccgatgccgcctgcgtgcacgaggtccagcagccgatccagccagccgaactcccttgcaccggggcgcggttcgatcctcgcccaggagaagacaccgatggtcacggagttgaccccggcctccttcatcagccggacgtcgtcggcccacacctcctcgggccactgctcggggttgtagtcgcctccgaagaggatgcggccacgggtggcgtcgttcagggacggcatggacgtctcgttcctctacggggagtcttcaccgggggtctgcgtactggatgccacggccgttggtgcccagatagacacggccgtggacgcgggggtcgccggtgatgacctcgccggtccacccccaccggtgggcgtcgtcgttgatgcggacccaggtcgcgcccgcgtcgtccgagcggagcacggccacgccctcgtacgtcgccgtgacccgcccggtctggaagaccgccgggtagcccgcccgtcccttcctcggagcggccctgccgaagccgagggcgtacgaggcctggcagccggccaccggcgtgaacgtgcggccgccgtccttcgagcgcaggaggccgttgtccttggcggagagccacagatcgcccgagcgcccgggagccgcggccatacggaactggacgtctcccgaagggagtccggtcgcgacctcggtgaaggtcgcacccttgtccgtggagagggagaccgcccccgtgtccgtgtcgtacacgtagaagcgcctcggatcgagcgggtcggcgaccggtgtgccgcccttggggaacgtggccacctccgcccacgtggccccgccgtccgtggagcggtgtgcggcgtacttggtgccgtcccagtggatgaacgaccacagcagcgtcgccccgtcggcggagaccgccatgggtccgggagccgaaggcgcgatcgccggctgggacgcgaacggctgccagctcgcaccgccgtcgcgggagtacgcaccggccgcgtcggaccccgacggccagcccgtccgcacgacgtacgacggcttcagcgtggccagggccaggcccgtcgccgtgccgaagaccgggttcgacgccatgccgcgcgtaggggacacggtcagtcggtcatgacgcatgaccccgatgtcacccaggccgctgagcagcacggctcccgaagggggtgcgatcagctgccgtaccgacgactcctccagtccccggatctcgggagcccagtgcgccaggtcgcgtgtcccgaagatcgtggcgccggtgccgtagacgatgtgccgcgagtcgtacgggtcgacggcaagggcctggatccaccagccgaacttgggttccccgtcccacctcagatacggcgtctccgagacgtccagcaccgccacgtccttgagggaggtccagctcgccccgccgtccgtggaacggaacagggtgtccacgggaccccagcggttgttcgtggagaccacgacggtgccggggcgggacgcgtccacagccactccgccgtacccgaacgcgtcgccgtcgcccggggccagcggagtcacgtcggtccaggctccggtcaccgtgtcgaggcggtgcaccgagccgtcggcctggttgttcgggcccggcccgtccgcgtaactcacgtacagcgcacggctgcccgcgtcgtacgccgcgcggaccggcaccttcgtcgcggctccggcggacggctgcccgggtactgcctcccagccgcccgagacgtctgagcggtagagcaccgggccgccgtctccccagcccgcgtacaccgtccggccggccgccaccagcagggtgacgccctggccgttcgccgacggcgtggcagggaaggaggtgtcggcggcccaggtggcgccccggtccgtggagcgcagcagcccgtcgtggcgcgtcccgagccagagcgtctcactgtcacgcggatcgacgatgatccgctcgccgcacccccggccgtcctcgttggccccgaggcgcacggtaagatcggtgcgtgaccatgtcgccccgcggtcctcggacctgagcaccgcaccgggggaggcgtacgcctgtgtgtacgtcccgagggccaggtacagccggtcggggtgcgccgggtcgacggccatcgcctcgacgcccatcaggttccagtcgtcccagccgatgtggtcggtgagtgcggtccaccgggaccagcggtcgtcccagcggtaggcgccgccgatgtccgtgcgggcataggcgaggccccgcacggccggatggaacaggacgcccgtcacgaagcccgtccccccgatcgccgcggtgcgccagtggtgcggctgggtcttcgcgggccgccgggcggccgaggacctgcccgcggccggcagcacggaggccgaggccgcgacccccgccgcaccggccaggacggtccggcgccggggacgcggggcgggttctggctgcgggacggacgaagcgcgcatgacgaagacccttcggtggggaatggcgggcgagtgcggtgcgggaggcggtgttcagcccttgacggcgccggtgagcatgccttccttgaagtgcttctgcacgaacggtgaaaggaccgcgaccgggatcagcgccagtaccatgaccgccatctggatggcgagcagtgacaggtggccggtgttgatgacctgcgtcagaccggtgggccgctcctgtttcaggaccagctggttcatcacgttctggagcggcatcatctccgggtcgctgatgtagatggacgcgttgaaccaggcgctccagtagccgaccgcgtagaagagcgtgatcaccgcgatgaccgcgcgggacaggggcatgatgatctgccacaggatgcggaagtcacccgccccgtcgatgcgggcgctctcgacgagctcctgggccgtgctcatgaagaaggcacgcaggaccaggatgttgaagacgttcagcgcgctcgggaggatcagggccaggtaggagtcggtgaggccgagtccctggaccaccaggtaggtggggatcaggcccgccccgaagaacatcgtggcgagcatgaacagcagcagcggacggtggagcaccgaccccggccgggacaggccgtaggcgcacatgaccgacacggccatgctgaagagcgtcccgaccacggtcacgcagatgctgaccaccgcggcccgcgtgacctggccgccgccgaggagctcctggtaggcgacgaaggtgatgccgcgagggatcaccaccagtccgcccgcgtcggtgatggtccgcaccgaggacagactggtgacgatcacgacccagagcgggaagagcacggccagacaggccaggacgaggaccacgcccttggaggcgagccccgccttcgtcggctcctcctcccacaccggccgcagccggccacgcgtaccgggcttgatcccggccacgccggtcattcggtggagcaggccgctcacttcttgtacaccccctgctcacccatgagatgggcgaccttgttggcacccaggaccagtagcagaccgaagactcccttgacgatcccgacggccgccgcatagctgaagccgccgtactggatacccacgttccacacgtaggtatcgaggacctcggaggcgcccgggccgacggccgtgcgctggagcaggatctgctcgaagcccacggtgagcgcgttgcccacctggaggaccagcagaagcgccacgaccgggcgcagggcgggcagtgtgacgtgccacatccggcgccagcggttcgcaccgtccatcgcgctcgcctcgtagagttccgggctgaccgaggccagcgcggcgaggaagacgatgacgccccagccggcgtccttccagatcatctcgaaggtgatcaggaacttgaacagaccggggttcgtcatgaggtcgaagccttcatggcccctctcgcgcagcgtctgcgcgatgagtcccgcgccgccgaacatctgctggaagaccgtgatgaccaggacccaggagaagaagtgcggcaggtagaggatcgcctgcgccacagcccggacccggggccgcacgaagctgttgatgaacagcgcgagcaggatcggcaccgggaagaacagcgtcagctgcaacaggaagatcgtcagcgtgttgcccagcgccgaccagaacagccggtcgttcaccatctgctggaaccactcgaagccgacccaggggctctgcagaatcgcctggaaggcgttgtccgcgatgtacgggtcgtagtcctggaaggcgacgacgttgcccgccagggggatgtaggcgaagaccagcagcagcagcatcgccggcagggtcatcagcagcagcgtccggtcgcgccgcaaccggtgccgcaggggcaccttcgcggtcacccgcacgtcttcggggaccgccccgcccttctcggccggcggcgacgtaggggatccctgtgcgcgccggtcatctgtgctcagcgacatgtcaggaggccgactcaccggtctcgtcgagcagcttcttgtaccagtcgcgcagcttgtcgccgcccctggtcttccagtccgagacctgctgctgcatgtcgctgaccttcttgcggccgcgcacgatgtccttctccatggcctcgaactgcgcgttgagctcggtgtaccgggtgggctcctggatctgcatcccgtggaacagcggcttcttcaggtgcgcgccctggcgctgctgccactcgatgacacccttggcgacgtccgggtggtccgggtaggcgcggtacggcttggaggtggcgacgtactcgtaggtggcgaagacctcgttgttgccctgctcgttcttgacgaggacgccgtccttgaggctgtggtgggtgccctccaggccgtaggcccgcaggcgctgttccttgctgccgtacggcgcggcggtgaagttcgccagagcgaggaggtcctcgacgaccttcttgtcggccttcttgctgacgaaacaccagatgttggagggggaggcctcgtagatgacggggtcaccgccgtcgtgggcgaagaagtccatcgcccccatccggaagcccggcttgtccagccgctgcacggcggtcgcggcgtaccagtccgagatgtccgcgttgtacatcaagacgttgcccgaggagaaggtggtgcgcatgtcacccgtctccgccttggcgtccgggtgcacgaagccggccgagtacagcgagcgtgaccactccagtgcctccaggtactcctgggtctcgtagcggttcaccagcttgccgtcgaccagctgccagtagtagggcttctccggcagcactccgaagaagacgaacgccgaccacgtcatgtcgctgcacgcccacaccttgctcctgggcgcgttgatctccttgcagaggtcgtagaactccttcgtggtggtcgggacctcgtaacccttctcctcgaaggtgtcggcgcggtagaagggggtgatgttgggcgtggcctcggcgggcatggggatcccgcgcagttggccggcgaagatgccgcgctgccaggcgccggtgggaatggccgccaggttggggtacgccttgaccttgtcgcccgacaggtaggggcccaggtcggcgaacttgttggcgatggcgctcgggatcttgccgccgagctcccagcccgggatgacgacggcgtccgggacggcgctggaggcgagcaccgcgccgagcttctgcccgtacacgttgccgtcttggttctgccacttgaccttgacgccggccgccgtgtccatggctgtccagtaggcgttgccttcgccgggcgaggtgccccagagcggcgccatgatgctgatctcgctgcccttgcccagcttctcgggcaccgacaccgccagcttgtcggcggggagcgccgtggtgaaaccgtcggcggagccgttcttgctggggatgtcaggggtgacggccttcgagggcacataggccggaaggatgtccttcagcttctgacccgtcgtggtgccctcgttcttcgagccaccggaaccgccgccgcaggcggcgaggagcggcatcccgccgcccacggctgccgcgacaaccacggaggaggcgaggaatcgtctccggctgggagcggagggggaattcggcgtcattgcgtcaacccttcgtggtgcacaggacggcccgcggcggcgactgccgctcggccctgtgtctgaggtaggggcgttaccggccgagccggtcgttactgcaccggctgagctgaagcggtcaacggactggaacgtcgaagcgcttcgatgttgcagcgaggttaagtgaagggtgtcggccgcacaagagttcgtttcgatattcctcctgcctgtttccgatccgcttctcggcgtgatgacgccccgatgcgccctgaagagcctctttgtggcggtcgtgccccttgacacccgcagggtcggccgaagagcatcgaagcgcttcgaaagatcttcccctcgcgccgaaggatgactcggcgcccgcagaccggaatacctcacacctctccaaggggacccgcacgtgacggaccatccgtttcccttccgcgacccgcggctgcccttctcccggcgcgccgacgacctgctcggacggctcacgctcgacgagcggatcgcgatgctgcaccagttcgcccctgcggtggagcgtctggggctcggcccgttccgtaccggacaggaggcccttcatggggtcgcctggatggggccggccaccgttttcccgcaggccgtcggcctcggcgccacctggaacgacgacctggtccgccgtatcggcgaggccgtcggcaaggaagtgcgggccaagcgcgcccaggacgaccgcgtcgggctcaatgtctgggcaccgaccgtgaatctgctccgccacccgctgtggggccgcggcgaggaggggtactccgaggacccggccctcacctccgccatcgccgtcgcgtacacccggggactgcgcggggacgacccccgatactggcgcaccgcccccgtactcaagcactggctcgcgcacaacaacgagacagaccgcgacaccgcgtcctcctcggtccgcccgcgcgtcctgcacgagtacgacctgcgggccttccgtgacgccgtgcgggcgggggcggtggccggcgtcatgccggcctacaacctggtcaacggccgcccgaaccacgtctccccgctcctggggcagtacctgcgccgctggaccgaccagccgctggtcgtctgctcggacgccggcgccccttcgaacctggtcgactccgagcactacttcgactcccacgaggaggccaccgcggctgccctgaaggcgggagtggacagcttcacggaccacggcacggactccaccgtcatgacgggacgcatccgcgacgcgctcgcgaagggactcatcgacgagagcgacatcgacacggcggtccgccgtctgctcgccatgcgcttcgcgctcggggagttcgacccggagctcgacccgtacgcacaggtcgacgacctggacaccgaggagcacagagctctcgccctggaagccgccgagcaggcagtggtcctgctcaagaacgacggcctgctgcccctggagccgaagcggggccggacagtcgcggtcgtcggactgctcgcggacgcctgcaaactcgactggtacagcggcacgctcatgcaccgttcgacgccgctcgacggaatccgcgcacggtacggtgccgagaacgtcctcttcgcggagggcgtggaccgggtcaggctgaagagctccgacggctggctccacgtacccgccgccgacgggacgacggagggggaggcgcgcggcgcggaaggcgccctcgacccggctctcctcgccggccgcaccgacctgcccccgctgacctgcggtgacgaggcgaccgaactggccctcgccgactggggagacggcgtcctgaccctgcgtaccgacgaagggctgtacctttccgtcgccgacgacggatacgtcagggcgtccgcggacgagccgggcggctgggtcgtccaggagacgttccgcctggaagcggtggaaggactcgacggcgggcaccgccttctgcacatcgggaccggcgggtacgtgtccgtcgccgccgacggcgcgaaggttgccgacgcgggagggaagatctcccgggacgacgccacggtcttcgaacgggagaccgtcgagcacggcgccgacgcggtggcccgcgtcgccgcggccgccgacaccgtcgtcgtcgtggcgggcaacgacccccacatcaacggccgtgagaccgaggaccgtaagaccctcgccctccccgcccagcaggaccggctgtggcgcgccgcgcatgccgccaacccccgtacggtcctcgtcctggcctccgcctacccctacgcgatcggcgacgcggcggacggactgccggccctgctc

SEQ ID NO: 2714 - DNA, 4822 bp, Unknown
  Kingdom: Bacteria, Phylum: Actinobacteria, Class: Actinobacteria, Order: Streptomycetales, Family: Streptomycetaceae, Genus: Streptomyces
  misc_feature (241)..(294): n is a, c, g, or t
cagggcccgtacggcgcgctcgcgtgagtctgcggcaagtgtgtcggaggtggggctcacgaccgttggctgctcggctcgcgtcatccgcccagcctatcggcagtggtgcggtgaccgtcggcccgtccgaacatatggacgcagacagcttccggccatggtgcgcgagacctctttacgcaccgccgcccgacctgcttacgcaccggcccggcccccttacgcaccgccgcccggnnnnnnnnnnnnnnnnnnnnnnnnnnnnnnnnnnnnnnnnnnnnnnnnnnnnnngccttcttcgccggggccttcttggccgtcttcttcttggcggggcccttggcgcgcttctcggcgagcagctcgtagccgcgctccggcgtgatgtcctcgacgctgtcgtcggtccgcagcgtcgcgttggtctcgccgtcggtgacgtacgcgccgaagcggccgtccttcaccacgaccggcgcaccgctgaccgggtcggtgccgagctccttcagcggcggcttggccgcggcccggccgcgctgcttgggctgggcgtagatcgccagggcctcttcgagggtgatgtcgaagagctggtcctcggaggtcaacgaccgggagtcggtgcccttcttcagatacgggccgtagcggccgttctgcgcggtgatctcgacgccctcggcgtcctcgccgacgacgcgcggcagcgacatcagcttgagggcgtcggcgagggtgaccgtgtccagggacatggacttgaagagggaggcggtccgcggcttcaccgcgttcttgccggtcttcggcgttccctcgggcagcacctcggtgacgtacgggccgtagcggccgtccttggcgatgatctggttgccgctgaccgggtcggcgcccagctcgaagtcgccgctgggcttcgccagcagctcctccgcgagctccacggtcagctcgtcgggagccaggtcctcgggcacgtcggcccgctggtggccctcggcgtccttctcgccccgctcgatgtacgggccgtagcggccgacgcggagcttgatgtcgttgccgaccgggaaggaggagatctcccgggcgtcgatcgcgccgaggtcggtgaccagggccttcaggccgccgaggtggtcaccgtcgccgttgcccgcgtcggaggccgcgccgactccggccgcgtcgtccccgggctggacgccgaagtagaagcgcttgagccacggcacggactgggcctcgccccgcgagatgcggtcgaggtcgtcctccatgcgagcggtgaagtcgtagtcgacgagccggccgaagtgcttctccagcaggttgaccacggcgaaggacaggaaggacgggacgagcgccgtgcccttcttgaagacgtaaccgcgatccaggatggtcccgatgatcgaggcgtacgtggagggacggccgatctcgcgctcttcgagctccttgaccagggaggcctcggtgtagcgggccgggggcttggtggcgtgcccgtcgaccgtgatctcgtcggcggacagcgcgtcgccctcggccacctgcggcagccggcgctcgcggtcgtccagctcggcgttcgggtcgtccgcgccctcgacgtacgccttcatgaagccgtggaaggtgatcgtcttgccggaggcggagaactcggcgtcccggccgtcgctcgcccggccgccgatcttgacggtgacggagttgccgacggcgtccttcatctgggatgcgacggtccgcttccagatgagctcgtagagccggaactggtcgccggtgagcccggtctccgcgggggtgcggaagcggtcgcctgaggggcggatcgcctcgtgcgcctcctgcgcgttcttgaccttcccggcgtacgtacgcggcttctcggggaggtagctcgccccgtacaactgcgtgacctgggcccgggccgcggagatcgcggtgtcggagagggtcgtggagtccgtacgcatgtaggtgatgaagccgttctcgtacagcttctgcgccacctgcatggtcgccttcgccccgaagcccagcttgcggctcgcctcctgctggagggtcgtggtccggaagggggcgtacggggagcgacggtacggcttcgactcgacggaccggaccgcgaaggaggagtcggcgagtgcggcggccagggcgcgggcgttcgtctcgtccaggtgcagggtctgggcggagccggccttcagctgcccgtcggcgccgaagtcgcggccctgcgcgatccggcggccgtcgaccgcgctgaggcgggcggtgagggtcgaggggtcggaggcgtcaccggtgcggccggtggcgaactttccggtcaggtcccagtactcggcggagcggaaggcgatgcgctcgcgctcccgctcgacgacgagccgggtggcgacggactggacgcggccggccgagagcttcggcatgaccttcttccacaggaccggcgagacctcgtagccgtagaggcggtcgaggatgcggcgggtctcctgggcgtcgaccatgcgctggttgagctcgcgcgggttggcgacggcggccctgatcgcgtccttggtgatctcgtggaagaccatccggtggaccgggaccttgggcctgagcacttcctgcaggtgccacgcgatggcctcgccctcgcggtcctcatcggtggcgaggaagagttcgtcggactcggccagcagctgcttgagcttcctgacctgggccttcttgtcggcgttgacgacatagatgggctggaagtcgtgttcgacgtccaccccgaggcggcgtacctcgccggtgtactcgtccgggacctcggcagcgccgttcgggaggtcgcggatgtgcccgacgctcgcctcgacgacgtatccggggccgagatagcccttgatcgtcttcgccttggcaggcgactcgacgatgacgagtcggcggccgccctgtgcggtctcgctggtcggggacaacttcgctcttctctccggtcgacactcgatgggcatccgggcagcgccatgacgctgcccgcggtgctgtcgctgcggagtgtgacggtacaacccgcccccgtgtcaaacggcaaaagcccgcaacggccactcgaacggtaacccgacttccgccattcctgccgcccggaccgccgggtccgggccgtgcggaggcttggccagtgtcttttcggaggtggtcgcggtgtccgccgggcaacctgtcggcccgggcgccgccccgccgggggcggggatcagacgagcgtgaagcaccacacgccgaggccgaggaaaaccacgccgaagagggtcgtgagtgcggtggaggcgacggggctcacaccgtgcgccaccggcgcgcggtgcagggctcgcgccccggtccagatcaggagggcggcgccgaacagcgccagggccgtaccggcgaagactgctgagacgctctccatgtcgtactcctggaccgtcgtggcgaaccacccgggacgggccgaccggtcccggagccggacctcggcggtccggcacggggaggttgtcaccccggggcatcgcccacacgaacccagggtgaacagcactcccccgccgaccggcggaacaccatcggccgcatacggggcacccgcgggccgcccacgaccggaatgcgcggtccgggcgcgtcggagagcgcgccgcgcgggaacgcactggtgacacggacgacaccgcccgacctgggagcgtccccactccgtaccggaaggcggtcgcggtcactgtcgtacggacacggcatccaggccaccggccgccgtacctccgcggcccactggcccgcggcctccgcaccctccgcggcctactggccccgcggtacgaggccgggcgccggttccaggaagccctcctcgaccagcagccggatcgcctgcggggtgcggtcgcgcaggagcaccgggtcttccgccatcaactgcgcgatggcgtccaggatccgcccggcgggcagcgagccgtcgcacacgcccgcgaacccggcggccaccgcgtcgaccttggtcgcccgcatcatgccgcggtgctgacgcagcaccacatgctcggggtcctcggcgcccggcatgccgacctgctcctgcaccacctcggcggcgaggacgaagtatccggcgagcaacgccgcgtcgtcctgatcgcggaggtagtcctggcgggtgaagtgctcctggacggccggtccgagcggctgctgcaccgcgtgcggccattcctcgaccacgatcgaggggttcccggccgctgcggcggcggatttacgcagcgtgatccagccgaatccgacggccgtggcaccccgcgcctcgaactcgtcgagccacgcctcgtaccgctcggcgtactcggcggggtcgcttcggtggtcgccgctgtcccgcagccacagctcggcgtactgcgtgacgtcctggacctcgcgctggacgatccaggcgtcacagccgtacggcacccaggagcgcagccggtcctgccactcctcgccctccacgtgctgccagttggcgaggaactgggcgtaacccccctcgttcagatggtcgccggactgctgcaccagcgtgcggcacaggtcgtcgccgcccatgccaccgtcccggtaggtgaggcgggcgccgggcgagatgacgaagggcgggttggagacgatcaggtcgaacgtgtcggagcccaccggctcgaagagggagccctcgcgcaggtcggcgggggcggcgccggacagggcgagggtgagc

SEQ ID NO: 2715 - DNA, 1759 bp, Unknown
  Kingdom: Bacteria, Phylum: Actinobacteria, Class: Actinobacteria, Order: Streptomycetales, Family: Streptomycetaceae, Genus: Streptomyces
gctcagcgagccgctgccggagcgtcgtcgctcgcggccgcgtcggcgtcgtctctggctgccgtgccgccgactgccgtgccggggggatctgcggaggtggtccgctggccggggattcgctcacccggggaagtcttgcatccggtactgacattcgggggcacggtcgcggatacggacccggcgacgcggttcgggccgaccccgctccggcccgcgaacaggacggcggccggcccggtgaaccgggccgcgccccacgccttgaaccggtcggcggtccgcatgacgggcctgaccagcagggctccgacaccaatcaccgcggcccccgcgacggcgtccagaaagtagtggttggcggtgcccatcacgatgatcgtggtgatcagcgggtaggcgatgcccgccgcccgtacgagggggtggcggccgtgccgccacagcaggatcccgcaccagagggaccatccgacgtgcaggctgggcatcgccgcgtactggttggtcatcccgctcagcccgcgcggggcgctcgccccctcgccccaccagccgtacgcgctgtactgcgccatcgtgtcgacgaagccgtggctcgcgtccagcagccggggcggacaggtcggcatcagcgtgaagccgaccagccccagcagcgtggagttcatcagccagacccgggccgcccggtacgcggccgacctgcgccggaacatccatatgaggacggccggggtgaccaggtagtgcagggacgcgtacgcgaagtcggcgggtatcccgagggacggggtgctggtgaagagacggttcagcgggtgctcagcgttgaggtacagcgactgttccagccgcaggatcgccaggccgtggtcgatcgccgtcgacacatcgccgcgcaccaggagccggcccaccgaatacagcgcgtacaccaccgcgatcagtggcagctccgtccaccagcggggccgatgaccggtcgcgggcggcgcggtggcgtgcggcatccggtagctcccccatgttcatgcggccgacgacgaacgttcaaccgtacggcggcactgtgccgccggctcccccgggggtccccttccggacgtcccgtacgcagcggcccccgccctggtccgaatcctcggccgggggactgctcagggtgggacgcccgcatggcccgggaggttgcctgccgggccggtacgggatgatggaaggcccagcaccagcgttccagggagagccttcatggcaccgcgcatcctgctcgcccggcacggccagacccagtggtcggtccggggcaaccacaccggcaggacggacatcccgctcctggacgccgggcgcgagggcgcgaagctcctcggcgagcggctgcaccgggcgccctgggcggggctgcccggggtcgaggtccgcaccagcccgctcgtccgggctgccgagacctgcgagatcgccgggttcgggaagcgggcggagccgtgggacgcgctgatggaatgggactacggggcgtacgaagggctgaccccggcgcagatcaaggcggaccgccccgactggctgatctggcgcgacggggtcccggacggggagtccgtcgccgacgtcaccgcccgcgcggacgagatcgtcgcctgggcccgctcggcggaccgggacgtcctggtcttcgcccacggccacatcctgcgggcgctgggcgcgcggtggctgggcgaggacctgtccttcggcgcccgca

SEQ ID NO: 2716 - DNA, 16964 bp, Unknown
  Kingdom: Bacteria, Phylum: Actinobacteria, Class: Actinobacteria, Order: Streptomycetales, Family: Streptomycetaceae, Genus: Streptomyces
gcgcgagagcgaccggctcgccctcgtccgggcgaccgccaagctggagacggccgcgggcgagtcaggtgcggccagctcccggctctcggtgaccttcgaggcggagggcggcgtcttcgccgacgtcgaccgggccatctccgagcgccgcaggctctggctgcgctactactcgcccgcccgcgacgaactcaccgagcgcgaggtcgacccgatccggctcttcgccgtcggccacacctacatggagggctggtgccggctctccgaggcccgccggaccttccggctggaccgggtcgccgagatccgcctcctcgacgctcccgcggccccgccggagctggagctgcgcgacctgtccgcggggctggtccagcccgccgccgaggacccggaagtcgtcatcgaggtcggcaccggcggccgctgggtcgccgagtactacccgcacgactccgccgaggaactccccgacggcggcctgcggatcaccctgcgcaccccggacccggcctccctgcgccggctcgccctgcgcctcggcggcgacggccgcatcgtcaccccgccggaactcgcggacagtgcccgcgaagccgcccgcgaggcgctcgccgcctacgaggacgcggtctgagacccgaggaggggagacaacgatgaaccggacacccctgtatccggccgccgcctccggggtccgaccggcaccccggcgcggcaccggacccgtcaccgtgccggtacccgccgccgtacgcttccgggccgcctgccccgactgccgcgggcgcttcgagctggccgccgcggcactgcgcctggccatcggcgccaccagtcgcaccaccttctacaccttcacctgccccgagtgcggcgcctcggtccgcaagcccgccggggagcgcatcatcgaactgctcaccggcggcggcgtacggacactgcgcctgcacaccgccctgtagcgcccccgaccgtccgtcgcaaaccttgtaggaagcccgtaggaagagggaccgccgtatgttctggcccatgctcgccatcgccctcggattcctgggcatcgccgtgctcggtgtgctcggcatcaaggtcttcgtcgaggcccagcgtctcggccggcaggtcacggtcaccacggagcggatcaaccgggcgtcggaggacctcgaacgggcggccacccgcctcgcggccaccggcgaaggcctgcgataacggacccgggggcctgatgttcgacagcaccggagggtacgctgcatgggtcggcccaggcagggaggtgcgggtcgcaatcgggagtacgcacgggcattgcctcgcgtttacccctgcgggttacgatcgctgccaagcgcaacgatcggacgtatgcccggtcgaacgggtagcgagcccaccctccagccgcctcagtgagaaggaagtcgcacatgatcggcaatctgaagcccctcgagatcgttctgatcatcgctgtcatcctgctgctcttcggtgccaagaagcttcccgacatggcgcgctcgctcggcaagtcggcccgcatcctcaagagcgaggccaaggccatgaagaaggacgacgcggcgacggcgacgcccacgacggagaccgtcgaggacccgacgcccccgcagtccaccaccgcgcgcaccatccaggccgctccgggagacgtcaccagttcccgcccggtcagcgaggccaagcccaccacccagagctgacagctgacgcgctccgccgacagccgccgcacgagacgagggaagtgggttgctcaagtctgcccgcaagcaggagaaggacgacgaggggcggatgcctctcctcgatcacctgcgtgagctgcgtaaccggctgctgaaggccgtgctggcgatcgtcgtggtgacgatcgtggcggcgttcttccagaaggacatctacgacttccttctgcgccccctcctcgaatccgtcgggtgcaaggacggcgtggtcgtggccgtcaacggcaagccctgcgcgttgctgaagaccaacaccctgctggcgccgttcaccaacgccctcaaggtcgctctgatgtccggtgtcctgctggccacaccggtctggctgtaccagctgtgggccttcgtggctcccgggctgcaccagggcgagaagcgttacgcctacgccttcgccgtcgtgggcgcgcccctcttcctctccggtggctacctcgcgtacgcgatcctgccgcagaccgccgagatcatgctcgggttcagccccgagaacgtgcagaaccagatcgagctcgacagctatctggatctgctggtccgcatggtgatcgtcttcggcatcgccttcgaactgcctctgctgctcatcgcgctgaacatgacgggtgtcgtcaccggcaagcggatgctcggctggtggcgcgggatgatcgtcggcctcaccgccttcgccgcgatcgcgacccccgggggtgaaccggtctccatgctgcttctcgccggaccgctcgcggtgctctacttcgtcgccgtcggtttctccctgctgaacgacaagcggcgcaaccgcaacaaccccgacgccgagctcagcgacgacgaggcctccgacctcgatctgacgcccgagcctgtcgggagcgtggagcacgtctccggctcccgccccgcacttccggggcaggcgtccggcgaggcggacggtcccgggtcgcaccggctgaacggttacgacgacgtcacctgaccttgtagggtccggcgggtgaccagcgagatcaccctcttcgtcaatcccaccgcaggaagcggccggggcgcgcacgccgcgcagccggccgcttccgcgttgcgggacgccggattctccgtccgtacggtgctgggcgaggatgccgacgacgccctgcgccgggtccgcgaggccgtcgcggcggggaccggggcgctgatagccgtgggcggggacgggctgatgtccctcgccctccaggcagtcgccgggacctccaccccgctcggggtcgtcgccgtcggcaccggcaacgacttcgcccgcgcgctgggtctgccgatacgtgacccggccgccgccggacggctggccgcgcgggcgctcaaggagggcggtcaccgcgccatcgacctcggacgggtcggggaccgctggttcggctcggtcctcgcctccggcttcgactcccgggtcaacgaccgcggcaaccggatgcgcttcgtcggcggccggttcacgtacgacctcgcgatcctcgccgaactggccgccttccggccgatcccgtaccggatccggctcgacgggggagaggtcaccgagatcgaggccaccctcatcgcggtgggcaacggaaccacgtacggcggaggcatgcggatctgcgccggggcggagatggacgacgggctcttcgacgtgaccgtggtggggcggtgcagccgcaccacgctcctcaaggtcttcccgaaggtctaccggggcacacatctggaccaccccgccgtcaccgtgcaccgggtctcctcgatcgagctggcggcggccggggtcacggcctacgcggacggggaaccgctgggcgcgctgccgctcaccgccacctgcgtaccgggcgccgtgcgggtgctcgccgggcgctgagcgggcgccggccggaccccgagggagggaacgggcgtgggcgattaaagatcgggctgagtgtcagaggtggcgggtaggctcgtacgcaagatgacagaggacctctcaccagctgagcgataccaggcttctcaggtccgtgcggccgagatggcgacggccctcgggcccttccgcgagatgtacgagttcggtctggacccgttccagatcgaggcctgccgggcactggaggcgggcaagggggtgctggtcgcggcccccaccgggtcgggcaagacgatcgtcggcgagttcgccgtgcatctggccctggaacagggccgcaagtgtttctacacgacaccgatcaaggcgctctccaaccagaagttcgccgatctggtcaagcggtacggcgccgacaaggtcggcctgctgaccggcgacaacagcgtcaactccgaggctccggtggtcgtgatgaccaccgaggtcctgcggaacatgctgtacgcgggctcccagtcgctgtccggcctcggctatgtggtcatggacgaggtgcactacctctccgaccgcttccggggagcggtgtgggaggaagtgatcattcacctcccggagtcggtgacgctggtctccctgtcggcgaccgtctccaacgcggaggagttcggcgactggctggacaccgtgcgcggcgacaccgaggtgatcgtctccgagcaccgtcccgtgccgctctggcagcacgtgatggccggccgcaagatgtacgacctcttcgaggaggcgaccgaccacggggggcgcggcgccggacggcgtgaggtcaacccggacctggtccgtctcgcccggcaggagagccagaacgtctacaacccccgtgaccgccgccggggcaagatggtgcgcgaggccgaccgtgagcgcgagaggcgtcagcgcggccggatctggacgcccggccggcccgaggtcatcgaccggctggacaacgagggcctgctgcccgccatcaccttcatcttcagccgggccggctgcgaggccgccgtccagcagtgcctgtacgccggtctgcggctcaacgacgaggacaagcgccggctggtccgggagatcgtcgaggagcggaccgcgtccatccccggcgaggaccttcacgtcctgggctactacgagtggctcgaaggcctggagcggggcatcgccgcgcaccacgcgggcatgctgccgacgttcaaggaagtcgtcgaggagctgttcgtccgcggtctggtgaaggccgtcttcgccaccgagacgctggcgctcggcatcaacatgcccgcgcgttccgtggtgctggagaagctcgtcaagtggaacggcgagcagcacgccgacatcacccccggcgagtacacccagctcaccggccgggccggacgccgcggcatcgacgtcgagggccacgcggtggtcctgtggcagcgcggcatggacccgacggcgctggccggcctcgcgggcacgcgtacctatccgctgcgctccagcttccgtccctcgtacaacatggcggtcaacctggtgcagcagttcgggcggcaccgctcgcgcgagctgctggagacctccttcgcccagttccaggcggacaagtccgtcgtcgggatctcccggcaggtccagcgcaacgaggagggcctggagggctacaaggagggcatgacctgccacctcggcgacttcgaggagtacgcgcgcctgcggcgcgacctcaaggaccgcgagaccgagctggccaagcagggcgtggcgcagcggcgggcggcggcggcctcctcgctggagaagctgaaggccggggacgtcatccatgtgcccacggggaagttcgcggggctcgccctggtgctggatcccggcctgcccgccgggcgggccaacgggcaccgcgggttcgaccaccacgacgggccgcgtccgctcgtgctgaccgccgagcggcaggtcaagcggctggcctcgatggacttcccggtgccggtggaggcgctggaccggatgcgcgtaccgaagtcgttcaacccgcgctcgccgcagtcccggcgcgatctggcctccgcactgcggacgaaggccgggcacatcgtgcccgaccggcatcgcaaggggcgggcgccggccgccgatgaccgcgagatcagccgactgcggaccgagctgcgcgcccacccgtgccacgggtgcgacgagcgggaggaccacgcgcggtgggccgagcgttaccaccggctgcagcgggacacccggcagctggagaagcggatcgaggggcggacgaacacgatcgcccggaccttcgaccggatcgtcgcgctcctcaccgagctggactacctccggggcaacgaggtcaccgcgaacggtcggcggctggcccggctgtacggggagctggatctgctcgccagcgagtgcctgcgggagggtgtgtgggaggggctcaaccccgccgaactcgccgcgtgcgtctcggcgctggtgtacgaggcacgacaggccgatgacgccgtcgcgccgaagctgccgtcgggtcctgccaaggtcgccatgggcgagatggtgcggatctggggacggctggacgccctggaggaggacttcaagatcaaccagacggaaggggtcgggcagcgcgagcccgatctcggtttcgcctgggcggtctacatgtgggcctccggccggacgctggacgaggtgctgcgcgaggcggagatgccggcgggggacttcgtgcggtggtgcaagcaggtgatcgatgtgctggggcaggtggccgcggcggctccccgggatgcgggggagggggcgagttctgtggcgaagaatgcgcgcaaggcggtggatgcggtgttgcggggggtggtggcgtacagctctgtcggctgacgcgccggcggggtgcgtcagccgcgggctcgggtgtgccgctacggaccccgctcctcaagcgccggaggggctggaaggcccggaggctggccagaggggcggggcttgtcggggtgcggcggggtcaggtgctgcgggttctggccgctgctcccgcgcagaccatgcccagcagtacggtcaagccgccgacgatgatgttgttgatcacgatcccggcgtccgggctgctgcccaccacccaggtcgacacgatgatccacgcacccatggcgcagatcgcccagctcaggccgtacatgcgctccggcatggcggtgaagccgagagccagtaccgcgatggcgatgcccatcaccaggttgtgcgtgaccagggccggctggctggccgtgaagtggagcacccacggggaaacggcgcagtagaggccgacgaggaacaccggcgcgtccaccagcgccacatcgcgaccacccatcacccggtcgtaccgcgcacgcatttcggaggcatcggggtggcctgatatgtcactcctcgcgtgtgagacgttgctcatgagatctcgtctccttcgtcgtgcgggccccgccgccgtgcggatggatgcggcaggcaccctcatccccatagtgctcttatctggcacttatgtgtacttttccggcggtattgctggaagagattctcaggcgctccgaggaccttcggagtccagccggctggccagcgtgagaaggtcccccctggtcaggcggcggtccccgtagccgggcagcggtacgtgcaggcgctcggtccagcgggcggggacggctccgacgccgtacaccgctcctgccaggccacccgtcacggctgccaccgtgtcggtgtccccgcccacgtcgacggcggccgccagggcccgctcgaaggtgtccgtcgtgcgcagcgcccagagtgccgtacccaggcagggccacaccgcaccgttgaactcggtcgccaggccggggtgccagtcgggcgccagcaccgtcgcccagcgggcccggtgggcggtgtggacctcggccagcgtgccggggagggcggcgaacgggtcctcgcccgccagcgccacccggatcagttcgtggaagaccgcggtgccctcccaggccgcccggtcgccgtgggtcagcgccgcgatccggcgggccgcctccatcgtcgccgggcggcccgcgtgggcgaagtacaccgccgatgtggtcgcccgcatcagtgaaccgttgcccgcggcccgcccgttgagctggaagtgcagggccgccgccaggtcccacggttcgccgttggtcagcacgtcctcggtctggaggccgatgtccttcggcccgcccgcggaccagcgccggaaccggtcgaacatgtccggcaggtccaggccgttccgctccagcagcgaatccccgaccagcacggccatctgcgtgtcgtccgtcgcctcgcccggatcccagccgccgcccccgcacagcgctccgacgccgtccgggaagcgggcggtgaacacgccggcggcgccgaactcgaacggagcaccgagcgcgtcccccacggcggacccgaccacggctccggccacgcggtcgccacggcccacggcttcacggtgcgtcatcccgtcaggctaaggcagcgcacgcacaggacgagggggagtcacggttcgccgtggctccccgccccctcgacccgggggaccggtgacggctacttcgggggcatcaggacggtgtcgacgatgtagaccgtcgcgttggcggtcgggacgttgccgcagacgaccttcgaggagtcgttcacggtgtactcgacgcccgagccggccgtggtcagcctgctcttctccagcgtgtcgaaggagcccttctccagctgctgcggcgtcagcttctcgcccaccacgtggtaggtgaggaccttggtgagctcggccttgttcgccagcagtgcgtccaggtcggccttcgggaccttggcgaaggcgtcgttggtcggggcgaacaccgtgatgttctccgcgttgttgagcgtgtcgaccaggcctgcctgcttcacggcggccaccagcgtcgacagctcctcattgttcgaggccgccgtggcgaccgggtccttcgccatgccgtcgaacgagcccgcgccttccttcggcaccgacgaacaggccgggccgaacggctcgtccgtgatcgccgaatcgtcggccgagggactcgccggcgcggacgcgctgggcgtcgagcctgccgccgagtccttggaggagtcgtccgacgagcatgcggtcagtgccagcggcagcacggccgccgcggagacggcgacggctgcgcggcggaaaaggagcgtgttcatggcgtttctcctggatcgaaggtctggtgcgaagagaagacgaagagaagggaggaaaggagagcgggccttgtggcgagcgggaccgccggggcaggagtgccccgtccatccgcgcatcgttcccgtccgctctcacacaaggggttcggcgccggtccgcccgcggattggtcccgggccctcattcactcgtccggagcggatccgctgaccgaccaatccatgcggccacctgccacgaatggagggggaggagcacgacgacagcgctccgacccgtgtggaagaaccggagggagccggaatggcaggggaacggcggcggacggccgtggtcggatccggagtggcgggactgaccgccgcccacgttctccgggacgcccacgaggtgacgctgtacgaggcggaggaccgcgtcggaggccacgcccacacgcatgagctgggcgcgtccgacggacgggtgcaccgcgtcgactccggtttcatcgtgcacaaccggcggacctatccccatctgctgcggctcttcgacgaactgggcgtcgccacccaggagtccgagatgtcgatgtccgtgaggtgcgaggggtgcggactcgagtacgcgggggcgcgcggcccggccgggctcttcgcgcagccgcgctccgccgtgcgcggcccctatctgcggatgctcgccgaggtgccgcgcttccacagcgcggcacgcgccctgctggaactgccggagagcgcgacgagcgggacgagcggaatgacgctcggggagttcgcccggcgcgggcgcttctcgccctacttcctcgcccacttcctcacgcccatggtctccgcagtctggtcctgcgacccggtcaccgccctgcgctacccggcccgctacctcttccgcttcctcgcccaccacggcatgctcgccgtcggcggctccccggtctggcgcaccgtcaccggtgggtcgcgcgcctatgtcgaccgcgtcgtcaagcagctcgccgccgtgcacaccgcgaccccggtacgcgcgatcacccggcacgcgggcggcgtcgaggtcaccaccgaggacggcacgaggaccccgtacgactccgtcgtcatcgccacccaccccgaccaggcgctgcggctgctcaccgacccgaccgacgccgagcgcggcacgctcggcgcgttccgctactcccgcaacccgacgctgctgcacacggacaccacgctgctgccgcgcgcccggggggccagggcctcctggaactacctgatgccctcgtgcgccgccgacgccgaccgcgtcaccgtcagctacgacatgagccggctccagcggctcgacgcgcccgagaccttcgtcgtcacgctgaacggctccgaccgggtcgaccccgcctccgtacgcgcccgcatggtctacgagcaccccgtctacacccccgaatccgtcgaggcccaggccgggctgcccgccctgtccggtcccgtcaccgcctacgcgggggcttaccacggctgggggttccacgaggacggctgccgttcgggggcagaggccgccgcggccctgggggtgaggtggtgaacgccctctatccgtgcaccatcacgcacgtacggaaccggccgacgacgtacgcgttccggcaccgtacgtatctgtggctcatcgaccccgaccggccgccccggctgccgcgcgtcctgcggccgctggcccggttcgacccccgcgaccacttcggcggcaccgcgcccaccgtccgggccgggctggagcgcttcctgcgggcccgggacgtcgaactcggcgacggcaccgtcaccatgctcacccaggcccgggtcctcggacacgtcttcaacccgatcaccgtctactggtgccaccgcgccgacggcagtcccctctgcgtcgtcgccgaggtgcacaacacctacggggaacggcacggctacctgctgctccccgacggggacgaccgggccgtgacggacaaggagttctacgtctcgccgttcttccccgtggacggcggctaccggatgcggctgcccgaacccgggtcccggctcgacctgagcgtccatctggagcgcgccgcggcccgcccgttcaccgcgaccgtacggggcgaacggcggcccgccaccccccgggagctggtgcgcctcaccctgcgccacccgctgtccaccctcctcgtctccgccgcgatccgcctgcacggcatccggctccacctgcgcggacttcccgtgcaaccccgtcccccgcaccgcccacaggaaggcatgcagtgaccgcgcccacctccgcgctgccggcagaacacacctccgggaccgacccggaacgctggcccgacgtcgtcaccccgccccgggtctcccgcgcccggaccgccgtcgccgaacgcgtcgtccgccacgcgctcggccgactccccctgcgcgctcgcctcgcgggccgggaggacatcggcatcggcgggccgctcatggacatccgcgaccccgacgccttcttccggcggatcggcgcgagcggactcatcggcttcggcgagtcctacatggcgggggagtgggacgcgcccgacctcgtcggcgtgctgaccgtgctcgccgaccacgccgccgacctcgtcccccggccgctgcaacgcctgcgcggtctctgggcgccgcgcagacccgccgcgcagaggaacacacccgagggctcccgggacaacatcagccaccactacgacctgtccaacgagctgttcgccctcttcctcgacgagacgctctcctactcctccgccgtcttccgcggcttccccgccgaacacgagctgctgcccgccgcccagcaccgcaagatcgaccggctgctggacgccgccggagtcaccgagggcacccgcctcctggagatcggcaccggctggggcgaactggccctccgcgcggcggcccgcggcgcccgggtcgtcaccgtcaccctctccgccgaacagcgcgaactggcccgcgcccggatccgcgaggccggcctcgcggaccgcgtcgaggtgcggctgagcgactaccgccaggtcaccggcgactacgacgccatcgtcagcgtcgagatggtcgaggcggtcggcgaggagttctggccggtctacttcgcgaccctggaccggctgctcgcccccggcggccggatcgccctccaggccatcaccatgcccgacgaccggctgcgcgccagccgctccacgtacacctggatccagaagtacatcttccccggcggactgctgccctccaccgaagccgtggagcggatcaccaccggtcgcacgagcctgcgcaccacgcagcgcatccgtttcggcgcgcactacgccgaaacgctccggctgtggcgggagagtttcaccgagcgggcggccgaggtcgacgcactcggcttcgacgccgtcttccgccggatgtggaccttctatctcgcctactccgaagcgggtttccgctccggctatctcgatgtgcagcaactgctgctgacccgcgaggagaccccgtgagcaccaccgccgccgccaccggaaccccggcacggctgttcgtcatcggccgcggccacggttcgccgaccccgtacgcaccggcggacccgggagcggaccggtgagcggcttcgcctggaacgcgttcgcgagcgggctcgcgggcacggccgtcgccgccgtcggcgtcatgctcgtcaccttcgccgtcgcactgaacaagggcgtccaccgcatcgtcgacgtcgcctggggcatcgggttcgccgccgtcgccctggtcgcctacagccagtcggcgggcgtcggtgacgacggccgccgactcctggtgaccgtgctgacggtggtctgggggctgcgcctcgctctccacatcggccggcgcggccggggccacggagaggacccgcgctacgcgaagatgctggccaaggcccccggcaacccgaacctccaggccctgcgcaaggtgtacctgctccagggggcgctggtctggctggtctcgctcccggtgcaggccgcgcagtacctcaccgcgccgctcgcccggtgggcctgggcgggggccgtcctgtgggcggtcggtctggccttcgaggcgatcggcgacgctcagctcgtccggttcaaggccgaccccgccaaccaggggaagatcatggaccgggggttgtggtcctggacccgccacccgaactacttcggtgacttctgcgtctggtggggcctcttcctcttcgtctgccaggcccccgccgccgctgccgccaccgtcgtcgcccccctggtgatgagcttcctgctgaccaggggcagcggcgcggccctgctggagcgccatatggcggaccggcccgggttcgacgcgtacgtggcgcggacgagcggcttcttcccccggccgccgcgccggacctgagcacatcgaggagggccccgttccgcggcttgcggaacggggccctcctcgtgcgtcgtgccgtcgtacgggtcagtccaggccgcgggcgcgctcgaagcgggaccgtgcctcggccaggtccaccaccgggtccgggtagtccaggcccgcgcgatccgggccctgaagcttccagggctcgtggatcgcggccccctccagctccgccagctccggcacccagcgccgtacgtagtcgccacgcggatcgaagcgcttgccctggatcaccggattgagcacccggttgggccgggtgtccgtcccggtccccgccacccactgccagttgagctggttgttcgccaggtcgccgtcgaccagcaggtccaggaagtgccgggcgcccacccgccagtccacgtacagcgtcttggtgaggaagctcgcggccagcatccggccccggttgtgcatccagccctcgtgcgccagctgtcgcatcgccgcgtccaccagcggataccccgtccgcccggtcctccaggcatcgatctcgtcctcgtcggagcgccagcggtcccggcgcggccggtagtcggaccaggaggcgtcgggacgggccgcgaggacctggtggtggaagtcgcgccaggccagctgccgcacgaacgcctcgccgccgggcccgcccttctcccgggcgcggtgcaccagttcggcggcggagaccgtaccgaagtgcagatggggggagagccgggacgtcgcgtccccggccaggtcgtcgtggccgtccccgtagtcggccatcggcccgttcagccaggacgtcaccagcttgcggcccgcgtcctcgccgccccgggcgagaccgggggagaggttctcgaccctgtcccggtccgggagagggtcgccggacacgccgtccggcacccggacctcacggggagcggtcagcgtgccccgtactccttccgcctcccagcggcggaagtacggggtgaacaccgcgaaatggtccttgccgcctgtcgggaccacccggcccggagcgagcgcggtgaccaccgcgtcatggacgcgcagctcgcacccggtgcccgcgagagcctcccggacacgctcctcgcgccgcgccgcgtaccggctgaccccggcggcgacgtgcacggaggccgccccggtctcctcggccacccgcctcgcggcggaggccggctcgccccggcggacgaccagccggccaccccggtggcggagtcctgcgtccagggcggccaggcagtcggcgaggaaggccagccggttgggcgcgtcgaacccggcgcggtggacgccgtcgtcccggacgaacaaggggacgacctcgtccgcgtcccgcagggcggcacgcagcaccgggttgtcgtgcagacgcagatcggaggtgaacagcaccaccgcgacactcatgaacgggcgctcctcgcatggttcgtgggtgagaggtcaagcagtcgggaagtccatcagcgccaccggggacgaggtcggttcgtcggagcctccggtgggttcgacggtgatgcccatcccggacgcccggtccaccggcccgttcagcaggaccgcgtcgtcgctcgccttcgggtccatcagaccggccgagcgcatcgtgccctcgtcgttgaaccagagctggtagaccttgccggtcggcggccgttccatccccgaggccaggaacaccgcacggttctggctccgcgagacgacgacggtgccgtgcgcgccaccggtcagctcggccgaggtggtcttcgcgtccggagcggagagcacctgggccagctgctcgttctgccgctgcgcccggtccgcctcctgccgcgcgtcctgcgccacctggttctgccagaccgcgaccccgccgaacgcggcggccgcggcgacacaggcggcgagcgcgtaggcgtaccaccgaccggtgcgtccacctccgccggtccgctcccgtccgccgtgcgccggagtctcctggcgtacggtcgtgatctcccgcagtacccgctcgcgcagctcgcgcggcggggtctcggcggcggcgaggccgagccgggcggcggtggccgacagctcccgcacctcctgggtgcaggcctcgcagtcctccagatgccgctcgaacgcctgccgttcgggctccggcagcgcatgcagggcgtaggccccggtcagcgtgtgcagctcggccgtgttcatgcgctcacccccaggcagtcgcggaggcggatgaggccgtcgcggagtcgtgtcttgatggtgcccaacggcacggcgagcagctcggagacctcacggtaggtcaggccccggtagtaggccagggtcaccgactcccgttgcagctcggacagggtgcgcatgcagcgccgtacctgttctctctccagtcggctctcgacctgttcggacacctcgtcgaaggcgggcgtccggtccagcagcgccgccttgtgctcccgggcggcagcggcctcggccgagcggacccggtcgacggcccggtggtgggccagggtcagcacccagttcatcgcgctgccccgggagggccggaaacggggcgcggtgcgccacacctccaccagcacctcctgcgccacctcctccgactgggccggatcgcggagcacgctgcgcaccaggccgagcacgggtccgctcaccgtgtcgtacaccgcggcgaacgcgtccctgtcgccccgcgccacccgcaccaggagctcctggagatcgggaccgggcgatggcgctccactgatgtgtacggcttccttcacgcgggtttcctcccgggccgatcgtcgcttccggcagtgattcggagccgaggaccatgcggattggtcggatgcccgcgatctttccagacgggaccccgggagggcgcgactcagccggcgagcgtcgcgcgccgtcgcaggcggacggcgcgcacggcgaggaagatcagcagcccgaacggcgacagcaggatcgtcaggaccagcagcggccccgtcagcaggggcgggagccccagcttccggctctggaggaacatccactgcccgagcagcaggtcccaggcgatcacctgtgcccagatggctcccgctccgccggccagcgccgtcagatcacggaaggtgtcgatgtccggactgctcaccgccgtccagagctccgggaacaccggcacggccatgacgacgtagacggcgagcacgggcagcacggtcagcggggaggcgaccacgcgggcggtgccggaccaggtgggggcgaagatcatcagcagccagaacggagcggccagacagaacgtgatctcgaagagtgcgccggtcatgccacgggctccttgtcgtctgcggtgcgggacgcgcgggcagaggcggccgggcgcagcgcgctccgtgttccgcacgccaccgccgcgaggagggctccggcggcggccagcgtggccc

SEQ ID NO: 2717 - DNA, 10306 bp, Unknown
  Kingdom: Bacteria, Phylum: Actinobacteria, Class: Actinobacteria, Order: Streptomycetales, Family: Streptomycetaceae, Genus: Streptomyces
  misc_feature (6341)..(6342): n is a, c, g, or t
accccggaccaacccctccgcccgcacggcgaaacccacctgcccggccagaatcacaccctgtgcattccggccgggcagtgtcatatccccaccaaagaacgacagttggccaacacactcggtcaacttccttgacgccacagcgcgttccatgagccactcagcagccacatcgaccccgcgaccacggggacccgagcaccgatgtaacactgcgtaacgtgcaggcaatgcggaatccagccgcacaccccggcctcgaacacccggggagcttcgccgcgcccaccgcgatcatcgaaccgcgtcagcaccaagatcacctcaagccccttagcagagctgcgcgttctcacgatgtggtcattccgcactccaggcgaaaccgccacatgtcctcacaggaacctcaagccttgctcaagggcataacaagagagtcacatccgccgccgaccagtcccggtggcccccagctgcgcttagagtcaccgccagtcaccgcgccgccgggcgcgtctgctgcacggccctgtaccaacccagtacggcccggcgatcgtcacggcacctcaagcagaggaggccgcgccagggaaaggacttttcgtgcgacaccgttctttgctcatactcaccgcagtgctcaccaccggagcactcaccctcaccgcctgcggttcgcgcgacgacagcaagagcagcggcggcgacggaggcaaccagacggtcgtcatcggcctcgacgccccgctcaccggcgacctgtccgccctcggcctcggcatcaagaactccgccgacctcgccgtcaagacggcgaacaaggaaaagaccgttcccggcgtcaccttcaagctggaggcgctcgacgaccaggcccagccctccgtcggccagcagaacgccgtcaagctcatcggcaccagcgaggtcctcggtgtcgtcggcccgctgaactccggcgtcgcccagtcgatgcagaagcccctcaacgacgccaagctgacccaggtctccccggccaacaccggcaccgagctgacccagggcaacgactggaagagcggcgacaagaagcgccccttcgcgtcctacttccgcaccgccaccacggaccagatccagggcgccttcgcggccaagtacctcttcgagaccgcgaagatcaaggacgtctacctcatcgacgaccagaagccctacggcgccggtctcgccgcctccttcaaggcgaagttcaccgagctcggcggcaagatcgtcggcaccgaccacgtgaaccccgaggaccgcgacttcaactccgtcgccaccaaggtcaagagctccaaggccaaggccgtctactacggcggcgagtaccccgccggcgccccgctgagccagcagatcaaggacagcgtcaagatccccctcatgggcggcgacggcatgtacagcgccgacttcatctccctcaacaagaaggccgaaggcgacatcgccacctccgtcggcaagcccgtcgaggagctggagtccgccaagaagttcatcgcggactacaagacggccggctacaaggacgcctacgaggcctacggcggcggcacctacgacgccacctgggccatcatcgaggccgtcaagatcgtcgccgccgagaacgacggcaagatccccgcggacgacgcccgcgccaaggtcctcgcggccatggacaaggtcaagttcgagggcgtcaccggccccgtctccttcgacgagttcggcgacaccaccaacaccctgatgaccgcctaccaggtcaccggcggcaagtgggtctccaaggtcagcggcaccgtcgagtaatcaccggccgggccaccaccccgccaccgtcacacaaagcaaccagaccgcgcgggagcgctacgagccctcccgcgcggtgccatatccgaaccactccacggaggccctgcggtgaacgaactgccgcaacagctggccaatggactcatcctcggcgcgatgtacggtctcatcgcgatcggttacacgatggtctacggaatcatccagctcatcaacttcgcgcacggcgagatcttcatgatcgggggcttcggagccctcacggtctacctcgggcttccgtccggattctccctcatagccgcgatacccctcatgatcgtcggcggtgtcatatccgccgtcgccatcagcatggccgccgagcgcttcgcctaccgccccctgcgcggcggaccacgcctggcaccactcatcaccgccatcgggctctccctcgccctccagcaagcggtatggatgtggtaccccaacgccacgaaggaccgctccttcccccagttcgagggcgaagccttcgacatcctcggcgccaccatccagcgcggtgacatcttcgtcctcgtcgtggcccccctgtgcatgctcgccctcggcttcttcgtctccaagacccgggccggccgcggcatgcaggccacctcgcaggaccccgacaccgccaagctcatgggcatcaacaccgaccgcatcatcgtcatggccttcgccatcggtgccgcgttcgccgccgtcgccgccgtcgcctacgggctcaagaacggccagatcggcttccgcatgggcttcatcatgggcctcaaggccttcaccgcagccgtactcggcggcatcggcaatatctacggcgccatgctcggcggcatcgtcctcggcgtcgccgaagccctcgccaccggctacatgagcgaagtccccggcatggaactcttcggcggcggcgcctggaaggacgtatgggccttcgcgctcctcatcatcgtcctcctcgtacgtccccagggcctgctcggcgaacgcgtcgcggatcgggcgtgatgaccatgaccaccaagaccacacccgccaacagcgccctcatcgcgctgcccgcagcccgccacatcaccaccgccggcgcggccatcgccctcatcggcaccttcctcgcctggacctggacctccgaattccccggcgacctcaccgtcaccggctaccccggcggcctccaggtcctcaccctcgtcggcgccgtcctcaccctcctcttcgccctctccggctacgggatcaagggacttcgctggctcaccccgggcggcgccaacagccccgtccgactcaccgcactcggcatcctcggcaccaccggcttcaccgtcggcgccatcgccgtcaaactcggcggcgtcgtcaacctggaacccggagcctgggtcagcctcgccggcgcgatcatcgccaccgtcgccgccctcggcctccccgccgaccaggaactcgacgacaccacccgccccaccccgctcaaccgcttcgtcaacagcctccgggcacccgctcccacgcgcgccaaggacctccccaactgggccgagatcctcatcatcgccggagccttcggcgtcgccctgcacgtcttcacgtacggcatcgacaccgagtacgccgaactcttcatcggctacatcatcagcgtcgcgttcggcttcacggccctcacccgggccgggctcatcgcccggatcacccggctgaccaccaagcaccgcaacgtcaccctcgccgccgcactcatcgcggcgttctgcttccccttcacccagcagaacgagcagtacgccctcatcggcgcgaacatcctcatcttcgcgaccgtcgcgctcggcctcaacgtcgtcgtcggcctcgccggcctcctcgacctcggatacgtcgccttcctcggcgtcggcgcctacgccgccgccctggtctccggctccccgctctcccccgtcggcgtccagttccccttctgggccgccgtcctcacgggcgccgcagcctcactgatcttcggcgtcgtcatcggcgccccgaccctgcgactgcgcggcgactacctcgccatcgtcaccctcggattcggcgagatcttccggctcaccgtcaacgccctcaacggcgtcagcggcccggacctcaccaacggctcccagggcatcccgagcatccccgacctcaacctcttcggcttcgacttcggcatcagtcacgacatcgccggattcaccctcggcaggtcggccaactactacctcctgatgctcgtcttcaccgccgtcgtcgtcctggtcttccgacgctccggagaatcccgcatcggccgcgcctgggtcgccatccgcgaggacgaaaccgcagccaccgccatgggcatcaacgccttccggctcaagctgctcgccttcgccctcggcgccaccctcgccggactcgccggtaccgtccaggcccacgtctcctacaccgtgacgcccgagcagtaccagttcgccggctccgtgcccccgaactccgccttcctcctcgccgccgtcatcctcggcggcatgggaaccctcagcggacccctcgtcggcgccgcactgctctacctcatcccggccaagctgcagttcatgcaggactaccagctcttcctcttcggcatcgcgctcatcctcctgatgcgcttccgccccgaaggactcgtcgccgaccgcaggaagcagctcgaattccacgagaccggccaactcgacgtcccaccggacgtcccactcaccgaccaggccgccggcaccacgaaggcgggggcgtgaccacatgaccaccaccacgaccaccccggccaccaccgtgctcgacgccagcggcgtcaccatgcgcttcggcggactcaccgccgtacgcggcgtcgacctcaccgtcaacagcggcgagatcgtcggtctcatcggccccaacggcgccggcaagaccaccttcttcaactgcctcaccggcctctacatccccaccgagggcaaggtcagctacaagggcaccgtcctgccgcccaagccccacctcgtcaccaaggccggcatcgcccgcaccttccagaacatccggctcttctccaacatgaccgtcctggagaacgtcctcgtcggacgccacaccaggaccaaggaaggcctctggtcggccctcctgcgcctccccggctaccacaaggcagaagacgccagccgcgaacgcgccatggaactcctggagttcatcggcctccaggacaaggccgaccacctcgcgcgcaacctcccctacggagaccagcgcaagctggaaatcgcccgcgccctggccagcgaccccggactcctcctcctggacgagcccaccgcaggcatgaacccccaggaaacccgcgtcaccgaggaactcatcttcgccatccgggaccagggcatcgccgtcctcgtcatcgagcacgacatgcggttcatcttcaacctctgcgaccgcgtcgcctgcctcgtccagggcgagaaactcgtcgagggcacccccggcgacgtccaggccgacgaacgcgtcgtcgccgcctacctcggcacccccttcgaaggcgcccccggcgccgacgaggtcgccgaggtcgaagcagccgaagcggaagccgcggcagcccacgccgggaccaccagcaccaccaccccggcgaaggacaccacgcccgacaccaccagcaccgatgaggagggcacccgatgaccgcactgctagaggtcgaagacctccgggtcgcctacggcaagatcgaagcggtcaagggaatctccttcaccgtcgacgccggccaggtcgtcaccctcatcggcaccaacggcgcgggcaagaccaccaccctgcgcaccctctccggactgctcaagccgctcagcggccgcatcctcttcgagggcaagccgctggccaacatccccgcccacaagatcgtctccctgggcatcgcccactcccccgagggacgccacatcttcccccggctgacgatcaccgagaacctcctcctcggcgcctacctccgcaacgacaaggcaggcatcgagaaggacgtccagcgcgcctacgacctcttccccatcctcggggaacgccggaagcaggccgcgggcaccctctcgggcggagagcagcagatgctcgccatgggacgcgccatgatgtcccagcccaagctgctcatgctcgacgagccctccatgggactctccccgatcatgatgcagaagatcatggagaccatcgtcgagctcaaggcgtcgggcaccacgatcctgctcgtcgagcagaacgcccaggccgccctgtccctcgcggaccagggtcacgtcatggaggtcggcaagatcgtcctctccggcgcgggctcggacctgctccacgacgagtcggtccgcaaggcctacctcggcgaggactgacacccctgccgtacgcgnngtacgcggctactcggccgacttcttcttctcctcggcgtcctcgatcagcgcctccgccagctgctgcatcgacatccggcggtccatcgacgtcttctggatccaccggaacgcggccggctcggagagcccgtaatccgtctgcagaatgctcttggcccggtccaccagcttccgggtctccagccgctgggacaggtccgcgatctcgctctccagcgccttcagctccgcgaaccgggagacggccatctcgatggccggcaccacgtcgctcttgctgaacggcttcaccagatacgccatggccccggcgtcgcgggcccgctcgacgagttcgcgctgcgagaacgcggtgagcatcaggaccggggcgatggactcctcggcgatcttctcggcggcggagatcccgtcgaggaccggcatcttcacgtccaggatgacgaggtccggcctgtgctcccgggccagctcgacggcctgctgcccgtcgcccgcctcaccgacgacggagtagccctcctcctccagcatctccttgagatcgaggcggatgagggcctcgtcctcggcgatgacgacgcgggtcgtcagcggcgggacgtgcgacttgtcctcgtcgacggcgtctacgggctggggcgactcgggggtggtcacggggctccttgattcagggcaggcgctgctgcgaagcagcctacctagctgctgccgccttctgtcaccaggtacactgctgatcggttaccacgccgggttggcgcaattggttgacgcggaggtctcaaacacctctgtccgaaaggacatgtgggttcgaatcccatacccggtactacctcgcagagcggatgttcactttcgcgtgaatatccgctttttgctgcccgaggccgcccctctccaccaagagtggacgaatgaacacatacagcgcagaagtgcgccgacaagctctcaccctccttcggagcggcacccgaaacgctgaagtggcccgcagactgaacgtgccgcgcggcaccgtctcgtactggctccacatggatcgttctcgacgcggcgagtgccccagggcgcacaacccatcgtgccaccggtgcgacggcacagtgctcgacgagtccacctacgcctacctgctcgggctctacctgggcgacggccacatcagccaatactcggcacatcgagcacgcagcctgatgatcacgctggacgatgcctggccaggcatccaggacgaggcggaggccgcgttacgcaagaccttcccgcagaacaccacgtgccgggtccgccgggtcggctgccacaacatcaaggtgtactcgaagcacctcgtctgctacttcccgcagcacggtcgggcaggaagcacgagcgcgagatagtcctggagccctggcagcagaagatcgtcgatgcccatccctggcagctcgtccgaggtctcatccactccgacggctgtcggctcaccaactggacgactcgcgtggtcggcggtgaacgcaagcgctacgagtatccccgctactggttcaccaacgtctccgacgacatccgccacctctacaccgacaccctcgacgcgctcggcatcgtatggacgcactgcacccgcgcgggcaagccctacaacatctccgtagcccgacgggcatccgtcgccctcatggatgcgcacgtcgggccgaaatactgagctgatcctgagccgccctacttcgggctgtcgtcctcgccgatgtggtggacacggaccaggttcgtggagccggcgacgccgggaggggagccggcggtgatgaccacgacgtcgcccttctcgcagcggccgatgcgcaggagctcctcgtcgacctgggcgaccatcgcgtccgtggagtcgacgtgcgggccgaggaaggtctcgacgccccacgtcaggttgagctgggcgcgggtggcctcgtcgggggtgaaggcgaggagcgggatgggtgagcggtagcgggagagtcgcttgaccgtgtcgccgctctgggtgaaggccacgaggaacttcgcgccgaggaagtcgcccatctcggcggcggccctcgcgacggcgccgccctgggtgcggggcttgttgcgctcggtgaggggcgggaggcccttggcgaggaggtcttcctcggcggcctcgacgatgcgggacatggtccggacggtctcgatggggtacttgccgacgctggtctcgccggagagcatcaccgcgtcggtgccgtcgatgatggcgttggcgacgtcggaggcttcggcgcgggtgggtcgggagttgtcgatcatcgagtcgagcatctgggtggcgacgatgaccggtttggcgttgcgccgggcgagcttgatggcgcgcttctggacgatcgggacctgttccaggggcatttcgacgccgaggtcgccgcgggcgaccatgatgccgtcgaaggcggcgacgatgtcgtcaatgttgtcgacggcctggggcttttctaccttggcgatgacggggaggcggcggttctcctcgtccatgatgcggtggacgtcgtcgatgtcgcgtccggtgcggacgaaggacagggcgatgatgtcggcgccggtgcgcagggcccagcggagatcgtcgatgtccttttcggagagggcggggacggagacggcgacgccggggaggttgagtcccttgttgtcggagaccatgccgccctcgatgacggtggtgtggacgcgggggccttcgacgccggtgacttcgagggtgacgcggccgtcgtcgacgaggatgcgttcgccggtggtgacgtcggcggcgagtccgtcgtaggtggtgccgcagatgtcgccggtgccctgtccttcgaggggttcgacggtgatggtgaaggtgtcgccgcgttcaaggagtacggggccttcgcggaagcgtccgaggcggatcttcgggccttgaaggtcggcgaggatgccgacgttgcggccggtttcctcggatgctttgcggacgtggtggtaacgcgcttcgtgttcggcgtagctgccgtggctgaggttgaagcgggcgatgtccattcccgcttcgaccagggctttgatctggtcgtatgtgtcggttgcgggtcccagggtacaaacgattttcgctcggcgcatggttcgagactaaaccttacctacgggtaggtatttggctgcgagtgacacctcaacaaccttcatatgaagggttgttgacaactgtttaactgtgcagcggggtgctccgatgagcgcttatccgaggttcggggggatgagtgtgaaggaggcttcgacctgggcgtcgacggtctggcgtacgggttccaggtcgacgggtgcggcgtcgacagcggattccgtggctcctccgtaggacctggcctgggcggagaagccgatgggagtcatgtgggggccgccgtggacgccggtgtcgctgagttcgaggagggcgccgagccgggtgtcgagggcttcggcgtactcgcgggcgcgttggagggccccttggacggcttggcggcgggcggcggcgtggtggggggatgtggggcgcagtccccaccaggggccgtcgatgcgggtgaggtcgtggtcggcgaggcgggtgacgagttcgccgagggtggtgaagtcgccgagggtgacggtgagttggatgtgtccgtggtaggcgcggatgcgttcggcgcggccgtggcgggtgagttcggggttgatggtgagggtgccggtctccagtttctcgatggcgtcgccgtaggtcttgatgaggtcgagggtggtggcgttgcggtgggtgaggccgtcgagggtggtgcggcggtcggtgccgcgggcggtgagggtgacggtgatgcgggcgatctcggggtcgacttcgaggtgggcttcgccgcggacggtgacgtggggggtggtgg

SEQ ID NO: 2718 - DNA, 2718 bp, Unknown
  Kingdom: Bacteria, Phylum: Actinobacteria, Class: Actinobacteria, Order: Streptomycetales, Family: Streptomycetaceae, Genus: Streptomyces
gccttccgccgagccggccgcgacggccccgcaccggagccgggcacgtgtcgcggcgtcagcgctgcggcgctgtcgcgatggaccagcacatacgaggcgttgaggtccacagtcgccgcttgggcgggctgggtcccgagaagggtggccccgagcaacaggggcgcaagggccgcgagcaggcgccttggccgaccaggggacgagtcgcggtaccccatgagccgctcctcctgagggctggaccgcggtgaccctgacgcacagcggagcgcaaatgccgcgagtccgcgacggttcgaaagtttcgggaattcccggatactttcgacggcacaagctagggatgcagggttctccggtcaagacttgccactgatctgtccacaaacagcacctccccttcgggcctgaggcgcgatcgcgccgaccgagcctcccccgagtacgcgaccgcaagctcgccgaccccaggcgtatgcgcggaggaggaaggccgagcaagcagcctccccgcactcaccccgaccgcgaccccaccacgtccgccggacggcagcaccgaggccgcatcgaatagccagggtgcagcaagatgccgaaaagtttcgaatgttgaaacgaaacttcttctgcgtggagtattgacggcccatcaccgatgcctcaatcatccctgtctgaggaactggccgtggtccgggataccgaacgtcggccccggcgttccgtgctgcacggcagatccgcgcaccgcatcactccttccgtgatttccaccttggaggcacagtcatgggctcctacgcctttcccagacccgttgtccgccggaaaacccgcagcctgctgttggcgctgatcatcggcgtcctcggtgcgtccgccgcgctggtcgcaccaccaggagcgcacgccgccgagagcacgctgggcgccgcggcggcgcagagcggtcgctatttcggcaccgccatcgcctcgggcaggctgggcgactcgacgtacacgtcgatcgcgaaccgtgagttcaccatggtgacggccgagaacgagatgaagatcgacgccaccgaaccgcagcggggccggttcgacttcagctccgccgaccgcgtctacaactgggcggtgcagaacggcaaggaggtgcgcggccacaccctggcctggcactcccagcagcccggctggatgcagagcctcagcggcaacgatctgcgccaggcgatgatcggccacatcaacggcgtgatggatcactacaagggcaagatcgtccagtgggacgtcgtgaacgaggccttcgccgacggaagttcgggagcccggcgcgactccaacctgcagcgcagcggcaacgactggatcgagctcgccttccgcaccgcgcgcgccgccgacccgtccgccaagctctgctacaacgactacaacgtcgaggactggacctgggccaagacccaggccatgtactccatggtccgggacttcaagcagcgcggcgttccgatcgactgcgtcggcttccagtcgcacttcaacagcggcagcccctacaacagcaacttccgcaccaccctgcagaacttcgccgccctcggcgtcgacgtggccgtcaccgagctggacatccagggcgcctcgcccacgacctacgccaacgtgaccaacgactgcctggccgtcgagcgctgcctcggcgtcaccgtctggggtgtgcgggacagcgactcctggcgagcggagcacacaccgctgctgttcaacaacgacggcagcaagaaggccgcttactccgccgtcctcaacgcactcaatgccggcgacacaactgagcccccggcgggttccggacagatcaagggcgtcggttcgagccgctgtctggatgtgcccaacgccggcaccgacgacggcacccagctccagctgtgggactgcggcagcggcgccaaccagcagtgggtggccaccgactcgggtgagttccgggtctacggcgacaaatgcctggacgccgccggcacgagcaacggcagcaaggtccagatctacagctgctggggcggcgacaaccagaagtggcgcgtcaactccgacggatccatcgtcggcgtccagtccggcctctgcctcgacgccgtcgggaccggcaccgccaacggcacccggatccagctctactcctgctcgaacggcagcaaccagcgctggaccctcacctgacgggagctgcagggccggagccggagaggcccgtgaggccgaggctcacgcttcgagcgtcaagaagctccgaacaggcgcctgaaagcgtcgccgacgcaagcgactccctggcgtgtcggccggggcggcctggcgatcctgccgaggccggcctcggccgtggccactccgctcaccccagtcggctcagtgccgccgacaccagcgtccggacacctggccggagcaccgaaaggtcgggagcgaacagggggctgtggtttcccggtacgttgccgatcgtctcggccaggtccgctccgggagccgcgtcccacaccgcgggcgtgccctacgactactggtacgtgacgtcgaccccgcccgcggtgtgggacgcggctcccggagcggacctggccgagacgatcggcaacgtaccgggaaaccacagccccctgttcgctcccgacctttcggtgctccggccaggtgtccggacgc

SEQ ID NO: 2719 - DNA, 3102 bp, Unknown
  Kingdom: Bacteria, Phylum: Actinobacteria, Class: Actinobacteria, Order: Streptomycetales, Family: Streptomycetaceae, Genus: Streptomyces
ccggaacccctccccgcgcacgcgagcggctgaccggccgcacggcgggagggtgaccgggccgcacggctcgaccgctcaaccgtccaggtcggcgatggcccgggtcagccagctgatccagaacgtctccaggtcgatgccgccccgcagcaccagataccgcagccggtcctcgtcggtcgtcggcgcgggggtgaagttccgctcctcgatctcccggtactccgccagctggcgttcgtgcagcgtgaggtggcggcgcagttccgcgcccataccgtcggtcccgacgaccgctgccgcccgcatccgcagcaggagcggatcgcggaccggccggggatcctcggggagcgccacccaggcggccagttcctcacggccggcgggcagcacctcgtactccttcttctgtccccgggccggcaccgcggagggcagcgccctgatccgcccggcctgctccagttttcccagctcgcgatagatctgctggtgcgtcgatgaccagaagtagccgatggaccggtcgaacctgcgggtcagttccagacccgaggacggcttctccagcagagcggtgagaatcgcgtgcggcagtgacatggggtgcatcctaaggacgtacggagaccggggcggcgcgtcctttcgccgccgcccggtccccgggcgctcacagcgaggcggccagctccgtgccctggcggatggcccgcttcgcgtccagctcggccgccacgtccgcgccgccgatcagatggaccgggacggctcccgtgcgcagctcctcgtacagctcgcggcgcggttcctggcccgcgcacagcaccaccgtgtcgaccggcagcacccgccgctcgccgtcgacggtgaggtggaggccctcgtcgtcgatgaggtcgtaggaggctccggcgatcatctcgacgccccggtggcgcagttcggtgcggtggatccaccccgtcgtcctgccgagacccgcgccgaccttggtggtcctgcgctgtaccaggtggaccgtgcgcggcgacctgggacgctcgggcgcgcgcagcccgccgcgctccgcgtaggaggtgtcgacgccccactgccggaagaacgtctccgcgtccaggctcgccgcgtcgccgccgtcggtcaggaactccgcgacgtcgaagccgatgccgcccgcgccgacgatcgcgacccggtcgccgaccggcgccccgtcgcgcagcacgtccaggtagctgacgacgttcgggcggtccgtgccggggatggccggggtacgcggctcgacaccggtggccagcacgatctcgtcgtaaccgtccagggtcccggtgtcggcccgggtggacaggcgaacctcgacgtccagctcggccagccgcgtacggaagtagcgcagggtctcgtcgaactcctccttgcccggcacccggcgcgccacgttcagctgcccgccgatctcgtccgccgtgtcgaacagggtcaccgcgtgtccccgctcggccgccgtcacggaacacgcgaggcccgccggaccggcaccgaccacggcgacgcgcttacgggtccgggtcgggctcagcaccagctcggtctcgtggcaggcacgcggattgaccaggcaggaggtgatcttgaggctgaagatgtggtccaggcaggcctggttgcagccgatgcaggtgttgatggagtccgcccggcccgccgccgccttggcgacgaactccgggtcggccaggaaggggcgggccatggagaccatgtcggcccggccggaggcgaggatctcctcggcgacctcgggggtgttgatgcggttgctcgtcaccagcggtacggagaccgcgccgcgcaccttctcggtcacccagctgaacgcgccgcgcggcacggaggtggcgatggtcgggatccgcgcctcgtgccagccgatgccggtgttgatgatcgtcgcgcccgccgcctcgacctccttcgccagcgtcacgacctcctccagcgtcgaaccgcccggcaccagatccagcatggagagccggtagatcaggatgaattcgtcgccgacgcgctcgcggaccccgcgcacgatctcgacgggcaggcgcatgcggttctcgtaactgccgccccagcggtcggtgcggtggttggtcgcggagacgatgaactcgttaatcagatagccctcggagcccatgatctcgacaccgtcgtagccggcgaggcgtgccagctcggccgcacggacgaactcctcgatggtctcctcgacctggtcgtcggtgagcgcgttcggggtgaacccgctgatcggggccttgagcgcgctcggcgccaccaggtcggggtggtgtgcgtaccgcccgaagtgcaggatctgcatcgcgatccggccgcccgccgcgtgcaccgccgaggtgatctcccggtgctgctccgcctccgcctcggtcgtcatcttggctccgccggggaaggagcaggcgcgctcgctgggggcgatgccgccggtgaccatgaggccgacgccgccccgggcgcgctcggcgtagaacgcggccatccgctcgaagccgcgctcggcctcctccaggccgatgtgcatcgatcccatgagcacccggttgggaaaggtggtgaacccgaggtcgagtgggctcagcaggttcgggtacaggctcatggggtctcctcgcacagggtcgtcgggtcagttgtagaccaccgtccagcgcttatgcaacaagttgcacaatgatctgcgtcgcacccggccctcctggggcgccgggcccgtgccacggacggcgtactcggccgcgcccacccgcctccctccgacgagagtgggatccgtacccgcaacccctcaccccgggagtcctcatggtctgcgtcaaccggcgtgatctcggtctgctcgccctgcgcgtcggcaccggcgcggtgctcgccgcccatggcagccagaagctggccggctggttcggcggcggtggcatccagggcaccacggccgcaatggaggcgatgggattccacccgcccaagcacagtgccgtggccgccgggctcggcgaggccggcggc

SEQ ID NO: 2720 - DNA, 2062 bp, Unknown
  Kingdom: Bacteria, Phylum: Actinobacteria, Class: Actinobacteria, Order: Streptomycetales, Family: Streptomycetaceae, Genus: Streptomyces
gcgctcgacggcctggccgcaccgaccctggtgcgggaggccgacccggcccaccgtgaggacgcggcccatgtccaggacctggtcctggtccccgtcgacgtcacccgggccctcgccgggcgggccaaggagcacggcctgacgctcaacaccctggtgctgggcgtctggggcctggtcctcggctcgctgaccggacgtcaggacgtcgttctcggctacaccgtggccgggcgcgctcccgaggtgcccggcatcgagtacgcgatcggcagctacgccaacctgctgcccgtccgggtccgctggagcccggacgagccgctcaccgaggtgctggcccggctccagggcgagcagggctctctcatcccccaccagcacctgagtctcgcggagatcgaacgcgacgccggcctgggcgagttgttcgacgccacggtggccgcacagaactaccccgtgcaccgccccgcctccgaggcgctggccgcggccgggacagcggtgctggacggcgcccggatcgtcggggtgcacacccacgaggtgaccgcgcacaccctgcggctctccttccgcgccgacgaccagctcttcctggccctggagtaccggggaggcacggaggtgctggccggtatagccgatcgggtccggcggctgatggccgccgtcgcggacgaccccggcagcaccgtgggcgcactgctggagctctcggcccgccctcaggaggacacacgtcatgagtcaaccgcgtacggagaggcgacccgatgagctctgagatgctgatggacacccggctgctggtcggccgccagatgcgccacctgaaacgcggtccggaacgggtcgtcccggtggtgatcaccccgctgatcctggtgctcctcaacggactgctgatcggcagtgcgatcgtggtgcccggggacggcagctacaaggacttcatgatggccggggtcttcgcccaggtcgccatgctcggcatgtccaacgcgcagaacgggctgaaggaggatctgcgcaacggtctggtggaccgcttccagtccctgccgatcgcccgctccgcggcggtcctggcccgctcggtcgccgaactgctcatgatgttcgtgggctggctggtgatcgcgggtgtcggcctgctgatcggctggcggatgcacgaggggttcctgcgcggcatggccgggatcggtctgatgctgctgttcggttacctgttcatctggctgggcattctcggtaccgtctcgggccgcaacccgcagtcctccggcatcggttcgatgatcgtgatgccgatgctgttcctgtcgccggcgttcttcccgatcgacaacctgccgggctggctccagacgatctgtgagtggaacccgttcagctccgtcgtggtggcctgccgtgaactgtggggcaacccgaacccgaccgtcacgggggccttcccggtcgagcaccccatcctggtggcgacggtgctgccgatcgtcctgctgatccccgtcatcccgctggccgtccgccgctaccactccgtggtcgggcggtgaggacatgagcgccccgtcccccgtcggccgctggtccaccgccaccctggcctcgctgctgggcgtccaggtcttccaggtcgtcctggcctggtccgtgctcaccgtgtccgggcccatggccaccgcggtcgtgctcgcactgggcacgctgccgcgcatcgcgatgatgtccggcctcacggccgggctcgcgggcaggttcgtcccgcagcggctgctggcggtcggcgaacgcgggcgggcggccctggcgctgggcgcggccggcgcgctcgccgccggcgggttcggtttcacggggctgctgctggcgagcctgctgttcggactcgtcgaggccgtgaccgaaccggcggcgggctcggtgcccgccctgatcgccgatccggcgggccgacagcggatggaggcgctgcgcaccacgctgttccgggccaccgtcgtcctcggcggtccgctcgcgggcctgggcgcactgctgggcc

SEQ ID NO: 2721 - DNA, 2694 bp, Unknown
  Kingdom: Bacteria, Phylum: Actinobacteria, Class: Actinobacteria, Order: Streptomycetales, Family: Streptomycetaceae, Genus: Streptomyces
cgcccccgcttacggcgcgccggagcggaccgtcccgacctccgccccgcccgggaagtgccccgcctccggggctgtggtgaccatgggggaggtgctgaccgcgatgatgagccgtgccgtcgccctgaccctgaccaactgcggctcgaagccctaccgggtcgacggctacccctcggtccaggcgctcggcgaggacggcgagcgcctccctgtgaaggtcaatccggccggctcgcagttcggccgcgaccacggcccccaggcgctcaccctgaagccgggtgccaccgtgcggtcgatgctcgcctgggtctccacccaggagggcggcgagctcgtcatggccgacgccctggagctggccgccgcccccgacgccggggcgcgggtctacccgctggagggtcacgacatccggtacatggacgagctgaacatcacggcctggcgggcagagctgcccgagtgaccgagggggacggcccttcagacgccgcccaccggcacggtgtgggtgacccggtccgtgccgggcggtcactccggcaggacgtgcggcaggaaggccgggcctcgtcggggtagccgggcacgccctcccgatggaccggtcgtgaggtgcgggtcgctcgggtgcgcgacggagagcgtcatgtcacctcctttcccggccgtcaccggccgcacccgaggccgctcacgccgtgggcgaacaggcgaaggcgcccgggaggaacatccttgacctcaagcgcacttgaggtgtcacggtggtgtccgcgacgcaccgaccggcgcgcgtgagaagggaacaccgccatgaccacgcacttcaccgaccgccccgacccggcccggaccgacgcccggctcgccaaggccagcacctggaacgtcggtacacagcggcggcagcgagaaaccgtcgacgccatccggaaggcctgggagagccgggaatggccgcaccccggactgctctcctacagcgtctgcgcgggggaggacggcgcgaccctgctgcactactcccagtggaccggcgaacaggcctaccaggacttcgtacgggacagtcgcgacacccgcaacgccgagatcgacgccgccgtccccggcatcgaacgcctccgactgcacacgtacgagctgtaccgctccggccaccgggccgcgggcgacacccgggagaccggctgcctcgtcattgtggaggccgagttcgacgggcccgacccggcccgccaacgcgcctgggtggacgccgtgttcgaggcgctcggcgaagaggccgacctgcccgccggcggcatcgccgcgcacttccacgtcagcaccgacggcacccgggtcctcaactatgccgagtgggagagcgccgagcaccacatcgcggccctcgccgcgcccggagaaggcgtcggctccccctccccgcactgggaacgggtccacaactacccgggcatgaccggcggcggcgtgcaccgctacaccctcgcgctcagcatggagccgggcgcgggcggataggggggcgcggcgggcggtatgtggtgaagcggcgggcggcatacggtgcattgcgtctaggcttgggcggctgaaccgcgtacgcactccgtatgccccgagcacgcaccgaggagaacccccgatgtccgcagagcgcccctccctgccgccggtgcggctgaactccgaggccgaactggcacgggacgcgctcgccgctccgctgttcgtccgcgccgtcgggctcgcccggtgggcgggaccggacacccgggtcggggcgggcggcgagctcgtcgaggaccagctgcccgcggccgccgagcacctcgccctcccggccgacgaggacggcgccgcgtatgccagcgaggcctggcggctcgccgtggacaccggcctcctcgacgtcaccgaccccgaggagggcgagggcgacgagggtacggacggcgaggccgagggcaccgtcaccacgggcgagaacctggccctgctcaccggcggctccccgcaggacgtcctgtccatctggctcgacggcctcgacgccgtgcacgccgacgccaccgcgcccgtcctggacgacttcgcggacctcgtcggcgaggacggctcgatcgacttcggcgccctggactgggatccggaggccgaggcggagttcctcgacggcgtcctcggcaacctctacctgctcaccctcgcggacaacggcgcgggcgaagggccggtcccgcttcccgccctcgccgcgtcgatgatcgtccccgacgacatgggcgagcccaccgacgacatcctggagcaggtgtccgaggcgatgatgcgcctcgacgaccagttccggctcctcgaacccatcgggatcgtcgagtaccacccggtcgacgaggcgttgctggtcgaggagggcgaagcagccgacgcctccgccgccggggccgacgacgaggacgtcacccggtacggcatggtcaagctcacccccctcggcctgtacggcatccgggcccggctgctggaggccggggtggacgcccccgcggtcggcgacctcgcgggcaagggcgccgacgccctcctcgacggcatcgcccactacccggagtccgccgcccgcgccgaggtcaagctctggctcgcggagtacggagcggggggtgcggtgca

SEQ ID NO: 2722 - DNA, 10722 bp, Unknown
  Kingdom: Bacteria, Phylum: Actinobacteria, Class: Actinobacteria, Order: Streptomycetales, Family: Streptomycetaceae, Genus: Streptomyces
cgggaccggtgggaataccgggactggtgaacacgtcgggacgcgtgggcacatcgggcccggtggacacctcgggcctggcgggcgtgctgggtccggtggagaccgccccacccgtcctcacggagacggaacgccgctatctggccggattcctcgcgggccacggcgcccggccggggggcaccccggtgcttccggcgggggctccgttcgccccggaccacgcgctgtgggtcaacggcgtgctggccggcatgtactcccggctcgcggggacgccggagaccgggcccgggctcgcggcaccggcgagcgcctcaaaggaacaggaccggccggtcctcgtgctgtgggcctcgcagaccggcaacgccgaggaggtcgccgcgacggccgcccggaccctggccgacgaggggtaccgcaccacgctcctcggcatggacgacggaacgcccgacgcgctgccgagcccggccgacctcctcgtcgtcaccagcaccttcggcgacggggacgcccccgacaacggctccggcttctgggagtcgctgaacgcacccgggaccccgcgcctggagggagtccgctacgccgtactcgcgctcggcgactccagttacgacgacttctgcggccacggccgccgtctggacgaacgcctcggcgaactgggcgcggaacggctggtcccgcgcaccgactgcgaaccggagtacgaacagcccttcggccagtggctcaaggaggtccgtgcggcactggagacgacgacaccggaagggacggcgacgcgggccccggcggccccggcgaccgcgtccccggccgggacggcgccagcgctcccctccagggccctgcccgtcaccgccctcctcaccgggaaccgcctcctgagcctgcccggcgcgacgaaggaggtccgggccttcacgatcgacaccgggggtgccgagacccccctgacgtacacggccggggacgccctcggcgtacagcccctcaactcaccggacctggtggccgaatggctcgccgtcaccggactcgaccccgccgccgatgtggacgtccccgggcacggtccggtccccctcgccgaggccctgcaccgtcacctggacatcgcccgcatcaccccgggcctgctgcgcctggtcgccgaccacacgggggaccgctccctgaagaagctgctgcgccccgacaacaagggcgagagggaccggtggatctgggggaggcaggccgtcgacgtcctcgccgaacacccggtacgggccacggccgccgcatgggcggaggtgctcgggccgctccggccccggctctactccatcgcctccagcccgctcgtggatccccaccggatgcggctgaccgtctccgtgatccgctacgagagccaccgcggccggatgcgcaagggcgtcgcctccacgttcctcgccgacgccgaaccggacagccccctgtcggtgttcgtccagcgcaacgaccgcttccgaccgccggccgacccggccaccccgatgatcatggtcgggcccggtacgggagtcgccccgttcctgggtttcctggaggaacgccgggcgctcggccaccccggccccaactggctgttcttcggcgagcagcaccgtgccacggacttctactaccgcgacgaactcgacgcgctgagccgctcgggcaccctcacccggctggacaccgccttctcccgcgaccagcgggccaaggtctacgtccaggaccggatgcgcgagcacggagcacagctctggtcctggctccgcgacggcgcccacctctacgtctgcggcgacgcctcccgcatggccaaggatgtcgaccgggccctgcgcgacatcgtcgtcgctcatgggggactcgatcccgacgccgcggccgcccaggtgaaacagctaacctcggaccgcagatacgtgcgcgacgtgtactgagcgtgggagtgcggccatggggtggacagaagtgccggtggacaccgaaccggcggcgggcgccgtcctgttgatcggcatccccggcagcggcaagagcacggtggcctcggctctcgccgcccgcttcgccgcctccgcccacatcgaggtggacgccctccaggaactcatcgtctccggcggccggtggcccacgcccgacggggacgaggaggcggaccggcagatcttcctccgggcccgcaacgcctgcctgctggcgggcagtttcgtcgccgccggcttcctcccggtcatcgacgacgtcgtcgtacgccgtgcccacctcgatttctaccgcgccacgctcaccggcgtaccgctgcactgcgtggtcctggccccgggagccgcgaaggccatggagcgcaacctctcccgggacaagaggctgacgacggactggtccccgctggacgacgtcatgcgcaccgaactggccgacgagaagatctggatcgacagcgcggagctgaccgtggacgagacggtcgacgcggttttgtccgccaccggcctgacgccgtcgctgccctgacactccagcggccgacggcccgggggaacgggtggcaccgttgccgccggggggctactccgaggcatgtgaaaatcccttgggggcattcgtacccattccggctggtcgctgtcgacagccgctccgacggataagtgcgcaagaaagtaggtccggtaccggtggacagacccagcgcggtcgagcgctccctgcgcgaggccgcgccccatgagattctcgatgtgatccgctccgagatcgagcgccgccatggtgcccgggcggtggagctgctgctggcggactacgccatgacgaggctgcagcccgtcggggtgcttccgtacacccgccccccggtgtcggtgcatgacagtgatccgggccgtgcgttcggcgcccaggaaccgcactgttcgtacgaccgctccgcttccaccgtgacggctcacctcccggtcagcgtccggggagaccggctgggcgtcctgagcgtcactctgcgggtggaggaaggcgctgatccggccgctgacgtgctggaggatctgcgggactgcgccgacgccctggcgcacgaggtggtcgtcgcggagcgggacaccgacctcttcctgcaggcacggcgggcggaacgtctgacgctcgccgccgagatgcagtggcagttgttgcccgggcgttcgtgtgcccggccggagtacagtctgggtgcccagctggagcccgcctacgccatcttcggcgacagcttcgactggtcggcgtcggccgacgacctgtatgtgacggtcagcaacggcatgggcgaggggatcgacgccgccttgctgacgaacctctgcgtcaacgcgctgcgcaacgcccgccgcgcgggcctgagcctgagcgaccaggcctacctggccgatcaagcggtgtacgggcagcacggaggaagccggtatctgtcgaccctgctcttccgcttccacctcccgaccggggacgtggaggtcatcgacgccggttcaccgagggtctggcgggtgcgcggtggtgtggtcgagccgatagagctggaggagcagatgcctctgggtatgttcgaggacactgcctaccgtccgcagcacttccgggtcgaacccggagaccgtctgctgttcatcagtgatggcgtctacgacgcgctctccccgggcggtgagaggtacagccttcgcgcactcgccgcgtcgatcagcagcacccgtctgctgcctgctccccaggtgcccagagtgatgctgcaggaactgctgggacaccgcgggtccggccccgccgcggacgactccctcgtgatgtgcctggactggcacggccgttagggccgctgcgatcctcaggtcctgtcgtcgagtttccgtcgtcgaccgaagggcggccctgcggggtccggcgggagttcgacgacagggcctagcccttcggatgcggggtatgtggccgtcaggtgaagaccctgcgaccttccccgcagtggggcccgcgcggagggggggtgggttgtcaggtggcaaccgggtgagggatggttgccttcaggcaatcgtctagttgatgaggtgagggatccgcccagcgggtcctcgatatttggcttccactcaggcgcgaacccttgcggacacgcggtccgactccccgtggggccggcccccgtatccggtgctggtcgctgacgcccaaggcgtggtggtgcggcgcagtgacgcggccggccctcttctgcccgccgcagcccccgggacatccctggtggatgtggctccggcctggctctgcgccgcacactccaggctcgcctccgtcggcccgcacgccgtcccgcagaccggaccgacggtgcgcggcgacatcgacgggcgccacttcgaggcgcaccccacggtgcggggcgacggctcggtggcctggtggctggtggatgacaccgctcatcagctcgtccgggaagctctgcgcagagagcgcgagcgaagcgcgttcctcgcgaaggcgtccaccgttctgctcgcctccctcaatctcggacgctgcatggacgtgaccgcgcgcatggccgccgaaaacctcgccgacgcggcactcgtgatcgcgccggcgcgtggtcagcgcctcccgatggtgacctgtgtgcgcggcggtgtccccgcgacgaccacgatgacgggggacctcgacggcgtgccggggctggcggaggcgctgcgcgggttccccccggtgccctcgcgctggatcgacccggccaccgcccccgagtggatgacgcccgagggattcgggccggtcggctcgatcgtgatcactccgctgcccgggcacggcatcccggccggagcgctcatcctcctgcgcgcgaccgagaccgccgccttcagcgacgaggaggaggtcttcgcccggttgttcgccgcccgtgcgggagcggcgatgtcggccgcccggctgtacgcggagcagagcacgatcagcgacatgctgatgcgtgaactcctgcccccggtcctgcaccagatctccggcgtggacttcgcgggcggctaccggccctcggcggaccatgagcgtatcggtggtgacttctacgacgtccacccggcgaccgtcgagggcgaaggctccctggtctccctcggggacgtgtgcggcaagggtctggaggccgccgtgctcaccggcaagatccgcaacacgctgcacgccctgttgccactggccgacgaccatcagcggatgctcagcctgctgaacacggcgttgctcagctcccaccacacccgcttcgcgaccatggtcctggcctccgccgtacgccgcggcagtgcggtggacctcaagctcaccagcggcggccaccccaccccgctgatcatccgcgcgggcggcaccgtcgaggaggccgacacccacggcaccctgatcggggccatcccgaacgtctcctccagcaccgccgccgtgtcgctggcccccggggagtcctgcgtcctgtacaccgacggcatcaccgaggccaagggcggcccgatgggcgacgacctgttcggggacgagcgcctcaagcgcgcgctcgccggatgtgcgggtatgccggccgaggggatcgtggaacacgtgcagatgctggccgcccagtggctgggcaaccggccccacgacgacatggccgtcgtcgtgatctccgcgcctcgcacccaccacctcagtgcggtgaacggccatacccggggcaggttcaccgcatgagaacgagcaccccgccccgccttccccaggccgaacacacggagcagtcggccgagcttctgtgggacgccgtctcgaccgcggacgaacacgcggccggagagctcgtgctgcgcgtactcgacgacggggccgaccccgagagcgtcctgctggacgtgatcgccagggtgcagggccgcgtcggtgaggagtgggcggccaacaggatcagcgtcgcccaggagcacgcggcgaccgccatcaacgaacgggccgtcgcagtggtgagcgggcaccccgccgcccgcgtcgctgccacccggggccggatcaccgtggcctgtgtggacggtgagtggcacgggctgccggcccgcctgctggccgaagtcctgaagctgcgcggctggcgagtcgactatctcggcgcccaggtccccaccccgcacctgatcttccacctccacaacacccgggcggacgcggtcgcgctctccagctccatcgccacccggctccccaccgcgcacgcggcgatcaccgcctgccaggccgtcggcgtccccgtcctcgtcggcggcgccgccttcgggccccggggccagtacgcgaagaaactgggcgctgacgcctgggcccccgacgcccgcgccgccgccgacctcctcgccgaggagccgcttgccaggccggagaccgaccaccagcagttcgacgacctgccgcacctggccgaccaggagtacaccgtggtctcccgcagcggcgcctcgctcgtgcgtcacgttctccccgcactggaagacgcctttcccgcgatgcgtgcctacagtgatctgcagcgcgagcgcaccgcggaagacctcgcgcacatcgtcgagttcctcgccaccgccctctacctcgacgacgaggaactcttcacccggttcatcgcctggaccgcgcaggtcctcgtggcccggggcgtccccgcgtcgagtctgccgccggccctggaactcctggcccgcgaactcaaggacttcccccgggcctcccgcatcctccgggccgggacacgcacccttgccaccgcccatcccaccgccgggaacaccgcatgaccacacaccccgaccacctgcagctgaccacggtcgacgaccaggaccgcgtccgcatcgagctccatggggacctcgactacgacaacgccgatctcctcgtgcaggaggccctcgcccagctcaccgcacggcccgtcctgaccgacctgcacctgggatgcgcgggcctccgcgccgtcgactccacgggactctgcgccctgctgatgatcagccgccggaccaccgaggcaggggtgcggatgcacctggacgaccggccggcgagactggaccggctcctggccctcaccggtacccttgaccacctcacggccccgcccgcgaccggatcggtcgccgagggaagccccatgggggccggatccaccggaccggacagcaccacctgagccactgcccggcccttcaccaggcagaagcacacactcgacgggtaatcatgaccgcagcagaggccgcttccagcagggcgtggcaggaggccacccactccgcgagctccatcgtcgaactcctcgacgtgctgtgggaccacgccagaaacgcgaccacgggcatgacagcacccggctccacatcccagctccgcctgatgtacgtcgtcgaccgtggagagggcgtgcgtatgcgcaccgtgtgtcaacgcctggcctccgcgcctccgacggtgacccgcatgtgcgaccgtctccaagccatcggcttcctcgaacgcctgccgtgcccggacaacggccgcgagatcatcctccggctcactcccaccggcagagagcacctgcaacgcatccgcgaacagcgcgacgccatgctccaccaggccatcgccggcatgtcccccggcgaacgcggcgctctggcccggggcttggcgggactgcagacacagttcgactccgtccacggcgaggaacaccccacacccggcagccactccgcagcctgaacagcgggtgtcccgtccgtcatgcgccgtcgtgcgcctgagctgcgcgccaccgaacgcggtagccgaacgacagaggtcggcccccggcgttgtccgacctccgtcgtacggtgaggacatctatccgcgctgctggctgctgcgctgctggatcgtcccgcccggctgctcccgggcgggacgtacgacgcctacggggtggtgcccgccgactcacccgcgtgcgggctgagcaccccggcccagatcaggatgaagaggacgataccgaggatgatgcggtagatgacgaacggcatgaagctcttggtcgtgatgaacttcatgaaccacgcgatgacggcgtatccgacgaagaacgccaccagagtcgcgaagatcgtcgggccccaggagatatgcccctcgcccacgtccttgagttcgtaggcgcccgaggcgagcaccgcggggatcgccagcaggaacgagtagcgggcggccgactcgcgggtgtagcccatcagcaggccaccgctgatcgtcgcgcccgaccgggagacgccggggatcagcgccatcgcctggcagaacccgaagatcagaccgtccctgacccccagctccttgagcgtcttgcgttccttcaccacccggtgcttgccgccggactcgtcgcgcgcggccagccggtcggcgatgcccagcacgatgcccatgccgatcagcgtggtcgcgatcagccgcagatcgcggaacggtccctcgatctggtccttgagcgtgatgcccagcacaccgatggggatcgagccgacgatgaccagccagcccatctgggcgtcgtggtcaccgcgcatcgaacggtccgtcagcgagcggaaccaggccgacaggatccgtgcgatgtccttgcggaagtagatgagcaccgccgcctccgtgccgatctgagtgatggcggtgaaggcggcccccgggtcgtgccagccggcgaacgcggcggtcagccgcagatgggcgctggaggagatcggcaggaactcggtcagtccctgaacgagtcccaggacgaatgattcgaaccagctcatggggctttggccatcccggaggtgatcgtgcatcggccacgggcggctgggcccgtcggctgcgtgcggagtgcggagtgcggagtgcggtcaaggacttcgaggtcgcgggcagcgtatcgcctgaaagtaaacgtcaggcctactgcgccggtcatccacgtgccgccgtacgctcagtccttcggcgtgtcccggccgagccggtggcgcttgcgccaggcgaccagcgccccgcagagagcggacagcacgatgaagcccatggcggccaggaacaccggcgaggtcggcgacgcggcctcgctgccggctatcacgtacgccgccgtgttcgggatcgacccgagcccggtggccaggaggaacggcggagcgctcatccgggaggtcgccgcgcagtagttggcggcggcgaacgggatcccggggaagagccgcagcgccaggacggaccggaagccgtgccggctcagcaccccgtccgcggcggtgagcagcctgccgcgcagcagggtccgcagcgcgtcctggcccagcacccggcccagcatgaacgacacgcccgcgcccagcaccgttcccgcgagcgccgccgccagacctgtctgcgcgccgaacaacgcgcctgcggcgatgttgagcagcgggcgcggcacgaacgccaccgtcagcgctccgtatgccagcccgaagagcatcgcggcggtgcccccggtcagctggggcggccagcccgaggccagcagccgctgtggttcgaacagcagcatcgtcgacgcggcccccagcaggacggccacgagcagcgagagccgggaccacggggacaacagcgccctggagaggcgcagggcggaaccggtggcgggccgggcggcggggacggggtcgaacattcggggagagtaaccgaaaacgctgtgtgatcgccgtaatgtgcctcgcgtgaaccccgccgccgacgcccccgtcccgccggacagcaccctcgccgacaccgtcctggagcggctcgtcgccgcctacgccccggccgccgaccccgtacgggcggagggagccgccgcgtacatgaaacacgtcgcccccttcctcgggatccccactcccgagcgccgggccctgtcgcggaccgtgctggcgggcgccgggcggccggacgagacggactgcacggcgatcgcgctgcgctgctggctgctgccggagcgggagtaccagtacttcgccgccgactacctgcgccggtacgtggaccgctgcacctcgggcttcctgcccgtcctgcaccacctcgtgaccaccgtcccctggtgggacacggtcgacgtgctcgccgcgcatgtcgcgggccccctggtcgccgccgacccggcgctcgcccgggagatggaccggtggatcgacgaccccagcctctgggccgcccggaccgctctgctgcaccagctgcgctaccgggaaaccaccgacgccgaccggctcttcggctactgcctccgccgcgcggaccaccccgacttcttcatccgcaaggcgatcggctgggccctgcgggagtacgccaagaccgaccccgtcgccgtacgcgacttcgtcgagggagccaggacccgcctgtcgccgctctccgtgcgtgaggcgctcaagaacctctgaggccgccgggagcgacgcgtccccctccgaaaaccattcgactccccgaccccgcccggacatgatcaggggcatgttccggtacgtcttcctcgcagcgcgtccgcgactgcggaccgcgctgcga

SEQ ID NO: 2723 - DNA, 8761 bp, Unknown
  Kingdom: Bacteria, Phylum: Actinobacteria, Class: Actinobacteria, Order: Streptomycetales, Family: Streptomycetaceae, Genus: Streptomyces
gtgccggcctgctggtagaactcgccgagcgaggcccgtgcgtcgtagggctgtgcggccgtcccgcgggccgcggggacctcggcgggcgcgcgtcgcgcgcgccgagcccggggcagggggacgggctgctggtcgggcggcgcggcgaggtccctcaccttcgggtcccccgaaccggagcgttccagccgcagcagtttgtgctgccgcgtccccccgcgcgccgggacgagccaccgctctccggccggcgaacagtcgggttcaccgccggcggccaccagaagggtgcgcggcagcacggatgccagggcggtgggtaacgcggtggtgtgtcccgccacgaggagggagaggtcgcactcgcccgaccagcgcacgtagtccccgtccaccgcccggttcaactgggcgatggtgcacgtcgccagctccgaggcggcgccgggcgtggccgtacggaagaccgtgttcacggcggtgatgcccagcgacacgccgtcggcccggagccgtaccgatccctcgccgggcagcgcaccggggtgccagtccgagaagccggcgtgttgctcggaccactgcgagaagtccgcgagggggatgtcgtggagcctgccgacgatctcctcctcctcgccgcgccacagaccctgttcggtgtcgctccaatagcgggtgagggccttggccagcattccgtggccgctcccgagaggggtgacgtcgtacttccccggcacggacacgaccgggggcacttggtcggcgccgaggtccaggcattccagcagcacggtgtccaggaagtccgcggtcgccgtcccggtaacccgccggggctcgggaacgctcgcgcccaggacgaagatgccgtggagacgatggccttcccggtgcagactccgcacactgtccagtgccgcgtgctgctgaaccagcggggtgaagcacaggaaatgaaaagctccgctcatcggtcccccttccatacgatggcccggacatcctttttgggtacggcgagttcctgggtgcccttgttcttcccgcaggcgtcaccgctcaccgagatccggacgaacgcactgccgagcgaggccttgtctatcttcccggtgatgtggtgcccggctgcctcgcagaggggcttcacgctgttcgcgtactccggggagacgaccagggcgccgggcgcggtgtccttcgccggaccgagcagggccgcgagggccacggtgacgacactggcgatcagcgcggcgatcaccacgccgttcgcgtggcgttggcgccggtcgacctgggcggcctcggcgtcggcccgttgcagcagcttccccagaagatcgcggcggtcctgagcgtgggcggggcctgccaccgcggataccggctgggccacggcgcgcagatacaggacggccgcggtgagccagagcgcgacagcgctcacccccgcgcagcgggtgagcagcgtcgtgccggcgagctgggtgaacgtcagggcggcgacgattccgctggcgaacagggtgaccgtcgactgcgcggactgggccctgacccgggcctcgcttccggagcgcacacggtcggagtagtaggcctcgctggccggccccaggacgatgtcgagcacgcgttcgcgctcgtcgttgttgatctgacctgccgaagaatccgctggcatcggccccccgttgtgctcatcggacgagcatcataggggaggaaacgccgcccggtacggcccgtgcggaaaaaccgggtggtcactgctgaaagggtgtcacgggcacggagaagggcgcggagtacgggaccgtatccgtactccgcgccctcgttcggggagcgacagaggtgtcgccggtgacagggaccgcggcggcggcgatcggcccgggggagggcgtctccttcaggtcaggagacggtccccgggtccttcaccaccgcactggcatcgctcgaccgccgcggcctcgtcgtcctgcccgtgccgcgcggcacccctcatccgggtgcgcggtacgggcagggtcctgggggaagctcagtcctcgcgcagggcgcggacggcctcctcgacgcgcttgccgtagtcggcgtcggcggcgtggaagtgggcgaggttcttctcgatcacatcgtcgcgggtgacctgcgagaggcctccggcgatgttcgcgaccaggcggcccttctcgtcctccgacatgagccggaagagttctcccgcctggaagaagtcgtcgtccttggtgtgggtgggcgcctcgtgcgtgcccgtccagccgtggatcgccagcggcgcggcgagcgccgcgtcggtctgcgccggaccggcgtacgagttgggctcgtagttcttgtcgtggcgcgagccgttgcgggtcgcgtggacgccgtcgcggccgtagttgtcgacgacggcggtcctcggggcgttcaccggcagctgggtgtggttgacgcccaggcggtagcggtgcgcgtccgcgtaggcgaacagccgaccctggagcatcttgtccggggacggaccgatgccgggaacgaagttgttcggtgagaacgcggcctgctcgacctcggcgaaaacgttgtccgggttgcggtccaggaccaggcggccgacccgctggagcgggtagtcgctgtgcggccacaccttggtgaggtcgaacgggttgaaccggtagtcggcggcgtcggcggccggcatcacctggacgtgcagcgtccaggaggggttgacgccgcgctcgatggcctggagcaggtccgtctggtgcgagttggcgtccttgccgacgagctcggaggcctggtcggcggagagggaccgcacgccctggttcgtcttgaagtggtacttgacgaagaaggcctcgcccgcggcgttcgtccactggtaggtgtgcgagccgtagccgttcatgtgacggtacgaggcggggatgccgcggtcgcccatcagccaggtgatctggtgcgtcgcctcgggggcgtgcgcccagaagtcccagacgttgtccggctcctgcttgcccgtgaacgggtcgcgcttctgcgagtggatgaagtcggggaacttgatcgggtccttgatgaagaacaccggggtgttgttcccgaccaggtcgtaattgccctcgtccgtatagaacttgagggcgaatccgcgcgggtcgcggaccgcgtccgcgccgccgagcgagtcggcgacggtcgagaaacggatgaaggtctcggtgcgcttgcccacctcggagaggaagtcggcgcgggtgaagcccgtgacgtcgtcggtgacctcgaagtagccgtacgcgccggagccgcgggcgtgcaccacgcgctccgggatgcgctcacggttgaagcgggcgagcttctccaggaggtgctggtcctggaggaggatcggtccaccgacaccggcggtggcggagttctggttgtcggcgaccggggcgcctgactcggtcgtgagcacacgcttagccatgtggcgggatgacctttcgtacgagctgctgacggcttgaggagcgtagattcgccgcggagcaacgtcaacagtttgttgaaaacgaagtaggtggttccgggccgcggcggcgcctgggcgcgacaggacaggtgtcagcgccaccgcggcccggagatcagggggcccgtcgtgcggaccgtggccccgggggcggaccggcgatcgtggtcggtcgccccttcgtggggccgggggtggtcagagctgggagccggacagccgctcgaccgagcgcagcagcgccgagtggtccaggccgccgtcgccctgggcgcgcagcgaggcgaccagctgggcgaccacgccgccgacgggcagggccgcgccgacgttgcgtgcggcgtccgtgacgatgcccatgtccttgtggtgcaggtcgatccggaaaccgggggcgaagtcccgcttcaggaagttgtccttcttgcgggtcagtacggtcgagccggccagcccgccgttgaggacgtccagcgcggcggcgaggtcgaccccggacttctccaggaagaccacggcctcggcgcaggcctggatgttgaccgcgacgatcagctggttggccgccttcaccgtctggccggagccgtgcgggccacagagcacgatggtcttgcccagcgcctccagcagcggcttcgcggcgtcgaagtccgcctgctcaccgccgaccatgatggacagaaccgcctcgatggcgcccgcctcgccgccggagaccggtgcgtccaggacccggatgcccttctcggccgcgttcttggcgaggtccacggaggtctgcggagtgatggaggacatgtccaccagcagcgcgccgcgcctggcgttctccaggatgccgtcggggccgtaggcgatggcctcgacctgcggggatgcgggcaccatcgtgatgacgacgtccgcgtccttgaccgcgtccgcgatcgaggaggcgccgttgccgccggccgctaccagccggtcgaccttgtcctgctccagggtgtacccggtgacgtcgtaaccggccttgaccaggttctcggacatgggggagcccatgatgccgaggccgatccacgcaaccttggggaggttgttgctcatgagggtgccttcctgaaaaacgtgtgtacgtaagggggttgggctcgaccggaggtcggcccggaccgcccgcggccggtcagcgggccgctcgggccgacgccgggagccagtcgaaggattccgcgctcggccggtcgcccggcttgtactccaggccgacccagcccgcgtacccggcgtccttcagttcgtcgaggagccgctccagcgggagcgagccggtgcccggcgcgccgcgtcccgggttgtcggcgatctggacgtggccggtcttcgcggcgtacgccttgatgacctggctcaggtcctcgccgttcatcgagaggtggtagaggtccagcaggaacttggcgttcccgaggcccgtcgccgcgttgaccttgtcgacgacctcgatcgcggccggtgcgccgaccagcggatagagcggcgactccggcttgttgagggtctcgacgaggaggatcgcgccgatccggtccgccgcgcgggcggccagcaccaggttctccagggcgagtgcgtcctgcacctgcgggtccgcgccctcgacgcggttgccgtacagcgcgttgagcgccgtgcagccgaccgaggcggcgaagtcggcggccacctcgatgttggcccggaagcggtccgactccgtgccgggcgcggagagcgcgccgcggtcggggccgggcagctgtccggcgtagaagttcagtcccaccaactgggtgccggcgtcgtcgagcgccttcttgagggcgtcgagctccgtctgcggaggggtgggggtctcgatccagggccaccacagctcgaccgccgtgaagcccgccgcggcggctgccgcgggacgctccaggagcgggagttccgtgaagaggatcgaaaggttcacatcgaagcgctggtccgggtatcccatgaggatgtcggcgctccttccgtattgcggaagttagtttctgcttaacggaagattgcccggagggtggtggggctgtcaagggggtgccggaaaattcgccccggccgacggcgtgcggaatcggtggcgtggccgcctccgggcatacgaaagcggggcgggggccgctctcgacccccgccccgcccggctctcacgccgtgtgtgccttcgctatccggccggaaccgtgtcctcgaagctcgtgcccgcaccgcggtacgcgccgaccatcgcgttcacctgtgccggggtgagcacctggtccttcacgtgcaggacgtagtccacctgctggtcgtaggcgcggggcgtcgtgctcggctgcccctccaggtcgatcagccactggttgaagttgatcgacatcggacgctcgggcagataggccgccccgtgcgtcccgaagtgctgaccgtcgaggtagtacgtgatctggttgtcgtcgatcgtcaccaccaggtcgtgccagcccgcgtacgactgccggacctcgctgtgcgcgttgaccgcctcccacgggtcgggccggtaggtctcccacgacgtcgtgtagaggatgttcgccggctcgccccagccgccgttgggcagatactcgaagtcgtactccgcgtagtcgtccgccatcggcgccttgaggtcgttgatcgtgaagaacgtctgcacgatccggtcgccgtccggccccgagcgcggcgcgtcgctgaacttcacgcgggacgcgtacgtcccgttcttgaacttcatggaccgcgtcaggatctcggtgtgcttcgtcgaggccccggtgcccgccgtcgaggtctccaggttcatcaccgagttgccgctctggtcggcgaaggtcacgttctccggtgcccaggtcgcgcccggcacccccggaccgccggagttggaccgtacgctccagccgttcgcgttgatctccgggtcggtgtgggagctgtagtcgaagtcgtcgaacagtgccggcgcgtcccccggcgggtccgtcgggtccggcgggtcggtcgggccgtcgcccccgggggcctcgccccacacggtcgccccggagacgtgagcggtcaccctggaccagtcgccgtacgccgtcctgtccgcgccgaaggagtagtcgtcggactggacgagcgaggcccaggaactctggtggaagcggagctgcaggtcacccgtgtccgcgcccggcgccagcgaaccggccccggcggtgaaaccgatctccagatagcggtccgcggtggcggtcgggttggcgggggtgccgaacgtaccggtgatgttcgcgcaccccttgaccgcccaggagcaggcgaaccggtaggcggcggacggcgagtcggccttgaagtagtagcgcaccttcacgttgctcaggggtacggaggcggagccggcgttacggaccttcagccacggctcgctctggtcggcgctcgcgccggacgcgctcgtccggtactggacgacgatcccgtccgccgcggcggacgccgaggagggcagggcggccagaccggtggccgccagcgccacggcggcggccgaggcggcggcggtgcgcagcctggacctgcgcggattcctgcgtgatgtgttcacgggtgtgttcctctccggaacggtggtgggggagtggctacgagtggggtcgcgctgttcctgaggacggggacgcgtacgtggccgtcgcgagtgaccgtgcgtccagggggcggtaggggacgcccagggcgtccagccgggcggtgtggtgacgcagccgctcgacgaaccccggccagtcgccgcgcccgccggaccaggaacggtcggccagcgcgcagagccgtgggtagctgaggtactcgatctcctcgggggtgcgggcgtactcggtccacaactgggcctgggtgccgagcacccgcgcccgctcggcctccggccagtcgagcggggccggttcgtagccgtggaccgtgtgcagggagaccggcgcgccgggctgggcgaccggttccgacaggtcgccggactgggcgtagtcgagataggtcgcccggtggtgcgcggcgatcacctgatggccccggcgtgcggcggcccgcgcgtgcgaggagtcgcgccaggtcatcaccgtgaattccggcgggagttccgcgccgttctcggcccagccgagcggaatccgcccgcgttccacgaggaacgccccgacccggcccatgaaccagccgtgcaggtccgccgggtccgcgagccccagcgccgccgcgcgttccctcgcggccgggctctcctcccactcggtggtcgggcactcctcgcccccgatgtggatgtacggcgaggggaagacgtccatcacctcctccagcacggcccggcagaagtcgaagaccccctcgtgcacgccgaggatcgtgtcgcacaccccccagcgggtccacacgtccagctcccggccggggtggttgcccagctccgggtaggcggcgagcgcggcccgcacatgaccgggcatctcgatctccggtacgacagtgaccccgcgctccgccgcgtaccgcaccagctcccgcaactccgccttggtgtaggccccttcgtgcggcaccgcgtcgaagtgggccccgtccgggccggtcgggcccttctgtgaccgggcccgccgggagccgaccgggatcagccgggggtaggcgtcgaccggcatccgccagccctggtcgtcggtcaggtggagatgcaggacgttcagcttgtgcagcgccagcaggtccacgtaccggcgcagatagccgaccggctggaagcgccgcgccacgtccagcatcgccccgcgccacggccggtccggcacgtcggtgatctcgacgcagggcagctcccaggagcccgtggtcgaggaaccacccgacagggcctcggcgggcaggagttggcggatcgtctggacgccccggagcaggccggtgaggtgcgctgcacgcaactggagagcctgccgggcgaccgtcagtccgtacccctcctcgccgaggccgccgagccggtcgtccagggcgatgacgatccggccgtccgacgccgcggtgagggggagcccggccgcgcggccgaccagtgagcgcagcaggtccgccgccggt

SEQ ID NO: 2724 - DNA, 5900 bp, Unknown
  Kingdom: Bacteria, Phylum: Actinobacteria, Class: Actinobacteria, Order: Streptomycetales, Family: Streptomycetaceae, Genus: Streptomyces
gccgggggcggtgcgccggggcgtgggctacggcctgggcatggtgcacatgctcggggccgagggcacggacgaggtctccacggccacggtccgggtccacgacggggtggccacggtgatctgcgcggcggtggagacgggccagggtttcaccaccctcgcccgccagatcgtccaggagaccctgggcatcgaggaggtccatgtggccgccgtcgacaccgaccagcccccggcgggcccggcgacgcacggccgccacacctgggtgtcgggcggggcggtggagcgcgcggcgaagatggtccgcacccagctcctccagccgctggcccacaagttcggcatgtccacggagctgctccagatcgccgacggcaagatcacctcgtacgacggtgtgctgtccacgacggtcaccgaggagctggacggcaaggaactctgggccacggcccagtgccgcccccatcccacggagccgctggacgagtccggccagggcgacgcgttcgtcggcctcgcgttctgcgcggtacgggcggtggtcgacgtcgacatcgagctcggctccgtccgcgtggtggagatggcggtcgcccaggacgtcggccgcgtcctgaacccggcccagctggcgatccgcatcgaggcgggcatcacccagggcatcggcgcggccctcacggagaacctccgcaccgcccgcggcctgatccgccaccccgacctgaccggctacgcgctcccgacctcgctggacgctccggacatccgcatcgtgaaactggtcgaggaacgcgacgtggtggccccgttcggcgcgaagccggcctcggccgtcccggtcgtcacggcccccgcggcggtcgcctcggcggtccgctcggcgacgggccgcccggtgaaccgcctgccgatcaggccgcaggcggcggtggcggcacccaggtaaacagtcttcacccttcgctcaccccgtgcggagatgaacccgatacggtgtgcgggctggtggccgcgttcctccgatgaagcggtctacgcaagcggacttggggaattcgtgacgttcgagaaggaatgggcggaactgcgcgcggcggcggccgagcgaggcgccacgcagatcaacagtgctccggcccaggggggcgggggttcggcggatctggtggtgaaccgggacgatctcggcgctatcgggaatgacgcctatgagctgaggacgaagctgtcgaaggacggtgaccacgcccgtccggccaccttcgacgcggcgatcgcgctcaccaacggcaacttcgcgagcggttcggcggtgctgaaggtgcatgacttctggcagacgcatctgaagacgctgctggattcctgtgcgcacatctcgaaccacctggactacaccaaggctctgcactcgaaggacgacgtgaagatcggcggggatctgtcatcgatctccaagctctcggaatacatgaagtagggctcgggggagcacgcacatgctgcaatacgaagacatcgtcgaagccccgctgggaaagctgaaggacgcggccgacgactggtcggagatggcgacgaatctcgacaagctcgccacccaggcatccgacgggatgaaggcgaaggcgaacaaggcgagctgggagggcctcaacgccggggtcaccagggagttcatcggcaagaccgccaaggagttcgcggacgccgcggccgaggccaacggtgtcaagacgctgctggaagagggctacacggccttcaagaaggccaaggacgacctggtcaacatccgggaccacgaagggccggcggccggcatcaaggtggacggcaggggcaaggtgacggcgcgctctccgatctccgagaacaacgcggcccgccacgaccccgacttcaacaaatacctccaacaggagagggagaacatcgagtcgtggcagaagaggatcgacctcatcgtcgacaactgcaacgacaccgatgtgacgttcaagaactcccttgaggccaacgtcaccgaccgcaaggacttcagcgccccgaagtacacgaagttcgaccaggaggaggcggaccgggccgccgggctggccgccaagggccgtgacctcacccacaccgaactccaggctctgaacgagctgctgcgcgacaacggcaagtcgccggagttcgcgaaggccttctacgagaagctcggcccggagaagtccctcgccttcttcggccagctctccacggacacgcacgactacgccaaggtcgacaagacccgcttggcggacgtgcaggaactccagcgcaacctcggcctgaacctggccaccgcctccaacgacaaggcgttctcggcggagtgggggccggagctccgcaagctggggacgcagcagatcccgctgtccaagtacgacaacagcggcggcccgtacggctaccagctgctcggcggcatcatgcggtacgggaactacgacgcgaagttcctcaacccgatcgccgagcatgtggcgcagctgcaccagcaggatccctaccggttcgccggcaacaagcaggtgaacggcttcctggagaacccgtacaacccctcggggaagaacggcgccggctacgacccgaccacggccatgctggaggcgctggggaacagcccggaggcggcgaagaggttcttcaccgacgaaccgacggcctacaacgaggacggcacggtcaaccacggtgccacggccgatctcgggaagaaggacaacgaggcgatcggcaactacctcgacttcttcggcaacgagaagtgggagtcgttcccggactccaactccaccgacccggacaagctggggcccaccctccagtacatgccggacgcgctgggccacgccctggaagcggcgaccctcggctacccggcgggcgacccggacgcgggcgtgaagcgggacgccgacaacgctgcggtcatgcagcaggtcatggagaagtacggggcggacgccggcttgctcaagcaccaggagggcctggcggacagcatgggcgtcatgggtgcgggatatatcgacgacatcaactgggcgctggacaagggcgacagtaacagcgtcttcgcgcccaaagagaatatcgcgggacatattcccttcggagctgacggggaggaagggcggtcgaccgttcgacagttcctcagcgcgctcggccagcatccggatgcctacgccaccctctcgacggcggagcaggtttacaccagaagtgtgctggaaacgcacgtcagtcctgacggggccattgatgcggacgccgcacgcacgaccgttcgggtcggcgccgaaatgcagggcatgctcgaccagtccagggccgaccaggtccaggcggatcacatgaagacgcatgaggactacgagaaggcggtggccaagcgtgcgggctgggtggagttcggtgcgggagtgggaatcgcggccggcgtcgcgttcctgccggcgacggcagcggtgggtgcggccgcggtactgatcccgctggctaccgacacggccggcggtctcgcggaacaggtcatcggccaggtcgtcggggacgtctcggacaactcggtcgacaagagcaaggagaaggcggagcagctcaccgacgaggagtgggacaggatctaccgctccggtgaatccatggcggaggcaccgatggagaatttcctcgctcttcatgcgaccgcagaggacacaaagctccgcgaagacctgaagcaagcgatgctcctgggctacggggtcggcaacgaccgggagaaccagcagggcgtgaacccggagacgggctgaggctgccttcgggctgccgtgaaaggtagggatgtgaaccggaacggaaagacactgatcgctggtctggtcgtggccgtctgcgctaccgcatgcggatcggacccggagcctcagtcgccttatgtgaaggcggcggaggtgtgcgacgggttgttcgcggggggcctggagaagacggtggaggccgtgacgggcgcgacgtccttcgagcggcgagcggatgacgacatggatcggctgatcgggaagatcgagaaggagtacgcctccggccgtagttggtcgcaaggcggagatctctgcgaattggctgccaagggaagccgcagtgttgacgagacctccttgcgattccatatatatgcaccgcaggacgtcaattacccagggagccgcgaaggggaacggcgcttctccctggggaaggaggcggtgaccaacccccgctcggcgggtatctatttcgaatgcgtcagcccgcggctcgatggctcgaagaaccgcccggcgcggatctacggaggactgagcaaagcccacgaccgaggggatgccctggagaacgtgatggacaacctccgtgtcgtgcatgccgcgtccttggcagttgccgagaagctggagtgcgaggacaacgccggtcttccggcggaactggactcggatctgaaggagctcccaccggtcagccgtgaggcggagccggactcttgacgatgtcgcaccggacgaaactgctgacagacgtggccaatcaggctgtcgacggcagtggccgcagatggtgatcggccccagggctgtacgtgatgggttcgtggccatggccgtggccggctcactggctctcggagttgtcggccaccactctggaggaaggcgccgtgcgctgccaggacacggtgccggcgggcagcatcatggccaaggcgcagagtctcctcgactgcgggccggccgccgcggaggacgagcgcccggcgggcgcggtggcaccgacgatgaagcaggagcaggagcaggagcacacccgggagcaggaccgcctcgcgcaaccctcggcccccgccggcagggcgtccggtcgaggcgaccctgtggaactgggcaacggcgggtgcgcgaccatcgccgcgccgaacgcggccaccgaaagggcggttctgatgacggccgcctgggcggaggacgaccttcagcggttctacatctaccgtgatgtgcccgggagttcgaagatcggtgtgcagaacaagtacaccggatccatgatgggccacgaccggtacgcggacggggagttcatccgccagtactccagcggcaggcaggcaggacggtacgggtacgtactctctggacgccgtctgacgactcaagcgctgtgagcggccctgtacgtgaacctcccccttccggttccgtgcggggccctccgtgtttcgggtcgaaggctttccggcaggcctggagagctggagaatgccgcgaggggccgaaccggtccgaggttcgtaccgcgtcgtccgaccagggagagcccgtacgtgatcactgagccggaactggtgggcgatcccgggccgggggagcgcgcggacgtggttagcgggttcgaccgggggccgtcggcggccgggcggcgtcggaggcaggggctgctgtgggctcgccgccggagcggtcgtggccctgcccgttctcatcgggtgcccggtgtgtcgggtccatcgcaaagtcccccagacgcgtcgtgcgcggttgcccctcccggcctcactcgcgccccgctgtcgcttccggtccggtgtccgcccatgggttcgttgtcattcggcggacggccgaaccctagaccttggcacagtattcatgaaccgccggggtgccacgccgtccaggacgtcacgttccggtgaggattgcgtgacttctcccgccgggcacggtccgtccggacggtcggccgcatcccggcgggaggcggccgcgcgcaggtccgtcagacgcgcggcagcgactccgcggcgatgccgccctcga

SEQ ID NO: 2725 - DNA, 1169 bp, Unknown
  Kingdom: Bacteria, Phylum: Actinobacteria, Class: Actinobacteria, Order: Streptomycetales, Family: Streptomycetaceae, Genus: Streptomyces
ggccgggtccctggaggcggcgggggtccgggtcgagcggggcgcggaaccgtccgcgcgggccgtggtgctggtgcccgtctgggggactccggtgtcggcggcggtcgcggcgggcgcgggtccccgggagcggacgttcggcgtggaggtactgccgccgccccgccgacggcgacgagccgtacgcggtgtcggtggtgcgggacaccgcgggctcggtcgctcagcggctgctgtcctccgtcgtcgcggtcggctgctcgatcgcggagcgctcgctcgccgcgccgggtgacatcgatctggcggtgaccaccgggctcggctatccgtacggaccgctggcctggggcgagcgcgtcgggacagcgaggatgctggagctccagcggtcgctgcacacgacgacgggcgacccgcgccaccggccgacgcggtggatcaccgaacgggccgccctcggcctcgcgctcaccgatccggggacctcacccgccgactgcctgggctgaggacggcacggcagcgcacgactgcctgggccgagaagcgcgtcacgggccccggacgtccgattcctccaagacggccggggtgccgtgtgcctacggtcggggcatgactccacgattcgacgccatcagcatcatcacggccgacctggccgcctcactcgccttctaccggcggctcggcctggacatccccgacggagcggaatccgcaccccatgtcgaagtgaccctgccgggcgggcagcggctgctgtgggacacggaggaggtcatcgcctcgttcgatccggactggaagcgcccgacgggcggtgagcgggtggccctggccttcgtctgcgacggcccgcaggaggtggactcgttgtacgcggagctggtcggtgccgggtacaccgggcatctgaagccctgggacgcggtgtggggacagcgctacgcggtcgtcctggacccggacggctgtggggtgtcgctgttcgcctccgcgtcactcgccgagaagtaggccccgagcgtcgtcccggcgaggtcgcgcatctcgcgggccaggtgcgcctggtcggcgcagcccgccgcgcaggccgcctcggcgtacggcaggccggcgcggacgagggccagggcgcgctggaggcggaggatccgggc

SEQ ID NO: 2726 - DNA, 13782 bp, Unknown
  Kingdom: Bacteria, Phylum: Actinobacteria, Class: Actinobacteria, Order: Streptomycetales, Family: Streptomycetaceae, Genus: Streptomyces
ccggccggcgggcccgtcgaccgctacttgcccatgcggagcccgtccttgtccgcccctctgccgaggacgacggcgcggatgcggtcgcggacctcgcggaggtgctcggccccggcgtcgagggaggcgttgaggttgacggcgcgcccggtgacggtgtcgtaccactgcgggacgaactccgccttcttcacggtccagcgctcgccggtcctcgcgggcggcgcgaaggtgaagcggcccatcgagctctggttgccgcgcgggtcctggacgccctcgtagttgatcatcgctccggcgatctggtctcccatgccgtagacgacccaggtcccgttgaccttctcgtaggcctgcggcacatgggcatgggtgccgatgatcaggtcgatgtcggggcggcccccgtcggcggacgcggtgagccgccgggccagctccagctgggtcgcgtcgggctcgtcctgccattcggtgccccagtgggcggagaggacgacgacgtcggcgccggcccgccgggccgccctggcctcctcgacgatccggccctcgtcggtcacgttgaccgtccagggccggtcggcgggcagcgggatgtcgttggtgccgtaggtgtacgcgaggtgggcgaccttggccgcgcccttccccggtccggcgggcaggatcgtgggccgggcggcctcggcggcggttagggcggagccggcgtgccggatgcccgccctgtccagcgctccgagcgtgcgccggaccccctcggccccgtcgtcgagggtgtggttggaggcggtggagcaggagtcgaacccggtggtgcgcagggccgcggcgacctcgggcggcgacttgaagctcgggtagccggtataggggccgccctcctcgccgtacaccgtctccatgtggcagaacgccaggtccgcgccggagacgaccggggcgacgcccgccagcatcggggcgaagtcgtagccggcgccgcccgcgtcggcggcggcccggtcgatcacggaggagtgcggcaggacgtcacccgcggcgagaagcgtgaacgggcgcggcccctcggtgtcctggccgccggcgccccgggcggcggccggtccgctcgacgcgggggccggggactgttgcccggtgcagccggtggccgcggcgagcaggagggcgatggcggccacggtgcccggtcggatgcgctgcgtcatctgctcgactccacgttcggatgatgaggaccatccgactacacatatcttcataccgcctaagcaaggagcattgccgcatacctagctgaactggtcgtaccggccgaccccgacggcccctcgaccgttcaccgcaccattcgccgcactgagcgaccgctcgtcgcacgcctcggcgcaccgcctgttcccgcgccgccgaatgcgttcgtatacgccagtcggcaacgaggccgtcaggggcctcggcgggagagggcgttcatgaagaccaccacgacgaccgatgagcggactctcgcggagttgcagcgggaacacggtcccgccctgttccgcttcctcctcggcctgacgttcggggaccggcagcgggccgaggacctggtgcaggagaccctggtgcgggcctggcagcaccccgaggccttcgacgcgccctacgactcgatgcggccgtggctgttcaccgtgggccgccgcctcgccgtgctgcggcggctcacccacccgcgccaggacgacccggagaccggtccggtctccgtcgtcgtcgcgccggtccgctccgtgctccagccgcaggtcaaggggctcggcgagctggagcccgtggcgctgaccggcgggcagagcgcggatctgggggaggtggtggaagcgctggcggccgccgcgtactcccgggtcgaactggtcgagaagcgtggcgagttcgccgtacgcggtgggatcctggacgtcttcccgccgaccgaggagcacccccttcgggtggagttctggggtgacgaggtcgaggagatccgctacttcaagatcgccgaccagcggtccctggaggtcgcggcgcacgggttgtgggctccgccctgccgcgagctgctgctgaccgacgaggtgcgggagcgtgcggcggtgctcgccgaggcccacccggagctgggcgaactgctcggcaagatcgcggagggcatcgcggtcgagggcatggagtccctggccccggtcctggtggacgacatggagctgctgctcgacgtcctgccgaaggacgcgatggcgatcgtctgcgatccggagcgggtccgcacccgggcggccgatctggtcgccacgagccaggagttcctccaggcgtcgtgggcggcgagcgcgggcggcggcgaggcccccatcgacgtgggcgcggcctcgctgtggggcatcgcggacgtccgggaccgggcccgcgagctggacatgatgtggtggtcgatctcgccgttcgcggccgacgccgccgaccacgacgacgacaccctccagctctccatgcacgcccccgaggcgtaccggggcgacaccgcccgcgcgctcgccgacaccaagggctggctggccgacggctggcgcacggtgtatgtgacggaggggcagggcctcgcctcccgtacggtcgaggtgctgagcggcgagggcatcgcggcccgcctcgacgcggatctgaccgagatcaccccgtccctggtgcacgtctcctgcggggccatcgaccaggggttcgtcgacccggcgctgaagctcgccgtgctcaccgagacggacctgaccggccagcgcaccgccacgaaggacctgggccggatgccggcccgccgccggaagacgatcgacccgctgacgctggaggtcggcgactacatcgtccacgagcagcacggtgtcggccggtacgtggaaatggtgcagcgcacggtccagggcgcgacccgcgagtatctcctcgtcgagtacgcccccgccaagcgcggccagccgggcgaccgcctctacatcccgaccgaccagctggagcaggtcaccaagtacgtcggcggcgaggccccgacgctgcaccggctcggcggcgcggactggacgaagacgaagcagcgggcgaagaaggcggtcaaggagatcgccgccgacctgatcaagctctacagcgctcggatggcagcccccggccacgccttcggcgcggacaccccctggcagcgcgagctggaggacgccttcccgtacgcggagacgcccgaccagctgtccacgatcgccgaggtcaaggaggacatggagaagacggtcccgatggaccggctgatctgcggcgacgtcggctacggcaagacggagatcgcggtccgggccgccttcaaggcggtccaggacggcaagcaggtggcggtcctggtccccacgacccttctggtccagcagcacttcggcacgttcaccgagcgctactcccaattcccggtcaacgtacgggcgctgagccgcttccagtcggacaccgagtccaaggccaccctcgaaggcctgaaggacggggccgtcgacctggtcatcggcacccaccgcctgttctcctccgagacgaagttcaaggacctcggcctggtcatcgtggacgaggagcagcggttcggcgtcgagcacaaggagcagctgaagaagctccgcgccaacgtcgacgtgctcacgatgtccgcgacccccatcccccgtacgctcgaaatggcggtcaccggcatccgcgagatgtccacgatcaccaccccgccggaggagcgccacccggtcctcacgttcgtcggcccgtacgaggagaagcagatcggcgccgccgtgcggcgtgaactgctgcgcgagggccaggtcttctacatccacaaccgggtcgagtccatcgaccgggccgccgcccgcctccgcgagatcatcccggaggcccggatcgccacggcccacggccagatgtcggaaacggccctggaacaggtggtggtggacttctgggagaagaagttcgacgtcctggtctccacgacgatcgtcgagtccggcatcgacatctccaacgccaacaccctgatcgtggagcgcggcgacaacttcggcctctcccaactgcaccagctgcgcggccgggtgggccgaggccgcgaccgcggctacgcctacttcctgtacccccccgagaagcccctcaccgagacggcccacgagcgcctggccacgatcgcccagcacaccgagatgggcgcgggcatgtacgtggcgatgaaggacctggagatccgcggcgcgggcaacctcctgggcggtgagcagtccggtcacatcgcgggcgtcggcttcgacctgtacgtccgcatggttggcgaggcggtcgccgactaccgggcccagatggagggcggcgagcaggaggagcccccgctggaggtcaagatcgagctcccggtcgacgcgcacgtcccgcacgactacgcgcccggcgagcggctgcgcctccaggcctaccgcgcgatcgcctcggcctcctcggaggacgacatccgcgcggtccgggaggaactgaccgaccgctacggcccgttgcccgaaccggtcgagaacctcctcctggtcgccggcctgcgcatgctggcccgcgcctgcggtgtcggcgagatcgtcctccagggctccaacatccgcttcgccccggtggagctgcgcgagtcccaggagctgcgcctgaagcgcctgcaccccaagacggtcatcaagccggccgcccaccagatcctggtcccgcgcccgacgaccggaaagatcggcggcaagccggtcatcggccgggaactgctggcatggacgggggagttcctgacgacgatcctggggtcgtagcaccgggtgccgcgtgaacgatcgggccccgccgggctgaccggcggggcccgatgcgtctggcccggggcccgctacggcgtcgcgcgccgcttgaacacggcccacaccgtcttgcccacgacgtggtggtcgacgccgaagtccgccgcgagttcaccgacgaggaacagcccgcgccctgagcaactgcactcgtccgcgtgctgcatggtgtccggccgctggccgccgcccttcggcgaggtacgaaagctgttccggcggaggacagctgcggcacgtacgggcccctgatcaccacgggcccgtgacgcggacacgtccgtctgatcgacgagaacggcgcgataccgttcggcacccggccgggcgctcctctgatgcctggcacgcccggtttcgcggggtgggcagcccactgggtccaggaccgttcctggttcgcagacgactggggagccacgggggaccggggacccgggcgtcgatcggaccgcatcgacgcccgggcgggggacggccgttgtcgtcccccggcggcggactcccggctcagtggcccgaagccctcggcctccaccggtccgccgacgcggcagacgtcacttcacgacgacgttgtccccggacgacgtcgacgccccggtggtggtgttgccgtagtacgcccagcgccacgtacccgtcttggaggccttcacggtcgtcttgagcttgcccgagccgtccgcgtacaccttcttgaccgtgctgtaggaggccgagccggaaggcttgaactgcaagctcacgtggcggccaccgtaataggcgtacttcctggtctcccagttggcccgcgtgaccttcccggtcacggtgatggtcctgcccttggccaccggttccggtgaggcgttgacggtcagacgggagttgcgctggacgtagaccgtcatgcccttgtcgtcgacgtcaccgctgccgtccttgaaacgcacctcggccccgaccctccaggccccggcctcgctgttacgcatgtcccacacgctcgggtcgaagtacatcgtctcgttgatgtcgcaggcgccgacctggttggggcagtcgttcgtctcgatcgagtgccacagctgttcctccccactgttgcggtggaggaacaccaaccccggcgccttccacggcttcgtggtcgtcatccggaaggaggcgggcaccgcgacctccttcgtcgtcccgatgacgatcggcttgccgccgttcacctggacatggctgaacgaggccccgccctcggccgccccggccggcaccgcggccaccgccgtgaacaccgccgccgcaccgccggccacgacggctctccagacctgcttccccacctgatccccgatctccgaacggaatagcgccgaaggatcgtcctccagcgccttacagacggccggcattcacccagggttgtacacccgcgcatcacgatggggcatcggccctgcggacgcggccgaccggggcggcggcggccggtgggacgtcgcccggacggtcttgccgacgaccccgtgctcgaccggccgaggtcactcggccggggccagcgcctccgcgatctcctcgtgcagtcccagcggcagccgcgtcccccaccggtccgccgcctcggccgccagttcccggctccaccgccagctgttcaccgccgccgtacggaccgcctccggggccaggggcccggtggtcgtggcgtaccgctcgacgtccaccgtcggcaggtccgcctccagggcgcggctcggggtgagccagtgcgcggtcgaaccgcgcagcaggcgacagagcttgagctgaagcggggcgatgacggcgtgcagcagatggtgggcgcgggcgtgctcaccccgggcccgtacgtgggccagcatcagggtccagttggccagttcgtcggtgagttgccgggcggtggccgccggctccggcgggctgaaggcggccagttcgcgggcggcggcggtcaggcggccggtgcggtccaggagcacggccgcttcggggcgggggaagtggacctggtcgcgccaggtggcgatctccgcgatgccggggccggcgggctcgacgtggaactcgccgcgcatcaggtcgtcgaagaccacggcgaggatgccgtacatattggtgtacgccagcttcagcggggccagccgctccacgaactcccgcccgtcgaaggcgtcgacgtcctcctcctgtacgtagaggcaggcgtccaggtccgagtgggcgtcagcctcgccgagcgtccacgagccgtagaggaggacgccctccacccggggatcggcctcggccgtcgcgcgcagcaactcgatgcggcggtccagggccagggcgtcgacggacaggggagcaggggcggtacgggcgcgggcggggcgaatgtgcggcatggccgggctcctgagagggtgcgtgggcacggggcccggcggccggcgccgggctgcttccggtcccgctgcgggacctcgttcgtcgctcaggaaacgcccatgaggagcagcctaggggacggccccgtcagccgtcgcggcggttctccggcgtgaagatcaacgcggtgagcgaccggaacgcctcctccgggtcccggccctccatcgcgtccgacaggttgccgctgagcagcagcgtcgcgaagccgtgggccagggaccaggcggccacgcccgcgaggcggtcgtcctccccccggccggccggggggaggtccgccacgcccgcgcgcagggcctcggtcgcccgggcgcgggcggccagcaggtccgggtcgtcggtgcggtgcaggtccggctggaacatcacctggaagtgcgcggggtgcgtcgccgcgaaccgtacgtacgcgacgccccgctcccggaggtccggcgccccggtcagcgcgtcggcgaacagggtgtacccctcggcggccactgcggtcagcaggcccgtgcggtccttgaagtggtgcgccggcgcggcgtgcgagacgccggcccgccgggccaggtcgcgcaggctcagggctccggggccgttcgccgcgatgacgtcgagagcggcgtccaggatcgcgcgccgcaggtcgccgtggtgataggtgcgctcgcgctcgctgctcatggcagcaccctacccggcatctagtcattgacaagttctgaaggtgtgcgcatgctgacggtctgatctagtcactggaaagatcagcgatgtccgttcgggaaggtggagatcatgaccggagaaccggcccgtgtgcggcaggtgtggcacctcctggagcccctgcacgccgttctgtactacgcccccgaggccttcggcgaggctgccgcgctggggtacgacaccgaggagcgctggtcgagctacttcgcctggcgggcggccccgttgggatcggtgggggcggaggaggcggtgcggacgttccacagcttcgctccggcgatggtggagcgccatgttccgggtatctgggcgaccgccgccccggacgcggtcctcgcggcccggctgcgggcggtcgaccggtcctaccgggccctgttcggggaccgcgtggagggaccggggttcgcggaggccgccgcactggcccgccgcgcggcgggcgcggtgaccccggggacgatcggcggcctcgggcccgccaactccggcctgccctggccggacgccccgcacctggtgctctggcaggcggcgaccgttctgcgcgagcaccggggcgacgggcacatcgccgctctggccggggccggtctcgacccggtcgagtcgctggtctccttcgcggcggtcggcgcgacgtcccccgaggtgttcgcgagccggggatggggtgcggaggcgtggggtgcggcccggcttcggctccaggagcgcggactgctgacggcggacggcgcggccacggacgcggggcgcgagctgcgcgcgaaggtggagctgcgtaccgacgaggaggccgccgcaccgtggcgggcgctgggggagcgggggtgcgagcggctggtggaactgctgggggagccctggctggaggtcatcggatcgggactgctgccggccgagaacaccctcggcatcgggaaggtgtgacccgggaggcccgagcgggccggggcaccgttcgctgatgcgtcgaggtggtgcggtgccgaagcgctgaagcgctgtcatggaagcgcccccggcggggaagacgcccttaggattctcggcgttcggctttctccccgtcaggacggcttcacgtgatagttccccgtacgtacggtacgtaccgagcggccctgcccgccatcggcgctctcgtcgcgatcgccctggcgggcggctgcacccccgacgacctcgcggccgacggcggcggaggcagcgcgagcggcgggaccaacggcgacgcgcagtccgccgagggcttcggcgccagcccgctggacaaccccgacggtacgaagccgggtctggcccccctcaccaccgacgcggaccgggccgccgcccggaagatcatcgagaaggtggccaccaaggggcgcggcccgaagaccggctacgagcggaagaagttcggctacgcctggaaggacgggatcgacggcatcccgctcgcccgcaacggctgcgacacccgcaacgacctgctcgcccgggacggcaaggacatcgagcacaaggcgggatccgactgcatcgtcatgtcgatgacgctccaggacccctacaccggcgagagcatcgactggcgcaagcagcaggcgaccaaggtacagatcgaccatgtgatgccgctgtcctacgactggcagatgggcgccgcccgctggaacgagtccaagcgcgagcagatcgccaacgacccgctcaacctcatcccggtggacggtccggccaacaacgccaagcgggactccggacccgcctcctggctgcccccgtacaagccggtccgctgctcctacgcggtgcggttcgcccaggtctcgctgaagtacgaactcccggtcacggccgccgacaagcggaccatgctcacccagtgcggcggctgagcggcagccaccgccgcaccggggaggggcggggtctctagaccttgccgccgcagatcacgtcgtacgggcggcccatcgccatcatcagctgcatcggctccgtggtcgccgccgggcactcggtcttctccttgacgaggccgaggaccttgaagtcggccgccccggccgagtcgcaggcgatctccttcgccgtcgccgagatgcagtcgccctcgaccagctggcccccgccggcgcccgcgtctccggggtggtcgcccgtcaggttgcggccgcagaccgtgttggtcgggatgccgctgctcttcttgtcgtcgccggagccgaagacccgggagacctggatgatcagatccgtaccggccgggcactggatcgcgttgggcaggatgctcgcgctcttgatctccagcgcctcgaaggtcgctccctgctcgtcgcagtcgaaggcgcggtagccgtccggcttgttctccgggtcagggcctccgcagtcaccgatctcccacgagccgcccttgccgtccgatgcggacgaggacgaggacgacttcgagtacttgttcgaggcatcgtcaccgaagatcttgaacgccccgtagctcaggccgaggatcaccgcgagcaccaccaggctctgcaggcacccggcgcctctccgggggcgggtcggtgtactgccggggtgggtcatggttctgctccttgacgagtggcgcacagggtgcgaagtcacgggtggggacgcggcatgcacacctcatggttccggccggatcacgtcggttcggtggccggatcgtgagcccgtccagctcgggggagccgcgggagcgagcctgcgcctccagggtggcggcattccaccggttcggggccgagtggatattcgctggtcggaaaggcgtgggctgcctagggtcgcgcgtatggagctgaagatcaccaccctcgccgatcgcccggagctggccgacgccctggaccggatgccggacacctggccggagttcatcctggaggacctcgtcggctgggcgaacttcccgcggatcgcggtcgagttcccccagtacgtgctggtcgccaccgaccccgagggtgccgtggtcgcgcgcgcgttcagcgtgcccttcgtgctggacgcccccgggcgcggcgagctgcccgtcggcggctgggaccaggtgctgctgtgggcgttctcggacctgcggcgcgggcgcacccccgacacggtcagcgcgatcgacatcacggtggccaccggccggctgggccaggggatatcgggccggatgctcgccgcgatgcgcgacaacgcgcgacggctcggcttcggacaggtcgtcgccccggtgcggccgaacggcaagcacctgcggtccggtcagccgatggaggagtacgcccggctgacccgtcccgaggacggactgcccgaggacccctggctgcgggtgcacgcccgcgcgggcggcaaggtggactcggtcgccaccgtgtcgatgaccgtgcgcggctcgctcgcccagtggcgggagtggaccgggctgccgttcgacacggacggaccggtggaggtgccgggagcgctcgtccccgtgcactgcgcgctcgcgcacggttacgcggtctacgtcgagcccaacgtctgggtgcggcaccaactgtgacacccctgcccgaaggtcggggtgcggcgcccgcacacacccccgctctcctcgtcgtcgacatgcagaacaccctggtggcgatggcatggcgggcggccggaaccgtcgcggccatcgcccgcctccaggagcgggccagggcggccggtgcgccggtggtgatggtgcagcagcgggacgaggagctggagcccgggaccgagggctggcggatcgtgcccgagctggcccccgcccccggtgagacggtcgtgcccaaggcctcccctgacagcttcctggacacggaactggacgcggtcctgcgcgcccggggggtcaccgaggtcgtcgtcaccgggttcgccaccgagatctgcgtcgagtccacggcccggcaggcgctgagccgggggtacgacgtggtgctcgtcgcggacgggcacaccacgtccgtccgacccggccccggcccgtacgccgcgccggaggtgtccgtcgcgcaccacaacgagatctaccgcaacctcagctacccgggccgccgggtacgtgtactgccggcggccgaggtggacttcggaggcggagccccggcggcggccgggtgacggggacggcggtcccgcgggcgggctgagtcctactgctccaggtcgaccatgtccttcgcggcgggcttctccgccacgacaggcacgtcgaactcggacaggttcatcgtcatcggctcctcgccgccccgggacgcgacgcgcaggatgtacgggtcgccctcggcggagacgtcgatggtgaacgtctcctcgccctccttctccgtgaggcgcagggcgggcttgccggcgaccgtcgtggggcccttcttgcgggcggcgtcgtcccccgcctcgaactccttgagcagtcccttcaggtcgcagaactcgatggtgtccttggtgtccggttcggaggccttcgactccatccagcggcccgcgatcagcttgaccgccgcgtccacgtccgccttcggctcgcccttcgactgctcgcgcagcagggtctcgtcgagcttcgtgtagaccgtgtcgccggtcttgcggacctccatcgtgcccgtgccgcccatggtcatcgttccggtgcagtcacctcccaggctcgtggcgaagtcggcctcgacccggccgtcggaggtggtcatgtcgagcccgatccgcagggacttgaccccggtcgtcttcgcgagggccttgttcacgacctccggaccggacactccggcgaacggcccggtctccttcggggagtccgtgccgcaggcggcgagaccgaacagggtcatcgcgcagacggtgttgacggatatacgggtgatgagacgcatgggtcaggctccggaaggagaggcgcgcggcgccggtcagcagagaggggaaagcggccccggcggggggcggaccaataacaacagagcttgtgaaccgagtcaacacgaaagattcgtgaccggtcgggcaacgatgctttccggtgtggtgcgggtgattcgctatgctcgcgggcaggcagcgcggacggaccaagggggagccagtgccggagaacgcgacggaggtcaccgcggccgggatcgcgcggctggcaggagtgggccgtgccgccgtcagcaactggcgccgccgtcacgccgacttcccccagcccgtcggaggcacggcggccagtccctccttcgcgctgcccgatgtggagcagtggctgcgcgaccagggaaagctcgccgaggtgccgctccgtgagcgcgtctggcaggaggtggtcggccaccccgcaggggccgcgcaggccctggtccataccggctgcgctctgctgctcgtccgtgaccggcccaccgcctggctggagttgaccgccgtgtccgacgagcggatggccgacgcgctgccgcacgccgtggaccacgtgctcaccgcccggctcggtcccgacgcaccctcagtcgtccccggccccggcctggccacaccgccaggagccgtcggcgcgccgcgaaccgccgactcgaccgcgcccggatcacatgcgcctgactcgacgacgcct

SEQ ID NO: 2727 - DNA, 2270 bp, Unknown
  Kingdom: Bacteria, Phylum: Actinobacteria, Class: Actinobacteria, Order: Streptomycetales, Family: Streptomycetaceae, Genus: Streptomyces
gtgggctcggcgacgcaggcgccggcgtgtctgcgggtgaccacgaagccctcggactccagcgtgcgcagggcctcgcggaccgggacgcgggagaccccgtaacggcgggccagcaactcctcggtgaggcggctgccgcgctcgtagacaccggagacgatgtcgtcacggattgccgtgcataccgaatgcgcgggaatgcgcatgtccgaacctccgccttgatccccgcgaaacgcggccgcccgacgtctgttccgtgactctattgcaatccgccggaatttccgatggcaggccggaatccatggatatcctggggtcggaattaccgaaggccccggcgggtgccggggccttcgggcaaggtcgcgcggagcgggtcagacgttcagaccgtgggagcgcaggtagccgacggggtccatgtcggagccgtagtcgggggtggtgcgggcctcgaagtgcaggtgcgggccggtggagttgccggtggagccggagaggccgatctgctggccggaggagacgctctggccgacggagacggcgatcgaggagaggtggccgtactgggtgtacgtgccgtccgtcatccggagcacgatgttgttgccgtacgcgccgccccagccggcctcgacgaccgtgccggcgccgaccgcgacgacggagctgccggaggaggccatgaagtccacgccggagtggctgccggaggaccagagcgaaccgccggacttgtagccggtggtgacgtgggagccggcgaccgggaggtggaaggcgttcagccgggcgcgctcggcggcgcgggcggcacgggccttctcctcgcggacctccttggcgcgggcctccgccttgcgctgggcctccgccttcgccttggccttggccgccttcgcgcgggcttccgcggcggccttcgccttcgccttcgcgatcgcgtcggcctgctgcttctgggcgtgggcctgcgcgtcgatctggtcggcgagggtggcgtcgagggtgacggcctgggtgaggccggtgtcggcgaccttggcggcctcggtgtccgcggcgagggccggggaggccagcgagccgaggacgccggtggtggccagagccgcgatgccggcggcctgggcgctccggcgcgtgaggcggctcggggcacggtgcttcccggtggcacgggtgaacgccatggaggggctgatcctttccttccttctcgcctaccgggttagctgacgggttcggagcaggaaggtctcctacggatccccgcgccggtttcgcggcacgggcctccgattcaccccagggactgcatgggtccccggctccccaggctcgcgcctgacggggactcggcgatgactgcccggcgccgcggctgcggcatacgggtgacggacagccgagccgacgctaggcggggcgacttcccatcgccaaacggaccaggggatttgtcgcacatcccacagggcagacaggcagccactccaccaaagggaatggaacgtactaaacgggcaaaatatgcaggaccccgacgaactggcgtccgtcggggtcctgttcgcgcggtgtgccggggtgcgtcaaccggtgacgacggacacctctccgatgccgagggccctcacgggctcctcgatccgcgcggcgtcccccacgaggaccgtgaccagccggtcgaccgggaaggcgctgaccacggcggcggtcgcctccacggtgcccgtctcggcgagccgggcgtagaggtgggcctggtagtcgtcgggcaggtgctgctcgacctggtcggccagggtgctcgcgacggaggcggcggtctcgaacttcagcggggcgacgcccaccaggttctgcacggccgtctcacgctcggcgtcggtcagaccctcggcggccagcgtccgcaggaccttccagaggtcgtccagcgccggtcccgtggactccgtgtccaccgaaccgctgatcgcgagcatggccgcgccgcccgagtcggggccgctggagcgcagcacctgggcgaaggcccgcaccccgtaggtgtagcccttctcctcacgcagcacccggtccagccgggaggtgagggtgccgcccaggcagtacgtgccgagcacctgggcgggccacacgcgctcgtgccggtcggcgccgatgcggccgatcagcagctgggtctggaccgcgccgggccggtccacgatgaccacgcggcccgtgtcgttcgcggtgatgggcggcaccgg

SEQ ID NO: 2728 - DNA, 20363 bp, Unknown
  Kingdom: Bacteria, Phylum: Actinobacteria, Class: Actinobacteria, Order: Streptomycetales, Family: Streptomycetaceae, Genus: Streptomyces
agggggcgggggtggcggtcatggaggctcctggggcgcgggcagttagagtgccactctaaccacgggtgctgccgagcggaagctcatccactcccagttcgatcagcgctcaattcgcagggcacggaaaaggccgcaccggtcgagaagccgggtgcggcctgatcccgaggcgtgacgcctagccgagcgggtgcatccagccgtgggtgtcctcgacgacaccgcgctggatgtcgagaagacgctcccggagcttcatggtgacctcgccgggctcgccgccgctctgggtccactcgccgccctcggacttcaccaggccgacgggggtgatgacggcggcggtaccgcaggcgaagacctcgacgagggtgccgttcgccgtgtcgtcgcgccactggtcgatggagatccggccctcctcggagccgtaaccgaggtcgcgggcgaccttgaggagcgagtcgcgggtgacgccggcgagcagcgagcccgtgagggacggggtgacgatcttcttcgagccgtcctcctgggcgtacacgaagtagaggttcatgccgccgagctcctcgacccacgtgtgctcgaccgcgtcgaggtaggcgacctgggcgcagccgtgtgcggcggcctcggcctgggcgaggagggaggcggcgtagttgccgccggtcttggcgtcgcccatgccgccggggacggcgcggacgcggttctccgagagccagatggagaccggcttcacaccgccggggaagtaggcgccggcgggcgaggcgatgaccaggaagaggtactcgttggccggcttcacgccgaggccgacctccgtggcgatcatgaagggacgcaggtagagggactcctcgccgccgtgggccgggacccacgccttgtcctgctgcaccagcgcgtcgcacgcctcgatgaacgtctcgacgggcagctcgggcatggccaggcgcgcggccgagcgctggaagcggcgggcgttggcgtcggggcggaaggaggcgaccgtgccgtcgggctgacggtaggccttgagaccctcgaagatctcctgcgcgtagtgcagggtcatgttggccggatccagcgacagcgggccgtagggaaccagctcggcgtcgtgccagccccggccctcggtccagcggatggtcaccatgtgatcggtgaagtgccggccgaatccggggttggccaggatcgcctcgcgctccgcgtcggacagcgggttcgaggagggcttgagctcgatcgtgggcgtcgtcatgagtgcgtgtccttcaccggtcttgtgtgtgatggaccgcgctcacgcctgttcgcgcccgacgcttttcggtcaggtcctaggacgtccgagctttaccgcgagccacggccccgcgttcgattatcacttgcggggggccgtgcacgaaatggtgtgaatgcggtccaggggtcgatggtggcacccgggggccgcacaggtgaagccgccgggtgctttcgctgacccggcggcttcgaagggagtcgtcgggtcagcccgctacgcgtaccgcgagggcgtcgccgatctcgtcggtcgtacgcgtggcggcgctgtcgcgctccgcgaggtcggcggagacggcgtcctcgatgcgcgcggcctcggtctcgtagccgaggtggcgcagcaggagggcgacggagaggaccgtggcggtcgggtcggccttgccctgccccgcgatgtcgggggccgagccgtggaccggctcgaacatcgacgggaacgcgcccgtcgggttgatgttgccggaggcggccaggccgatgccgccggagacggcggcggcgaggtcggtgaggatgtcaccgaagaggttgtcggtgacgatgacgtcgaagcgctccggctgggtgacgaagaagatcgtcgcggcgtcgacgtgcagatagtcggtgctgacctgcggatactcggcggcgacccggtcgaaggtgttcttccacaggtggccggcgtagacgaggacgttgttcttgtggaccagcgtcagcttcttgcgcgggcgggccgccgcacgctcgaaggcgtcccggaccacgcgctcgacgccgtacgccgtgttgaggctgacctcggtggcgacctcggcgggggtgccggtgcgcagcgagccgccgttgccggtgtacggaccctcggtgccctcgcgcacgacgacgaagtcgatgtcgggacggccggcgagcggggtcgcggtgttcgggaagagcttggagggccgcaggttgatgaagtggtcgaaggcgaaacgcagcttcagcagcagcccgcgctccaggacgccggacggcacggacgggtcgccgatcgcgccgaggaggatggcgtcgtggttcttgagggcttccagctccgcgtccgggagggtgtcgccggtgcggtgccagcgctgggcgccgaggtcgtactccttggtctccagcttcacatcctgcgggaggacagcgttgaggaccttgaggccctgggccacgacttcctggccgattccgtcaccggggatcactgcgagatcgatgctgcgagacatgcgggaagcctaacggtgcgtcccaccccatgacatccggcgtccaccatacggacggggcgcaagggtgttcggtgtacgggagggcggaggagagtggcgcgcggacgggcggcggccccggctcagtggccggtcgagccgccgttgtcacggcggtccagggcgcgctggagggcggcggcggcgttcttgcgctcggcgtcggcctggcgggaggtgtggcggacgcggcggacagtggtctcggccatggtggatcgactccttgagatcgcgtggacgtcgacatcgggacgcgggccggtgcctgcggacaacacggtgtcgagcggtcgggatcggatttcgaggtgccggaaggggcggggagcgtacgccgcaggggttgcctgcttcggggcgtgcgcccgcatccgccggtcgctcgatcgagcgattcgttcggctcctaccaagttaggacagtcgggccgtcctgtctccacagttactcggacttcctactatctgagacggccggcgactcggagcaggccatcgggccggaacgggtcacccgctcagagcaggtcgccctcccgccagtcgaactggagcgggtggccgggcccgggcagcgggcgtccggccgcggggcggacgtaggtggtgccctcctcctcgggcagcggcacggggccggccgggccgagggcggtgagccggcccggccacacctgccagccgcgcgccgtgtagagcggcgcgccggcgtcggaggcggacagggcgccgaagtcgtaggccgtgtcgacgacatgttccagtgcggccatcacgcggtggccgtgaccttcgcggcggcggtcggcgcggacggcgacggcctcgacgtatccggcgcggtaggaacggtccgcgtgcaggacccggcgctggacgaggctcccgtgggcgatcgggccgccgtcggcgtcgcacaccaggaccggaacgccgtggtgctcgacgatgtcaggcatggtccgccccctgcgtggacgtggaggtgaacaggccgctgtccgggcccagcaggccgtcgatcatgtggagcagatcggcggtggcggcggcgccgccgagaatgacgatcttcatccgggttcgctccttgtcgtagaccgtctggatgcgcagggggcccgacgcgtcccgcgcggactgcgcgcccgccgtgacgaacgtgctcagtcggtgcgcggcgtccggaccgagcgcgtcgatctgcacgatgctggacacctcgacgtgtcccggcgcggatgccttttccggggccgtgtcgtcggccggccggccggtcagggcggccagatccttcttgttgatccggtactgcttgccgatccggacggccttgagccggccgtcgcgtacgtagttccggacggtccgcacatgcagccccagcagttcggccacctcgccgaccgagtagagctcccgctcgtcattccccatagttctgcatcctacgctaaacagtcctttccagaatccactacgcgagaataggggtgtttagggaatgtcgcggctggtgatcatccggtccggacgtactcggcgtgtgcgacgaagccccgggtagcaaggtgggaaacgaacgccgcccacggacaaggaatcccatgaaccccgaatcccggcagcccgatccgcggcatcagcgacccgaaggcgtgaccgacgcgaccgtcgaggccctcggggccctgtcgaaggcgctggagaccgccgagcgtgcccgcggcgccctctacgactttcatcagctcaccgggagcgccgacctcgcgctcgacgacgccgtacgactgctccgcgccgcggggcacggactgcacgccgagctggtcgaacgcgagatcctcggccgcaacgtgattcccgggcactggacgttccagatcgtcgaggagtacaacgccacctactacgacgtgttccggacgatcgaacggcagatcagactggcactcgccgagggccgcgaccacctctacgaggccgagatgaaggcggcccggcggaccgaggggcatccggaccacaccgccgaatgacggcggtcgccgtcatcccgggactcgctctcctccgccgtcaccgaacgtagccacacgagatgcggatcggaccttctccggtgacgctgggtctccggtcgcgcgcgcaacggttgttgccgacggacgaccgatgacggaggacaccccatgaacccgtacgacaccccggtggagcgagcccgccgcatccgtgaacgcgccgaggaactgggccgcgccgccgaccgggccactgaccccgagcaccggcagcggctgcgggagaaggctctgcgcctgctgcgcgaggattccgcgaccgactcccgcccttcctaaagcccgttccggggatcctgccgctgctgcgccgggccgcggacgaggctctgctcgggttcaccgacgcggatctgcgggagcaggcggaggcgatccggtccggtgcacggtacgtgctgcgggtccgcgtcacgtagaggtcggggcggcggcggtggtgcgggggagtggtcggcccgcccggtcgacgtgcgaagggcacccggacgggcttcactctccaccctgtcgcccgcgcagcgatggcagcatgccgcaccgcccccgaactcgacgctccggccgggtcgctcgtggtcgaggctggtgcggtgaatgtctgcggggccaggcgactgtgccccgtggcggctgcgtaccgcaggtgcggtaggcagccggggtgtgcgccacccggatgtgaccgggctgatcgacctggtggtcaccctgcccgccgtcctgcggcaggccggacacctgctcgggccggcacgggtactgggcctgtacgggacgcccccgcagctttcggcgcccgctggacgggacgctgaagaacgccgtgcgcacgtacgtggcggccaccggtctggagagcctgcacggcctgctggtcgactgtaggagacgcgatttcgtgagcgttgctccctgcgaaattacctgaatccgcgtgtgatgagcagtgcgaggccctggtccgccaccgcaacgacagcatcggctcgccattgccatgtgagcggggagcacccaccggcagacgctgcactcccagcagcacaccccgcccctgcgcactcaactgcggagattccctacacctcacagcgggacgccatcgggcgccgagcacagtgccgttctcggagagcggttcgtactcgacgggcgtgctgtcacccgtgcgagctacacgcggatggcactgcggggtgacgcccttcgggatccgagttcttaggattttcaggctcgcggatgttgaccgcgctgattgaggggacgttcatgagaagacccgggtggctgaccgcgctcgtcttagcggtgacgctgatgacggcggggatggcggaaccggccgaggcggcgggggaggcttgtgccacggctggatcgaacttcgccggccagccgatcgcagagagcacggcggcgttgcggatgggatgcgcccgcgacgcgggatcgctgcggccgctggcgggcagtgacaccgacatggtggccgccatcgacttcaacaccgcgcagcggccggacgcgtggcagcagcagatgtcgcagatggtcgacgcggtgcgtgccgacaagggcaaggggttcacgctcagcgagtcgttcgacttgcaggcgcagaagaacagcgtggacttctacgacgggcaaagcgacgcccggttcgacggcagtatccaggtcgtcggcgacagcctcgtcatcgtcatacccgcgggcgaggtgaacgcttcggcgaactggtggcagaagatggtcgccatcgcggtcggcgccgcggtgtttgtagtggcctatcaggtgtgcgaagtctccttcggtcccgccgcgcctctcgccgtaccgatctgcacggccatctcttccggaatggccgggctcgtcggtgacctgatcaactccctcttcgacgggcggtcgctgggcgacgcggacgtctgggctgaggcgatcgccgtattcgtggcggccgcggcggccgggtggggcgcgttggaacgcgagaggctggtggaatgggcctcgaaggggtttacctgggtggtcgaagcggtggggaagaccgcgcggaacctcagtacccggctcggctcgttgaagtccccgatggagtacatcagcagcctgctcaacagtgccttcgcggagagggtgaggtcggccatcggccgagtgttcggaggcgggcgagccaccgcttggccgtcgacgatccgggtgatggtggtcggcgactcgatcagccagggccacgagggtgactacacctggcgctaccgtttgtggcagtggttccaggagaacaacatctcggtcgacttcgtgggcccctaccacggcacgttcacccctgaccagccctccccgccgaaaccgccgctcttcgtcggtgagaagccggcggaccagggcatccgcgtggacggcggctacgcggccggggtcgccttcgacagcgaccactacgcgcactggggcaggcaggccgcacagatcaaggacgacatccgcgggcaggtcgagacctacaagccggaccttgtcctgctcgcggccggcttcaacgacatgggctggttcgtcagcgacgagaacggcaccctggacagcgtcgagaccatcatcgaccaggcccgcgcggcccggccgggggtcgacttcgcggtggctaccgtgccgcaccggtcgaagatcggcggccgggacgatctgatcgccaagaccgacaacttcaaccggcagctcgcgaacgcggccccacggtggagcaaatccatctcccaggtggaggtcgtcgactggcagaaggggtactcgtgcgcccccgccgcctgcccggccgcctatgacggcctgcaccccaacgccttcggcgagtaccagctcgccatcgctttcgagcagacactgcacgaccggtacggcctgggccggggcccgatacccttcccgcccgagaacctgccggtccggccgacacccgtgccgaccggtctgaaggccgagtccagcccgcagggcgtgaccgtcacctgggacccggtgtacggggcgttcggctacgacgtgcggtcgcggatcgccggccagagcacctggagcgagggccgcgtcaacagcaaccggaccgacaccacctggaccgtcgacggcatccagtgggagtaccaggtgcgcaccgtcggcggtgacaacgtcaagggcccctggtccggcacggtcagcgcggtcgcccacccgaagacggcaccgccgccacggatcctagccagccgacccatcggcaaggacggcatcgagctcgaaatcgcaccacctgactaccccaccaccatcgaccggtacgaattgatcctcttcgacaaggacactcccggcgcttggctcaccggcaccggcttccgcggcaaccgggtgcagatctacgggctgaacccgggccaccgttaccttgtcgcggcggccacctggaatgccgccggcggcgggttgcccgcactggcccggccggtgacggtcggcggcggcatcccggccgccccgaccgacctgcgggtgaccaccgtcgatcccaccacggtggaactggactggaacggcacgaagccggcggccggctaccggctgtgggtgtccaacgtcaaggacggcggcaccaccccgccggaggccgacgagaacatcatcgaggacacccactatggcgtcgggttcctgttcccgggcgtgtggaacttcgagttctgcgtgacggccgtcaacggctccctcgagtccgacaagtccaactgcgtcatcccctcccatcccgacggcagcgcgccgaccaaccccggcggcagtgcgctgaacctctcaccgaacgctcgcaccgcgtcggacacggtggacatcggttcgctcaccaccctgaggaacccggacggcacgggaagccccgtcgcggtcggtgtcgggatcaacggaggtgatcgctaacccggcctcggtgtcctgtggtgctgccgcgcacgcgacagcaccccaggacaccggtagcggatcacgaccgcgaaggcgaggcgggcccatcagcgcggtgagcgaggctcgcatgctgggcgggccggcgttgtaggtgtcgttgatgactcggctgacggttcccgtacattgccctgcccttcggcatctccagaagggcggaaggtctcgctccgcaacttcagtcaggacgccttccctcgacgagggccatccctgtcgagagctggagacaaaacgctgcgctgacactgcagttgggatcaaatataggtatgccccctacgcccgcccgtcgcgcccggttacgccgtaccacccgcctcaccgcccggaccaccagccggccgtcgacccctcctgctcctgctcagggtgaaggtggggagggcatggactgggcgcggcggatcgagctggtcactggcgtggtcgccgccgcggtagcggtcgtgggtctttggtactcgaacgttcagaccaggcaggccaatgaacacaacaagcaggccaatgagcaggcgcgggatgaccgggcgctggcgaaggaggggcagatcaccgaccggtacacggcggcggtggggagggcgtcaaactccccaacgtcaccctcgacttcgtcgattccatggcggctctgcaagacgcggatctgagcggtgcggatctgagcggcgcggacctggccggcgcgaacctgagcagcacagacctggaaggggcgaacctggctggcaccagcctggccagcgcagccgcgggggccgcgggcggttgctgaaccagcaggccgggacgccgtgatggcgcgtccgggccgcgatgtccgtatcgcacgtgagctgggctgtccactcgtgttggcgaggcccgcggctcttgcgctcctcgaacgaggggcctgcggccgatccgcccctgctcggctccagtgttgcctgcctgtcatggtggtgatgtcaccccggcgtagattccggacggcgcggtgagactctcggattgtcgtacccaacaggttcaatggagccggcgagacgaccgacaggagcagcgcgcatggagtcaatcttcttctcaagtcctggggagttccgggactggctggaggagcaccacgcgactgcctccgaatgccgggtgggcatgtggaagaagggcgtgggcaaacccactctgagctggtcggaggcggtcgaccaggccctgtgcttcggctggatcgacggtcggcagagtccgatcgacgacttctcctggtcaatccggttcaccccgcgcaggccgcgcagcaactggagccaggtcaacgtccgcaagatcgaggagctgaccgcgcaagggctgatgaggccggccggcaccgcggtgttcgaagcccgtgaccgggagcgtgaggagaagccggtctgggagttcgaggcggcgcagctggctcgcttccaggccgagccgcaggcctgggagtggttcagcgggcgggcgccgtcctaccgcaagtcggctatccactacgtgatcagtgccaagcgggacgagactcgcgagcggcggttggatcagctgatcgccgacagcatggagggggtgcggctcaagcagttccggcggccgggaacctgagagccctctcgaaggggccgatagcgtagccgtccagcgcgggacctgccgttccaggaacccgtcgtgcttgccctttcggagcccaagcacacgattggcgatggacaccgccacccacgaggcaccagccgtcaccacagcctgcaccgcccgccgcgacctcgaccctggaagctcgccgagcgcgtggcgatgccagcccggcacgagagggctcaccgcccacccgcagcgagccaggccggcgtacccgccgctcgtgaccaggtgactgaaggaaacagaccgacccacgctatgagctcgtaacacgatcttgttgcaacggcctggcaggccgtgaccagtccgaagattcggccgttcgtgaggtgtgggtagtcaaccgtggatcatggacgatgagttgtgcgcgttgatcgagccgttgctgccgccgtggccggagcggacgccggggatcatgccaaggctacgagggtgagtctgctgcacgacgctgtccgcgtcgagtccctagccgtgttgtcccagttccgggccgacctctacggctgcctgaccgctcgcgcggacgcgttgttcgagctgacggacgcggtgctgtgcacgtgatcatttgctggacaggcgaaggtcgtcggaccaggtctcaccccggacacggccggagtcgaaggtgatctccggcgcgatccgcccgctatccgggacgctctcttcgctgactgccagcaccatcctgccgagttgatccgcgaacgggtctcgccgttgatcggtgccacctcgacgcggcctgactccgccacgtcgtatcccgcgaaggggccgatgcctccacgatgaggcaccagtccgaaccggtcgtgatgcgtgtggcgaccgcttcgctgtcgatcagccagacgtccagtaaaccggacggcgcctctgggtcatacagggccacgaggcgactacttgctcaagacggcgtccgaccagatagtcaggacgcacgccgacatcgtgcgacgggcactcgctcaccctcttcgactccacctgtcgaccgtaccgtcaggcaaacccccggctcacgcccttatacgggacagcccttaggacttgtccggccgatcatgcggcagaggcagatagaaacacccgtcttgcctgcctgctgaggggttacagaggcgccaactccaccctgcctgtgaatcgtccgtccacttgagcggcgagccagtggacgcggacgatctggtcaccggtccgatcccggacgtggacgtggacggtgtggtcctgcgatggttcgtcctggtagaggtcccgggaattcacggtcagcgtgaggtaggcgtacttctgcgagatcgcttccagcccggcttcgggaaccgcaggccatgcgttcagatcccatcgaacagctgcggggtccgaccccaaagcggcgacgaagggctcagcgcggtccagtggacgcccccagtcgaacactcggatcggcagacagtctgcagggttgtcgttggctttcgaagacccatgctgttcgccggccaacgcccaccattcgaggtcgggcagtacgtgacgtacgtgcgtcaggacgtccggcgacctgatcacggcttcgaagtccacctctccctgatcgatgtctgccatgcccagcaaggtacgcaccacacgtatcgcttcagataggtcggtggttgtgaggaccgcagccgcagcagagttactcattccggaaccataagacggcactcacagaccggcccgagcgggtgctgacctgcctcgcatttgttgtcaggaccggagccatatggcaagtaacgctgcggtgacagtgccgaggaagacgtaaccgcgcttgtcgtaccgcgtggtcaccgctcgggactgcttgagtcgattgatcgcccgctcgacagtgttgcgcttcttgtagcggtcctcataaaagccgggcggccgtccaccgcgtgcacccttgcgccagccggccgcctggctgtcggccttctccgggatggcgtggcggatgcccctccgtcgcaggtactcgcggatggggtcgttgctataagaggcgagggcctgggccgctcgcgcggtgggttcaccagcaagctcacctgagtgcggacggccgctgccgtccgctgtccctggtcgtgactgcaggtcagcggcggactgcacccagttcaagccggtcctggagaagatccgggtgcctagatctggcctgggcaggccgcgcaagaagtccgacagccttgcagccgacagggcccgtttttgccctggtgccagtcgccgccgtgggcgttgtcagtgggcgagggcacactgatgtcatgagcgtttcttcgtctcccgaagcccatgcgtcctgcgcctcccctgtctgggtggagtcgatgggcgggccgttgatcgccgtccccgtctccgcgttgggtgcatggcgtgggtgtacggagaccggggtcatggtgggggacgccaccgctccggacgactacgaccgggcctgcgcggtggacggcctggctggtgtgatcaccgttggcgagaacggtgcgcaagcactggtgttggcggacgagccagccaccagttgttttctacccgagcatcgagccttcctgcggtggcttgcggctgactccgaggccgggctgaaggcggcggccagggttgttctcgcaaaccccgccactgagtgggaggagtgcggcacgtggtcatcggacggtccagtcacactcatggactctgccgaagcaggttccgcgctcgacaccgagtatcccggaggcgggatgccctcccaggcgccggttgcgctgcccgccggccgctggagggttcgagccacccataccaaggcggacgaagagaactgggtcggcctggtccagatgctgcccatcgcatcttgaacggtcagctgctttggtcgagtgcggtcacgtgccgagcgcaaggttgtgcagatgggagatgccgagcaccgcgtggtggacgacttcgcctttcaaccggcagtcgcggaggatcttccaggtcttcatccgcgcgaaggcgtgctcgccgcgggcgcggacctgcttgtgcgagcggttgtgctcttgcttccaggtaggcaattcctcccccggccgccgacggtgtggcatgacgaaaccagtgccgggacagccgccgtcggcgacggtcataatcttgccgacggcggccttcacaccggattcttcccatgcctggccgccattgcggttgcgcggcatgggccggccgaccagggcctgtgtgaggtcatgatcagtgagcttcttcgggctaggcactgtccggcggatcatgtgactttccgaccggttgctcgttggttgggtcatgggccggggggatctgacgaatcgcgagtggtcgctactgaatccgcatctgcctttgccgggtggtcggggcggtcggtggaacgatcaccggactgtgctcaacggaatcctgtttcgggtccgtaccggtgttccgtggcgtgatctgcccgaacgctacggatcgtggaagaccgtctacgagcgccatcgccgctggtcggcagacgggacctgggaccggctcttgcaagcggtccaggccgaagccgaccttgccgggcggatcgactggggcatggtcggcgtcgactcgacgtcctgccgggcccaccagcacgcggtcggcgcccgcaagaccaggccacgggtcccgaaaaaaggacgacgctccggcaccaccgccccgacgagggactcggacggtcccggggcggcctgacctccaagatccacctcgccggtgaaggcggctgccgccctatggcgcttctaatcactccaggtcagtggggtgatgccccgcagatgatcgaggtcctggaccggattcgggttccccgccggctgggcgggcggccccggaccaggcccgatcatgtcagcggcgacaaggcttacagctcccgccgcaatcgccgctacctgcgaaggcgccgcatcaagcacacgatccccgaaccgaaggaccagcgggccaaccgccgccgcaaaggcagcgcgggcggcagacctgccggcttcgaccgcggccactaccggcgccgcaacgaagtcgagcggaccatcaaccggctcaagaactcccgcgcggttgccacccgttatgacaagagggcctacgtcttccacggcacggtcaccgcagcggcagtccgcttatggctccgcccatgatctgccagagggccctaagtcaatgcctgccaaccctgcgtgatctcttcgtggacggatctgggattgggcacggtgtttcccgggccgtgggtgagcagggtgagcagtgcggtgccgtcggccggacggtccgccggttgggtgttcagggcttgcaggaccactgcggctagggcggggtcgatggctcgtagtgcggcgagggcggccggttccgggccggtctcggtgatcttgcggtacaccgcgccgatgctggtcgcggcgaacgggctgtccccgtggacggcggcgactacgcagcaggcccacgcccagatgtcggaggccgggccgggctgggcttcgtcgaactgttccggggccatgtacgtcagcgttcccggtgaaccgccggtgcgggtgagtcgtgtccggtccacgatcgccgcgatgccgaagtcgaggaggcgcgggccgtcgctggtgagcatgatgttgcccggtttgaggtcccggtggacgaggcccagacggtggatgccgcccagcgcagtcgccagtgcgagggcgagcgcgcgcagggcctgcggtgcgcggatcgggccctgttcgcgcaggtgggcatcgagggggcggccgtcgaggagttccatggccaggaagggccgtccggcgtccacgcccgaatcgaggacgcgggccgtataggcgcccgagaccatgctcagtacctccgcctcgcgctcgaagcgggtcagcagatccgcgtcgtcgaggagttcggggttgatggtcttgagcgcaacctgtgtggcggagcccgcgcggcgggcggcgtagaccgtgcccatgccgccggctccgatcctgccgagcaggtggtaggcgccgatgacctgaggttcgtgcggttgcaggggcgggaaggcgtgaaggagttcctgggacgggagaccggtccggggaggggtgtccggcgcggcggcaacggacggaacgtgccgagtgtggctgggtgcagcgaatgccgggggcgcggcggcggtggccaggggctggtgtcgggaggccgcgacgaaggcgacgatctggaacaccgcggccgccacggtcacgccgatgggcatcaccgtgaccaccagcagcagccacaggacgaagccgccgatgatccgggtccgcgtacgcggtgagtgccacaaccccgcgggcatacccaccgtcagcaacttccgctgcgtgagcgtccagaacaccagcaccaagaccatgcagaggagggcagcgccagcctcttgctgataaagggcgaggtccaggccgtctcgctccttcatctcgaagatccagccacccacgttgagggggctgcttggccagggcgcggtcgcgagggtccgtacatcgacgggcgcgtcgatgttgggcagaagcgccgtcagtacgagcgcgcacgccaggaccagtcctctgtcgaagagggcattcgtccagttcccaccgtcatctgtccccgtgaaagccgcagactcccgctgcctgatcgctcgttgaaaacgattcagcagcgggagtgcgagcatccgtacgatcagcgcgcaggcgagaatgcccagcaccgctttgatggcgtacccgtcttcgtgcattccgcccccgtctcaaccatgcctctgaccggcggagtatagagggtccacgtgacaagcagacccggacttgtgacgatcacaagagcgtccccgggctccctcagtagcaatgccaacagcgcagcgagcgacctgcaccctctacattgctactgacccaggagtaccagccaacacgactacaagttccatgatccgccggacaagccctagcccctgatcgggtgaccgctgcgaggcgtaacaagcgaggtcctcgcgctgttgatcgagatgtctgacgtcccaaccgattcagcctggggcctcgttggtcatctactctgccagtctcgagctgcctcatgcgctcgtggagcgggtgacgatcatcatcgtcgctcgtgagggcgaccggcgatgcacatggcgcccgtcccagcgcgcgatggtggcgttggtgtacctgcgcgagcacaccaccctggccaagatcgccgccggcttccgcatcagcgagtccaccacccacgcctacaccaccgcggtcatcgatctgctggccgaacgggcacctggcctgctgaaggtgctgcgggaaagcgattcggacttcgtcctgttggatggcccctcgccgagtgcgaccgcgtcggccgggccgactactccgccaaacaccgccgccacggggtgaacgtccaggtcgcgcctgatccgtccggccagttgctgtggctctcgccggccctgcaaggggcagtcacgacctgaccgccgctcgcacccacaggatcatccggatctgtgagcgccagggtgtcccggtccttgccgaccttgcctaccagggcggcgggccctgggtcaccacgggcatcaagcgtcggccgcaccacgacctcactccaacagcccagaccctcaaccgggcgctagcttgcacccggttgagggtcgaacgcggtgtcgcccgcctgaagtgtggcgaatcccccgtcacacccgatgcagtccgaaccgtatgacgtcaatcgccaaagccgtcctcactcccgagcggcaccgctgacgaagctcgatgaacaacacgaagatcgaggagagcgtggggtagggcgatgcgtgaccgagcgctacagctggctgacccggtcagccacaacgctccggactcaccacggctctccgggtcctatgacagtgagtcccacctgttcggcaagccagtgtgcgtacggctctcttacctcgcggccgtccatgcagacgctacggacgtgaagcaggacggtgtgatcgtccgcgggctcgtcgagctcgcgggtgcgtgtgttcaacaggagcgacacctcggcatgcttgcgctcgccaaggaaatccagttcaggtgcatccggccagcacagccactcccagttgatccagcccctgctcgggccgatcgcggctgcgaagacgtcctcaatgcttccgatcggcagaccgtcgagctcgcacttcaccggcagccgtccctcgtacaccgccggatcgttcggcaggtcaggccctgcgaggccagccaccagcgggggccactgctcccgtggcactccgtcgacctctcgatagtcaaaatcccccgcgtagtgtccttggggcagcttcctcgccatccgctgcacctcggcaactgagcagagctcggcatacacggtgacccgggagtcctcgcggcttccgaactccatcagacggcgcgcggtgttgagagccaggtcgaggtcgggggtgcggaagacggggtaggcgatgtcgttggacatgcggcgactgtgccacaacccgtcctcgcaggtggcgggatttccgccccgaaccgctgaggcgcccacagggccacgatcaggtggcgtcgctgaagaggctccgtacgtgcattccgctcccgcgccagggcggatcgcggtagaacgctgctgtgacgcgccgacagattgacgatgaccagtgagagctcatcaagccgtacttgccgatcggcgagtacggcccctacccggtgaaactgcgggaccagtttgagggtgtgatctgggtttccggtccggcgctcagtggcgggagatgccgtccgacgccgacgcggagctcgcctgaaacaggccttgctcgacagacccagaggcggcccgacatgcaaggtccacctcgcgtccgaccgcagatgccggctgctgtcgatcgtggtgaccgccggacaggccgccgacagtcctcagttcgtcccggtcctgaagaaggtccgtgtccggctgcccgccggtacgcccgcggacccggccggccacggtggccggggacaaggcgtactcctcccgcgccaaccgcgcctacctgcgcagacacggcattaaggctgtcatcccgaagaagaatgaccaggccgccaaccgcaagaacagaggcggcaggggcggcagacccgtcacccacgacgcagacctgtacaaggccgcaacaccgtcgagcgcatgatcaacatactgaaggcctggcgaggcatcgccacccgctacgacaagacccccgagagctacgacaccggcctccacctcagggcctccatgatctggatcaacgacctcacgccggcggccggatgatcacggccacctacaaggcggtcatgcgcctgccgctggcgacgtgacggccgcgaactgttgtgccgtcgtgggataagcggctaggaagggaaaatgacgtgcgcccgcgctgtgacgtttcttcgtccatgaaggcggcgtcaagtcatcaattcaagcgattcatttccctggatgaaaagtcgatactgtttctggcgtcgcatcttctgttagggcgaacccttcttgctgttggctagatgcgccgtatccgaacgctctcttccgggcgctggatctcctggaggagagaccatcgatcagaaatgagtacgtcgtgcaccgattgacttccatggcggtggctctcgtgacaggagcgtcagcgctcgcgggactcagctcttcaggtgcgtgggccggggagcccgcaccgtccggcatcgtcaccctcaagaacgacgccacgaccaactgcgtcgaccacgaccccggctggagcggcgtcatcacgcggaactgcaacggtgggaacaatcagaggttcgaggtactgccgggcaggacggagggttacttcctcctcaagaaccttgccaccgggaactgtctcgacaacgacacgaacgagggccacatcatggcccgaggctgcaacgtccagaacggctaccagaactgggcccaggagggccggatcgtccgcaactaccagaccggtgcatgcctcgacgacgaccccaaccacaggtacctgatggcacggggctgcaacggcggcggaaaccagaactgggaatgggttcggtaggaccaggttcggaacgataggggaccagcaccggtcgcagcccgatgaaattcggctgcggcccgtgctcaattccctccaaagtattctctggcggccgggtccgcatacacctgcacggagttctgggaaggcatttccatgacggagcagaacaatgccgaacggcccccgacgtccggcacccaggacaccaccacgcccccgcacagcaccgccgcaggcccggtccccgcgcccgagacgatcgacctgctggatccccagctgatgcgcgaccccttccgcgcgttctccccggtacgcgaacgggcgcctctggtccgcggtgtgatgcccggagtagagccgatgtgggtggcgacccgctacgacgacgtgcggcaggtactgtccgacccccggttcgtcgtcgacccggcccacgtgcccggcgctgaacccggccaccgcatcgaacagctgtggcgcacccgcggagcccgcgccgaggacgcgcagtacctgcgcgcatccctgttcggcaccgacggtcccgaacaccaccgcctccgccgcagggtcgtccgggcctttaccgccggccgcgtcaaccgcctgcgcccccgcatcgaacacatcacccacaccctc

SEQ ID NO: 2729 - DNA, 18155 bp, Unknown
  Kingdom: Bacteria, Phylum: Actinobacteria, Class: Actinobacteria, Order: Streptomycetales, Family: Streptomycetaceae, Genus: Streptomyces
gagcgcggcctggacggcggcgggagccccgatgccggccggaccgtccgcgccctcgacggtgcaggtgattccagcggcctgcaacacgccctgcgcacccatgagttcggtgggaaggtcggcctcccggtagccgcgtacgacatcgcggacctcctgctgggaggcgcgggcgatccgctgcacctcgaccatctggtccatcgccgcggggttctggcgctgggccagctccacggccagctcgctcttcagggcgatcaccgacaggttccggccgagcacgtcgtgcatgtcccggccgaaccgcagccgctcctccgccaccgccagccgggcctgcatgtcccgcgcctcctccgcctgccacatcacggacaggctccagacgctgggccgggccgagacgagcaccagcagggtgacgacgaccagcgagacgaccgctccgaacagcagcccgcccggcacgcccacggccgccaggagcgccacgacggccaccgagaaggcggcggcgtggagcaggaacttccggaccgggacgatcaggacgtacgggatgccgaaggccacaggcaggtccagaaccagcagcacgagcccttcgtccttcacgcctcccacccccgcgagtgccaccagcaggccggtcatcagcacctggagcgcggcggggaggcgcaaccgcccaggcgggaacggctccgtcccccggtagtcgtcgaaggcgggggtcagattgcggttgctcagcacggactgggcgatgttggcggcgaggaacgcccctcccagggccatcgccaccggtccctcgtccagggtctcgccgagcggcagcagcccccaggacaccgcgaagaaccaggtgatcgagcagagcgtcacccgcgtgtagaggtcgatgcgctggagcttgctgcgctcgtgccagccgcgccgccagccccgtacccgaccgatcacacccctcagccccttcatgtcagccgcgcgggtcccaacggaaccaccgtcgcacagcaaacacgccgaaagcggtccaggccagcgcggtcaccccggccgtgagcaggtcgccgctctccacaccgccgagccagccgtgccggatcagggtcatcacacccgtcatcggcagcagctccagtacggaggccagcttgtccggaaacaccgcgagcgggatgaacagtccggagccgaacatcgagacgaagaacagcggcagggtggtgagctgcgaggtctgcaccgtgcgggtgatcacggtggtcgccgccgccagggcggacatcaggacgaagcccagcagcagtccggccagcaggagatcggggcggtgcggtgcgctcaggtcgaaggcgatggccccggcccccaccagcagcacgcactgggcgagcgccagcgcgacggacggcagcgcggtgccgatcaggatctcgcggtcggagatctcgccggtgcgcagccgcttcaggacgagttcctcgcgccgggcgacgtacgcggagacgaggttcatgtagacgacctggacgagcaccatgccgatgccgccggtcagggtggcgcccgcgacggtgaggccggtgccgccgagatcgatctgttcgagcgaggaccgcatcgcgaagatcatcgtgagcggcagcagcagggccacgacgatcgcggtccggttgcgcatcaggaggatcagctcggcgcggccgagagcggtcagccgccgggccacggccgccgcgcccgtgggggaggcggcgggcgtccggtcgcggacgggggtcgtggtggtcgtcatgccgtcaccttcttcgtgccgcgggagcgggtggagcggtccgggacctggcgcgggtcctggtcccgcggcgcgtgccgggtcttcgcgatgtcgaggaacgcctcttccagggaggcggagcgggcgtcgaggccgtgcagccgtacgccggactcccgggcccactccaggagttcgtgcagcgactcctggagggagggggtgcggatctcgacccgggacccctccgccgcggcccgcagcgagagcgggaggtgcgccgccggcacggcctcgggcagcacgaacctgatcctggcgggctgctgcgcggtcacttcggcgatggtcccggtcgtcacgatcctcccctgatgcatgatcgccaggcggtcggcgagcgcctcggcctcctccaggtagtgcgtggtcagcagcacggtcgtgccgttgtcccgcagcgcccggacgagctcccaggtctcctgccggccctcggcgtccagcccggtcgtcggctcgtcgaggaagagcacctcgggccgggacgtcagggcgagcgccaggtcgaggcggcgcttctcaccgccggacagctgcttgacccgcacgtttccccggccggtcaggccgaccatctccagcgcctcgccggccgggcgggcgccggtggtgcaggccgaccacatgcgtacggtctccatgaccgtgaggtcggaggggaagccgccttcctggagcatcaccccggtacgggggcggacggcggcgcgttcgcggtacgggtcgtggccgaggacccgcaccgagccgccggtcggcggcgccaggccttcgaggagttccacggtggaggtcttgcccgcgccgttcgtcccgagcagggcgaacagttcgccgcgggccacggagaaggagatcccggacacggcctcgaatccaccggcgtaacggcgccggacctcgttcgcctcgatcacgggaccgtccacgcggtcgctgagaatgtcgtcgctggtcatgcttcaaggtttccgccggaaccggcccgggagcagtgcgcgctgtcaccactgctcatgacaaacctcatgagggcggcgggatgagagaggcgggagcacgacaaaggccctgaccgagaaggtcagggcctttgatgctgagcggacgaccaggttcgaactggcgacctcaaccttggcaaggttgcgctctaccaactgagctacgtccgcagtgcagccactcggctttcaccggtggagcgagcactactctacccgatccaacgaagtggtccgaagagtcgtgcagagcgggtgacaggaattgcacactgcgccttccccctggaagggggatgttctactactgaactacacccgcacgctgcgtgggattcggctttgcggcctcgcccctcggcgtgctccagactctagccgacccgcaggggtgtcgcgcaagtcggctccccgcaggcctcgcgggacgggtcccccggcccggtcggcggggcgtccggggccgcctgacggagcgtccggcttcccgggtcgcggcgcccgccgggctcccggcgtgccgccggtccggccgggcggaacccccgcggctcaacccgccgcgtcgaacgcctcgtagaccttcttcgggatgcggccccgggccggcacctccatccggtgcgagcgggcccaggcgcggacggccgccgggtccggagcgagggaggtgtggtggtaggtcgcgggcgtcctgccgtgcttgctggcatttgtctgctttcggccggcagccacgtaaggagccagggtcttccgcagtttcttcgcgttggcgggattgagatcgatctcgtacgtcttcccgtccagggcgaaggtcaccgtttccgccgctgctcccccgtcgatgtcgtcggagagcgtcaccactacgcgctgagccacggatatcggtcctttcctacggcaccggcgcgtgtcgcgtgcgcggatgcctgccttccggctgccaggcgggcggatgtggatcgacgagatgtcgactgttccgttgtcgccggggcaatgtcgctttccccggtaatcatttgtacagcggtgggtgccgcattgtgaagcccacccaattacatccgcgtgtccgtgtgcaatccgtgtgcaatccggacgcgatttttccagaccttttcccgcacggtgtcgcggccgatatctcggcgtgatctgcgcagggcgcccgccgtgtccgtcccgtccgatatctacccgcgtagaaattttggccaggtacgctgagtggacccgcgggggtctggggaaccccccggagagacagccgcaccacaccaccacaccgggagtgccagtggcacgcgtcgtagtcgacgtcatgctcaagcccgagatcctcgacccgcagggacaggcggtgcagcgtgcactgccccgtctcggcttcgagggaatcgcggacgttcgtcagggaaagcgtttcgagctggaggtcgaggggccggtcgacgacgccgccctcgcccgtattaacgagctggccgagaccttcctggccaacaccgtcatcgaggacttcgtcgtgaaggtggaggaggagaagtgaccacccgtatcggcgtcgtcacttttcccggcaccctcgacgatcaggacgccctgcgcgccgtccggatcgcgggtgccgagcccgtatccctgtggcaccgcgacaaggatctgcaccaggtcgacgcggtcgtcctggcgggcggtttctcctacggggactacctccgcgccggcgcgatttcccgcttctcgccggtcatggaaaccctcatcgagcaggcgaaggccggtatgccggtcctcggtatctgcaacggcttccagatcctgaccgaggcgcacctgctgcccggcgcgatgctgcgcaacaaccacctccacttcatctgccgcgaccagacgctgcgggtggagaacgcggagaccgcctggacgtcggactacagcgccggccaggagatcagggtcccgctcaagaacatggacggccggtacaccgccgacgagcacacgctcgacgagttggaggccgagggccgtgtcgccttccgctacctggacggcaaccccaacggctcgctccgcgacatcgcgggcatcacgaacgccgcgggcaacatcgtcggcctgatgccgcacccggagcacgccgtggagccgctcatcggcaccggccgcaccgacggcctcggtttcttcacctcgatcatcaagaagctggtcaacgcatgagcctggatacggtcaagcacgcggccgagaccccggacgccgagcagccctggaaggagctcggcctcaaggaggacgagtacgcccggatccgcgagatcctgggccgccgtcccaccggcgccgagctcgccatgtactcggtgatgtggtcggagcactgctcgtacaagagcagcaaggtccacctcaagcagttcggcgagaaggtccccgccaacgacgcgatgctcgtcggcatcggcgagaacgccggcgtcgtcgacgtcggccaggggtacgcggtcaccttcaaggtcgagtcgcacaaccacccctcgtacatcgagccctaccagggtgcggccaccggcatcggcggcatcgtccgcgacatcctcgcgatgggcgcccgcccgatcgcggtcgtcgacccgctgcgcttcggcgccgccgaccaccccgacaccaagcgcgtcctgccgggcgtcgtcgcgggcatcggcggctacggcaactgcctgggcctgcccaacatcggcggcgaggtcgtcttcgacgcctgctaccagggcaacccgctggtcaatgccggctgcatcggcgtgatgaagcacgaggacatccacctcgcgcaggcgtcgggccccggcaacaaggtcatcctgtacggcgcccgcaccggcggcgacggcatcggcggcgtctccgtgctggcctcggagaccttcgagtccaccgggcccgccaagcgcccggccgtccaggtcggcgacccgttccaggagaagctcctcatcgagtgcaccctggagatcttccaggagaagctcgtcgcgggcatccaggacctcggcggcgccgggctctcctgcgccacgagcgagctggcctcggccggttccggcgggatgcgcgtcgagctggacaccgtgccgctgcgcgactcctccctctcgcccgaggaaatcctcatgagcgagtcgcaggagcgcatgtgcgcgatcgtcgagccgcagcacgtggaccgcttcctggagatctgcgagaagtgggacgtcatcgccacggtcatcggtgaggtgaccgacggctcccagctggagatcttctggcacggcgagcagatcgtggacgtgccgccgcgctcggtcgcccacgacggcccggtctaccaccgcccgttcgcccgcccgtcctggcaggacgcgctccaggcggacgacgccggaaagctcgcccgcccggcgaacgccaccgagctgcgcgagcaggtcctccagctggtcgcctccccgaaccaggcctccaaggcatggatcaccgaccagtacgaccgcttcgtgcagggcaacaccgtgctggcgatgcccgaggacgccggcatggtccgcatcgacgccgagtcgaatctgggcgtggccatggcgaccgacggcaacggccggtacgccaagctcgacccgtacaccggcgcgcagctcgcgctggcggagtcgtaccgcaacgtcgccgcctccggcgcgaagccgctggccatctcggactgcctgaacttcggttcgcccgaggacccggacgtcatgtggcagttcgccgaggccacccgcggtctcgcggacggctgcctggagctgggcaccccggtcaccggcggcaacgtctcgctgtacaaccagaccggtgagacggcgatccacccgacgccggtcgtggccgtgctcggcgtgatcgacgacgtcaaccggcgcacgccggtcgccttcgcggaggagggccagctcctctacctgctgggcgacacgaccgaggagttcggcggctcggcctggtccgaggtcgtccaccagcacctgggcggcctgccgccgaaggtggacctcggccgcgagaagctgctcgccgagatcctcatctcggcctcccgcgacggcatgatcgacgccgcgcacgacctgagcgacggcggtctgatccaggccgtcaccgagtcctgcctgcgcggcgggaagggcgcccggctggtcgtgccggacggcctggacgcgttcacgttcctcttctccgagtcggcgggacgcgcggtcgtcgcgatcccgcgcagcgaggagctccgcttcaacgacatgtgcggcgcgcgcggcctgcccgccacccgcatcggtgtcgtggacggcgaggagatcgagatccagggcgagttcagcatcccgctgagcgagctccgtacggcgcacgaggcgacgatccccgcgctgctcgcctgagccgcgcgccgaccggcgcctccgaagcccccgcccgggtcctccgggcgggggcttcggcctttccccgtctccctgacgaacacgcttgtcaggggttacgtaattacgtaaggttggttccatggagctggagcagcgggtcgccgaactggagaggcggctcacggcactggagcggcaggaccccgggtccccccgcctgggcgacggagacttctgggcgttggacgggctgaaacagcagctcgccgaggtcggagaagccgctgccgacgggggagtgctctacacggggtcggtgcggctgcccaccggcgagagttacgagtggcagtacggcgccctcaccgaggccctggtcgacggggactgggcggacgccgccgaggcgttcgccgcgctgggccacccggtccggctgcgcctgctccgcgagatcctcggcggcctgaggacggccgccgaactggccgcgctcgacggggccggcaccaccggccagatctaccaccacctgcgccagctgaccggcgcgggctggctgcacgcggccggccgcggccggtacgagattccggcggtccgggtggtgccgctgctggtggtgctgacggcggcgcggccctgaagcagaagccaagcgggaaacagggggagacatgtctgtccgcacagccgtcgcaagggccctgcgcctgtcctgggcggtcctgatcgcgctgatgatcagcgagttcgtcacggatctgcccggacccgggtgggcgaccaccctgctgcccgcctcggtcgttctggtcctcatggtggcggcgatgacgctgcaggccagggccgccgcacccctgggcgagccgcggtccccggtcgaggtcgacccgccggtggccggacgatggacggccctgaacagcccggcggacaaggtgccgagccacgggacgcacgtgtacgggcagacgtacgccatcgacatcgtggccgagccggaaccggaggagggcggggtcccggcccgtccgccgttccgcctcttctggccggtcgtgcgccgcaaccgcgacttcccggccttcggcgccccgctgttcgcggtgggtgacgccacggtcgtccgggcgagcgacggccggcgcgaccacctgagccgcaattccctgcccgccctcgcctacctgatgctcatcgagggcaacgtccgctcgatcctcggcgcgcaccggatcatcggcaaccacgtgatcctcgacctcggcgagggcgcgttcgccgtctacgcccacgtgcggcgcggctcgctccaggtgaaggccggggacgcggtccgcgccgggcagccgctcgggcgggtgggcaactccggaaacaccaccgaaccgcacctccacttccacctgatggacggcccggacccggactgcgcccggggagtcccgttcacctggcggggcgtcggagtccccgcgaacggcgagacgttcacggtggaaaagcgggccggcgagcaggccggggaacgcgtcggggagcaggccgcggacgcctgaaccccggcggcgatgtcagtggggccggttagtctcgccgcatgcccccggccaagaagcgcccgcgcgcctacgaccacctcaggacccggacggcggtcctcgcccagttcgcccatgtccgctacgccgtcgctgtgttgacgcccgaccagctcgcccggccgacccggctcggcgactggacggtgcgcgagctcgtcgcgcatgtcgcgatggggctgagcagtgtctcccggtccgtggacctgccggaaccgcccgggcccaagcctcaggtcgccctgctggagtggccggcggcccccgccgcgcacgccgcgcggatcgccgaggacgtcgaggacctggcggccgcccgccccgacctcaccacgttgttcgaggaggcggaagcggggttcgccgacgccgttccggccgccggcacgggggagcgcctgctggccacccggatcggctcgatgcggctgaccgattacctggtcacccggaccgtcgagctgatcgtccacacggacgacctgaacgaggcgctcgggctggagatcccctacgaccggcaggccctggccgcctgcacccggctgctggcggacgccctcgcggaccgggcgcccggcggctcggtcgaggtgcgggtcccgccgttcgcggtggtccagtgcatcggcggacccaagcacacccggggcactccgcccaatgtcgtggagaccggcccgctgacctggatccggctcgccaccgggcgtacggagtgggtgcgggccctggaggacgccgaggtcagcgccagcggggagcgggcggacctggccgagctgctgcccctgatgcgctgaggcggccaccgggaagcggagcgggcggaaccggatccgccccccgttccgtcacatcgccatgcgcacacaacggatgaccctcagcgtcagtgtcctggccctcctcaccctcgccgcctgcggtacggagccgggttccggctccggcaagggatccggcggaggcggcgacagcgtgcagagcgacgtccccgtcaccggggtcgcgtggcgcgtcgactccgtcaccgtcggcgggaagaagaccgaggccccggagggggcccggctggagatcgacccgaagggccgcgccaaggccgatttcggctgcaaccacatcagcgtggacgcccgggtgaagggcgatcggatcaccctgggcaaaccggtgaccacgcagatggcgtgcgaggagaacatcgagaagttcgagaaggccgccatcgacgcgatgggcggcgagcacaccgcgaagctctccggcgaccggctgaccctcaccaccgaaagcggcgactcgatggcgctcagcgaggagaagcccgccgatctggtcggcacccggtgggccgtgaccacgctgctcagcggtgagaccgccacgaccgtaccggcggacctgcccaaggagaaggcaccccatctgaccctctccgaggacggcaccgtggagggcaactccggctgcaactccttcagcggcaaggccacggtcaaggactccacgatcgtcttcggatcgacggcgggcacccggaagatgtgcccggaggcggagatggagaccgagcgtgcggtgctcgccgccctcagcggcccgacgacgtacacgatcaagggcagcaccctcacgctcaccgccgccggcggcaagggtatcggcgcctcggccgcgacccccgggtccgggaacagctccgagcagggctgaacccgggagacagccgggccgagcaggcggacggtctccgccccggcggccgagggcctgccgaccggggctcgaccgcccgagaccaccggagcgggtcaggaagccgtcggatagggcagcaggcccgagtccgtcctctcccacgacgcccgcaactcggccagccgctccgggtcggccttcgcgcggtcggcctgctcgcgccggtcgtcggccaggttgaacagctggtcggccccgctccttccccggtagtacttccagtcgccgcgccgcagtgcccgctcgccgcgcacccgccagaacaggtcgcgttccttcggtgtctcgccccgcagcagatatcccgcgaggctgatgccgtccagtgggtgggcggggtccggtcgtgccccgcccagctccagcagggtggccgtccagtcgggggagaacaccgggagatcgctgacctggtggccttcgatgcgcgcgggccagcgcagcaccgagggaacgcggatgccgccttcctggagcgagctcttgttgccggcgagcggccagttgtaggagaaccgctcgccgccgttgtcgctggcgaagaagaccagggtgtccttctcctgccccgaccgcttcagcgccttcagcacctcgccgaccgagcggtccaggtcctcgaccatctccgtgtacttctcgaccgagccgccgtcgccgtgccggagggcggaccggtcgccggccttgatccggcggacgatctcggcgctcgcctccgtgtcgccgtcggcgatccagggccagtgcggggtggtgaagttcaggttgagcagccacggttcgccgtcgtggtcacgccgtacgtacgcgctcgcgcgctccgtgaggacccgggtgtagtaccgcaggtccttgtattcggcgtcgccctcgtacaggtcgtactcgcctgccaggccgagcttggagtagtactccagggctccgccgaagttgccgaagaactcgtcgtagcccgacctggtcgggctgtagtccggcaggtatccgcagtgccacttgccgatcagcgcggtcgagtagccgacgccgcgcagcagggaggccagtgtcgggtgagtgggctccagccccaccgacctgtcggcgatgggttcggcgagtccgcctttcgtacgccccggatagcgccccgtgtagaggctgaaccgggtgggggagcaggtcgccgaccccgcgtacgcatcggtgaagcgcacgccctgccgcgccagtccgtccaggtggggggtgcgtatgtgcggagacccgtacgaggagagatccgcccagccgaggtcgtcgccgaggatgaagaggatgttgggacgccgcgcgtgcttgccgcggtcggcacggaacggacgttcccgtgtcacgtcgtcggcagtcgctccggcggcggatgccgggacggctgtccgtatcccggccgcggtgacggcgctcgcgcccacggcggtggtgaaggcgcgccggctcagcggcgtaccggatcgttcttccgaaggtgtctgcgcatcgcgagaggtcatgagggctcctgggagggcctcggccgccggtcggaggacgggacgcgaggcaaggggcgcgacgtcccggcgggcaggggcccgtggacgggcgcaccggcccgcagggggcgaaagagggagggaggcgaacgtgtgcacgcatggcgaagcccggggcggaagcccggcgggggttctggaggtgcggcagcctcaggcgcggcgacagatggcgctcgctacacgtcccagatcgacgtgccggcgctccacgagcgtgatcgaaagatcaccgaggggctgcatggggaaggagcctgccaacggggcatgggcctgtcaacggtggtctcgaactgcggacggcgggccttcgccctccaccacccgcgccgctcaccctgccgcgcaggcgccacgtcccggcggttcgccgtcggggggagcggctctcctctccccggccggagcccggggtgtgaggctcaccacgaaacgagcgttcggccagcggcccgggcggtgatcgggcaggttcaccgagcgccacggccgcccgtccggcccggtcgttccctacctgtcggtaaccggcctcccggcccgtaagtgagcgccgcattcgcctcgcggggtctttcccgcatacctgacagtcacgcaacgtcaccggtcgaagtcccgcgaatcgcccgctccggtcggtggacgggcccgtcccccatgccctgccgtgggtttgcccaccggtccccaattcggaccagtggtcgatctcgcctacactcggtgctgtgccccgtggtgatggacgactcaaccacgacctgctccccggagagaaaggcccccaggacgcttgtggcgtcttcggtgtctgggctccgggtgaagaggtcgccaagctcacctatttcggactgtatgccctgcagcaccgcggacaggaatccgcgggcatcgcagtgagcaacgggtcccagatcctggtcttcaaggacatgggactggtctcgcaggtcttcgacgaaacgtctctgggttctctccagggccatatcgcggtcggtcatgcccgctactccaccaccggcgcctcggtgtgggagaacgcgcagccgacgttccgtgccaccgcgcacggctcgatcgccctcggtcacaacgggaacctggtcaacaccgcccagctcgcggagatggtcgccgacctcccgcgcaaggacggccgcgccacccaggtcgccgcgaccaacgacaccgacctggtgaccgcgctgctcgccgggcagcgcgacgagaacgacaagccgctcaccatcgaggaagccgccgccaaggtgctccccgacgtcaagggcgcgttctccctcgtcttcatggacgagcacacgctctacgccgcccgcgacccgcagggcatccgcccgctggtgctcggccggctggagcgcggctgggtggtcgcctccgagtccgccgcgctcgacatctgcggcgccagctacgtacgcgagatcgagccgggcgagctcgtcgccatcgacgagaacggtctgcgcacctcgcgcttcgcggaagcgaagcccaagggctgtgtcttcgagtacgtctacctggcccgtcccgacaccgacatcgccgggcgcaacgtctacctctcccgggtggagatgggccgccgactggccgccgaggcccccgtcgaggcggatctcgtcatagcgaccccggaatccggcactcccgccgcgatcgggtacgcggaggccagcggcatcccgttcggcgccggactggtgaagaacgcctacgtcggccggaccttcatccagccctcgcagaccatccgccagctcggcatccggctcaagctgaatccgctgaaggaagtcatcaagggcaagcgcctggtggtcgtcgacgactcgatcgtccgcggcaacacccagcgcgccctggtccggatgctccgcgaggcgggcgccgccgagatccacatccggatctcctcaccgccggtgaagtggccctgcttcttcgggatcgacttcgcgacccgcgccgaactgatcgccaacggcatgaccgtcgacgagatctgcacctcgatgggcgccgactccctctcgtacatctcgatcgacgcgatgatcgaggcgacgacgatcgacaagccgaacctctgccgcgcctgcttcgacggtgaatacccgatggagctcccggacccggagctgctcggcaagcagctgctggagaccgagctggcggcgggcccggcggcgaccgccgcggccgacgcgctgcgccgtccgtgacccggacgcgccgccgcatcccccaccagccccgtatctccacacgaaagatcccaggccatgtctgagacaacaggtgcttcctacgcggcggccggcgtcgacatcgaagccggcgaccgtgccgtagagctgatgaaggagtgggtgaagaagacgcagcgccccgaggtcgcgggcctcggcggcctcggcggtttcgccggcctcttcgacgcctcggcgctcaagcgctacgagcgtccgctcctggcctccgccacggacggcgtcggtaccaaggtggacctggcgcgtcggatgggcgtgtacgacaccatcggccacgacctcgtcggcatggtcgtggacgacctcgtcgtctgcggcgccgagccgctcttcatgaccgactacatctgcgtcggcaaggtgcaccccgagcgtgtcgcggccatcgtgaagggcatcgccgaaggctgtgtcctggccggctgctccctggtcggcggcgagacggccgagcacccgggcctcctcggcccggacgacttcgacgtcgccggcgccggtacgggcgtggtcgaggccgatcgcctgctcggcccggaccgtatccgcaagggtgacgccgtcatcgccatggcgtcctccggtcttcactccaacgggtactcgctcgtccgccacgtggtcttcgaccgggccggctggtccctggaccgcgaggtcgaggagttcggccgcacgctcggcgaggagctcctggagcccacccggatctactccctggactgcctggccctcacccggacgaccgaggtgcacggcttcagccacgtcaccggcggcggcctggcgaacaacctggcccgggtcgtcccggacggcctgcacgccaccgtggaccgctccacgtggacgcccggcgcggtcttcgacctggtcggcacggtcggccgggtcgagcggctggagctggagaagacgctcaacatgggcgtcggcatgatcgcgatcgtcccggccgactcggtggacgccgcgctcacgacgctggccgaccgcggggtcgactcctgggtcgccggtgagatcaccgaccgcggtgagcacaccacgggcgccgagctgaccggcgactacgcccgatagccaccgtcgcgccgtggtgcgccgggcagcagcccgcccgccgcaccacggcacccgggaaggcctggaccgggacacacagaacccggcccggggcaggcccggaccgggttgatgtgtcagcgcgaggtcaagcgccgcggcgctgtgacgacggaccggactgatcgtcctgatcctcgtcatcgtcctgattgtagcgatccgcgtactgtgcgtacgggtcatcttcctcgtcgtcgtcctcgaacggctctgcgttcggtggctgactcgaaggcgatgcgcccagctcattggccagacgcgacaggtcagtcccgccgctgctgtacttcagctggcgggcgaccttggtctgcttggcctttgcccggccgcgccccatggctcgaccccctcggtgacggggctcgacggccccagagtcttgacacgcgttcatgtttcgggacggactctcgacagagagaccgtgcccgtagggctttaacggtacctgcttccgtggccatacggtacgccgcccgcatttcggtcccggcacagggccagcgaggagccccgtcctccctggtcaactgcgattttaacctcttgtggaggtacgacccgccgaccggggtgagtcttgtctcgtcggccggcgggccgctggggccgcccggtcagcgggcgcgcgcctccgccatccgctgttcggcgagccggtcggccgccgcggccggcggaatcccgtccgccttcgcgcgtgcgaatatttccagcgtggtatcgaagatcttcgtcgccttcgccttgcaccggtcgaagtcgaacccgtgcagctcgtcggccacctggatcacgccgccggcgttgaccacgtagtcgggcgcgtagagaaccgaccggtcggccaggtccttctccacacccgggtgcgccagctggttgttggccgcgccgcacaccaccttcgcggtgagcaccggcacggtgtcgtcgttcagcgcgccgccgagcgcgcacggtgcgtagacgtccaggccctcggtgcggatcagcgcgtcggtgtccgccgccacggtgacctcggggtgcagatcggtgatccggcgcagcgattcctcgcggacgtcggtgatcacgacctcggccccgtcggagagcaggtgctcgacgaggtggtggcccaccttgccgaccccggcgacgccgaccttgcggccgcgcagcgtcgggtcgccccacaggtgctgggccgaggcccgcatgccctggaagacgccgaacgcggtgagcaccgaggagtcgcccgcgccgccgttctcgggggagcggccggtggtccagcggcactcccgggcgacgacgtccatgtcggcgacataggtgccgacgtcgcaggcggtcacatagcggccaccgagcgaggcgacgaaccggccgtaggcgaggaggagttcctcgctcttgatcttctccgggtcgccgatgatgacggccttgccgccaccgtggtcgagaccggccagggcgttcttgtacgacatcccacgcgacaggttcagcgcgtcggcgacggcgtccgcctcggtggcgtacgggtagaaacgggtgccgccgagggccgggcccagggcggtggagtggagggcgatgacggccttgaggccggtggcacggtcctggcagatcactacttgctcgtgacctccctgatccgagtggaacagggtgtgcaggacgccgttagtcacatcggtcactgtggtgactcccaagtacgaagcggcggaggccctcctgggggtggggagggccccggaccgaccggcacggccggtccgatgggcaagagcgtaagtcctccggcggcgcggttccgccctcgtgcggaggatcaccccttgggggtgtaccgccgtgacacgatgcgctgcatgtcggtggtgtcttcggtgctcgtcccttacacgtcctacctccgggtctacgagccgctcgccgcattcgccgagcccgagcggagtcactgggcgcgctacgcgcagcgcgaggaccttcccacggcgcaggacgaactgcgtcgctcgctggccgacttggcctcgacgccgccggtcggggtgcccgtgcgcgagagcggcgacgcgttcgtcgcggagctggacggggtggtgtgcgtctgcccgtggcggaccaggctgcggggctggctggccctggaggaactggagggcctgtttccggccaacgtgctggacgtcgtgctgcctgcggtggtgcgcgcccaggccgcggcggaccacgagcgctggcagcggctccacccggacgcgaggccctggatccgtacgacggtgtggcaggttccggtgcgctggttcgtcctcttccgtgacgaggagcgggagtacgcggcggcggacggcgagggggcggggcctgttctgcgctaccgcaccccgatggtcgaggcccgccgccggctggcgcgggcctcgaccatcgggg

SEQ ID NO: 2730 - DNA, 8574 bp, Unknown
  Kingdom: Bacteria, Phylum: Actinobacteria, Class: Actinobacteria, Order: Streptomycetales, Family: Streptomycetaceae, Genus: Streptomyces
ggttgtagaagacgaagtccgcgtcgctgcggaccttgccggccaccagcaggagggcggaggcgtcgacgtccggggcgcccggtgcggtctgcctgcccacttcgacgcgcacggtgccggccggcaccgctacgttggttcctttttgcatggtcatgctcgcccccatcacgaatccgctgcccgcaggctttcccccacaacctaacggcctggggcgggaaagcctgcgggcgccgggaccgtggcggaagcggtcccggcggtctccgccaggtcgtgttcgcaaagcctcgtctggcccgagggcggacgacgaggctctgcggacactccctagggcttcccggtgcccggagggccttcaccgtccggagcgacgcccgcgagggcggactcgcgcgatgtggtgtccgtcgccggggcggagccctggacggcgccgctgtgcgtgctccacgcctccagggccgtgcgacaggcgtggtccacgtggcgcagccgcgagaggtcgagctccaccggccggtccttcggcagggcctccagggtgtcgagaatcagcggcaggcgcaggaaagtggcactgccgctgagggagaccgtggtgcggtcgtcctgctcgtcgatgtcgaggcggacggcggaggtctcccaggccgtcttgacgacggccagcccgatgccgagcagcacacccatgaacatgtccgtgaagacgatcgccagcgcggtcaccaccaagaccacggcctcgccccggtgttcacgccagagtgctcggaaggtcgcgacggggatgagcttcgcaccggcgtggacgaggataccggcgagggcggccacggggatcaggccgagtacggcggggaacagggccgcgaacagcagcagccacgctccgtgcatgatccgggaggccctggtgcgcgcacctgcctgcacgttggccgcactgcgcacgatgacggcggtcatgggcagcgcgccgacgaggccgcagatggtgttgcccgtcccctgggcgatgagttccttgttgtagtgcgtgcgcgggccgtcgtgcatccggtccacggcggcggcgctgaagagggattcggccgaggcgatgagcgtgaaggcgaggatgacgcccagcaggctgacgtctgccaggagaccgaagtcgtccaggcccgtcagccgcagtgagtcgatcagcccctggaccttgatgggatcgacgggcaggtcgaacaccgccaccgccgcggtggcgatccccacggccaccagcggcccggggagcatctggggcaggcgtccgggaagccgcttccagaggatcagtacgacgatggtgccgacaccgatcgcggtggaggagatcgccgcggctcccgtgatctgcgtgaacagctccggcagtccggccaggttgtcgagaccgttccccggggcgtcggctccgaccgtggcgtacaactggctgccgatcaggacgagtccgatgccggcgagcatgccgtggacgacagcggtcgatatcgcgcggaaccaccggccgaagccgatgaggccgagcccgacctggaggagtcccgtggacaggacgaggacgccgagcgccgcgatgccgtgggtggtgacggcctcgtacaccaggacggtgagcccggcggccgggccgctgacctggagcgagctgcccggcatcgcgccggcgatcagcccgccgacgatgccggtgaccaaccccagttcggcggggacaccggaggcgaccgcgataccgacgcacaggggcacggcgacgaggaacaccacgatcgaggcgagaaggtcgcgggacagggcgtccgggcgtaaccggagtcgtggaaacgacatgagagcttcagctcctaggggagtggggggagacaggaggtggcggcgggggcggcccgcgtactcaccggtgggtcgctgtcacagggaggagaaggttccggtggagggccggtgggcctgtacggcgccggtgtggacctcgtagtaccaggcgtgcaggccgagtcggccctcgcccctggcccgcctcacgcacgggtagtcgtgcaaggcgtccagttgcgccaccacgtggcgctgtacgggctgttcgcaatcggggccgaactcgtcgaggtcctggagagcgcccgtcggggagcatctgccgagccagccgcgtaccgccggcagggtccgcagatcctcgccccgggccagggctccgacggcgccgcagtgggagtgcccgcagaggatgatgtcggacacctccagcacgctgacggcgtactcgatcgtcgccatctcgctggtgggcgcgtccggatcgtagggcggaacgatgtttccggccgtgcgcatctcgaagagttcgccggggccggagtcggtcagcagggtgggcaccacccgggagtcggagcaggtgatgaacatggtggagggccgctggccggcctcgaattccttgagttcacggcctgctccgccacagcgggcagggaaggtgcgggcgtggtcgatgagtcgtcgcacaggagtgtcctccatacggaagtggcgtgtggctcttcacgcgggacgggctctcaccccgcccgcaaccgggccttcgtggcacacggggatccgcgtaccacggggatcaggtgcgggtgtgcgcgccgcagggcaggcggggggttcgcctccgtgtctgctggtccggtgtggcggctgcgcccggttcccgggcggggccgcggcgacgtctgcgccgctcacgggccccgcgtcaccgatgacccttaaggaggagtctcggggcgggcgatgaggtggcggtgagacagcggtgagactgttctcatcgcgtccggcggtgtatgtccggcggtgtgcgtccgccggacgaaggccgcccgccccggtggtcaggcccggagccggtaaccgacgccccgtacggtctggacccggtcggcgccgatcttgcggcgcagatagcgaatgtagacgtccacgatgttcgagccggggtcgtagtcgaacccccatacctggctcagcagttgctcccgggacagcacccggtcggggttgcgcatgaggatctcggcgagggcgaactcacgggcggacaggtcggagacgcgctcgcccgcctgggcccggcgggtgcggaggtcgaggagcagatcgcccaccctcagcagaaagttctccggaggctcctcgcggcgcaggcgcagccgtacgcgggccagtaactcgtcgaaggcgaagggtttgaccatgtagtcgtcggcgccgctctccagtccggccacgatgtcgctcacgctgtcgcgcgcggtgaggatgacgacgggcagggcgatgtgcgccttccgcagtttgcgcagcaccgccagcccgtcgtcgccgggcaggccgaggtcgagtatcaggaggtcgaagtcccggccgcgggcgtgctcgtaggcggagacgccgtcggcgacgacccgggtgacgtacccgctacggcgcaggcctttttcgacgaaggcagcgattcttgcctcgtcctcggctatcaggatcctgctcaccatgggttccttccgtcgtggggtgcagtgcgggaaggtcgatgacgaatcgcgcgccgccgccgggggcctcctcgacgcgggcgacaccgtcgtgtgcctgggcgatctcgcggaccagcgcgaggccgagcccgatgccgggggcgacccggccgggcacggcggtgcctccctggtagaagcaccggaagatccgttcccggtcctccggggccaccccgggcccggtgtccgccacccacagcagcacccggccgcgccacaggcgtgacccgatctcgatgacgtccccttccccggtgtggctgaccgcgttggccgcgagctgcatcagcgcctgggtgacccgctgttcgtccagttccacgctgacgtcggcgacctccgccaccgtccagtgcctgcgccccagggcctgggccttggccgccgtgtcgaccaccaggtcggtcagaccggtccggccgaggctgaggaagtcggggcgctcggcccgggccaggagcagcaggtcctccacgatccgccgcatccggtcgagttcgtcgaagagcagggcccgggtctggccacgttggctgtcggggtcctcgtccatcagctccagatgtccgcgcaggaccgtgatgggggtgcgcagttcgtgcgccacctcgtccaggaactggcgttgcgcggtgaaggcgcccgacaggcggtcgagcatgtggttgaacgtctcggcgagttccgccacgtcgtcgttgccccgcaccggcagccgctgggtcaggtccgtctcgctgatccgctcggccgtctgcctgaccagccggatcggagccagcacgcggcccgcgaccagccagctcgccagtcccgcgaccaccagagcgaagcttcccgaggccagcagcagccgcgccatgtggcgttcctgccgcagttcccggtcccggaaggtcaccaggacgagccgggtgtcggtgtggtcgcccgccatctgcaccgggacgacaccgtagcggaccttgccggccggggagtcaagcgtccggatacgggtgtcggccgtccgtgccatcagatcgacgacctcctggtcccggtccaggcgggccgggaccgggccggagctgcgccggtcggcccgtccgttcacgacgctgaagaaggcggcgttgtgctcgggccggtggaccgccatgaacgccgtcagcagcgaggcgcccgtggtgaaacgttcaccggtgtacgggtcgcgcgaggtgcgggcgaacgcgcgcagcttgtcggcctcggccaggagttgcgcgtcgacctgccggtccagctccgcctgccagacgatcgtgatcccgaaggtgggcacggccagtgccgcgctgagaagcatgagcatccagccgacgatccgggaccgggcgctggtcgagcgcctgagcatcagtcgtcccactcgtcgtccgcatccccccgattgctgccgcgtgacgcttcctcgtccccgtcctcagactcgtccgcttcgtcgcccacatcgcccctgggaaggcgtgaggccttctcgtcgtcaccggtggcccgtgacgttcctccggacccgccgcctccggggacggcgcgggagggggcgttcttgtcgtcggactcgggcggcggcgagggcggcacgggccggccgccggagcaggtgccggacggagcgggcgaagcaggggacggtgccggtgacacggcggtaccgccggggccgggtgggacggtgggcgaaggcgtcgggccgtgcaggaagggcacgacgaccacgggccccatggagggcggcacatgctgcccaggccatatccatacgaccagtaacaccagtgtccctgctccacatcctgccaataccgaccccaccccgcgccactgcatcggaccagtctgccttcgcggggtgccggggacggacatgaggagagcattctcatcttcggaatccgccgccgcgtccgtcaccaggccggcgccgggccgacgctccccgagcgcgcccggccacccgcttccaccaggggctctgccgatgacgcggttgtgtgcgcgagccgtgcgccgcgccggcgccgacgcgaccccgcggaacggaatcacgccgaaccggcaccgccgggggctgcttcttgtggttcgacattgctgttcattgacagtcgctcaatgacgcttttacattcagcgggcaggtcgaggagaaattcgttcaccgtcggcccgcctcagggagcaccttccgcactatcaccggaggacctcatggaacacctgatcaagaagatggctcaggacgacgtctggcagaattggctcgccgtcaactcgacccagcaggcggcgaagaacggctgcatcagcgccgcaccgaaggccggctgtatctcctgatcggcaacgggggcgtccggggtcggctctgtgagagctttctcccccaccgcagcatgttccccggcgctcccgactccgtctccctcatagcccatagttcttcagctatgcgaaacatgagaaggaattaatgaagggccagccgaccagcgatgtcatcgagcatattcgcgacataccgatctatcaggagtccctggcgaagggccacttcccgctgctcgacaagccggagatcgcccgcgggttccccgacaactggatgacaccccggctggccgcggcactggagaccggcgaggcggagttcgtcctgtccaccggcaccaaccacgccagaatgcagatcatccggcctccgtacttcctgctccgctcctactacgatttgtggcggaaccaccccgacatcggcgagacgtgggagtcgggctgccgccgggtctccctcaccacggtgctcgcgacggaacacgtggcgcgggtcaacgccgcccgacgcggcgtggagcacaagggaatacccatcctggccgaccgctggctcgacgagcgcacctgctacctcaacctgcggctggatccggcacagtgggtccgcaaggacatactgcggatgctccacgagatcgacctggcacggagcacacatccacagggccgttaccacctcgactgctccggctaccacttggcccacctggtgcggaaggcggaggcctggggtctgctggacgcgttccccgcgccggccagcatcatccacgcctacgagtacacaccggtgaacgtacggaggttcctgcaccggcgcttcgcctgcccggtcatcgacctgttcggcagtacggagttgggttacctctactacagcgaccgggagggccggtactggccgcacctggccgggatgagcgtcgaactcctgccggtggcacccggaagcacgatccaccagctcatcgtcaccagtgtgcgcaatccctacatgccgctcgtccgctaccggtcgggcgattgtgtgcgcaccctcgacggctctccggaccccgcggcgatcacccaattctgcggccgccagaaggaattgctgagcacgccgaacggcccggtcgcccagggcgacctcgaccggcatatcgcggacgcttccccccggatcttcctgcatcagctccacctccagggcgacgccgacgccaccttgctgtacacgacgttcaccgacgaacttctcggggccgcggaggccgccgccctgcggcagcgagtcggcgaactgaccggacgacactgccgaatcgagcaccgcacccatatccccatcggccgctccggaaagtacgcctggctcaccatcgccagcacctgacgcgccgccatctccccgtttcagagaacggagtgccatgaccagcggacagacactctccgccgacgacctgaagcgtcttctcggggacgcgctgcacaccgaggtgatgcggcatttctgcgacaaggcaccggacacacctcaggaattcgtggagcgtcaggtcaccgaatgcctgcggtacctctatctcgtctcccgttaccgtgaccggctgagcgggcttttcctgccggtcgaacaggacatcgacgagatatggcactatctcattctgcagacccgggaataccgcgcgctgtgcgaagaacggctccccgggcggttcttcatcaaccatcgcagcatcgcctacgaggactaccaggaggagccggggcgtgaacaggcgctggaggaggcattgcgctggattcccctgtaccgccgggaattcgggccgttcgacgccggtgcgctgccgcactggaccatggtgcggttcctccacgagcagatgggcctctctctcacggagatagcggatctgaaaccgatggccgttgcctgagcagaactccgcattctggccgagctggtgacggcccggaggcctcagggcgcgccgcgccggcgcggacctggcttcccccgcccggcggacgggccgtgagcgcggtgctgttcgccaccacgctgggagcggtgaccgggtccatgctggtgacgccggccggcgaggtcgcacgcgcctgggaagtgccgtgtctctccgatcccttcctgctggcggccgcggcgttcaccgccaccgcggtcgtcctggcccgcccgctgcggcccgatccgctccggctcgcccgggcgctgaccgcccgggggacgggtgccccgggacgagggcgcggacagcggcgaggagggcatcgcggaggtacggacgcccgcgccggggcccggtgccagccgggcgtcacgacgtcgccgtcggcaccaccgtgatgatcctgacccaggtcgtgatgctcgggatcatgacgatgacgccggtgcacctgccggcgcacggccacggcgcccgggccgcggggatcgcgatctccccgcacgtccgggtgatggtcctgccgtcccgctcaccgggctgctcgtcgaccggatcggcgggcgatgggtcgcctgcgcgtccgggcccctgccgccggcggcagg

SEQ ID NO: 2731 - DNA, 2143 bp, Unknown
  Kingdom: Bacteria, Phylum: Actinobacteria, Class: Actinobacteria, Order: Streptomycetales, Family: Streptomycetaceae, Genus: Streptomyces
gtctcgacgagatcctccgccgccccgccgtgcggcactgggccgatcagcaactggcccccgtcctcgggtccgaggcgactctgcgcacctggttgcgctgcgagggccggctgggtccggccgccgccgagctgggcatcagcgtgcccggcgcgcgcaagcgcctcacccggctcgaatccgtcctccagcgctcgctgctccggccgccgagcgcccgctacgacctgtggctggcgctgaggtcccgggacctggggaccgaggggggctgagcggcacggacgggccggaccagcgaaagaagaggcattctcattttttactttcgcaccgctgtatttctccggagatgccgacggtgaagttactggccggtcgcttatggcgcggttctgtcggcggaccccatttgcgcacggccggacgcgcgttattaaacccggcgtccaattggcagcccatgatcggccaatcgccctactgggtggcagcttgtgggcgggtgcgtgaacgcggaattgcgggagagggatccgcgcggagacggaagcgcccgggggaatttgctaacgcacttcggggtgaggggaaacggtcacgcgagtggggacgccaaagggtgccgccacggttgcaacccatggtcccgggacggtcacatcgtgaacggaccaggtggtgggggtgcccggcgcgccgaccgtgaccgcgaccgggccccgtcggcccgggtgggtctcgatgccggacaggtccgtcgaaatgccggtgccgacggctttgagcaccgcttccttccgggtccagcagcgcaggaacgcgcggctgcgggccgctcccgccgggacgcccagaaggttccggtgctcggcgggggtgagggcgacgcgtgccagttcctcggttctcagcgcgcgttcggcttcgacgtcgactcccaccggagtccgcgcgacggccagcaggcagcggcccgaggagtgcgagaggctgatcctgaaagggctgggcgggtgcagcaccgcgggcggcccgtggccgtggctcccacagccgggacagggcagccgtcccagcgcgatggcgtccggcgctgtcccgaggagcctcgccaggacgcgccggactcccgcacggctgccggcgaattcggcggctttcgtggggtgttggatgcgattcagcctttccagctcccgtggggcgagtacggcgagatcggccggatcggtgctgttcccggcgagttgccaccagtggacggccacaacggcggctgtcggggcctgaagtgcggtcacggggtgagcgtaggtcgacccctggggttgagagcgagcgctgtcctctatgggacaggcgtgactccactgcgtaaccgttcggttacgtacggaagagtaagtggaacggcaggggtgtgaatgtgagtcggaggtgcagcttcctgacatctccgagcccgtgaggggtcgcgcaacgtgggggtggaggaagttgcgaggcctattggttgaatggaaaggaccggcgttgactggttcacgttcgcgacctaatctctgggtgcgctggaagattggcgtgtaagtgcccatgagggtccgctgattggttctctattcaacttcgcatgtcgacgacaccttgagaaatccgatgtacgtcattggtatccggggtgaccgcaagtgggtaacgggggagtggaatgggttcgggggcgagaggtgtgtgtggggatgtgcaccgttcggaagacagacatcgcactgattccgtggagcgggcgctcctggaggcgcgggcgctgatcgagtcctcggtgtcgctgcaccgcagccggcccgggcgtacgtcgctgctggtgcgggcggacgacggctcggtcgtcgacgcggtgaagcgcctgatggcgggggcgcggtactcggcccatctggcggtgacgagcaaccggaagcactcggccgtggtgtgttccgccgtcgcggactcgctggccgaggcgccgcggaccgctcgcgagggccggggccggctcgccgtcaggctgctcgcctccggcggcgcgctcgaactcaccgcggactgccaccggtcgttcgccgagacgtatctggacgtacgcatgacc

SEQ ID NO: 2732 - DNA, 4974 bp, Unknown
  Kingdom: Bacteria, Phylum: Actinobacteria, Class: Actinobacteria, Order: Streptomycetales, Family: Streptomycetaceae, Genus: Streptomyces
gggagaaccagtggccccagcccgagctgtgctgcccgtgcgggaccgtcctgcggataccggtgcgcccggcggtcaccgggcgcaccggtatccgcaggacggtcccgcacgggcagcacagctcgggctggggccactggttctcccgggcgcaggacgcgcagcgaacggtgacccacacgtcgttccagctgcgatggccgaccaggaccgccggtgcgtcccgcagcagcggcggagcggtgggcgtcccgcacgggcaggggtaggccggtgtgctgtaggcgtggtcccggctgcagacagggcaccgtaccggcacggactccacgatcgtctccctccggcacggacgcgcgaccgactgcgctccgtgcctccctcgtcacaccatcgtccaccaggagcgaggctctggggagggggtcggcggacttcatgggggcgggcggccggcgcgcccttgacgagggtcgccccacgttttagattgcttccgtatagcagaactgaatttccgtaatgcggaattggtgctctcaggtggcgcgacagagcccgactccaccaatcccgagcaggagcactcaatgcctcgtatgaccgctgcccgagcggcagttgagatcctcaagcgcgaaggcgtcagcaacgcgttcggtgtgccgggtgcggcgatcaatcccttctacgcggccctcaaggcctccggcggggtgcagcacacgctggcccggcacgtcgagggcgcctcccacatggccgagggctacacccgggccgaggccggcaacatcggcgtctgcatcggcacgtcgggcccggcgggcaccgacatgatcaccggtctgtactccgccatcgccgactccatcccgatcctgtgcatcaccggccaggccccgaccgccgtcctgcacaaggaggacttccaggccgtcgacatcgcgtcgatcgccaagccggtcaccaaggcggcgacgaccgtcctggaggccgcgcaggtccccggcgtcttccagcaggccttccacctgatgcgcaccggccggcccggcccggtcctcatcgacctgccgatcgacgtccagctcaccgagatcgagttcgaccccgagctgtacgagcccctcccggtgcacaagcccgcggcctcccgcaagcagatcgagcgggcgctccggatgctgaacgcctcggagcgcccggtgctcgtcgcgggcggcggcatcatcaacgccgacgcctccgaactcctcgtggagttcgccgagctgaccggcgtcccggtcgtcccgaccctgatgggctggggcatcctccccgacgaccacgagctgaacgccggcatggtgggcctgcagacctcgcaccgctacggcaacgcgaacttcctggagtccgacttcgtcctcggcatcggcaaccgctgggccaaccgccacaccggcaagctggacgtctacacccagggccgcaccttcgtccacgtggacatcgagcccacccagctcggcaagatcttcgccccggacctcggcatcgcctccgacgccaaggccgcgctggagctcttcgtcgaggtggcgcgcgagctgaaggccgcaggcgagctgaaggaccgttcggcctgggccgcgtccacgcaggagcgcagggccaccctccagcgccggacccacttcgacaacgtgccgctcaagccgcagcgcgtgtacgaggagatgaaccgggcgttcggccccgagacccgttacgtcaccacgatcgggctctcccagatcgccggcgcgcagatgctgcacgtctacaagccgcgccactggatcaactgcggccaggcgggccccctcggctggacgatcccggccgcgctgggcgtcgccaccgcggacccggagggcacggtcgtcgccctctccggcgactacgacttccagttcatgctggaggagctggccgtcggcgcgcagcaccgcatcccgtacgtccacgtcctggtgaacaactcctacctggggctcatccgccaggcgcagcgcaatttcgacatcgacttccaggtcaacctggagttcgagaacctcaactccccggagctgggcgtctacggagtcgaccacgtcaaggtcgtcgagggcctcggctgcaaggcgatccgggtgaccgagccggaccagctgctccccgccttcgaggaggcgaagaagctcgccgcggagttccgggtgccggtggtcgtcgaggcgatcctggagcgagtcacgaacatcgcgatgagcggcagtgacatcgcgtcggtcaacgagttcgaggacatcgccacggacgcgtcccacgcgcccacggcgatccgccccctgacggcgtcctgacccgtccgggcaccggccgcgcccgccgccggacgaacctccggcggcgggcgcggccgactgcggctcgctacagggggatgcccttgctgcgttcgagcagccggttcagccggggttcgaactcgtccgcgatgcgcatgaactcgtggttgttcctgcagaatcgacggccgaactcgatgacgctgaagatgcggcgaatggtgtcgtccgtatcgtcgcccgacaggagggcctcgcatgcctccagccattccgtccctcttctggcgatgacggagaaggagtgcggtgaggcgccgccgtgccgcttggcgactccttccagcactcccagggcttcggaggcgcgtgcccgcagcccggcgtcgtcggggtgcatcgtggaccgtctcagacggatggcgctccaggccgtcaggacgaagtggtcggcggcgccgccctcgcagccctgggccgcttccaggtggttctccgcgatgccgaggtcgccgcgctccagttcgtactccccgcgctggagccagtagtggaagttgtcgctgagcagttcgtgcacggtggagtagatggtgcgaaccatctcgggtttgatccggagcgacaccatcagggagtggttcagcagccggatcatgatgcggcgataggggtcgtcgttgtcccgcgactccgcggcgtactgggcgtagaacttcagcaggaactcgatgacggaggccagccgccgcggttccttcttgagcaccgactcgaccaccgtgtcggcgatggtgcgctgacggcagcgcagggtcgcgtccgaagcgcgggtgagcagccgcatctccaccagccgcccgatggcctgctgaagggatggcttgggcgcctggcgcccggagacgatctggagcagatcctcctgctcgatgccgcgcttcttgaagacgatggcggactcgaagacgcagacggtcgagtagaccgccatctggtccgccgtgagctgacggtactcgctggcgaccttctcctcgaagcgctctccgctgaccacctggatcatggcggcgagcaggctgcggtcgcacatctcccgcaacttgtcgatcttctgctgccgtacccggtgctgcttgaggatgcccggcagtccgtgacggtccagcacatcgacgatgagacccaggtccgcgtccttgagaggctcgtccgccgacacctcccggcgctggaacgtcacgtccagttcgtcactccgggtggtgcggatggctgagacgaccagtgtccggcctccgttgttgagttccctcagcagcgaagcccccaggctcccgaagatgtcgacgtcgtccacgaagaccgcgtccgccgacatcccgcgggcctgtgccttgatgttcggcaggggatcggtcgcctcccggtcgatccacgccacggtcctgcccgcctggtgcagctcgtaggcgaactgcatcagggcggtggtctttccggccccggcccggccgtccaccagcacgatctcgtgctttccgtcctcagcgggctgcgcactcctgcggatccggtcgatgatcgagagctgggcggcgaagccctgcttcacatcaccccaggtgggatcctgccccttgaggaactccacacttcccgactgggcgttgtcgacgagggacgacacgaacttgatgccagacccgcgccgagcgccgacctgaaagcccgcgagccgtcgtttgccctgttcaagcgcttccagtcctggcttcagatccccgacggcgaacgtgtgcggggacacctggatgtgcgtgaggccggcctggcggatgcgagcctgctcggcggcgctccccggggccgtgatgacgaagcgggggaagcgctccgagtcgttctggggctgggcgaggcccagcgcctgccacagcgccctgctgctcggcgaggcggccatgaacaccgtggggtgacagagcagttcggccttcagtttgcggaaccacagggcgcggggggccaggtcgtcgtccgccgggatgctgaagtccagcgtgctcgccgtggtgggatcaccgtgcatggccacggtctccaccgtcgcgttgcgagccgcgggcttgctcaccacggcgttgacgaaccggtgggcttccgtggcctgcggatcgtgccccagtaccgaggagaagacgtccgtggcggtgaagtcgtagatgcgccaccagggagcctgcagcagacggtgggccgccggcgcgaccacaccgccggtgctcagttgaccgacgtactggtccaaggaccgttgcccgagttcgttcctcgcggtgacccagatctccggcatcccgggcggcgggtcgggaacttcaccgtagaccgcttccgtgagccgtgtggccagggcgtcggtgctgatgggagggtcctgctcgtggatgccggagatggcgatgagaatcatgcgaccggtgccggcctgctggtagaactcgccgagcgaggcccgtgcgtcgtagggctgtgcggccgtcccgcgggccgcggggacctcggcgggcgcgcgtcgcgcgcgccgagcccggggcagggggac

SEQ ID NO: 2733 - DNA, 22318 bp, Unknown
  Kingdom: Bacteria, Phylum: Actinobacteria, Class: Actinobacteria, Order: Streptomycetales, Family: Streptomycetaceae, Genus: Streptomyces
cgtccaggattccgctgccgggcgcgctctcgcgccaccggacggcacgcagccccagcaccccgtagacggtgagccggccgtccgtcccggaggcgacctgggcccgcgggcccgggtagcggtggtgggtggagcgcacccagcccttccggttggtcagcggccggccgccgcccacgttgtagtcgccgcagccggacgggttgccgcactcccagtcgggcgcgccgccgtacgggacgaggtgggcggccttgtgctccagcaccttcggcggcaggttcttgggccagtgccggttgtagtagccccggaaggaggcgacggcgaacccgggcaccggctctccggccgccgtggtccgcgccacccagctgatcagcgccgcccaggtgaagcagccggccgcggtgtggtcggcgtggtcggagtacccgtgctgctcactgtcccggcggcgctcgtcctcgctgctgaactggaggtcggggtccgggtcgagggtgtgtacgacggtcggccggtactgctccaggagtcccacgagaacgtcgacgagtccgtcgtacgtgtacgaacccgccttctccagcggggagtcgtcggcgacgacggtacgcagcaccagccgccggtcctgccagaggctgggcagcccgaggcggccgcgcgcggtgtgcatcgcggtgttgaggaagaccagttcgacccggcgggccccgtcggtcaggacgtcccgctcggcccggtggccgccgtgcagggtgagcaccgacctctgccagggggtgaaccggtcgagcccgagcagctcggcgtacgcctggcgcaggccctggtgacgggaggaggcgtaggcggcgcggtcgggttccgggcgcggggcgccggggaccttgttgaggccgtcggcctcgcccgcggtgaggtagacgcagaccacgggggtcccggcgtcgaggacttcgcgggtgtccgggttcatgaagtacaggtcgtcgtccgggtgggccagcacctgcatcaactgcgcccgccgggtgctcgctatggccaggccgggtgccgggtcgggcaccggcccacgacgccgtggagccggtacggcgcatccggcggtggtggcggtcgcggtggccgcgaggaggagggtgcgccggggcacccctgtccgggacaggacagaccgatccaccatgccgcgcactccgtccgctcccgcttcccccgcagcgggcgaacggtcgccctgtcctgcgtactccctggctctgtcgcggaccgtcggccggtcgagccgtgcccgcgggggagtagacggggtcaggggcggaagggttgcgcggtcagggcgcgggttcgcgcaccaggaacacgtcgacggggtcctgctgctccagggagaagccgtgccgctcgtagagccgccgggcggcgcttccccgcagcacgttcaggcgcacgggcacgcgctcggcgtccgcgcggtccagcagcgtgcgcaggacggccgagccgatgccgtgtccctggagggcgggggagaggtagaagtgctccagccaccagccgtcggcggccggccgcagcgccacgcaacccgcgaaggcgccggaggcctcgacgatcgaggtgtgctcgggggcgtaggagtcccgcagccgctgccgcacccggcgcccgtcgtagcggccgagccgctacaggtcggggcgcatgacgacggcccgcagctcgacgatggcctcgacgtcctcgggcagagccgggcgcagggtccagtcgtgcagggtgctcgtgcgcatggcgggattctgccagggggccgtacggggtgttccggcaggtccgtggcggtcccggccccgccggacgcgcgcccgcgtttgaggactcgctcgctcggggtaggattcccgactcgattggccaggcccgcgccccgtatggcacactgaccaggttgctcggttgagtgtcaatgctgcgcgcctcccgccgggaggaccggaagcgagtcccacagtactcgtcggcccccagggccggacgtacgggaatcttccgggaagcaatgcagggcgccgaccaggcacccggtgggtgttccacccccggttccgcggtctcagggcccgcacccccttggttgggatctctttcgggagattttcgtagaggggatgcgacacgcccgaccgcgtgggtcggaggaggagtccagagaacccccgggttccagagcgttacgagagacaggactactagtagccatggcgggacagaagatccgcatccggctcaaggcctacgaccacgaggtcatcgactcctcggcgaagaagatcgtcgagacggtgacccgcactggtgcgtcggtcgcgggcccggtgccgctgcccactgagaagaacgtgtactgcgtcatcaagtcgccgcacaagtacaaggactctcgcgagcacttcgagatgcgcacgcacaagcgcctcatcgacattctcgaccccacgccgaagacggttgactcgctgatgcgcctcgacctgccggctggcgtcgacatcgagatcaagctctgaggggacgggccgagatgagcaagaacatcaagggcgtcctgggcgagaagctcggcatgacccaggtctgggacgagaacaaccgggttgtcccggtgaccgtcgtcaaggccgggccgtgcgtcgtgacgcaggttcgtacgaacgacagcgacggctacgaagcggtccagatcgccttcggcgagatcgacccgcgcaaggtgaacaagcccctcaagggtcacttcgccaaggccgacgtcaccccgcgccgccacctggtggagctccgcacccctgacgccagcgagtacacgctgggtcaggaggtcactgccgaggtgttcgagtccggcgtcaaggtcgacgtcacgggcaagagcaagggcaagggcttcgccggtgtcatgaagcgtcacaacttcaagggcctcggcgccgggcacggcacccagcgcaagcaccgttcccccggttccatcggtggctgcgccacccctgggcgtgtcttcaagggcatgcgcatggcgggccgtatgggtaacgagcgcgtcaccacccagaacctgaccatccacgcggttgacgcggagaagggtctgctcctcatcaagggcgcggtccccggtccgaacggcggcctcgtcctggtccgtaccgcggccaagggggcttgaggtaatgagcaccattgacatcctttcgccggcaggcgacaaggccggtaccgtcgacctccccgcggagatcttcgacgcgaagaccagcgttccgctgatccaccaggtcgttgtcgctcagctggcggctgcccgtcagggcacgcacaagaccaagcgccgcggcgaagtccgcggtggtggcaagaagccttaccgccagaagggcaccggccgcgcccgtcagggttcgacccgcgccccgcagttcgccggtggtggcgtcgtccacggcccgcagccgcgtgactactcgcagcggaccccgaagaagatgaaggccgccgccctgcgcggtgccctctcggaccgggcccgtcactcccgtatccacgtcgtcaccggcgtggtcgagggtgccgcctccacgaaggccgccaagacgctgctcggcaagatctcggagcgccagaacctgctcctggtcgtcgaccgcgccgacgaggccgcgtggctgtccgcgcgcaacctgccccaggtgcacatcctggagccgggccagctcaacacgtacgacgtgatcgtctctgacgacgtggtcttcacccaggccgctttcgagtccttcgtgtctggcccccagaccgctgagaccgaagggagcgacgcctgatgagcgaggcgaccgtaaccagcaagacgtactcggacccgcgtgacgttctcgtcaagcccgtggtctccgagaagagctatgcgctgctcgacgagaacaagtacacgttcatcgtcgcgcccggctccaacaagacccagatcaagcaggccgtggaagcggtcttctcggtcaaggtcaccggggtcaacacgatcaaccggcagggcaagcgcaagcgcaccaagaccggcttcggcaagcgctccgacacgaagcgcgccatcgtgaccctcgccgagggcgaccgtatcgacatcttcggcggcccgacctcctagtgaggtcgagtcgtccggaatcggacgaggactgagaaatgggtatccgcaagtacaagccgacgaccccgggccgtcgtggctccagcgtcgccgactttgtcgagatcacgcggtccacgccggagaagtcgctggtccgccctctgcacagcaagggcggccgtaacaacgccggtcgtgtgaccgttcgccaccagggtggtggccacaagcgcgcctaccgcgtgatcgacttccgtcgtcacgacaaggacggcgtgccggccaaggtcgcgcacatcgagtacgacccgaaccgcaccgcgcgcatcgcgctgctgcactacgcggacggcgagaagcgttacatcgtcgctccccgtggcctgtcgcagggtgaccgtgtcgagaacggtccgaccgccgacatcaagcccggcaacaacctggcgctgcgcaacatcccggtcggtacgaccatccacgccatcgagctgcggcccggcggcggcgcgaagttcgcccgttccgcgggtgcctccgtgcagctgctggcgaaggagggcaccatggcccaccttcgtatgccgtcgggtgagatccgcctggtcgacgcgcgctgccgcgcgacgatcggcgaggtcggcaacgccgagcagtcgaacatcaactggggcaaggccggccgtatgcgctggaagggcgttcgcccgaccgtccgcggtgtcgcgatgaacccggttgaccacccgcacggtggtggtgaaggcaagacctccggtggtcgtcacccggtctcgccgtggggtcagaaggagggtcgtactcgttctcccaagaaggcgagcaacaagtacatcgtccgccgccgcaagacgaacaagaagcgctaggagcgggtttagatgccgcgcagtctcaagaaggggcccttcgtcgacggccacctcatcaagaaggtggacgtacagaacgaggcaggcaccaagaacgtcatcaagacctggtcccgtcgctcgatgatcgtcccggccatgctgggtcacaccatcgcggtgcacaacggcaagatccacgtcccggtgttcgtcaccgagtcgatggtcggccacaagctcggcgagttctcgccgactcgcaccttccgcggccacgtcaaggacgaccggaagtcgaagcgccgctagcgcggggtggaaacgactatgacttacaccgaagggacaaccatggaagccagggcccaggcgcggtacatccgcgtcacgcccatgaaggcccgccgagtggtggacctcatccgtggcatggatgccacggaggctcaggcggtcctgcgtttcgccccgcaggccgcgagcgtgccggttggcaaggtgctggacagcgccattgccaacgctgcacacaactacgaccacaccgacgcctcttcgctggtcatcagcgaggcgtacgtggacgagggtccgaccctgaagcggttccgtccgcgtgctcagggccgggcctaccggatccgtaagcggaccagccacatcaccgtggtcgtcagcagcaaggaaggaacccggtaatgggccagaaggtaaacccgcacgggttccggctcggcatcaccacggacttcaagtcccgctggtacgccgacaagctgtacaaggactacgtcaaggaagacgtcgccattcgtcgcatgatgacgaagggcatggagcgggccggcatctcgaaggtcgagatcgagcgcacccgcgaccgcgtccgcgttgacatccacaccgcccgtccgggcatcgtcatcggtcgccgcggcgccgaggccgatcgcatccgcggcgagctggagaagctgaccggcaagcaggtccagctgaacatcctcgaggtcaagaaccccgaggtggacgctcagctggtggcccaggccgtcgccgagcagctctcctcccgcgtctccttccgtcgtgccatgcgtaagagcatgcagagctcgatgaaggccggcgccaagggcatcaagatccagtgcggcggtcgcctcggcggcgccgagatgtcccgctcggagttctaccgcgagggccgtgtgcccctgcacacgctccgtgcgaacgtcgactacggcttcttcgaggccaagacgaccttcggccgcatcggcgtgaaggtctggatctacaagggcgacgtcaagaacatcgccgaggttcgcgccgagaacgccgcggcccgcgccggtaaccgtccggctcgtggcggcactgaccgcccggccggccgcggtggccgtggtggcgagcgtggcggtcgcggccgtaagccgcagcagtcgccggcagccgaggcccccaaggccgacgctcccgccgccgctgctccggctgctgagagcaccggaacggaggcctgaccgaaatgctgatcccccgtagggtcaagcaccgcaagcagcaccacccgaagcgcagcggtatgtccaagggtggcacgcaggttgcgttcggcgagtacggcatccaggcgctgaccccggcgtacgtgacgaaccgtcagatcgagtccgctcgtatcgcgatgacccgtcacatcaagcgtggcggcaaggtctggatcaacatctacccggaccgtcccctcacgaagaagcctgccgagacccgcatgggttccggtaagggttctcccgagtggtggatcgcgaacgtcaagccgggtcgggtgatgttcgagctgtcctacccgaacgagaagattgctcgtgaggcgctcacccgcgctgctcacaagcttccgatgaagtgccggatcgttcggcgcgaggcaggtgagtcgtgatgtcggccggtaccaaggcgtccgagctgcgcgagctgggcgacgaggagctcctcaacaagctccgcgaagccaaggaagagctgttcaacctccgcttccaggcggcgacgggtcagctcgagaaccacggccggctcaagtccgtccgtaaggacatcgcccggatctacaccctgatgcgtgagcgcgagctgggcatcgagacggtggagagcgcctgatgagcgagaagactgtgactgagacgaacaccgaccgcggtttccgcaagacccgtgagggtctggtcgtcagcgacaagatggacaagaccgtcgtcgtcgctgtcgaggaccgcgtcaagcacgcgctgtacggcaaggtcatccgccgtacgaacaagctcaaggcccacgacgagcagaacagtgccggcgtcggcgaccgcgtcatcatcatggagacgcgtccgctgtccgcctcgaagcgctggcgcatcgtcgagatcctcgagaaggccaagtaattcctgagggattctcccctcgggtcagttccgccaggctcggtggggtgcctctcccgtaacggagaggcacccgccgggaaccggcagacgatcaggagatagacgtgatccagcaggagtcgcgactgcgcgtcgccgacaacacgggtgcgaaggaaattctcaccattcgtgttctcggtggctcgggtcgccgctacgcgggtatcggtgacgtcatcgtcgccaccgtcaaggacgcgatccccggtggcaacgtgaagaagggtgacgtcgtcaaggccgtcatcgttcgcaccgtcaaggagcgtcgtcgtcaggatggctcgtacatccgcttcgacgagaacgccgccgtcattctgaagaacgacggcgacccccgcggcacccgcatcttcggcccggtgggccgggagctgcgcgagaagaagttcatgaagatcatctcgctcgcgccggaggtgctgtaagcatgaagatcaagaagggcgacctggttcaggtcatcaccggtaaggacaagggcaagcagggcaaggtcatcgtggcctaccccgctcaggaccgcgtcctcgtcgagggtgtcaaccgggtcaagaagcacaccaaggccggtcagacggctcgcggttcgcagacgggtggcattgtcaccaccgaggccccgatccacatcagcaacgttcagctggtcgtggagaaggacggcaacaaggttgtcacccgcgtcggctaccgctttgacgacgagggcaacaagatccgcgttgccaagcggaccggtgaggacatctgatgactgccaccactgcgccgcgtctcaagacgcgctaccgcgaggaaatcgccggcaagctgcgtgaggagttctcctacgagaacgtcatgcaggttcccggtctggtcaagatcgtggtcaacatgggtgtgggcgacgccgcccgcgactccaagctgatcgacggtgccgtcaaggacctcaccacgatcaccggccagaagccggccgtcaccaaggcccgcaagtccatcgcgcagttcaagctgcgcgagggccagccgatcggctgccacgtcacccttcgtggtgaccggatgtgggagttcctggaccgtacgctgtcgctcgcgcttccgcgtatccgtgacttccgtggcctgtcgccgaagcagttcgacggccgtggcaactacaccttcggtctcacggagcaggtcatgttccacgagatcgaccaggacaagatcgaccgggtccggggcatggacatcaccgtggtcaccacggcgaccaacgacgacgagggtcgtgccctccttcgtcacctcggcttcccgttcaaggagaactgaccgtggcgaagaaggctctgatcgctaaggccgcccgtaagccgaagttcggcgtgcgcgggtacacccgctgccagcgctgcggccggccccactccgtctaccgcaagttcggcctgtgccgcgtgtgccttcgtgagatggctcaccgtggcgagctgccgggcgtgaccaagagctcctggtaactcccctctgccctcgggcaaagggaagttccggagactctcggtaagcatctgggtcggcaggagcccgtcctttcatgccgtaggcttgaagggttgggcgcctgccgcccaagaccgacttactacgccgtaggtccccgcaccgcacccgtcccgccactgagtggggagagggatggcgcatacaggaaaccccggcgagagaggccgaaggccaactcatgaccatgactgatcccatcgcagacatgctcacgcgtctgcgtaacgcgaactcggcatatcacgacgatgtctcgatgccgcacagcaagatcaagtcgcacatcgcggagatcctccagcaggagggcttcatcaccggctggaaggtcgaggacgccgaggtcggcaagaacctcgtcctcgagctgaagttcggcccgaaccgcgagcgctcgatcgccggcatcaagcggatttcgaagccgggtctgcgtgtatacgcaaagtccaccaacctgccgaaggttctcggcggcctgggcgtggcgatcatctccacgtcccacggtctcctgaccggccagcaggcaggcaagaagggcgtaggtggggaagtcctcgcctacgtctggtagtcgggaaaggaaggaaagctcatgtcgcgaatcggcaagctccccatccaggttcccgccggtgtggacgtcaccatcgatggccgtacggtcgcggtgaagggccccaagggttccctcacgcacaccgttgccgcgccgatcgaggtctccaagggtgaggacggcgtgctcaacgtctcccgcccgaacgacgagcgtcagaacaaggccctccacggcctgtcccgcacgctggtggcgaacatgatcaccggcgtgaccgcgggttactccaaggcgctcgagatcagcggtgtcggttaccgcgtccaggcgaagggctccaacctggagttcgccctgggctacagccacccgatcctcatcgaggctccggaaggcatcaccttcaaggtcgagtcgcccacgaagctcagcgtcgagggcatcgacaagcagaaggtcggcgaggtagccgccaacatccgcaagctgcggaagcccgacccgtacaaggccaagggcgtcaagtacgcgggcgaggtcatccgccgcaaggtcggaaaggctggtaagtagccatggcatacggtgtgaagatcgccaagggcgacgcgtacaagcgtgccgccctcaagcgccgccacatccgcgtccgcaagcacatctccggttcgccggagcgtcctcgcttggtcgtgacgcgttccaaccgccacatcgtggcccaggtcatcgacgacatcgcgggccacacgctcgcgtcggcgtcgaccctggacacctcgatccgtggtggcgagggtgacaagagcgcccaggcccagcaggtcggcgccctggtcgccgagcgtgccaaggccgcaggcgtcgaggccgtcgtgtttgaccgcggtggtaaccagtacgccgggcggattgccgctctggctgacgccgcccgtgaagccgggctgaagttctaagccccggttcctacgcacagcggacgtaacagagagaggtaaatccaatggctggaccccagcgccgcggaagcggtgccggtggcggcgagcggcgggaccggaagggccgtgacggtggcgccagcgccgccgagaagaccgcgtacgtcgagcgcgtcgtcgcgatcaaccgcgtcgccaaggttgtgaagggtggtcgtcgcttcagcttcaccgcgctggtcgtggtgggcgatggtgacggcaccgtcggtgtcggatacggcaaggccaaggaagttcccgcggccatcgccaagggtgtcgaagaggccaagaagaacttcttcaaggtcccgcgcatccagggcaccatccctcacccgatcacgggcgagaaggctgcgggcgtcgtcctgctcaagccggcgtcccccggtaccggcgttatcgccggtggcccggtgcgtgccgtgctcgagtgcgccggcgttcacgacatcctgtcgaagtcgcttggctcgtccaacgcgatcaacatcgtgcacgcgaccgtggcggccctccagggcctgcagcgtcccgaggagatcgcggcccgccgcggtctgcccctcgaggacgtcgcccccgcggctctgcttcgtgcacgtgcgggagcgggtgcgtaatggctcgcctcaagatcacgcagacgaagtcgtacatcggcagcaagcagaaccaccgcgacaccctgcgttcgctcgggctcaagcgcctgcacgacacggttgtcaaggaggaccgccccgagttccgcggaatggttcacaccgtccgccacctcgtgacggttgaggaggttgactgacatggcggagaacagcccgctgaaggcccacaacctccggcctgccccgggcgccaagaccgccaagacccgtgtgggtcgtggtgaggcgtccaagggtaagaccgcaggccgtggtaccaagggtacgaaggctcgttaccaggttccggagcgcttcgagggtggccagatgcccctccacatgcgtctcccgaagctcaagggcttcaagaacccgttccgcacggagtaccaggtcgtgaacctggacaagctcgcgacgctctaccccgagggtggagaggtcacggtggccgacctggtcgccaagggcgctgtgcgcaacaaccacctcgtcaaggtcctcggacagggcgagatctccgtggcactgcaggtttcggttgacgccgtttccggctccgccaaggagaagatcaccgccgtcggcggtacggtcaccgagctcgtctgagccgcgggacagaactgagcctggccggccgcctcttcggaggtggccggccaggcttttctgtgtttgtgccgctgtacgggaaccgtaaaggctcgggaaaggttgaacgggtgtccaccgcaccggcggtgggggagcggaggggcgttcacgtcccaaatggtgtggcttggccggtcttccgcggcgcgggccgggaagcgggccgtgcaccggtgtgcggcgcgtgtttcctgctcagtcccgggccgggtagggtggcgccgttaatcttttgtggcctccttacgatgtagggctgccttgtatccgatcccgtccagtcccatccagacccgtcgcctctgacgcatagcgcgggggtcgcaggaggcaccgtgttcaccgcgttcgcccgagcgttcaagacgcccgacctgcgcaagaagctgctcttcacgctcggcatcatcgtgatctatcggctcggggcgcatgtcccggcccctggcgtcgactacacgaaggtgcagcagtgcatcgaccaggccgactcgggtggtctcctcggtctgatgcagatgttcagcggtggcgccctgttgcagatcaccatcttcgcgctcggcatcatgccgtacatcacggcgagcatcattctccagctgctgaccgtagtgattccacggctggaagccctgaagaaggaggggcagtccggcacggcgaagatcacgcagtacacgcgttatctgacggtcgcgctcgccgtcctccagggcaccggactcgtggccaccgcgcgcagcggtgcgctcttccagaactgttccgtgggcagccagatcgtcgcggacaagtcggtcttcaccacgatcatcatggtcctcacgatgaccgccggtacggccgccgtcatgtggctcggtgagctgatcaccgaccgcggcatcggcaacggcatgtcgatcctgatgttcatctcgatcgccgccacgttccccggcgccctgtgggccatcaaggagagcggcaagctggccgacggctggatcgagttcggcacggtcatcctcatcggcttcgtgatggtcggcctcgtcgtcttcgtcgagcaggcccagcgccgcatcccggtgcagtacgcgaagcgcatgatcggacgcaggtcctacggcggtacgtccacgtacatcccgctgaaggtgaaccaggcgggtgtgatcccggtcatcttcgcctcgtcgctgctctacattcccgcgctgatcgtccagttctcgaactcgcaggccggctgggcgacctggatcacggacaatttcgtcgggcagaacgagccgtactacatggtggcgtacttcctgctgatcgtcttcttcgccttcttctatgtggccatctcgttcaaccccgacgaggtcgccgacaacatgaagaagtatggtggtttcatcccgggtatccgtgcaggtcgtcctactgccgaatacctgagctacgtgctcaacaggatcacttggccaggctcgctgtacctggccctgatcgctcttgtgccgacgatggcgttggcgggcttcggcggtgcgaacgcgaacttcccgttcggcgggacgagcatcctcatcatcgtgggtgtgggtctggaaaccgtgaagcagatcgagagtcagctccagcagcgcaattacgaagggttcctccgctgatgcgaatcgtcctcgtcgggcctccgggtgccggcaagggaacgcaggctgcgtaccttgcccgaaacctctcgattccgcacatcgccacgggcgacctcttccgcgccaacatcagccagggcaccgaccttggcaagcaggcccgcgcctacatggacgcgggccagctggtgccggacgaggtcaccatcgggatggccaaggaccgtatggcccagtcggacgccgtgggcggcttcctgctggacggcttcccgcggaacgtcggccaggccgaagcccttgacgtgatgctcaaggacgagggcgtgaagctggacgcggtcctcgatctcgaggttcccgaggacgaggtcgtgaagcggatcgcgggtcgccgcgtctgccgcaacaacagcgcgcacgtcttccacctgacgtacaacccgccgaagaccgagggcgtctgcgacgcctgcggcggcgagctgtaccagcgggacgacgacagcgaggagacggtccgtacccggctggaggtctaccacacgcagaccgagccgatcatcgactactaccgggcccagggcctcgtggtgaccatctccgcgctgggcaaggtcgcggacgtgaccgcccgcgccatggaggcgctgaagacctccgacgagggctgagcgtcacccccgcaccacccgtagtgcaagccggccgcggcgcctcagggcgccgcggccgactgcttgcgcccgtatcgttgaacctgccgagccgtacccgtcaccgtcgatgcagagaggcgccgagcaatggtgcagatcaagacccccgagcagatcgcgaagatgcgcgaggcgggcctggtggtcgctgccattcacgccgccacccgtgaggcggccgttcccggggccaccacgcacgacctggaccaggtcgcccgcaaggtgatcgccgaccacggcgccaagtcgaacttcctcggttacggcgggttccccgcgaccatctgcacctcggtcaacgaggtcgtcgtccacggcatcccggacgagaagacggttctgaaggacggcgacatcatctcgatcgacgccggcgcgatcgtcgacggctggcacggcgacgcggcctacacggccttcgtgggcaccggtcacgctccggagctgatcgagctctcacgggtgaccgaggagtccatgtgggccgggatcgccgcgatgaaggtgaacaaccgcctcgtcgacatctccaaggcgatcgagtcctacatccgccgccagccccgcccggcgaccggcaagtacgggatcatcgaggacttcggcggccacggcatcggcaccgagatgcacatggacccgcacctgctgaactacgtctcccgcaagcgcggcaagggcatcaagctggtcccgggcgtctgcctggcgatcgagcccatggtctcgctcggcacggcgcggacggagaccctgagcgacgactggacggtcatcacgacggacggcacctggtcctcgcactgggagcactccatcgcgctgaccgagcagggcccgctggtcctgacggccccggactgcggcagggcgaagctcgcggagtacggggtcgaggcggctcccgaccctctcgggtgatgtgatccctcggggaggtctaaggatcaccccggctgggcaaacttgacggattcgtcttttggagtccgctgacgtagactgactcgtcggctctcgtgcatcagtgtgcccgcatatcagcacaccgacaagcaagagccgatcaaggtagccgattcgaaaggcgaagcgtggccaagaagcaaggtgccatcgagattgagggcaccgtgatcgagtccctcccgaacgcaatgttcaaggtggagctccagaacggtcacaaggtcctggcgcacatcagcggcaagatgcggatgcactacatccgcatcctcccggatgaccgggtcgtggtggagctctctccgtacgacctgacgcgtggccggatcgtctaccgctacaagtagatcttgccggcaccccgtttcggcgggtgatggcactgacccggagaacctgacatcccatgaaggtcaagccgagcgtcaagaagatctgcgacaagtgcaaggtgatccgccgtcacggtcgggtcatggtcatctgcgacaacctgcgccacaagcagcgccagggctgacgcacgaccgcctgcatctcgcagttcttcgcgcgacgcacgtaattcgtacatacgcagtgcccgtccaagccacggctgacgacacctccggcgggggccggggacccggacgtaccaccgctcctcgtgagcggtcggcggtcgggagtggtgctgcggaagacccccgatataacaactggagccattgaatggcacgcgtttcaggtgttgacatcccgcgcgaaaagcgcgtggaggttgccctcacctacgtcttcggtatcgggcgcacccggtccaaggagatcctcgccagcaccggcgtgaacccggacgcccgcgtccgcgaccttgccgaggaagacctcgtcaagatccgcgagtacgtggacgccaacctccgcaccgagggtgacctccgccgcgaggtccagggcgacattcgccgcaagatcgagatcggctgctaccagggcattcgtcaccgccgtggtctgccggtccacggtcagcgcaccagcacgaacgcgcgtacccgcaagggcccgcgtcgcgccatcgccggtaagaagaagccgggcaagaagtagtcctcagcggacgcactgcggacctccggttctccggaacccgcagcaaccagcggtcttcgctgtaggaccgatcacctcccctctccatctggagtcaagacatgccccccaagggtcgtcagggcgcagccaagaaggtgcgtcgcaaggaaaagaagaacgtcgctcacgggcacgcgcacatcaagagcacgttcaacaacaccatcgtctcgatcacggaccccgcgggcaacgtgatctcctgggcctccgccggccacgtcggcttcaagggctcgcgcaagtccacccccttcgccgcgcagatggccgccgagtcggccgcccgccgcgcgcaggagcacggcatgcgcaaggtcgacgtcttcgtcaagggtcccggctccggccgtgagaccgcgatccgctccctccaggccacgggcctcgaggtcggttcgatccaggacgtcaccccgacgccgcacaacggctgccgtccgccgaagcgtcgccgcgtctgatgcgtcgcggccggtgacggccgtgcgtcagtagcgtcaggtccgggcggtacgcctcattcggggcgtaccgcccgtacccttgttacatctgtcgggcatcaaatagtgggtgcccacgactgaaggatcaccgcatgcttatcgctcagcgtccgtcgctgaccgaagaggtcgtcgacgagttccgctcccggttcgtgatcgagccgctggagccgggcttcggttacaccctcggcaactccctccgccgtaccctcctctcctcgatcccgggcgccgctgtcaccagcatccggatcgacggggtcctgcacgagttcaccaccgtgccgggcgtcaaggaggacgtgaccgacctcatcctcaacatcaagcagctggtcgtctcctcggagcacgacgagcccgtcgtgatgtacctgcgcaagcagggcccgggtctggtcaccgccgccgacatcgcgcccccggccggtgtcgaggtgcacaacccggacctcgttctcgccacgctcaacggcaagggcaagctggagatggagctgaccgtcgagcgcggtcgcggctacgtctccgccgtccagaacaagcaggtcggccaggagatcggccgtatcccggtcgactccatctactcgccggtgctcaaggtcacgtacaaggtcgaggcgacccgtgtcgagcagcgcaccgacttcgacaagctgatcgtcgacgtcgagaccaagcaggccatgcgtccccgtgacgccatggcgtcggccggtaagaccctggtcgagctgttcggtctggcgcgcgagctcaacatcgacgccgagggcatcgacatgggcccgtccccgacggacgccgcgctcgccgccgatctcgccctgccgatcgaggagctggagctcaccgttcggtcgtacaactgcctcaagcgcgagggcatccactccgtgggtgagctcgtggcccgttccgaggcggacctgctcgacatccgcaacttcggcgccaagtcgatcgacgaggtcaaggcgaagctggccggtatgggcctcgcgctcaaggactcgcctcccggcttcgacccgaccgccgccgccgacgccttcggcgccgacgacgacgcggacgccggtttcgtggagaccgagcagtactgatcgccttccggcggggggtgcccggtttggagggtgcccccgggccggggctgaggctttgtcctcaatcgccggacgggcttgatttcggctgatgtccggcgaacgtcgggcgggcttgagtgtggctgatgccggactccgagcccgaccggcagctatgacttccgggaggcgtccgcctcgcgggaactgacaccggtacctgatacggccggtgcagcacacaaggagaatcaccatgccgcgtcccgcaaagggtgcccgtctgggcggcagcgccgcgcacgagcgtctgctcctcgccaacctggcgaagtcgctgttcgagcacggccgcatcacgacgaccgaggccaaggcccgtcgcctgcgtccggtcgccgagcgcctcgtcaccaaggcgaagaagggcgacatccacaaccgtcgcctggtgctccagacgatcacggacaagagcatcgtccacacgctcttcaccgagatcgctccccgatacgagaaccgccccggtggttacacccgtatcaccaagatcggcaaccgtcgtggcgacaacgccccgatggcggtcatcgagctggtcgaggcgctgaccgtggcccagcaggccaccggtgaggccgaggccgccacgaagcgcgcggtcaaggaagacgccctcaagaaggacgaggcccccgcggccgagtccgtcgaggacgccaagccggccgacgacgcggagtccaaggacgcctgagcgttccagcgaccacgggacgggcccgcatcacccttcggggcggtgcgggcccgttctgctgaccaggggcatggagaggatgacgcggtgagtgacgaggcggagcccgggttcgtacgggtgcggctggacctggcctacgacggcaaggacttctccggctgggcgaagcagaccagccggcgcacggtgcagggtgagatcgaggacgcgctgcggaccgtgacccgctccgccgtgacgtacgacctgacggtggccggccggacggacgccggggtgcacgcgcgcggccaggtggcgcacgtggacctgccggaggcggtctgggccgagcacgaggagaagctgctgcgacggctggcgggccgacttccgctggacgtccggatctggcgggcggctcccgcgccggccgggttcaacgcccggttctccgcgctgtggcggcggtacgcgtaccgggtgggggaccggcccggtggcgtcgatccgctgacccggggtcatgtgctgtggcacgaccggtcgttggacgtggacgcgatgaacgaggcggccgcgctgatggtgggggaacacgacttcgccgcgtactgcaagaagcgcgagggcgcgacgaccatccgtacgcttcagaagttcggctgggtgcgggatcccggctccggggtcctcaccgcgaccgtgcaggcggacgcgttctgccacaacatggtgcgggcgctgatcggggcggcgctgttcgtcggcgacgggcggcggccggccgggtggcccgccgaggtgctcgccgcgaaggtgcgcgaccccggggtgcacgtggtgcgcccgcacgggctgacgctggaggaagtggcgtatccggcggacgagttgctggcggcccgcgccgtggaggcccggaacgtacggacgttgccggggtccggctgctgctgagcgttgctccggcgggaactcccggtcgcccgaccgggagttcggcgccgaggccgtcggcccgtcagccgttggggtcggcggcggcctgggaggcctggagctggccccggcggtggatctggcggaaggtgaagttcgtcaggtccttgttgaccgcgtagacggccttgtccgccgtggtgacccgcttgccgttcaggaagccgccgacggtgaagtaggcgtagcggccgtaggagttggccgtgcgcaggcagaccgtgccgccccggcagaaggtgtcgacaccgccgccgctgagggaggcgaggccgcccgagctctggtcgacggccttcttcgcgcgggcctccgtcccgaagacggcgatgccgaccgtgacggccaccccgtccttgcggtaggtggcccggatgagccggtcgcagccgttgttcgcgaggaccgagccgagagcgccctgggtgcccgtcgtgcacttcgcggtgctgctcgtcgcgcccttgaggtggacgcggtcgcccatggtgagcttcctgccggggaagaacccgtcgacggtgatcggcgccctgtccttctcggcgctggagatgtactccttggggtccggcgggggtggcggcgcgaccgaggagaacgagggcgcgggcgccgaggtgtcctcggggagctcggcgggtgcgggcagccggctcgcgttgttgtccgccttgcccgtgccgccgccgttcgacgtgaccacggccgtggtcacgatcgcgccgatcgccacggtggccagcgcgccaccgccgatcatcatcagcttcttccggcgggcgcgcgccgcggattcctccgccagcgccgcccagtccggagtcccgtcgcccccgggcccccaggaggcccccccttgcccaaagctcatgcgcgcagtttagagggagacgtaaaccggttgggacaacagttcgcggaccgtgacaatgctctgtatgggacatctcgaagcaggccacctggagtactacctaccggacgggcgggtgctgctcggcgacgcctcgttccgggtggccgacggggccgtcgtcgcgctcgtcggggcgaacggggcgggcaagacgaccttgctgcggctgctggccggtgagctccagccgcacggcggcacggtgtcggtgagcggcgggctcggtgtgatgccgcagttcgtgggctccgtgcgggacgagcggacggtgcgggaccttctggtgtccgtggcgcagccgcgcgtccgggaggcggcgaaggcggtcgacgcggccgaggagaagatcctcaccgtcgacgacgaggccgcgcagatggcgtacgcgcaggcgctcagcgactgggcggaggcgcgcggctacgaggccgagacggtctgggacatgtgcaccatggccgcgctgggcgtcccgtacgagaaggcgcagtggcgcgaggtgcgcacgctcagcggcggcgagcagaagcggctggtgctggaggcgctgctgcgcgggcccgacgaggtcctgctgctggacgagccggacaactatctggacgtgccgggcaagcggtggctggaagggaagctgaaggagacccgtaagacggtcctgttcgtctcccacgaccgggagctgctgtccagggccgcggagaagatcgtcagcgtcgagccgagccctgcgggcagtgacgtatgggtgcacggcggcggcttcgccacgtaccacgacgcgcgcaaggagcgcttcgcccggttcgaggagctgctgcggcgctggcaggaggagcacgcccggctgaaggcgctcgtcctgcggatgcggcagcaggcggcgaacagtcccgacatggcgaaccgctaccacgcgatgcagacccgcttcaagaagttcgaggaggccgggccgccgccggagccgccgcgcgagcaggacatcaggatgcggctgcgcggcgggcggaccggggtgcgggcggtgacctgcaagaacctggagctgaccgggctgatgaagccgttcgacctggagatctactacggggaacgggtcgcggtcctcggttccaacgggtcgggcaagtcgcacttcctgcggctgctggcgggggagccggtggcgcacacgggggagtggaagctcggggcgcgggtcgtgcccgggcacttcgcccagacccacgcgcatccggagctgctcggtaagacgctggtggagatcctctggtccgagcacgccaaggaccggggcggggcgatgtcggtgctgcggcgctacgagctggagcggcagggggaccagccgttcgagaagctgtccggcgggcagcaggcgcggttccagatcctgctcctggagctggccggcaccacggcgctgctgctggacgagccgacggacaacctggacctggagtcggcggaggcgttgcaggacgggttggaggtgtacgacggcaccgtgatggccgtcacgcacgaccggtggttcgcgaagtccttcgaccggtatctggtcttcggct

SEQ ID NO: 2734 - DNA, 3453 bp, Unknown
  Kingdom: Bacteria, Phylum: Actinobacteria, Class: Actinobacteria, Order: Streptomycetales, Family: Streptomycetaceae, Genus: Streptomyces
ccgccgggtcgtcgcccggcgctaccaccgcctcccctcccgcacgctggcgatgggcctgtccaacggcggctatctggtgcgctggcagctggagaaccatcccgggctgtacgacggcggggtggactgggaaggcgcgctctggcgcgcggacgggccgaacctcctcaccttccttccgcccgccctccgcgcctacccccgctacgcggccgggggcgcggacgccgaggacgcccaccgcaccatgacggccgctggctacccggccggttcggagttcctctggccgtaccatcaccagttctactgggacctcacccaacggatctaccgggaggagatcgacccggacttcgacggcgcggccgaggcgggcactcccttctgcgcaccgggaacccccgcgtgcgacgccgactacgactacgcgggacggccggccgaggtgcgcgacgccgtgtcggggatcgccctgaccggccgcatcgggaaaccgctgatcagcttccacggcaccctggacgtcctgctcccgatctccaggacctcggacacgtacgcgcggatggtgcggcgggagggccgaggcgcgctccaccgctactaccgggtcgagggcggcacccatgtggacgcgctcgtcgacaccttccccgaccggctgcggccgctcgtggcgtgccaccgttcggcggccgcggcactggaacgatggctggacgacggccgacggcccccgtcgagccgcacgctggagctgcccgcagggtccggccccgccgagctgctcggccgctgcccgctggacgggtagcgggctccgaccggtcgccgggtggcggtgcccgccatgtctccgccgcccactgtggagatccgcaccatgggatgtccggccgggtgtctctagcgtttccggccatgacgagccaatttcacgcagcttccggttcctccgcgccgggcgccggggccgtggacctcagggggcgcaccgccctggtcaccggcggcggcagcggcatcgggcgggccaccgccgaggcgctcgccggggccggcgccctcgttcacgtggtcgaccgcgaggccgggagcgccaagtccgtcgccgccgcgatcggcggtgtggcccacgtcgtggacctggccgaccccgaggcggtcgggacgctgccgagggatgtggacgtcctggtgaacaacgccgggctgcagcacgtggccgccatcgaggacttcccaccggaccgcttcgagctgatccagaaggtgatggtgaccgccccgttcctgctgatgcggcactgcctcccgcacatgtacgccagggggtggggccggatcgtcaacgtctccagcatgcacggactgcgggccagcgccttcaagtccgcctacgtcgcggccaagcacggtctggagggactgagcaaggtggccgctctggagggcgcccctcacggggtgaccagcaactgcgtcaaccccggttatgtgcgcacgccgctggtggagggccagatctcgggccaggccgccgcgcacgggatccccccggaggaggtcgtcaccgacatcctcctggaccggtccgcgatcaagcggctgatcgaacccgaagaggtcgccgcggtctgccgctggctctgcggcccccacaccggatacatcaccggcgtctcgctccccgtcgacgggggctggggcgcccactgaccccacctccgccacggtcccccaccgtcggcgccggctgcacccgctcgtaccgctgcacccgttcgtaccgctcgcgactccgccccgccccgcactcccgtccctgaccgccctgccaatgaaacgcggtgactccaccatgggttcccccagttccgtccagccccccggaggcaagatcggccgcatcgtcgcggccagcctcgtcggcaccaccatcgagtggtacgacttcttcctctacggctcggctgccgcgctcgtgttcaacacgctcttcttccccagcagcgatccgctggtcggtaccctgctggccttcctgacctacgcggtcggcttcgccgcccgtccgctcggcggcgtcgtcttcggccactacggcgacaagatcggccgcaagaagctcctcgtgctcagcctgctcatgatgggcggcgccaccttcgccatgggactgctccccacccatgcgagcatcggcgtctgggcgccgatcctgctcaccttcctgcgcctggtgcagggcttcgccctcggcggggaatggggcggagcggtgctgctcgtctccgaacacggcggcgacgagcgccgcggcttctgggcctcctggccgcagtccggtgcgcccggcggcaatctgctggcgaccggcgtcctggcgctgctggccgccgtccagtccgacgaggcgttcctcgcctggggctggcgcatcccgttcctgctgtccggcgtcctcgtcatgatcggcctgtggatccggatctcggtcgaggagtccccggtcttcctggaggcgcagcagcggtcggccgccgcggcggcgcagggcgtcaaggaacaggccccggtcgtccaggtgttccgcaagagctggcgcgaggtgctcctcgcgatcggcacgcgcttcggcgagaacatctcctactacatcctcaccgcgttcctgctggtctacgtgaccgtgcacctggagatgtccaggagcgacgccctcaacgccgtcctgatcggctccgcggtgcatttcgtcaccatcccgatgtggggcgcgctctcggaccggctgggacgccgcccggtcacgctgatcggtgcggtcggcatggcgttctgggcgttcggcttcttcgcgctcctggacaccaggtcctttcccgtcatcgtcctcgcggtcaccgtcggactgctgctgcacggtgcgatgtacggtccgcaggcggccttcatctcggagatgttcgacacgaaggtccgctactccggcgcctcgatgggctcccagctcgcctcgatcatcggcggcgccctcgctccgctcatcgcggtcgaactgctcaaggactacgagtcgtccgtcccgatctccgtctatctctgcttcgcctccctggtcaccgcggtgacggtctgggtggccaaggagacccgcggccgcgacctcgccaaggacggcgtcgacggctccgtcccggcggcgccggtcgcggccgtcaaggactcggtccccctcggccactgatcccagccctcccgcgcaccgctccgtgcggtgcgcgggagggccgtccccgttgtccgctcggccctcccgggaggcgatcaccgtatgctcaccggcgtgacaccaccggccgcccagcactccgcgcctgccctgcgccggctcctcgacctgctggcgcagggtgcggcggtcgaggagttcgaccggcgcac

SEQ ID NO: 2735 - DNA, 1811 bp, Unknown
  Kingdom: Bacteria, Phylum: Actinobacteria, Class: Actinobacteria, Order: Streptomycetales, Family: Streptomycetaceae, Genus: Streptomyces
acgcggcccggtatccggccaggttggagcgcttggagagcgagtggacggcgacgatgccgtcgtagtgcccgccgcagacgtccgggtggagcaccgataccggctcggcgtcccagcccagctccaggtagcactcgtcgctgaagaccagcacgccgtgctcgcgcgcccaggcgacgatccgggtcagctcgtccttggacagcaccttcccggtcggattggagggcgagttgagccagagcagcttcagccccgccgggtccagctcggtcgggtcgtcgtagacgacgggctccgcgccgcagagccgagcgccgacctcgtacgtcggataggcgagccgggggtaggccaccttgtcgcccgcgccgagcccgagctgcgtcggcagccaggccaccagttccttggaaccgacgaccgggaggacgttggcgtgggtcgcgccgaccgcgccgaggcgccgccccacccagccggtgagcgcgtcccgcagggcctcggtaccccacaccgtcggatagccggggctgtccgcggcggcgaccagcgcgcgctggatcagctcggggaccgggtcgaccggagtgccgacggacaggtccacgatgccgtccgggtgggcctgggccgtcgacttgtagggcgcgagcttgtcccaggggaagaccgggaggcgggaggagactgcggacacggcgctctgctttctcgggtgttctcgttcgggcggcggatcggacgcgcggtgacggatcccggcgggaccggggcccggtgacggatcccggcggtacggggaaacgcctcggtcccgcacggtgacaagccgtacgggaccgggccgcgcgcgtggtgccgccgcttactggttctgcggcggcagtccggcgatgaacgcgtggtcgcgctcgatgagaccgagcttggaagcaccgcccggcgagccgaggtcgtcgaagaactcgacgttcgccttgtagtagtccttccactcctccggagtgtcgtcctcgtagaagatggcctcgaccgggcagaccggctcacaggctccgcagtcgacgcactcgtccgggtggatgtacaaggaccgctggccctcgtagatgcagtcgacggggcactcttcgatgcaggccttgtccttcacgtcgacacaaggctgcgcgatgacgtaggtcacgctgtcgttcctcctcggtagggcgttggctctcgcgcgggagcgcggcgtcgtcgatgcccgcctctagtatctccgttctcgggcacgatccgaacaggaggggcggacagagctgtggaattcaccatcggcggacggctggaagtccgcatcacacccgctgacgtgggtaaacgcgtgtctgttcgacgccggacggacggcgggggcacgggcgcgcagttcaccgacgtggtcggggtgctcacatcatggaacaacggtgtgctctcgatcacaccaaagagcggggaatccgtccacatcgtggaatcctccttggtcgcgggcaaggtcgtccccgccgccccggcccgccgtcgtggccccgccgcctccttcgcggagctggcctccgtcaccgcgcgcgcctggcagcccgtggagagcgaagcgctgggcgagtggcggctgcgcgccgccgggggcttcacgcggcgcgccaactccgcgctgccgctcggcgatccgggagtgccggtcggcgaggcgctcggacgggtccgggactggtacgaggagcggggcctgcccgcgtacgtccagacggcgaccggggccgcgggcacgcaggagc

SEQ ID NO: 2736 - DNA, 13706 bp, Unknown
  Kingdom: Bacteria, Phylum: Actinobacteria, Class: Actinobacteria, Order: Streptomycetales, Family: Streptomycetaceae, Genus: Streptomyces
ggccctcagcagcgcggggatctccgcacgcgtgaggcccgccgcgacggccggttcgaggcccgcgctgtaggtgtgggcgccgaccgggagccgcccgtcggcgaggaggtagggggcgagcagcgacatcagaacatgctgtaccgctgggccagcggcagttcggcggcgggggctggctcgacgagctccccgtcgatgcggatggcgaaggtctccgggtccacgtcgatggccgggagcgccgtgttgttcggcaggtccgccttggtgaggtgcctggtgggacgtacggcgaccaactcccggaccaggccgagccgttcggccaggccgtcggccagtgccagcggagagacgaagctgaccgacaggtgcggcgcggcctcggcggcggcggtggcgcgcatgaggaccggctgcgtggtggggatcgccgcgcccgcgtcacccagcggcgcgtacacggccatgccgcccttgatgacggcggcgggccggatcccgaagaaggcggggtcccagagcaccaggtcggcgagtttcccgggctccacggagccgacgacatggtcgatgccgtgggcgacggccgggcagatcgtgtacttggcgacgtagcggcgcgcccgctcgttgtcggccggcagttcgctgccgcggtcgccgaaccgctgcttcatgacgtgggcgacctgccaggtacggcagacgacctcgccgatgcgtcccatcgcctgggcgtcggacgaggtgatggagagtgcgccgatgtcgtgcagcacatcctcggcggcgatggtggtggcccggatccgggactcggcgaacgcgaggtcctcggggacccggggattgaggtggtggcacaccatcagcatgtcgaggtgctcggcgaccgtgttgacggtgtgcgggagcgtcggattggtggacgccgggaggatgttcgggtgggaggccacggtgatgatgtcgggagcgtggccgccgccggcgccctccgcgtggaagacgtggataccgcgtccggcgatggcgtcgagggtgccttcgacgtagccgacctcgttgaggctgtcagcgtgcagcgccacctggacgccgtaggcgtcggccgcccgcagcgcggcgtcgatcgcggccggggtggcgccccagtcctcgtggaccttgtatccgccggcaccgccgagggccgcctcgcgcagggcttcctcgcccacggtggagcccttgccgaacagcatgacgttgagcgggacgcggtccagggactggtgcatcatcgcgagattccacgcaccgggcgtgacggtggtggccttggagccctcggtggcgccggtgccgcccccgatgacggtggtggtgccggtggcgagcgcctcgtggagggtttccggcatcaggaagtggacatgggtgtcgacggctccggccgtcaggatgcggccctcgccggagatcacgtcggtgcccgggccgatcaccaggtccgggtgcacgccgtcgctgatgtcggggttgccggaccggccgagggcgacgatccgcccgtcgcggacgccgatgtcggtcttgacgacaccccagtggtccaggacgaccgcgttggtgatgaccaggtcgggcgcgccctcggcgcgggacgcggtggcctgggccatcgactcgcggatggacttgccgcccccgaacacggcttcgtcgccgccgaagcaccggtcctcctcgacctcgatccagagatcggtgtcggcgaggcggatccggtccccggtggtggggccgtagagcgaggcgtaggcggcgcgggtcagctgggccatgtcacaggtcctccgttcgaggcatgggcgtgggcgtgggggcgggtgtgcgggtcccgggcagcacgatgccgggaacgcggcggcgtccgcggagttcgacgaggctgacgtcgaccccgacccccggttcgaagcgcagggacgtgcccgagggaatatcgagccgaaatccccgggccgcgacccggtcaaaagaaagcgccggattagcgtcggagaaatgcagatgggatccgacctgaatgggccggtcaccgtcgttgaccacagtgagcggcaataccgcgctttcggcattgatgtgcagcactccggatccggtccggatctcgcccgggatcacgggatcggggaggtgatcgtgacgagcttgcgtccgtccgggaaggtcgcctcgacctggacgtcgtgcagcatctcggggacgccttccagcacttcagcacgggtgagcaccgctctccccgccgtcatcagctcgctgaccgaagctccctcacgggcccgctccatcgcccagcacgcgagcagggccacggtctccggatagttgagacggacgccgcgcgcccgccggtcacgggcgatcattccggcaacactcagcagcaatttctccgtgtcggacggagtcagaaacatgggaaacctccatggcggcctccccggaattcccggcggcgcctgaaccacatgcttcttatagctcttctcgtcgaggcgtggcaaattctcacgcacggcaaaaagtccctttttgtggttacgaccccctacatacgggcaaaacgtacaaaaaacggcctgccatttcagcaccagagggctcgtagcgcaccggtcggcgccccgggaaccccgcactgagccggtgacccggatcacattccactcctgtcagcaatcggagcgctgtcccgttcaaggggtacgcgaacgagacaggagccatgtcatgaagcaccgcatcgtcgtcctcggcgccgggtacgccggggctttcgccgccggcaacctggcccgccggctctcccccgccgacaccgagatcaccgtcgtcaacgccgcacccgatttcgtcgagcggatgcggctccaccagctcgcgagcggccaggatctgacgtcccgcaagctcgccgacgtattcgccggcaccggggtgcggctgcgtctggcgcgtgtcaccggtatcgaccccgagcgcaggaccgtcgccgtgaccggcgaggacggttccgccgaactcgcctacgacacccttctctacgcgctcggcagctccgtcgcccaccgtgacgtccccggcgcggccgcgtacgccttcgatgtggccggccggtcctcggcgctgcgcctgcgcgagcgcctggccggcctgggcgagggcggcaccgtcctggtcgtcggggaggggttgaccggcatcgagaccgcgaccgagctcgccgagtcgcaccccgggctctcggtcgcgctcgccgcccgcggcgagttgggcgcctggctctccccgaaggcacgccgtcatctgcgcggcgccttcgaccggctcggcgtcaccgtgcacgaacacaccgccgtcgaagccgtcgagccgacacgggtgatcgccgccggcggcaggtccatcccggccgatgtgaccgtgtggtcggccggattcgccgtgcaccccatggcggccgccggcggcctggaggtcgccggtaccggccagatcgtcgtcgaccgcaccatgcgatcggtctctcatccggacgtctacgccgcgggcgactgcgcctacgcgatcggcgagaacggccggccgctgccgatgtcctgtgcctcggcgggtctcaccaacatgcgggcgaccgccgcgatcgtcgcgcgtctgacgggccgcgaggtcccggccaccgggctgaagtacttcggcaaccacatcagcctcggacggcgggacgccatcttccagatggtggacggggacgtccggtcgaaggcctggtacctgggcggccgagccgccgcacggctcaaggcgggcgtgctcaagggggcctggtggggcatcgcccatccgaccttcggcctgccgaagcggcggcaccgcctggcccccgcgcccggccggacgggtgcgcgggtcgccgcctaggctgttgcgcatggacagcgcagccgtcgatcagttcgaggccggccggggcaggctggcctccctcgcgtaccgtctgctcggctcggcggccgacgccgaggacgccgtgcaggacacgttccttcgctggcaggccgcggaccgagagcggatcgaggtgccggaagcatggctgaccaaggtcgtcaccaacctctgcctcgaccggctccgctcggcacaggcacgtcacgagcgaacggccggcgcgtggctgcccgaaccgctcctcgacggcgaccccatgctcggtcctgccgacaccttcgagcagcgtgaatcggtgaccttggccgtactgaccctcctggagcgcctctcgcctgccgagcgggccgtctacgtcctgcgtgaggccttctcgtacagccacgccgagatcgcctcgatcctcgacatcaccgagtcggcgagccagcagcatgcccatcgggcgcgtacccgagtcaccgccgagcgccgccgcggcgcggccgacccggcgtccgcgcgccgggtcgtcgaggagttcctcgccgccgccacgtcggggcgcaccgatcggctggtggcactgctcaccgacgacgtgacggcggtctcggacggcgccggactggccaggcggctgctgcggtacaggtcgcgcgagcgggtcgcctccttcgtacgggcgggtttcaagccgacgccggcgaagcggcggctggccggcggctcgctcgcgatgcatctcgcgcgggtcaacggcaccccggccgtcgtcgccgtggtcgggggccgggtcgtgggcgccgtggcgttcgaggtcagcgacggcaaggtcgcgtccctgtacggcatcgccgccacggaccggctcgcacgcctcgacgaggcgtggcagcaccacgaacccggcgtaccggtcatcgacgcgtggtgacccgtcgtggcgaagtcggcggaggaggacgacgcggctccatcccccgccgccacggccgagaccggtgggcggagatcgtcgaccacgacgaaaccgaccccgcgacgccctcgacctctacggcacccgcctgtgctgccacgccgtcagacgtggctcgaagagccggcagaagcgggaccggtgaagcagctgccgcgcgccgccgaccgctcaccggccacgcgacgtcagcagctgcgggagttgtaagtggaccagtaggggccgcccccagtgggcgggtagaaccggtagttcccgtcgggcgaacgctgcaacacgaaatcgtgcgagctgtacgagctcctggaacccctcacgccgtcgaacaccacatacagccacccgttctggttgtcgtgctgcgtgattctgttccctgcctttgtccagctgttccggccggcggatccgtccgcggtaaggcccccgtccgcttggaatctcctcgtcgcggaatcactctggtcgccgaagacaccatcgatcccggacgagggcaagtagccatttgcccaaagaatcgtctgccagagacaggcgacgttcgaggagcggtgcgtcccgacgttgacgacgccctcgtcgtcgaagtcgtcgccaaccgtgccgctgccgtaaacgtacgacctgccgctgtaggagccgctggccgcagccggggtggcggtggtgacagtgacgccgaaagccaacgaggcgccgacgacggggaccgccgctctgcgcagcacgcgacggatggagcggattgcagacatggatctccctgggtgggtggaatgcgagcaaagggtgcagggcgctacctggcggtagttacgccgatgaggatccggacgactcgttgccggtggtcggcctcgtgcagtgccggccgggcgaggtccggatgcagcgaagttcggcagaactccggtgctggccggcccccggctctggcaggcgggaggcgggatgccgagcgacacggcaccatcgagtggccgcgaccacgcagacggattgggttcgcgaacgaacggcgcaagtgaactcccccgagattgatgcgcactcaacagtccgtacggcgaacatagtagtcccaccagcttcgttgggctgtctattgttcgacgaggagcggcaacacaacccgtgccgccgtcgcgtcgccctcggctcagggccgtcgccggtccagggccgcaccgccggcgagcggtagcaagtcaggaccgcgcgccgggcagaatgcccggcatggatcgagcgggcctttgagctgagcggtcgtttgcgggatcgtgtccgtccgcgccagagatgccagggaggcacatgagatgacgggaaccgcgggggatccggctgacaccgaggaagccccgccatccgctgccggcgcccctggggtactgcgcaccttcgcccaccatttcggccccgcctacaggttgacgctgcacggcaccgcttgggccacgctggccgggaccggcgttctgctactggccttcgccgccgcgtggcccgcgttcgtcgagatgcggcagggcgccgagctggccgggcggcaggaggactcgtacgcgcccgacaacaccgaggtgctgctgttggtcgcggctggtgccctgcccgtactgctgtgccttgccgcgttcgcgttcggtgtgctgcacacggcgcactccctggccgtcacccgtgttcggcccgtcgcggtgggtgagctgtggcggcaagtgcggcggcaggcgggacaggccgcggccgttcaggtctggcgcggggtgttgctgggcggactggttctttcgggagcgctgttgtggtcgctggccgacgtggtgctgcccgcggccgcaccggtaccggggtacgtcctgctggcgctgctcgtgcccgccgtggtggcgctgcgcgtcggcctcgccctcgcaccggccgtcgcggcactcgagggcctgggcgcgaccgccgcgctgcagcgttcctggacgctggtgcagggcgcgtggtggcgcaccaccgcctgtgtcaccgcgctcgtggcgttgaatgccggcgcgtacctggctctgcggtacgcgatggaaccggcgggcggtgcggcgcacgccctggcgatgtccgtcagttcgggcaacacctactttgcgttcgcggcggcccaactggcccccgcgacggtcgcattgccgctgtgcgcgctgttgacgctgccgttctcccataccgccctgaccaccctgtacgtgcgccgctgcgccgagcggggcctgcaccaccctcgaccagctgcgcctggccctcgatgacgtcggagacgaactcctccagcgcggcgcgacggtgggcgagcgggtgttcgccgtagagccagtcgaccgacgcgggccatgaagctgtgggaagacgatccgcgacactacccggatccggagcgggttcggggttccgggtcggccggcaccggcccggggcaccgagacctgctccagtacgcgctcgagccggggtccgtggccgtagtggccggtgtcaggacgaaggcacggggcggctccatctggaggacgctttgacgtgggcctcttcaacagcctcacctactgctgaccggatcggtccgctgccggacccgatgcggcctgttgccggcccgcccgcgcggctcaagcttggggacatgacccgagcactgatcgtcatcgatgtccaggagtccttccgcgcccgtccactgtgggagaccacctccgacctgaagatcgccgaccaggtgaaccgactggtccggctctcccgccgggccggggacctggtggtgtggatactgcactccgaacccggcaccggcgatgtcttcgacccggccctcggccatgtccagctgatggaggagctggagcgagcggagggggagccactgatccacaagacctcacacaacgcgttcaccaccaccaacctgcaacaactcctcaccgagcgcggcatccgcgaactcaccgtctgcggcatccgtaccgagcagtgtgtggagaccaccacccgcgtcgccagcgacctcggctaccaggtcacctttgtcgtcgacgcgaccgcgaccaatcccatcccgcaccgcgacgctcccgccgaccagagcgtcgcggagctgctggccgacccccgcacgctgcctgccgaagaggtcatcaggcgcaccgagtacgccctcgccggacgcttcgccaccatcgcgacggtcgaccagctggaggccgcagcaggacttcagacataatgaccgaatcatgagccgtatcgccttctttctggtgcccggagtccatttgctggacctggcgggacccgcgcaggttttctccacggccgccgacttcgggcacccctacacgctcgcctacgtcgcggagcggccacaggtctccaccgcccaggggctgccgctggtggccggggtcgactggcccgatctcggacccgaggatctgatcgtggtgcccggctggcgggcagtcactctggccgacgcccctgccatcggcagcgcctccctgcaggtcctccgggaccaccacgccaggggtgggacagtggccagcgtctgcaccggagccgaggcgctcggccaggccggcctgctcgacggccgccactgcaccacccaccacgacgtgcagcacgagctggccctgcgccaccccagggcagtggtcgtccgcgacgtcctgttcaccgccgacgaccgggtgatcacctcggcaggcatcgccagcggcatcgatctggccctgcacctggtcgcgatcctgcacggcccggccgtcgccgcgcaggtggcccgggacatggtcgtctacgctcgccgcaacggccatgagccgcagtccagcgcgatgctccggcaccggtcccacctcgacgacaccgtgcaccgcgcccaggacctcatcgacgcccgcttcgatcagccgctcccgctacccaccctggcctcggccgtcggcgtgagcgagcgcaccctcacccgcctcttcagccgcgccaccgggctcaccccactgcgctaccagcaggccctccgcctcgaacgcgcccaacacgtcatcagccacggcgcgacgatcgacgccgccgcccgctcagtcggtttcgaggacccccgcatgctgcgccgcctccgcgctcgcacagcctgatggcgccaggtaatcgaacactcctgggcaggcaactgactcccgtgcccacctcctggtggagcctctggagtgctgaactcgacggtgccggcgatcagccgccgtggagccccccacgcgtcgaggccgtcgtacacgtgggcttccaggcatggtggagcgttcatgccgacggcctcgcctcggtagagggcgatgagcgagtcctcgctccgcaaccacgtgtccgtcacgccctgtacgtcaggcaccggctcgaagccgatgaggtccaatgactcgacggccttccccttgacccttgtcacggtcttggcccggcaaccggcatgggcggcgagcgccaaggactccacccatccgtccgtgccggcgtgcagcggtgtccagcgacaggcatcgatcccgaatgcgccgccggagccgatcatgaatccgtaggccatggacacccgacagtctccggccggtaacaaccagccctcagcggcagagccctggggacagtcggcgtccaggatgcgcggaccgccctcgtagaacggggcgggcggcaatgcgagaccgcccagcggtcctggaaggccgcggccccgggcgatctccacggccgggatcctgtgctcgatccacctctcccggtggtgcccgaggcctgccgaggaacacgaacgccgtcagcctcgatgaaccttccggcccgatcggtcaggcccgcaggcgcgaccgggatgggtaacgtctcctcggtggacaaccggtcgttcgctgagccacgctccacggcaggctgcgccacagcgcggatcagtggggcagtgtcgtgccaacgatcctggcgaggggcagctccccgatctgcggattcgtcagtctcgctgatactggccgcgctctgctcgttactcgccggacgtggatctcgcggtccacgacgaagccgggtccgggaagggccgcaggcagccgatcaggttctctttgccgagatctccgcgtgccgcgtacgccgtccatgggtctgatgaccaaagtggcttcgcaggcatatgccgatgacacgaaggagaacgttcatgatccgtcgtctcgcgatcaccctggcaaccgtcgccgcagtcggcttcgtcgccgcggccccggcttccgcgaacggggagaacggccacaccggcggcggccacgccggcatcgaggccggctgggccagtggcgagtaccagaacctgggcggcccgtacgggatcaccaccgtcaaggggcaggccgcctacttcgacgcggagcgcggctgggtcgtccgctgacgacggcagccggacgcacgtaactgcggggttccggaggagagtgaggggcttgtgccaccgtggcgcgggcccctcactcatgccatcagccaaagttcagcgccggcgctaagtgtactgaccggtgtattgacccgcggggttgttgacgtcctgacccatggaccgagcagcccgctgggctccccgggcgggccggcgggctgccgtagcggtgggcggagctcaggcgacaacgaccgtcccggatccctccccctccgcgccggatccgtcgacggtcacccggaagacccggtcggtcccctccgccgtgacgcggaccacggccccgtcccgtacgacatggaacgtcgccgccggggtgccggtcaggtccggcacggtgaccgtgcgctcgtccgttccggtaccgaagacccgcagggtgaggccgtccagccagtcgccgtccgggcgttggtcgtcggcgccccacggcagtacggcaccgtccctgaccaacagcggcaggctgtcgaagccgtgcgtctcatgccgccaggcgggaccggtgacgcgttcgccggtcagcagtgaggtccaggcgccctcgggaacgtagtactcgacctcgccgtcctcggtgaagaccggcgcgaccagcaggtccgggccgagcatgtactgccggtccagggtgcgggaggcggggtcgccggggaactccgccagcatgggccgcatcatcgggatgcccgtacggtgcgcctcggcggccactccgtagaggtagggcatgagccggtgcttgagcagagtgaacttccgtgccacgtcgacggcttcctcgccgaactcccacggcacccggtaggagacgttgccgtggagccgactgtgcgaggacagcaggccgaaggccagccagcgcttgaagaccgccgggtcgggggtgccttcgaagccgccgatgtcgtggctccagaagccgaagccggacaggctgagcgacagcccgccgcgcagggactcggccatggcggtgaaggaggcgaagcagtcaccgccccagtgcaccgggaactgctgtccgcccgcggtcgccgaccgggcgaagagcaccgcctcccccgctccgcgctccttctccagcagttcgaagacggtgcggttgtagatctgcgcgtagtagttgtgcatccgctccgggtcggagccgtcgaaccagacaacgtccgtgggaatgcgctcgccgaagtccgtcttgaagcagtcgacaccctggtcgagcaggagacgcagcttgtcgttgtaccaggcgcgggcggccgggttggtgaagtcgacgagcgccatccccggctgccacaggtcccactgccagatgtcaccgttggcgcgccgcaccaggtagccgtgttcggcgccctccgcgaacagggccgacttctgagcgatgtaggggttgatccacatgctgatgcgcaggccccgctccttgaggcgggccagcatcgcctcggggtcgggaaagacctccgggtcccacaggaagtccgaccactggtactcgcgcatccagaaacagtcgaagtggaagacgctgagcgggatcccgcgctcggccatgccgtcgacgaaggaggcgacggtctcctcgtcgtaggacgtgcagaaggacgtggtcagccacaggccgaaggaccaggccggcggcagcgcgggtctgccggtcagggccgtgtaacgggacaggacgtccttcggcgtcgggccggcgacgacgtagtactccagcgactggtcctcgacgctgaactgcacctgcccgaccgactccgaaccgacctcgaaggagaccttgccggggtggttcacgaagacgccgtaaccgcgcgaggacagatagaacgggatgttcttgtaggccagttcgctgctggtgcccccgtcggcctgccagatgtcgacggtctgcccgttcttgacgaacggggtgaagcgctcaccgagtccgtagacgtactcaccgacatccaggcccagttgggcaatcatgtgatgcgtgccgtcgggcgcggtcgcgaacgccgtgcccttcgggtccaccccggtgaggcgccggccgccggcatcgaggaaggtgataccccaggggccgtcaccgtccatccgcaacgtcatcggcccgctggtgagttccgtcgccgtaccgtcccggcgggtgcgggccgcgggtgccgtggtgtcgtccggcaggatcgtgaagtccggcccccgtcgggccttgcccgcgtgatgggtcgtgcggacgccgatgacaccctcggccggggagaagcactcgacggtgatcagcggggtgttgagcgtgtcgccgcgcgccgccacacgcttcaccgcggcgtacgcggtgaaccggtcggcgtcgacgcgcagatcacggatctccgtcgcgtacgaggctcggacgccctcgcgcatgagccagaagccgtcggtgaacttcatgcggtctccttcttggcgggaacgacgtccacgcgggcgaggcgcatggcgcccttgaggccgatacccatctcgtgcaccccgcggaggtccagcgcggtctcgaaggtgcggtacgcgtacggtccgccggtgtccgggaactggagcgccaggctgtggccgcccacgctcacggtgatgcttccctcccccgaggccaggaacatcagtccggacaccccctcaccgaagtcgcacgcccggtagacgaggctcccctccctgccggcggacgcgggcgccacgacgtcaccctccgtcttcgttcggtcgaggatctccgtgtccttctgccggtcgtagtcgacggcctccagaccgtgcgtcgccagcgggcgggggccttgcgcctctccgccgacgaccgctgtcgcggtgagccggatgtcggcgctcgacgctccggcgaggatctcgtaggcgcccggctcgacggtccaccggccgttggccacgctccagtgtcccaactcctccacgagcacgtcgaattcaatgcgttccgccgcaccgggcgggaggtgcacgcgacggtgggcgaccagcttgcgccgcggcaggtcctggggatcgccgaggcccgggagccggcaccccaggccctcggggacgggttcggccgtctccgcgggttcggccgcgcggacgtagagctgcgccacctcgtcggcggcgagcctgccgccg

SEQ ID NO: 2737 - DNA, 13256 bp, Unknown
  Kingdom: Bacteria, Phylum: Actinobacteria, Class: Actinobacteria, Order: Streptomycetales, Family: Streptomycetaceae, Genus: Streptomyces
ggggtgagcgcaccgccgtccacgacggcggtgcgctcaccccggcactcgcgcgccgcaaccgcagggacttcgcgctggcgctccagctgctggtcgacgccgtcgaccggttgctgaggatcggcggcaccagggctcaggaggacggacacccgttgcagcgctactggcgggacgtgcactcggtcgccggccacgcggtcatgcagttcgagcccgcggggatcgactacacccaaggcctcttcggctcggcctgaagggcctgaaggagacgaacatgattctggtatccggagccaccggccacgtcggcaggccgctggtggacgaactgctcgcggccggccgcaaggtacgggcgctcagccgcgacccggcccgggccggcctgcccgccgaggtcgaggtggccgccaccgacgaacttcccctggacggcgtcgagtcggccttcttcgtcctggccgcgttcccggggggttcggcggagccgatcgcccggctgaaggcggcggggattcgccgcatcgtcgccctgtcgtcctactcggtcctcgacgacgaccccaagaacatgatcgccgtgaagcaccgggagctggagcgccagatccgcgagaccggcgcggagtggacgttcctgcggcccgccggcgggttcgccgcgaccgccctggagtgggccgggcagatcaggaccgaaggcgtcgcccgcttccccttcgcggacgcgtggaccgcccccgtacacgagcgcgacatcgcggcggtggccgcccgcgctctgctgaccgacgaactcctcggcgagacaccgctgttcagcggaccggagtcgctcagctacgccgaccgggcccggatcatcggtgaggtgaccggcttgccggtccgcttcgaggagctgacccacgacgaggcccggcaggaatggctccgggccggcatcccgccgcacgccgtggaggcacggctgcggatcttcgccaagctggtcggcaccccgcacgagatctcacccgtcggcccctacctcggcaggcccggactgagcttcgcccagtgggtcgccgatcacgcagacacgttccggaagggaacctcatgattctggtagccggtgccacaggcaacgtgggcggcgagctgctgcggcagctgcgggacggggggacacccgtgcgggcgctctcccgcgacccggggaaggccgcgctcccggccgacgtggacgtggcgaagggggacttcgcctcaccccagtcgctggccacggccttctccggggtggaggcggccttcctcatgatgtccgggaaccagaccgcggtggtcgaggaggcggcccgcgccggggtacggcggatcgtgctgctctccagtgtggccgtggagacccggccggactcgctgatcggcaggatgcaccaggaggccgagagcgccatcgaggggtcaggtctggagtggacgttcctgcgcccgggccagttcgcctccaacacccgcgcctgggcggcccagatcgcccagggcgacgtcgtccgcaccccgttcgcccgggtcggcctgcccgccatccaccccggcgacatcgcggcggtggccaaggtcgcgctcaccgaggacggacacaacggagcggtctactcgctcagcggcccgcggccggtcacgcccgtcgagcaggtggcggcgatcggtgaggcgatcggccgcaagctgcgtcacgaggagatcaccccggagcaggcaggccaggagatggccgccttcatgccggccgagatcgtcgccgccacgctggacttcctcggcagcccgaccgcgacggagacccaggccctccccaccgtcgagaaggtgaccggacagccggccaggacgttcacgcggtgggcgcgcgacaacgccgacgggttccgctgacacccaggaaagggagggtgcgcgacagtgttgacccagcgcagtttccgcaacgtactgggacgtttcaccaccggagtggtgctggtgaccgcggagtcggacggccggccggtcggcatggcggtgaactccttcgcctccgtgtccctggatccgcccctgatcgtgttctgcgccgcgctgacctccaccacctggccgacgatccgggcgaccggcggcttcgccgtcacgatcctcagcgacacgcaggaggagctctgccgggccttctcggtacgcgacgcggaccggttcgccgggcgggactgggccaggacccctgccgggcggcccacggccgtggacggactgggctggctggactgccggatcaggaccgtccaggtcgagggggaccacgaactggtgatcgcccgagcggaggactggtccgtcggggccgacgcgcggcccctggtcttccactccggccgctacggaggcctggaggaacgcgtgcacgcggaatgacatcggcacagccgtcgagagccgtcggaagtcatcagggaatgtcagtgaaggagaggcccgtgcttcttgtgaccggagcgaccgggaacgtcggtcgtcatgtcgttgatcagctcctcgcctcgggggaggccgtacgcgccctcacccgggaccccgcggcggcccggctgcccgagggcgtcgaggtggtgggtggcgacctcacccggccggagacggtggagcccgcgctgaaggacgtctccgcgctgttcctgttccccgctcccggtgccgcgggaccggttctgcgggccgcgaaagagcagggggtgcgccgggtcgtcctgctctcctcgtcggccgtcgagttcagctccgagagtgccgacaacgcgatcgtggcgtaccaccgggaggtcgagcgccaggtcgtggagtccggtctggagtggaccctggtgcggccctgtgggttcgccgccaacacccgtcagtgggctccgcagatcagcgcgggcgacgtggtgcggggaccgtacgccggagccgagatggcgctcatccacgagcgcgatatcgccgacgtcgccgcccaggcgttgctgaccgaccgccacgtgggcgccaagtactcgctgaccggcccggaatcactcacccaggccgagcaggtccggcggatcggtacggctctgggacgcccggtgcggtacgaggaggtctcgccggaggccgcccgcgaacagatgatcggcaacggggtaccggccgacttcgtcgatatgaacctcaccttcctggcggggctcgtcggcgtgccgacggaggtctccccggcagtcgagcaggtcaccggccaccccgcccgcacgttcgaccggtgggccgccgaccacgtgaccgacttccggtaggcacctccgtccatagcgagaacgacaccacgtgcgagcacgcgcacggcagaagaagagaggtttccccatggacgacgtcatcatcgcgggtgccggcccgaccgggctgatgctcgcctgcgaactgcggctcgccggggtggaggtgcagatggtcgaacggctcgcggacctgaacagcgagtcgcgggccggcggcctgcacgcccggtccatcgaactcctcgatcagcgcgggatcgtggaccgcttcctggaggtggggagcgcgcagccgctcgcacacttcgccttcatgcacctggacatcgacgacttcccgacgcgacacccctacgcgctcgccatccaccagtcccggatcgaacggctcctggaggagcgtgcgatcgagctgggggtgaagctgcgccgctccgccgaggtgatcgacatacgccaggacgagaccggcgtcgaggtgcacatcgccggagaggccggcaccgaacggctgcgcgccggatacctggtgggctgtgacggcggccgcagcgtcatacgcaagctgacgggcatcgagttccccggcacctcggccacgctgaccgcgctgctgggcgacgtcgtgctcgacgacccgcccgccgagatcgtcttcggacccgagggtcggcgggagaacgggttcttcatggccttccactccgagcagcccggcaagtaccgggtgatcaccgtggagttcgacaagatcacggaccgggacgcgccggtgggcctggagacgctcagcgaggcctgcgccaagatcgccggtaccgacttcggcatgcacagcccgcaccgggtcgaccggttcagcgacgcctgccgactggtcgcgaagtaccgcgagggacgggtcctgctggccggggacgccgcgcacgtccacttcccctccagcggacaggggttgaacctgggactccaggacgccgtcaacctgggctggaagctcgccgccgtcgtgcgcgggcaggctccggtggaactgctggacacatacgactccgaacggcgcctggccaccgagcgcatgctcagcaacatccgcgcccagaccgccctgtggcgagcggggatccaggccgacgcactccgcgacgtggtcggcacgctgaccgagttcgaggagggcaaccggtacctgggcggagtcatcagccagctcgacaccttctacccgatgggtgacgggcacccggcgctcggccgccggatggccgacctcgacatcaagtcgccctccggacaggtgaccgtcttcgagttgctgcacggcgcacggcccgtgctgctcgacttcacaggccgcaccgacctgcgtaccgccatcgagggctggacggaccgggtcgacctcgtcgaggcggagccccagggcgaccactgggcgttcccggtgatcggtgacctcccggcccccgcggctgtgctggtgcgcccggacggccatgtcgcctggaccgcctccgtcggtcccgacggctcgcccgttccggagacggacaccgagaccctcaggtcggcgctcgaccggtggttcggccccgctctcgtgtgatcgccggccgttgttccggaacgacggacaccgttggccggacccggccgaccatgtcccctgattggagaaccgcgtttccatggatgaaccgacgaccgatgcggcacagcggccacaggacagcgatttcggcacgcccgctgccatcgtggacacctcctccgggttcgccgcgctgtcgcggctcgcggacctggtgacccccatggcgctgagggtggccaccggtctccggctggtcgaccacatgcgcgacggcgtgcacgacctcgcatcgctcgcgaaggcgaccgattcccaccaggacacgctcaggaggctgctgcggcacctggtcgccgtcgaggtactgaccgaggccgagccggaccactatgtgcccaccgccgtgggcgagttgctggcccacggccaccccgcgtcccaggcgggatggctcgacccgagccacatggtcgggcgggcggacctctcgctcgtccacctcttggaggccgtacgcgagggtggcgccgtctacggccggcagtacggcaaggagttctgggacgaggtgtcggacgatccggtcctcggcgccaccttctacgacctgatggcgcacggtcagcggagcgtcttcgaccaggtggccgaggagcacgagtggaccggtgtgcgccacctcctcgatgtcggcggcgccgacggcgacctgctcgccgccgtgctggcccgggagtccgcgatcagtgccaccctgctggagctccccggcccggcggccagggcgcgggtcagggtcgaggaggccggactggccggccgggtcgacgtggtcgacggcagcttcttcgatccgctgccggtgacagccgacaggatcgtcctctcgttcgtcctgcacaactggtccgacgaggaggccgtacggatcctgggccggtgcgcggacgcgctggagcccggcggttccgtgctgctcatcgagtgcgccgacgagtcgcccgccgcgccggacccgggcttcaccagcgccgatctgcgcatgctggtctatttcgggggacgcgagcgcacccacggccagtggcgggagctggcccgtgccgcgggtctggacatcgccgccgtttcctctgccctcgcctacaacgcacgcgtgatcaccctggtgaaatcgaccggctgaaattgctgtccttttgcggagcctgccccgaagaagtttcggcgcgggtgctttcggcctgccgcaattaactgagctgtaacttttcgcaccccggtagagggggaaactggacgctttggccgaatgtgatcgggcgttttctgtcgaggttgacaagaaaaagaccagggtggcacggtccgagcgtctgcagaatcgggacgactccactcggggatcggtccgaaaccgccaggcggaccggcgaagcacaggaatacgtaaattaaggagtcactctgtgacagcatctcgcggccgggcccccctttcgatcggggagctcaccgatgagcggtacgggcagatcatcggccccgacgacgccgagtacgaggccgcgcgcaccgtgtacgcgggcgatgtcgaccgcaggcccgccgtcatcctgcggccccggaacgccgagcaggtggcgagtgtcgtggcgctggcgcaggagaccgggcttgcgctggccgtccgtgccggcggtcacagcggagccgggcacggggtctgcgaaggcggcatcgttctggacctggccgccatgcgggcactggagatcgacgtcgagacccgtacggcctgggccgaggccggcatctccgccggtgagtacaccgaagccgccgcggagcacggactcgtgaccgggttcggtgacagcacccaggtcggcgtcgccggcatcaccctgggcggcggcatcggcttcctgtcccgcaagtacggcatgaccatcgacgacctgctggccgcggagatcgtcacggccgacggcgaactgctgctggtggacgagcaccaccaccccgacctgttctgggccatccgcggcggcggcggcaacttcggcgtggtgacccgcctcaagctccggctgcacgagctcaccggcgtgtacggcggcatcatggtggctcccgtcacccccgagatccttgaggcctacatcgccgaggccgaggcggccccggaagagctctccacgatcgtcaacgtgtggacggcaccccctttccccttcattcccgaggagtaccacggcaagccgatcatcctggcggtgatgtgctacgccggtcccgcggaggagggcgaggaggtcgtcggccggttccgggcgatcgtcccgccgctggccgacatggtgcaggccatcccgtatccccggatgttccccccggcggacccccagatgcgccccgtctccgtggcgcgcaacctcttcatcgaccgggtcgaccgcgcgacagccgagacgatcgtggaccgcgtcaccacctccagcgcgatcgtcgccggtgcgcagctgcgggtgctgggcggtgcgctggcccgggtcccggccgacgccacggccttcgcccaccggcagagcaggatcatggcccatctgtcggccatctacgccgacccggccgaccgggagctgcacgacacctgggccgaggacttcatggccgacatccggcagtccgaccccggctcctacggcaacttcgtggtggacgcgcggccggagcagattcgcgaggcgctctaccccggagccaccggagaacgactcgcccagatcaaggcgaaatacgacccggccaacgtgttcagctccaatcacaacattctgcccgcggcgtcgtgaaaacgcgtcggccgtacgcggcggcggcgtccggacagccgaccggtacatgagagcggtcggttctccggaaccggtggtcgtcctcttcggatgacgctccggcgcgatgggccacgccatggggaaggggacgccgatttccggcgtccccttcttgatgttcgtcctgagtttccccgccggaggtcgttttcctcccctttctccctctcggattgcgcggtcggcgcgatgacgcgtcgggcgttcccagcgccgcctctccgggacgatgacggctgccgcaccggtcggccgtacccgtacgtccacttcgaccacccgcgggccacccacccagggtccgcggactccctactcccctgaaggagtgttcatgacacgggaaacgacggccgtgatgtcgctggtcgcgcggtgaccgcccccgacagagcagagatacgtacgcgggcggtgaccccccaggagggggcgccgcccgccggagtcggccgggcccggctcgactcgctgaccggactgcgcttcttcgcggcgctcgcggttttcatcacccactcgtccttcctcctcatcggctccgcgagcctggtcttcccgaccttcgccgaccagggggccaacaccgccttccagaccgccgccgcccaactgggcagcctcggtgtgggtttcttcttcgtcctcagcggcttcgtgctcacgtggtcggcgcggcccaccgaccgcaccggggccttctaccgccgccggttcgtcaagatcgtgccgctgtactacgtggccggcgccgcggcggcggtcctgctgtgggacctgggcatgcggtggcaggacctgctcgcctacgggggactcgtccaggtgtgggtccctgacccgcaggtcaacttcagcgtccacacgccgggttggtccctcgcggtggaggcagtgttctacctggtctttcctctggccatccgctggttccgcgatctgggccggcgagcggcctggtcgggactggccctctgtgtggcggtctcgttcctcgtgccggtcctcgcctacaccctgcccgccggggtcggcgagttcgtgggcgcgccgaacgggcccgctttcgagacgtggttcgcctacaccctcccgctcggccgcgtctccgacttcctcgccggaatgttcgccgcgctgctggtgatctccggcggcttcccccggatgcgcatggcgtgggtgctcgtctcgttcgtgccctgctacgtcgtggcgagcgaaaccccctacctgttcggccagcgggctcccctgttgatctcctgcgtcctgctcatcgtcgccgccgctcagcgggacatcgaccggcgtccctcgttcctgtcgtcgagcacgatggtgctgctcggcaacgtgtcgttcgccttctacctctgccaccacctggtgctctacaccctcaacatcaaggtgttgaaggggccgttcgactcggtggcgatggtgatcgtctacatggcgacggccctcgtcatctcggtcgccctgtcgtggctgctgcaccggtacgtggagatgccggccgtccggcgcttcagtacgtccaagggacggcgatgacgtagcggccggccgggcgctgtcgagccctgcggcgagccctcaccccccacacgaaggagggcggccggacgaacccgtccggccgctccgccccccggcacagcagacccgcgagccgcactccggcggcccgcggcccgtacttccctggaggagagttccatgacacaggaatcgacggccgtgatgctcgactacgagggcaccaccgcgaccaccgcgtccgtggcatccatggcgtccgtggcgctttcgacgtccttgtggtcgaggagagaacagtgacctctctcgacggaacagcggggacacggacgcgggcggcagctcctcagggggcgccgcccgcactcgtccgccgggcccggctcgactcgctgaccggactgcgcttcttcgcggcgctcgcggtcttcttcttccacttctcgagcccggtcttcccgaccttcgccgaccagcagatcaacgccgacctcaacaccgctgccacccagctgggcggcctgggcgtgggtttcttcttcgtcctcagcggcttcgtgctcacgtggtcggcgcggcccaccgaccgcaccggggccttctaccgccgccggttcgtcaagatcgtgccgctgtactacgtggccggcgccgcggcggcgctgttgctgtggaacgtgagcatccggtggcaggacctggtcgcctatgcgggcatgttccaggtgtggatccccaacccgcaggtcaacttcagcgtcctggcgacgggttggtccctggccgcggaggccgtgttctacctggtctttcctctggccatccgctggttccgcgatctgggccggcgagcggcctggacaggactggccctctgcgtggccgtctccttcctcgtaccggtcctggcctaccacatgcccgccgggatcgtctcgttcgtgggtgccccggacgcgctcagcttccagatgtggttctcctacatcttcccgctcggtcgcctctcggacttcctcgtcggggtcttcgccgcgctgctggtgatctccggcggcttcccccggatgcggatgacctgggtgctggtctcgttcgtaccctgctatgtggtggcgagctacacccccttcctgttcggttggcgggccccgctgctgatctcctgcgtgctgctgatcgtcgccgccgcgcagggggacatcgaacgccggccgacgttcctctcgtcgcggacgatggtgctgctcggcaacgtgtcgttcgccctctatctcatccactacctggtgctccacacgctcaacaccaagatcatgcacggccccttcgactcggtggccgtggtgatcctctacttcgccctggccctggtcagctcggtcggcctggcgtggctgctgtaccggtacgtggagatgccgatcgtccggcgcttcggtacgaccggacgacgtcactgacccacgagcggaagctgtcgagtaccggcctcgacatcgccggcgtcgcgtagctgtgggccgtcccggtgcacccggacagccggcccgaacactcgaacggagaggacctctcgatgaaggctctggtgcttgcaggtgggtccggtacccgcctgcggcctttcagttactcgatgcccaagcaactcatcccgatcgtgaacaagcccgtcctggtgcacgtcctggagagcgtccgggaactgggagtgaccgaggtcggcgtcatcgtcggcagccgcgggcccgagatcgaagccgtgctcggtgacggctcccggttcggcctgcggatcacctacatcccccaggacgcgccacgcggactggcccacaccgtctccatctcccgtgacttcctcggtgccgacgacttcgtgatgtacctgggcgacaacatgctgcccgacggagtggcctccatagccgaggagttcaccacgcaccgtcccgccgcccaggtcgtcgtgcacaaggtggccgacccccgctcgttcggggtcgccgaactcggtcccgacggcgaggtggtgcgtctcgtggagaagccgcaggaaccgcgcagcgacctggcgctgatcggcgtgtacttcttcacgcccgccatccacgaggcggtggaggccatcgagcccagcgcccgcggcgagctggagatcaccgacgccatccagtggctggtctcctccggcgcggacgtccgggccagtcgatacgagggctactggaaggacaccggaaaggtccaggacgtcctggagtgcaacagccatctcctcgacagcctgacccggcgcgtggacggtcacgtcgacgcgagcagcgtcctggtcggccaggtcgtggtcgagctgggcgcgcggatcctgcgctcccgggtcgagggcccggcgatcatcggcgccggcacggtcgtggaggagagccatgtgggtccgtacacctcgatcggccgggactgcctggtgaccgacagccgactggagagctccatcaccctggacgaggcatcggtcaccggcgtccacgggctgcgcgactcgctgatcgggcgcgccgcctccgtaggcaccaccggccagggcacgaaccatcactgcctggtcgtcggagatcacacccgagtggaggtcgcggcatgagggtcctggtcaccggagcggccggtttcatcggctccaacttcgtccgcaagctactggccggcgagtacagcggctgggtgggcgcccaggtcaccgccctggacaagctgacctacgcgggcaaccgggacaacctgcccgcctcgcacgagcggctggtgttcgtccgcggcgacgtctgcgaccgcgatctgatgcgcgaactggtgcgcggccacgacgccgtggtccacttcgcggccgagacccacgtcgaccgctctctggagggcgccggcgagttcttccgtaccaacgtgctgggcacccagaccctgctggacgccgtgctggagagcaacgacgtggagcgggtggtgcacgtctccacggacgaggtgtacggctcgatcgaggagggctcctggaccgaggagtggccactcgcgcccaactccccctacgccgccgcgaaggcgggctcagacctggtcgcccgggcctactggcgcacccacggcgtggacctgtccatcacgcgctgctccaacaactacggcccttaccagcaccccgagaaggtcatcccgctgttcgtcaccaacctgctggaggggagccaggtcccgctgtacggcgacgggcgcaacgcccgcgagtggctgcacgtggacgaccactgccgcggcatcgacctggtgctcaaccacggtcagcccggcgagatctacaacatcggcggcggcaacgagtacaccaacctcgccctgaccgagaagctgctcgaactggccggcgtgggcgaggagatgatccgccgcgtcccggaccgcaaggcgcacgacctgcggtactccatcgacgactccaagatccgcgatcagctcggctacgccccgctgatcggcttcgaggagggcctggccgagacggtcgcctggtaccgggacaaccccgactggtggaaggccgtcaagcacggggcgacccgtgcggactgatgcccgcccggtggccggcctctcggtcgtcgtcctgggcggcaccgggttcctgggccgccacatcggcgcggccttcaccgcgcgcggcgcccgggtccacccggtctcccgcaccggcggcgacacccccgcgccgggttcgacgcccgtacggctggacctgctcgcggcgccgccggaccggatcgcccagctcctcgcctcgaccggcgccgacgtggtcgtcaacgcggccgg

SEQ ID NO: 2738 - DNA, 15346 bp, Unknown
  Kingdom: Bacteria, Phylum: Actinobacteria, Class: Actinobacteria, Order: Streptomycetales, Family: Streptomycetaceae, Genus: Streptomyces
tgaggtcctcgcccgcggtcttcctggcttcgccgggggtgcgtacggagtggtcgagggccaggcccaggtcccagaccgggtaccagatggagtcggcgagggcggcgagggccgccgcgtcggcgctggcgtcgggcaggaggagcaggtcgaggtcgctgcgcggggagagctcgccgcgggcgtagccgccgacggcgacgagggcggcgccgcgcaccccggcgcgtgtcgcggcggcggtgaacaggccggtgagccagtcgtcggtgaggcgggcgagggccgcacggcgcggcggcccggaccgcgcctcctgctggaggaggcgcagccgggccgccgcgtagccgctgggtcccgagccttcggtttcggtggtcacttcggtactcgtcacccagctgccttccgtttgcgggccgtcggtcagagggcgtccgggccgcgttcgccggtccggacgcggacggcggtctcgaccgggacgctccagaccttgccgtcaccgatcttgccggttcgggcggccttgacgacgacctcgatgagctgttcggagtcctcgtcctcgacgaggacctcgatgcggatcttggggaccaggtcgacggtgtactcggcgccccggtagacctcggtgtggccgcgctgccgcccgtaaccgctggcttccgtgacggtgagcccctggacgccgaaggcctggagggcctccttgatctcgtccagccggtggggcttcacgaccgcggtgatgagcttcatgcgtccaccttctttgccttcggtgctgccgtcgggtccgtcgcgggagcggtggtgcgggagaccgtgccgccgccggcgccgctgaagtcgtacgccgtctcggcgtgctcgacctggtcgatgccggagatctcgtcgtcctcggagacccgcatcccgatcgtcctgtccagcaggagcgcgatgagggcggagacgaccagagagtacgcgaggacggcgacgacgccgatggcctgcttgccgagctgttcgaggccgccgccgtagaagaggcccttggcgtcggactggacgccgccggtggcgaagaagccgaccaggatggagccgatgatgccgccgacgaggtggacgccgacgacgtcgagggagtcgtcgtagccgaaccggtacttcaggccgaccgccatggcgcacaggacaccggcgatggcgccgaccgcgatcgcgccgagcgggctgacggagccgcccgccggggtgatggcgacgagtccggcgaccgcgccggaggcggcgcccagggtggtgaaggagccgtggcgcagcttctcgtagacgagccagccgaggacggccgcggcggtggcgacctgggtgttcaggaacatgaccgcgccgacgccgtcgtcgttgccgagccaggatccggcgttgaagccgaaccagccgaaccacaggagggccgcgccgagcatgacgagcggcaggctgtgcggccgcatcgggtccttcttgaagccgacgcgcttgccgatgaccaggatgacgccgagggcggcggcgccggcgttgatgtggacggccgtaccgccggcgaagtcgatgacgcccatctcgaagagccagccgccggtgccccagacccagtgggcgacggggaagtagacgacgctgacccacaggacgatgaacaccgcccaggccgtgaacttcacccggtcggcgagggcgccgctgatcagggccggggtgaggacggcgaacatcagctggaagacggcgaagacgtagaccgggatggtgtaaccgtcccagagttcggtgacgccgatgttgctgaggccgacgtagtcggagctccagccgatgaccgagccgacgtcggagccgaaggcgaggctgaatccgtagagcacccacaggatcgtgacgatcccgaggctgatgaagctcatcatcagcatgttgagggtgctcttgacgcggaccatgcctccgtagaagaaggccaggccgggggtcatgagcatcaccagggccgagcagatgagcatgaacccggtgttggcggcagacagctcgggggcgtctgcggcaagcgtcgtgatgcctgggggcatcggcgtctcctcgtcgtcggtgcggccgcggcgtgcgggggaatgctgcgggaccactgggaaggtgcgggccggttatgggccatgagattgaccgagcgccgtttccggggatgccgcacgatgtttcgcgagcgtgacgaagagggatcgcgtgttacggccgaatgaatccggggtggcgcctccggtgtgccgcccagggtctttcgttcggatcaggccggatcagggagcggggttccggtgcgtgcgacggcaaggcggagaagggagtcactgcggagcacgggcgaccgaccacaacgccgcggacgcgcgtgccggaccccacgagcccggtcggatccgaacggtaggtcccagcatgcagcgcacgccgcatacggtgcggttgaaacgcccaggagccggaaaacacgaaaccggccacggcggccctccgtgtgaccaggcgatgggggagccgggtcgggctgtacggaaggggcgccgcggccggggccgcgggggccggtcagaccgcttcggcggtctccggcagctgttcgtggagcagctcggtgagccgggcgacgtcggcgacatcgccgaagtccctggcagcggtgtcgacggtcttgcgcaggcgggtgttgacccgctcggagcggaccttcttggcgatcttcagggcgcgggcggcgagcacggtggactgctcgggctcgcgctggaggaggtggacggtggccatgccgatgaggttgagcgcgtaggagcgctggtgctcgtcgtcctcgccgaacagctccacggccttgtccatgacgggctgggcgagcgaggcgtacgtggggctgcggccggcgacataggcgaggtcacggtaggagtgggcgttctccccgttcagctcggcctcggagaagaagcggatccagtcgggttcgggctcgccgtcgagaccggcgtccaggaaggtgtcctcggccatccggacggcccgcttgcacttgctgggctggcccatgttggcgtaggcgcgggcctccatcgcatacagcatcgcctgcgtacgggaggtggcgcagtcacggctgccgtactgcgcgaggtggatcagctccagggcgtcgtcgggacggcccagatggatcatctggcggctcatgctggagaggatgtagctgccgagcggcttgtccccggcttccttggcggcgtgcagggcgagcacgaagtacttctgggcggtgggctggaggccgacgtcgtagctcatccagcccgccagctcggccagttcggcggcgcgggacggggcgaccggcagcaggggcaggccctccgccagcggcagcacgtcgggggcgtccgcgatcaccgcgtcggccgcgtcgaccaccaccacgtccccgtccaccaccgcgcgcagctcgtccggcaacgtcacctggtccgggtccagttcggccagcgccgtgtagagcgcgtgcagctgtacgggggtgacggcccggtcctcgtcggcgagccggcccagcagttcggccgcgccgcccggctcgtccagcagagccgcgaccgaggtgcgcaccccgagggcccgcagcacctgggcgtcgtcgaagccggtcgcgtccaccgcgtcgtacagcccggccagccgggggtcgccgcccggccggactgtccggccgggcggcggccgtccagcacggggtggtcgcgcagccaccacgcggtgtacgggcgcacggactgcgtcgtgccgtccgggagcagcacccgcaccggctgcgtcagcgcgtcgcgcagcggcggccgggccagcatggcgagcgcctgcggccaggcgtcgtcgtcgaccaggtccagatcccgtacggcgacgatctcggtggcgacgggcggcacgggggtctcgggcagctggtcgaggaggtcctcgcaccagacgtcgaccgcgtccagcagccccgcgtcgtcgggttcggcgaagtcgctgtcgcggggttccagttcgtccgggtccaggaccacgtcggtggcccgtacgagggcgaaggtggcgagcaccccgcaggcggtgagcgggccctcgccccagcggtcggccagctcctggtcggcgagggcgagttcaccctcgcgcatgacctgggcgaacgggctcccgggaaggacgagttcacctgcgggggccggttcgccgtcctcgtcgggtagggcgagcgcgccgagccagggctcgtcgccgggggccagctcggcgtcccggacgagggtgagcacggtctcggccagctcgtcggcgtcgagcgcgtcctcgtcccagatctcccccgcgtccagcgaaccggcgacggccgcccgcacctgaggggtcgtcagcacggcgcggggcgtggcgggcagagccccgagcttctccagcaacgggtgcgcggcgtccgggtgggcgaccttgagcccgagacgggagagccgggcgaggacggggccggtgagcgcgtccggaagcggcagcaggatctgccgcggtccgatcgtggtgcgcggcgggcgcccgtcccgctcgtcctccgggtcgcccgcgagcgggacgggaagcccggagagccggtcggggtcggtgcccgcgaggctgtcgtagagccggtgccaccaggcggggtcgcgctccagaccggcgaggcggtcgatggcctcggtcagggggacgcgggccacaccgagggtgcgcagctcggtgcgccgctccaggcccgcgggcagcagacagggcagcacctcggcgaggacccgtacggtctcggccccgaccccttcgacgacctcggcctcgacggggcgcagggcggccgtgtccggggctttcgaggaggcgtcgcggtccgcgcggtcccagtcgtcggtcgcccagccctgctcggcctcggggtcccggggtgcggcgggctccaggaacgcgacccggggcagccgggccaggatcgcaccgcgcagggcaccgtccaggcctcccttgcccagcggccccggcaccaggtcgatggtcccggtggacacgggccgccaggagcccagcagctcggcgtacgcgtcggcgacggtgttgcgggcgaggccgagatcggcggcgagggaacggtagggcggcagccgggtgccgggcgcgagccgcccgctgcgcacggcctcgcgcagcgcgtccatcagcagggcccggcggttaccggtcccggagagctccagcggcagatcgctgcccaggatctgcgccgaattgacccatgaattcatcacagaaatgcaccccacgcccagtcgcttgtcgccctagattcgtacccatgacgacgacggagatcaagacgaacgaccgcaccgccacccccgccaccaccgtccggagcaacacgaccaccccccggctcgacttcgcgaagagcgccccgaaggtcttccgtgccgtgatcggcctggacgcggcggcccgcgcgggcctggacccgacactggtcgaactggtccagatccgcgcctcgcacctgaaccgctgcgcgtactgcctgcacatgcacaccacggacgcccggaaggcgggcgagagcgaggaccgcctgcacatggtcgcggtgtggcaggaggcggaccacttcttcacggagcgggaacaggccgccctggccctgacggacgcggtcacccggatcggggacgccggcgtaccggacgaggtctacgaccgcgcggcggcccacttcgacgaggaggagctggcccatctgctggccctgatcctcacgatcaacacctggaaccgcatagccctggccaccgccaagcgcgcgggcacggacgaacgctgacactcctggccggtccgtccggctcgctccgcccacccacccacctcaccgacccacccgtcccgttcggtccggggccgggtgcgagggccgctaacgccccaacgcgtcccgtaccgcttcctcgctccgcgccaccacggccgtaccgtcctcggcggtgatgatcggccgctggatcagcttcgggtgctcggacagggcggcgatccaccgctcccgtgaaccggcctcccgcggccactccttcagaccgagctccttcgccgccgcctcctgcgtccgcgtgatgtcccacggctccagaccgagccggtccagcacggcccggatctcctcgggcgagggcacgtcctccaggtagcggcggacggtgtagtcggccccttccgcgtcgagcagggtgagcgcgctgcggcacttcgaacaggccggattgatccagatctccatggggccaaggttacgcgagggactgccgaaatggcctctggccaggggcgattgtcagtggggggcagtaaaatggagggagttcgtgagggttccaccacgctgcaggaggatgccgaatggctgttgccacagtcacgaccgagccgctcgaccgacagctcccgatgcccttccacccgccgcttccgaccccgctgccgaagaagcgactgcccgcgggccgaccccgcgagtggtacgtctcccacaaccgccgcctcaaggccatgcgcctggccatcgccctgctcgacagcggggtctaccagccctccagcgccggcaaccaccggatacggatcaccgccgagcgcctgggcatccacccgccgtccgacaccacctgccgcatggtccgcgccctgatccgctacggccgctgaccggagcggatcagcccggaccgccgatcgccctgtgcccccggcctgctcgtccggccgggggcacaggcctgccccaccacccgcccccggtaggctcccggacccatgaagctactcatctcggtcgacatggaaggcgtctcgggaatcgtccatcccagcgagacgaaccccgagcgctacgactaccggcgcggccgggagctgatgacggccgacgcgaacgcggccgtcgcgggcgtcctggacgccgaccccacggccgaggtgctggtggccgacgcgcacggcaccttccgcaacctcctgccggagcagctggaccgccgggcccgactggtccggggaaagccgcgcgcgctgaacatgctcgccgggctcgacgcggagaccgacgcggcgctgttcgtcggctaccacgtccgctcgggcgaggggccgggcgtgctggcgcacaccatgaacggcgagatcctcgacgtacgggtggcaggccgctccctgggcgagatcggcctcaacgccggcatggccggccacctcggcgtaccggtcgtcctgctcagcggcgacgacgcggcctgcgccgagctgaccgacctggtccccgcggcggtcaccgtcccggtcaaggaggccctgggcatggcggcggccgtgaccctgcacccggaggaggcccgtgaccggctgcgccgggcggcggcggacgcggtcacccgccgcgcgtccatcgagcccctgacgctcgcccccgcgccgctggacgtggaggtcgacctcgcgagcccgcacaccatcgacctggcgaccctcgtcccgggcgtctcacgcgccgggggcgctcgtacggtcaccttcacgtcccccgactacgcgaccgcctaccggctgatcctgctcctcgcgcaactggccacgatcaagcccgcctgaggggtgtcccgtaatcgcgtcgaacaccgtaccggttccctctactgtgaccgggtgacaacccaggtgatcgtgctgaacggcgggtccagctccggcaagtccggcatcctccgctgcctccaggcggaactgccggatccgtggctcgccgccgcgatcgacgctttcgtcgactcgctgcccgggtccctgcgcacatcggtcgcgggcatcgagttcgccgaggacggcggcgtggcggtcggaccggagttccgcaggctggaggcggcctggcgcgagggtgtcgcggcgatggtccgcgcaggcgccaaggtcatcgtcgacgacgtgttcctcgccggccccgcctcccaggaaccgtggcggagggccctggccggactgaacgtgctgtgggtgggcgtccgttgcgagggcgcggtcgcggaggcccgcgagatcgcccggggggaccgcccgagaggcatggccgcagcacaggcggagacggtccaccggggcgtgacgtacgacctggaggtcgacacgacccacacggagtccctgacctgcgcgagaaccatcgccgccaggctcacgtaaccgtccggacccgcccgagcaacggaccggaccggaccgtccccgccgcaccgcatccgtacacaccggcccccgcacgggccgccgaaacagtggagagcgatgaccgacctgtggaccggcgagagagtgcgcctgcggggcgtcgaaccgcaggactgggagggcttccgggccctggccctgcacaccgtggacgcccgcaacgccgacgtggtcgagccgccccgctcggacgagagcttccgcgcctgggccaccgagcgcgccggccgcaccccgaacgcggccgcgtaccaactggtcatcgagacccgcttcgagcacgccttcgtcggcgcggtgtcggtcggcgagacggacgcccgggcaggccgcttccgtacgggcatcgaggtcacccgggaacaccgccgccagggttacgcggccgaggcatccgagttggtcctcacctacatgttcgccgaacagcgctgtcacaagtgcgaggtcgaggtctacgccttcaacgacgcctccctggccctctaccgcaaactcggcttcgtggaggagggccgcctgcgccagcacgagttcttcgcgggcacgtaccacgacgtggtcctgctgggcatcacggcggacgagttctgggcgggacgggcacggccttcgttgcggtgaggaggtgcgccacgcctcctattcctctattcctcgccggacgcggtgtcggcgtcctggacgccggagttacggtccacggtggaccgctcgtcgcacgtcgtgagagtgggcccggcgtcgagggctccgttgcgcagctcgttccgtacccgccgccaggcgcggatgatctgaggcagcttcgccaggacctcgctcacctgcgtcagcaggagcgtgaggcaaccgaaggcggcaaggatgaccaggctgaggttgtcccaattcatgtcggtccttcgagattcatgtcggtccttcgggccgacccggtcgtacggacggcgaccgactagcccagcggcgtgtgccgggtaatccagtcgagggcgtccacgcccaggcggtccggagcttcgagcagagcggtttccacggaagcgaggtccgccagtgcctcgggtgcgttcgaccggtcccgttcggcgagacgctccagtacggaggcgacggtggcgggccaccgaggcataccgaagtgagcggaggccttgaccgtggccgaaagggatcggtgcaacagggccgcgcgccagctttgttcgcgcatcaccttggccgtgaacctgatccggtcgtcgacctgctgaacgaactcggccacgggttcggacaccgtacgcagcgcgaaggaggaaccgccggcccacggcaggtccacatccgaggcgacggcgacgaaggcgagcagtgcctccggcccgccctcctgcgcggccgtcagcgccgcgcgggccctgcggtacagatcgacgctctgcgcgaagatctcaccgtcgccgggcccctcggcggcggcgtggatcgcgtccagcggcccgtcacgccaggtgtcgacgaccaggccgaccgccgccacgctcaggaggacgtacagatcagcccggtgggccggacgggacttcccgacgaggagcggttccggatcacctggcgcgtaccagtgccgtccgcggcgtagcggagacacgcgtcgggagtgccggcgtacagaaaaggccgtcggccgcacccccggagggacacggccgacggcccacggtcagcgcgacctgtggcttagatgtcgaagtacagctcgaactcgtgcgggtgcggccgcagctggatcggggcgatctcgtgcgtgcgcttgtagtcgatccacgtctcgatcaggtccgacgtgaagacgccgcccgcctggaggtactcgttgtccgcctccagggcgtcgagcacggccgggagggacgtcgggacctgctggacgttggcgtgctcctcgggagccagctcgtagaggtccttgtcgatcggctcggccggctcgatcttgttcttcacgccgtccaggcccgccatcagcagcgccgagaacgcgaggtacgggttcgaggacgggtccggggcgcggaactcgacgcgcttggccttcgggttcgagccggtgatcgggatgcgcatcgcggcggagcggttgcgctgcgagtacaccatgttgaccggggcctcgaagccggggaccaggcggtggtaggagttcaccgtcgggttggtgaaggccagcagcgacggagcgtgcttcaggatgccgccgatgtagtagcgggccatgtccgagaggccggcgtaaccctgctcgtcgtagaagagcgggacaccgccctgccacagcgactggtgcacgtgcatgcccgagccgttgtcgccgaagatcggcttcggcatgaaggtcgcggtcttgccgttgcgccaggcgacgttcttcacgatgtacttgaagagcatcaggtcgtcggccgcggcgagcagcgtgttgaacttgtagttgatctcggcctggccggcggtgccgacctcgtggtgctggcgctcgacctggaggccgttcttgtccagctccagggagatctcggcacgcaggtcggcgaagtggtcgaccggcggggtcgggaagtagccgcccttgtaacggaccttgtagccgcggttgttctcctccgacccggtgttccaggcgccggcctcggagtcgatgtggtagaagctctcgttcgccgacgtctggaagcggacgttgtcgaagacgtagaactcggcctccgggccgaagtacgcggtgtccgcgaagccggtcgaggcgaggtaggcctcggccttcttggcgatgttgcgcgggtcacggctgtactgctcacccgtgatcgggtcgtggatgaagaagttgatgttgacggtcttgtcacggcggaaggggtccacccgagcggtcgacaggtccgcgcgcagcgccatgtccgactcgtggatggcctggaagccgcggatcgacgaaccgtcgaaggccagttcctcggccgggtcgaaggtcgctgccgggatcgtgaagtgctgcatcaccccgggcaggtcgcagaaccggacatcgatgaacttgacgtcgttgtccgctacgtacttctgcacttcgtcggcgttctggaacatccaactcctcctactcccggcccgggagggacggggttgtagctcgtggtgcggccagtgcggtggcacacgctggacccgaccataggcaggcgtgatttctcaagcgtgacccatttgtttcgcccaagttaaccggggcggtggcggacggcacctccgcgactgtttccggtgccccgcccggccgggggcaaacacgggcgcagtaccgtggacgggtggacaacaggcaagcaatcggatcgtggctctcggggccccgcgcggccgccgaggagatgggcgccgacttcggctaccggggcaagggcctcgggctgcccgaggaggggcccggctcggtcgctccgctcggacggcgcttcggagccctcttcatcgactggtcgctctgcatggtgatcgcatacgggctgctcgctcgcggtgaccagcaggcgacggggaactgggcgctcggggtcttcctcgtgatgagcctgctgaccgtcggcaccatcggctgcacgcccgggaagcgcatcctgggcgtacgagtggtcgccgacgacggcgggcggctcgggttcgtgcgggtcgtcgtgcggaccgtgctgctcctgctcgtcatccccgcgctggtctgggaccgcgacggccgcggactgcacgaccggctgtcccgcgccgtacaggtgcggatgtgacctcgcgtacgcgggggcgtagggatgcggcctccccgaccgggcggcggctgctggccgtacgtgacaggtgaaacggcccgtacgtgacatgtaagacggcccgtacgtgacatgtgaaacggggcggccccgggaccgttcatcggtccggggccgccccgtttcgcgtatgtcccggtcagcgcatcttcccgccgcgcggcatccgcatgcccttgggcatcgggcccttcggcagcggcatgttgctcatcaggtcgcccatcgcgcgcagccggtcgttggtggaggtcacctgcgggccggtcaggacgcgggggagcttcagcatcttggtgcggaccttcttcaggggcacctggccctcgccgttgccgacgatgatgtcgtgcaccggcacgtccaccacgatgcgggccatcttcttcttctcggccgccagcaggctcttcacccggttcgggttgccctcggccaccaggacgatgccggccttgccgaccgcccggtggacgacgtcctggctgcggttcatcgccaccgcgggggtggtggtccagccgcgtccgatccggtccaggacggcggccgccgctccgggctggccctccatctgtccgaaggccgcccgctcggcgcgccggccgaagacgatcgccatcgcgaggacggccaggacgaagcccaggatgcccagatagacggggtggccgatcgcgaagccgatgccgaggaggacaccgaacgtgacgattccgacacccgcgacgacaagaccgatcttgctgtcggtccgcctggtcatcttgtaggtcagggcgatctgcttgagccgccctgcgttctcggcgctgtccgcgccttcagtttttgccttcctcgccatgtactgaagtttacgtggcgtgggagcggcctaggaacggtggtcggccacggcgtccagcacgtgctgggcctccacccggtccttggcgcggcggcggtcctccaggacggccgtccaggcgttgcggcgggcggtgcgctggccgctgctcagcagcagcgactcgacggcgcgcagggcggtggtgacggacggaagagcgtgggcgcggaccggtgcggcctgcatcgtggtgttccccctcggaatggatgcgcctgtggggcgcggatgagtgcgggaagcagtgacgacggcggccgctggagtcgccgccgtacgtgtacccagggtcactgctcggtgttaccagcgcatgaccgggcggtcaaacaccaatgaagccttgattccggtgccgcgcacgccgaagcggtccgtacgcgtccccgacctgcggggagcgcccggaccgcctcggtgatgcggttactgcgcggtaatctcttgtgagcggattcacacggcctgtgcggcctgggtgctcccggcggcgacgccgcgcgcttccatcgcctgctggaagagacgtcccgcgcggtacgaggaccgcaccagcgggcccgacatcacgccggagtagccgatcgcgtcggcctcgtccttcagctcgacgaattcgtgcggcttcacccagcgctcgaccgggtggtgccgcacggagggccgcaggtactgcgtaatcgtgatgagctcgcaacctgcgtcgtacaggtcctggagcgcctcgctgacttcctcgcgggtctcgcccatgccgaggatcaggttcgacttggtgatcagaccggcctcgcgggcccgggtgatgacctccagggaacgctcgtaacggaagccggggcggatccgcttgaagatccgcggcaccgtctccacgttgtgcgcgagcacctcggggcgcgaggagaagacctcggcgagctgctcgggctcggcgttgaagtcggggatcagcagctcgaccttggtcgcgccggcctcccgctccgcggtgagcgtgtggatctggcggacggtctcggcgtacagccaggcgccgccgtcctccaggtcgtcgcgggcgacgccggtgatggtggcgtagttgaggtccatcgtgacgaccgactcgccgacgcggcggggctcgtcgcggtccagcgcctgcggcttgcccgtgtcgatctggcagaagtcgcagcgccgggtgcactggtcgccgccgatgaggaaggtggcctcgcggtcctcccagcattcgaagatgttggggcagcccgcctcctggcagaccgtgtgcagcccttcgcccttcaccagctgctgcagctgcttgtactcggggcccatcttcgcccgcgttttgatccactcgggcttgcgctcgatgggggtctggctgttccggacctccaggcgcagcatcttgcgcccgtcgggtgcgacagcggacactccggctcccctttgctctctgctgcgttggattcgcgtcgggttcgcgtgggatgcgcgagcgtttcgcgagggactcgctttggattctttggcgaacaccagggtacgcccgtacatcaaacggccttacgcctgcccaacctgcggccgacggggcctattccccggccgctggtggcggtcgggctactcgtcggtacggccggtgcggtcctaggcgggggccggggccgggtcggccgcggccttcggctgctcgaccgcgcgcggcgcgagctccgcgttctccaggatgtcccgcaggtgcttctcggcgaccggcagcacctcctcgatggtgatctcccggcccagttcgttcgagagggacgtgaccccggcgtcgcggatgccgcacggcacgatccggtcgaaccaggtgttgtccgggttcacgttgagagcgaaaccgtgcatggtgacgcctttggcgacccggatcccgatcgcggccagcttgcggtcctcgcggcgttggccggcattggacggggcgtactcggggccgttcagccgcgggtcgaactcctcgtcctggagcctcgggtcgaagtccagcgagagcccgcccagcgcctggcgctgctcgaccgggtcgccgagcacccagacgccgctgcggccctcgacccgggaggtctccacgccgaagtcggcggccgtgcggatcaacgcgtcctccagc

SEQ ID NO: 2739 - DNA, 18515 bp, Unknown
  Kingdom: Bacteria, Phylum: Actinobacteria, Class: Actinobacteria, Order: Streptomycetales, Family: Streptomycetaceae, Genus: Streptomyces
ttcgggacgaagaggtcgtgggttcaaatcccgccaccccgacagctgaaacaccaggtaaagggcctgatccgcatcgcgggtcaggcccttcctgcatctctggtgatcgtttgggagaatctgggagaagatcttggtcatagtctcccagcgggcacctactctcctcccttacggtgacgtgcatagcagggatcgccgtatgcgcgttcgtgaatcggcgaccccaagcccggcgcggttggaaccgagccaaccaggggggcaagtggagccgagaagtgcagcagcagcgggaatcgactttccgtacaccgcgcgtaccacctgctacatcgaggtccatgatgacggcagagtcactcatggcaacgatcgggccgcctacgagcgcgccgtcgccggaaagtcgcggctgttcgccgtctggcccggcgagtggtcgagccacctgttcatgatcgacgacctcgacgagtacgccaaagctcgggggatcaagcatgaccagaaccggaccgggctggaggaacacgtccacgacgtggggtggaccgaggcgacaggccgcaaccccaatccccggagtccgtacatcagcatccggctcacgctgacatgcggatgcgagatccgtgacttgggcaccttcgcgagccagatgcaggagcagcggggatgggccatcgcgaccagtgttgggtggggcagcagcagtggccccgaaggtacgtcctactccctgcgggtgcgacggaagagtctcggcatctgagcgcctgcagcaagggcagggggcgcggcgtacttacgcgcggtctgcggtgtgcgccgccccctcgggttcgtccgccgcggacgggtggacgtacctgccctcgttaaacggggtgaaccacgccttgaacgccatcgatgctacgccgagagcctctccaacggcgctctcgtcgatgccgtccatggagtcgtcgtagagccactcgtgatccatgtcctcgtaaacgttgtcagcgaacgagtcgagtgcggccgagacgccgtcgtcgagcagcccgaaagtttccagtgtcacgttggtcccagtcagcagcagctttagcgcgagttcctcagcgacgcagctcaactgctggaagctgccatccgtgaagcgggtagtcatagcgatcaccgcgactagaaaacggcgagcgaaacgggcgtcgtactggagggcatatcgctcgggaagatcctcgaaatgccacagaggaccgccgcattcagccgcggtggtgtcctcctccgtcagggtctgcacgtcctggaacagttcgtccaccaagatgtccgtcgcgtagaccaaggcgccagcagcgagtttggcgtcctccggcgagggggtgaactcgctggcgtcttcttcctccttgtagtcttcgtcgtccaacacgccgaacatcacgggcgggaacgagcgcagctcatctgccagcgccagcatctgaccgcgtaccgcctcagctttcgcctcggcgtcgtagccctcactgtcgtcctcggccgtggggcgctcggtatgccgcgccttacggtctgccacatcatcgggcggggcatcaaaaccgtcagcagcggcgagactctcctgggcgagctccgggtgcagttcgacctcacatcgctcgatctgccagtcggccaacagctccgatctttccagcagttcacccacgactgaccggacagcctcctctgcgaactccagagccgccgcatccacgaacactttcaaaagcgcgccgcctgggtagacggccacaacggtgtcgagaagatcgacttccatgctatcgggcccctcaatggcctcgacggaagcaaaaccatcttcgatgagggccaccgcgccagtgtgttgaagtgggtccatctccggagtgttcttgggtatgagggcgtccacagtcactacgtatgtcacgcctctgatcctggcagcaatatgccgggtgatgaggaagaatccacttaaacgccagcagtgccccgtaacagcgctgcggggcactgctgagtgactcagcgtacgcacaggaggtcgttgagcacgcacacgggggacgaaggacgcatcgcgcgtcggacatcgagcgccgccttccatcgctcggtcagaccagccccgccccgcgaaccgatgctgctcaccatctgacggcaccccaccgatggtgcacccggcaccctgcccgcgccactgtcggccgcagccatccgtgacgacgaggtccagatcatcgccgacctggacgaggccgccgagggcgccgagtgcagctgctcggccggggacgaccagccgtactagatacaccgcaggcgggcgccgcaccgctcgcgtacgcgccccctgagtgccgccccggtcgtaccctggccggggcggcactcccttgtctccgagccccatgaggaaccgcgcgtgtccatgtctcgcattcccttcgatcagctcccagccgacgtccgccaggctgtcactgacaagaccggccccgtgcatcaggcggtggccatgaccggcggcatgaactccggcgtcgcctccgtcctggagacagagagcggcagcgttttcgtgaagggcatcgcgagtgatcatgcgcaggtcgcagcacagcgccgcgaggcggagatcgccccccacctgcccacgtcctgtccccgcctgtactggcacctggaagtcggtgggtggagccttctcggatacgaggtcctcagcggtcgccacgccgactacagccccggctccgccgacttggtgctcgtagaagccgcgctcaccgaactgcaacggatcaccgctccggccgacatcgagatcaaggacgcggtggaccgctgggcggactacgctccgcccggaacgctccagcacttcagcggcaacaccctgctgcacaccgacttcgcaccgcacaacgtcctgatcgccgacgggcgtgcccgcctcatcgactgggcgtggccaacgcgcggtgcggcgtggatcgatccaggcaccttggcactgaggctcatggactccggccacccggcagaggacgcgatcgtgttcgcaggccgcttcccgtcgtggcggaacaccgatccggaggcgctgacagcattcggttccgcatctgccgcgctgtggcaggagatcgccgaggaggacccaacgccctggaagcagaggatggccaagcgggccgctgcgttcaggctcgcactcctctgagagtccatgcccgccgtcagacctatctcgtcttgaactcgatctttccggtactcatacggaagttcccactcgagtacagcgtgggtcgggcctcaacgtggttgccgctgtacttctccacatgccggatctccacaccgcctggaacagtgaagtcgatcagggcaatggcgacccagtaggacaggttgcgattgttgaacaagggcaccgtcaccgtggacccgcgcccatccgtgaccaccacctgagcgccgtacgacttgaaagaacctgttccgttctccaccgcgctgtaagcgcatagcaggacgtagccctggaggtctgggcgacggatggtgatcgtctctcgacctggcactttggagtcgctgtccagtgcgatgtaggggggcgctactgacgatccgagttgccggtagtagacggcctggtccgtcttgaccgggcgctgcccgggtgaggtgaccagactccgaggaacgtagagggcgtagaggtccaggtctgccccggcccttcttcgtgctgcacttccgccgttccactcgagagtggctgtcactacaaggctcgggtcgtccttacgcatgtcgatggtcgcctggccggccttggtcaggagcactttgcccaacggcacaggcggccggaccggtgccgtcaccggccccggcggtgacgccacagctgacatctgtcggcttcgcgcgggtgtgacggttgaaggagccgccgtgatagggccagggtcatcaacaacgatgccgaagtccgacgccaaccccgccagacctgtgtcccacccctggcccacggccctggccttccagctgcccgcccgccggtacagctcgacgagcacagccactgtctcccggtgcatgagcggcggcggctcaaaggtacttcgaacaccgccacactcgatgaccgcatgcggggtgctactcgcgtcgaaatacctcacccgcagctccggatcgatgctggcgacgatggcaacgcggtccaccgtctccgggattgcggcaagatccgcgacgatggtctgcccgctcagcctgaccccgtcctgcgcagcatggttgtagaagatcaagtcgtcatcactccgcaccctgccgtccggcccgagcaggacagcagacacatcaatgcccgtcgtaggggcgctgagggtgacgctgcaagccgcagcagacagggcagtgttgccgcctttggcaagggcagtagtcatgagtcggcctctctccgaaatccgtacatgatggtggccctggccgttccacgcagtacaaacacggattctcttaccgaccgcatcgggcggtagacgcggcttgggagcaccgaaagtcccaaaataagccgggatcactgtgcacccgctctacacgctgggtaccgtctggcggggcggcgcccggccgggtccgaacgtggcacggaagccgggaagtgcaggatcaccgcgaggaagccgcacatcttcacgtcgtagtcgatgtgtgagacgttcggaaccagggcggcaggctgcaccgcgattatgcgggacatagggggcttgcaccgcccagtcgaagaccgtcaccatccggattggctgcccgtctcagatgtcactggcctgacttttagcgtttctgcgtgccgcgcggttcacgggcacattgcgtctacggtttccaccgaagcgccagttctgtgactgctgacgggtcagtgcggtgagcatgtctgcggcttgcttcgtctcgtaatggttgatgccgagcacgtcgcggcgagcaacgagcaccttcctcatctccgcacgggccacagagggagagccgaggaccgcccaacagaatgcccagttgtagtgagtgcggagagtggacgggtgccgcgcgcccaggttgcgttgctcctcattgaggatccggcgccacccttgatgggcttccacatgctggccgcgctgtgccgcgatgtgcaccctctcgtgccgggtggacagtagatcggtgaggcgaccttgtagtccccgtgtttcgtactccgcttccacctcgctgaggagcggctcggcctgatcgacttccccgatttccaccagaatttgacccacctgatgccgggtctgtagcgttttatagtgatctttccctagtagatcctgctctgtcagccagatgtccatgagatccgtgaaggccctgattgagtttccctgcaggctgtggatggacgcgatgtcatatcgagtgacaaggactgacgggtgccaggcaggcaggaaggagcgctgctgcctcagcacctctgacaggacagtaagcgcctggtcgagatggccgcgatgccacagaatgacgcctagttcgtggcggatgatggcctgagtgaagagcccaggctccaggcggtccgaggactcgacggctcgacgagagtgattttccgcctcgtctagacgccctgactgacgcagaatggtggcgaagtgatgatgggcctgcatgccgaggtacgggagatgcggcttatcgtccatctccgcgcacagctcgcgtgccattttcgctcccgactccagggagccaagctccgaatggatcgcgacggccagcgcgcgggccacatagaattcgacgctatctggtccgagcgaagagactgccaggcggcacgcggccgcagacatggtgtcggcctcatccaagcgtgacatgttccaggcccactccgccgcgttgagttcgaccaggtaacggattcggtcattgggcgtgaaggtggctagtcgcgcacgaagagccatagcacacttgtgcgcgatgtcgtaccggccgaccattctcaggtaacggctcaagtacatatgcgtattgacgacggtctcgaacaactcctcgagtgatggggggagtcgcccggccactgccatcatgtgaggaaccgcgaagggccattgggcagcggcttcttggtcctcggtgtctcgcagagccccaaggcagcggactgcggcggcccaagtgcgggcgcggtgaggggaccgttccagatgcactgcgttcacctcggcgaccagcggatggacaatgacgcaccggcgccagctcatgtcactcctgcggtggtagaacgcgtcggcttccgcggagggaccgtcggagttctcgtctgcgacgtcgatcaagccgacggcactgagagcattcagcgcacgctccacggcaacgctgtcccacctgccggtttccaagcggtgggtccttgccagcactttgggtgacagcagggccaccggtactggccttgttgcccaacacgacagggtccgcatgatcggcctgacctgaggtaagccctgctgttccagcgcatccagagacacctcccaggtctgcatcactaggctccgggcgtcctcgatcgtggacgagtgcggtgaagtggtggcggcccgatcaaccacattcgggaagtcacggtcgagcgcctgacggaaggctttgaggtcttggatgggagagaaaggctgcgccacgcagagtccagcagcccgcaacgcgaggggcacgccgcccaaccgctcggacagttcccgtgcggcgccgcgttccgcaggatccggtgcagaactgccggacaaagcgagcagcatatcggcgccggcttcatggtcaagcgggccgagcctcttcaaccgcgtaccgggtggccagacgtcccggtgcgcttggcgggtggtgaccaaaaccgccccggacgcagatggctccagccagttgggccccaagtcctgatgaagccgtgcggggtcgtccgcattatcgaagaccagcagccagggcttctcgctggcatggagggcctcccaagcgaggtccgcagtattcagccgatccagcggtgtctcgccgccctctgcaccctgcggccggagcttcgttgcaatctgccggaacgcttcgcttacctcagacccgccggaagcgtgaacccacagcacagtcgctccggcgctctgcgcgtagttggcgatggtcagagccagagcggacttcccaatgccgcctaggccgctgaggacggtaatgcggcccatcagtgccgccaagtctccgccgcccaggtcgcggaaggcggattctcgcccgtgcagttgcggtggtctgagattgactggtggccgcagtgatactggagaggcactgggcgactgcaagccgttgaagtggacatgcaccgtccctgagtcgaacacaaactggtcgcgacccgcctgaatgttggtgccgctcccagcggactccgcgttctgcctgatgtagatgaggccgtcatcgcgataccgcattgcttactccgcttatccggcgcaggactctgcaggagccagcctcacaacctgcgccctactttgttgaccagtcacagaggtcagtgaccaacgacgttgtactggtctcgcccggcctggaagttagtgccatggttagccttggcggtcatccgaatgctcctagctggcagtcgctcctgcaccggatcgtccgtgctgaccgcagccagcgcacggcgcagggcagcggcgtctgattcgacggacagcagcggggcgagccgttgttgccaggcatatgcgagattctggacggtcagggcatctgatgctccctgaatcagggtcgctcgtgtcgcttccagatccgcagcgatcgtcgccatctcgccggggcgcagacgggcccacagtccgagaacagcgcttttcgcgctactgaaagcggtcgacgccataagggccactacggtggttcccgccgtttgaatgaaaatggacaaatcgtcttccatggctaatcctggcgttcgctctatactgatcttgcagcatattctgatgggccgaagcggatgttctgggcattgcgccatctcgcgccgtgtcggcgcggcctgatgttcaccccgccgtcggctcgttgccggatcagggggactgtgagggcgtgctaagcacaccgcgctggttcggcgacttggccgcctcagccggcgggcgacggtcattcgcgatcactgcggtcactgacccgtggaccagatggctcgctggtggtccatttgtggtcggtgtgcttatcacggcggtcggcaactgccttacatgtaggtcaccaagaggaccgagcaaacttgcttacgctacgcagctcggaactaaggcttcgagggcaaggcactcctcgctgggagattcctgggagatgatcttctcccagagaccaaccggaaccccgccgcaccatctcaaagcacctacctgacctgcacttttacaagatccgcaggtgtcgaccccctcgaacctcattcgggacgaagaggtcgtgggttcaaatcccgccaccccgacagctaagaagtcatctcaattggcgattgagccgcccgtgtaatcggagaccgggcgcaggcccgttgacttgaccgtgatgtgagacttgcagcatggacatggggcgtgagtcgcggtgggaaaaggacgcaatgacggtggagatcgttttcgccctggtgactgccgccgtgctggctggggtgatctttgccgtcgcctgggctctcgtcctggtccttgacctctctggctcggcggagagaggcgggttggtaggaggtgcactgctcggagcggtggccggagtgtggcgtctggtacgggtgctgcttcggttcaacgagcagcaccgaatgggccactgactacggcccttccccttgcggtcggtagcctcccggcgtggggatcgttgagcggttggtgccggatgagttgtgggagttgttccagcgggtggtgccggaggcgccgtcgcggccgcagggtggtggtcggcgtcggcatggcgaccgggaagttctggcggcgatcgtcttcgtggcgacgtcgggttgtacctggcagcagctgccttcggcgtcgttcggcccgtccggagcgaccgcccaccggcggttctcggagtggtcgaaggccagggtgtgggcgaagctccaccgcctggtcctcgacgaactcggtgccccgcggcgagctggactggtcgcggtgcgcgatcgactcggtgaacatgcgggccctgaaaagggggacctgacaggtccgaatcctgtcaaccggggcaagtacggctcgaagatccacctgatcacggaacgatccggtctgcccatatccgtcggcatctccggggccaacgtgcacgacagtcaggccctgatcccgctcgtgaagggcataccgccgatccgctcgcgccgcggccgacgacggcgcaagcccgggaaactccacgcagacaagggctacgactacgcccacctgcggcaatggttacgcgcacgcggcatcacccatcgcatcgcccgcaagggagtcgagtcctcgcaacggctggaccgccatcgctggaccgtggagcgcaccatagcctggctcgccggctgccgccgcctccaccgacgctacgaacgcaaggcagaccacttcctcgccttcaccagcatcgcctgcaccctcctctgctatcgcagactcatcaaatgagatgacttctaattaccaggtcagagggcccttaccgaatcggtaagggccctctgtcgtgtctatctgcgtgactatcgcttcctgagtgcctacggcttccgagggtccgcgccgaagatgccgtccatcacgacggcccccgtctggatcaccggcctgatctggccggttgcggccacgggcgaggaacatggcgacctggacgggtccgatgcgacgggcgttgcggaagcgcggagtcatggagcggtcctttcgcagaggtgggcggcgacggacggcgtcatggaagcggggaggccgagccgggtccgtacggtgtcggcatcggccgccctgccggtggaggcgcggtactccgcctccagcgactggacgcggtccacaagggcgggcggcaggggcgatacgggatgggagcagccgtcgacttctcggaggcctcagcggcggggagttgaggaggcgaactcaccggccccgactcgtcgtccaccgcaacggcagcgggcggttccggggtaggcggctgcgggatcgggctcgtacgaaccgctgctggagggggagcgtcaacgaggagcgtgccgccgaagaaggcggcggcgggccagcctgccaccacgacgcggagcggggcggggacttgctccaggtcgaggagtcctgccgtggcgacgttggctccgagggaagcagccagggcgatgaggaaccagaggcgcgggcctccggcaggttgtccggcgcgctgttgttcgcgcatccggcgccaggccgcgacgagcagcaggtcgacgctgaccgggtaggcccacaccttccatccgccctgccctacggcttcggcaaggtcgtgcaatcgaggactgggagcggtagtccgccaggcgacaacagacagacccaagggcaagtgtgtcaaccgaccacagacgcatatgcctccaccagcaacggacgccggggcagtacggtctggcacggccacgtccgccccacgcagcagaggtggacaggcgggccagccgaggccccggaccgatcgcggtccggggccgttgacatctacccctgacatcaacagcaacgcaccaagcgcgaccttgagcagctaccccgtgtgtcctcgcacctcatgccacagacgatgcggcgtgaaacggcggcagccatcaggatggcggccgcagctgtggcgcgcgtggatgcgtcatggcacctagggaacgcgggggctcggctgagacagcgatgccggtgggcgcaagagaccgtcgtccgcacttgacggtcgtgacctcacccacccacgtggcatgcgcatcccctcaaggtttgcaaacgactcagggccggcctgccttagcggccggacgcacctccagccgctcccccggacagggtcacgttatgaccgagttctccccgccgccacggaacatctgctagtaatgacaaatgacgccgcatgggcgccaatacgggcacaggggagggcgttgatggcttgcacatccggcagaccgaaacttagcgacgatcaagatcgagaactattttcagagagtgcgggaacctgcctcctctgctccacgagcctatttcccaaggacccaaaaagaaagaggtctattcccatcgcagaacgggcccatatcatcgcccatagcgatgatggccccagagccaacccctcaatcaccgattcagaacgggcagcccctgagaatattgcacttctgtgcccgtcctgccacaccattgtagataaagctccggacgagtatccagttcaggacctgctggatgccaagcaagcacgcaagcagcttgtggcaaacattggaggggcgcaaaagttctccgatgccaccgaagctcagaaggcagtacagcgaatcttgattcggaatcggattattttccagcgatacggaccgagccccgaagacggatctacgaaatcggcggaaacagctctaacgtggtcgcggcgcgttcggacagaaattatcccaaacaatcggctcattgtagcattggtagacgtaaacagcgaattcgcttccaccggcgatatggaggcgagtgagctcctcagacaacataccgatgaccttgagcgaaagcatagaaataagaccctggaagggcctgcatcaaggtttccttcggaagtggaaaacattttcaagggagatccggtgtgaagtactcgactagttggttcatccgcacaatctccagccactctgcggtgaaatctgcatcagagctccaatctggctgtgtgctgctagaacgtaaacatggccccgcgatcgtggtagctcccgtatcgatcgattggctcgacaccaatcacgtccgaacaatccttcaagcggaaaaagcggcaattatctgtctcattcctaaggattctcactacagctgggaggcccgagaaatagccgaggacctcgaatccgacgtgcaaaccgtgaaggagttgtactcttccctcggctgggaagatccgagggggcatatcgacaagaatgtagggtacgcaaaagatcggctggagcagcacagtcgcgtagaacgcctcgtaatgcaatgcgaggccagcatgaaagtcatgcggtttggcggagcatccgacaagattgtatctgtcgagtacgaatatgagtttacggaggaagcactcgtgcgagccctcaagcgacaccctggggccgatatcatactgaactcaaaccctaacggcaggccaaccggagccgcactgcagcacgcaaaggatgcaggagtggcgctcttccaaattggcgagctaatgggggcactaaactatgacggttatgaattcctcaattattcgggacctgagaatcgtcgccgatagacttcttgcagggagtctcaacttcgaaatctatctgttcgggtcgaccgttaaagggtcctcaaatccgcaggataccgatgtcgccgtcatctacccagagggatcactagagctggcccacctcgtggcggaaaagtataggaagctggacttctcgccacccattgaagtgattgccctaagccagtccgagcagaaagagtgcgactttctgagtttagtggcagcgtcacttctctggccgcttcctgactccaaattaacctagggggcgccgcacctcggctccctcacaggagactcgaatgtcaggcggcgtctcccggcgcaagaggcgccccctgaccgttaggcccacgcgcgcctggccggtcagcgcgcccaccgtcgcgggtggttgttgtctgttgaagtcagtgccgtagctggcatccgtgagtgtctaactgcctgaccacgcccacgaacgccagcgcacaaccgtggacacctgcggaccatcagcgcaggtgaggatcacaccagcccaaggtagcctccaccaagttgcttcgggacgaagaggtcgtgggttcaaatcccgccaccccgacagctaagtagcaggtcagagggccggtactgattccagtaccggccctccgcctttgtgcgtgtctgtctgcgctcactgaagcggcaccgctccaagctgccacatctcatagttcccgcattctgccgtgatctcggcagccgtccgagccgcggtgaagaagtcgccgaccaccggcgaggtgtgcgatgccgccaccgcgaggcacacctggtcggacgccaggtccgagacgggcacgtagctgatgttcggatgtgagtagaacacggtcgccgaacgtgccaggaacgagatgccccggcccgccgcgacatgctcgagcgtctcgtccaccccgcgcaccacgtacccggcgttggggtgcgggctcctggtgggctgcgtgctcgggtcggggtgccagagcaggggttcgccggccagatcggcctcggtgatctggtcccggccggccagccggtggccggtcggcagcaccgccacccgcggctcggtgtacagcggggtgacacgcaggccggcctcgtcgacaggctgccgtacataggcgacgtcgatgcggccgtcgagcagcatcggggcctggtcgtccccttcgatccgctggacgtccaccagaacgtccgggtgctgggcggcgaacagccgtaccgccggagcgaccgcgatgcccgcccggaagccgaccatgatccgccggctgccgcgcgcggccacggtcacccgacggcgggccgcgtgcgcggaggccagcagcgggccggcgtcggccagcagctgtctgccggcgtcggtcagtgccacgccgtggctgtcccgtgtcagcagctgggtgcccaggtccttttccagtgcgcggatctgacggctgagcaccggctgcgcgatgtgcagctcctcggcggcgcggccgaagtgcagcctgtcggcgacggcgacgaagtagcgcaatttgcgcaggtccaggtccatgaggcctctcggtccggcgatgcctccagggtatcgcagcgactgaaagaggtcttggacacccactcgggccaatgacaccctcaataagtacccggtggggccggagtgaattcggcataagaatgcgataccgggcgggacttggcaacaggacccgaatcattatcggcggcacaaccttcgacaactacggggcagacatcgcgccctattcagctccagaaagcaggcacacccatgagcagcatcagcattatcggcctggggaacatggccggcgccctggccggccgggcactcgccggcggcaacgccgtcgaggtcatcggtcgcgacccggccaggaccaaggaagtggccgccgcggtcggcggcgccgctgtcgggacggccggcaatgtcccggccggggacatcgttgtcctcgccgtgccgtacgccggcgcggcggcggtggtgagcgagtacggggacgcgctgcacggcaaggtcatcatcgacatcaccaaccctgtctcccccgatttcaagggacttgtcacccccgacggcagttccgccgcacaggagatcgccagggccgcccccgccggcgcgcatgtcgtcaaggcgttcaacaccctgtactcccatgtgctggccgccggcccagtcgatggccgccagttggacgtgttcatcgccggcgacgacgcacaggcaaaggcacgcgtgtcaacgttcatcgagagcctggggatgcgcccgttggacaccggggacctgccgatggcacggacattggagaacgccggcctgttgatgctgggcctcgtcgccaattccgtcaagcacaccgacttctcgctcggcgtcagcattctcagctgagcgcacccgcaccagcacttctcgcgcgacaccctttccaaggagcattgacgtgcgcgttttcatcactggcgggaccggccattccggttcgtacatcatccccgagctcgtcgccgccgggcacgaggtgacgggcctggcccggtcggacacggctgcggcggcggtgtccgcgctcggcgcgaaggtgcgtcgcggcgacctcaaggacctcgacgggctcaaggaggcggccgcggactccgacggcgtcatccacgtcgcgcacaggcaggacctgcttccgtccggcgggatcgacgccgtggccgccgcggagctcccgatcacgctcgcgtacggcgaggcgctcgcgggaaccggaaagccgctggtcgctgcggggagcatcggctcgcccgggaacctgggccggccggtcaccgaggaggatcaggcccttcccggcggcgatgagtacaagggcaccctgcgggttcgtaacgtcgtggaaaccgccgtgatcggcctcgccgagcggggagtgcggtcgtcggtcgtgcggatcgccaacatcgcgcacagcgcgaccgaccgcaccggcttcctccccacgctgatcgcgctcgcgaaggagaaaggcgtcgtcggctaccccggagacggcgcgaacctgtggaacgccgtgcacacccgcgatgtcgcctccttgttccgcttggcgctggagaaggggacggccggcaaatactggcacgcggtcggggaaggggacatcccgttccgcgagctggccgagggcatcggcagtcgtctgggcctgcccgccgtaagcattcccgcggacgtactgatggtgccgggatacttcgggttcctcgcgaacatagtcacgcagaattacccggcgtcccacctcatcacccgccagaccctcggatgggaacccgctcagcccggcctgctcgccgatttggacaacggccactacttccccgccggctgacgacaaggacccgcatcacggcgagtccgggcggatgacaaggcgcggcttctccggaggggaccgagaatatgacgacggccgtgggattccgcgcaactggccgggaggaggggcccatcggtggcaccgctcgcccgccctaccgccgcacctgaatcagcgcgtgcgtgccactggtacgccaggcatccccggacagttcgagagcgtccagtgtttcctcatccaggcccacgatgacgtcggacttcagggtcctgagcgccgcgacggccccggggaagtacgtggtgagatcggcgaaggacgccgtggcgtcccacgaccggtcgcccaccaggcgacggtagttgaggtcgcccttcaggatggtgagcgcggcgctctcgaactcgccgcgcaggtcctccggcatctccccgtacggctgcggagcgcagaagaacgggtgggtacggacctccaggcttcccgccgccatggccctccacagccggccgccgatccttccggcctcaccgggcgcctcgacgaggcgacggaggcagtcgacgacgtcggccgtcatcgcgtcggagacgtagtaggggtagggcttcacgtgaagcacgacccgttcggcctgtcggtgttcgaggaggtggtcgatgagaatcaggtcggggatcagctcccgacccgcgttgtccgcgaccacggcgaccgtggacccggattggacgggcaggagctgccacaacaggccgctgtcgtcggcgaccaacgcgggagcggcggcggtgtgtccggcctccgccgctcccgccgcgacgcggaagccgaggtccgcgcggttgccccagagcgaggcgtggagcagggccgtggcacgctcctcagccggcacgttcgcgagcgggtccagggctcgcagctcctcctccaccgcgtcgcctcccagttcggccttcttgaacggcgcgaacggatcgactccctgccatggtccggtgccgaagtagccgacggcgccgaggagcctgcggtagaagtagctctccgcccacaggaacggagcgtcgtaccaggagcggccgaagtgctcctgtcccgagaccgcccagaggccgtggtcgcgttccgcgggggcaagtcgttcgacgacaccgttggtgatctcgtccagcaaggcgtcgagggcctcgtgctggcgtcggctgtaggggaacgcgtcccgcacctgctggacaagagcagggtggcgcttggccagcacactccgggcgaatgaacccggctcgttgctcaggatgaccgtggcacccgacgtggaggcccgagccgcctcctcgcccgaggcgcgggagatcttctctttcatgctgtccaagcccttcgatcgaacggttccgccacgtcgtggcgcgtgcgcgccacctccgtggacgagggcagggaatcgattccgtcgacgaccaccacaactcccctcggcaagtggatcgtacgaagcggcagcaccggtgccggcggtgccacgtccgggtcgggcagggaggtatcgacggtcagggaacgaagcagcggccatgcgcgcggccacctccacgagtcgccgatatccacggtcagccgttgatgagtgatccgtgccgtgcgacagccggtgaggaagtcgacggctgtgaatctccgacgatcgccggatgaggccggtcggaagccgggtgcgcccggtcgggcgcgccctcacccgtccggatgaaatcacccgcgcgccggcgccaggacggggccctcccacccgcgcgtcgccgctcggccgaccccttgggaacgcgctgggactcccttgaacttgcaggttctggccaggagttgagcgtttatctacgcgcggagcatggctcgccgaacgatcattcgggcatatcagacgacttctcgcgcgggcattaccggcgggtaccgggagctgctagaaactccatcgctccctctccccacctgtcacccaccgtgcgttcttcatcccctcatccccccacacttcgaagggccggcagccatgtcagtacgaagaattcgtgcgtccgtcgtcactctcgcgctcgccgccgtggccgcgctcggcgtcgcgggaccggcctccgcggccgactcggccgccgcgggcggctatgtcgcgctcggcgactcctactccgcgggcgtcggcgccggaagctacctttccgacagcggcgactgccgacgcagcaccaacgcctacccgtatctgtggcaggcggcgaactcccccgcctc

SEQ ID NO: 2740 - DNA, 3308 bp, Unknown
  Kingdom: Bacteria, Phylum: Actinobacteria, Class: Actinobacteria, Order: Streptomycetales, Family: Streptomycetaceae, Genus: Streptomyces
gtggccaccgcggcgaccacggacgtgtgccggaactcctcgcgggtgtacgggttggagatgtgcacctcgatcagcggggcggtgcgctgggcggccgcgtcccgcatgccgtaggagtaatgcgtgaaggcgcccgggttgagaatgaccggaatcgatccgtccgccgcctcgtggagccagcggatcagctgaccctcgtcgttggtctcccgcacctcgacgtcgaagccgagctccttgccgagggtcgcgcaggtctcgacgagtccggcgtaggaggtggccccgtagacgtcgggctcacgcgagccgagccgtccgaggttggggccgttcaggacgaagacccttcgggtcacgtggagacctccccgtaggcggcgagcagcacggccgggtcggggccctccaggacggtgggcttgccgatgccgtccaggacgatgaagcgcagcaggtcgccgcgcgacttcttgtcgaccttcatgttctccagcagcttgggccactggtcgccgcggtaggcgagcggcaggcccaccgacgcgaggacgctgcggtgccggtcggcggtggcgtcgtcgaggcgaccggcgagccggcccagctcggcggcgaagaccatgccgatggagacggccgcgccgtggcgccatttgtagcgctcgttcttctcgatggcgtgggccagggtgtgaccgtagttgaggatctcgcggagtccggactccttgaggtcgctggagacgacctcggccttgacccggatggagcgctcgatcagctcggcggtgtgcggcccggccggggtgcgcgcaccctcgggatcggcctcgaccaggtccaggatgacggggtcggcgatgaacccggccttgatgatctcggccatgccggagacgtagtcgttgaccggcagcgagtccagcgcggcgaggtcgcagaggaccccggcgggcgggtggaaggcgccgacgaggttcttgccctcggccgtgttgatgccggtcttgccgccgacggcggcgtccaccatgccgagcacggtggtcgggatcgcgatccagcgcaccccgcgcagccaggtggccgcgacgaacccggcgacgtccgtggtggcgccgcccccgatgccgacgatgacgtcggtacgggtgaagccggtctggccgagcgccttccagcagtaggcggcgacctcgacggtcttggcctcctccgcgttcggcagctggacggcgatggcctcgtacccctggtcggcgaggtcctgacggaccgcctcaccggtctcggcgagcgcctccgggtgcagcacggcgacgcgccgggcgcggtcgccgatcagctggggcagctcgcccaggagctggtggccgacgaggacctcgtacgggtcggagcccgcggagcctgcgacctggatgcgggtgggtccctgctgcgtcatgccggtgttctccacgccgggggcggctgcgccctccggcagttccagtgcgtcgatgatcgcctgggcgacctcttcgggggtgtgctcgtcggtggcgacgacggtacgggcgacctcttcgtagaggtgacggcgggcttccatcagctcgcgccactgccggcgcgggttgaccgcgagcagcgggcgggcggcgccgagaccgacgcggcggacggcctcgtccacgtccatggagaggtaggcgaccggacggccggccagcagctccctggtcgccggatccaggacggccccgccgccgagggagaggacgcccgtgtgcccggcgacggccgcctcgacggcccggcgctccagggcgcggaagtgctcctcgccctcgtcgtagaagatctccgcgatcggcttgcccgcctcggcgacgacgtccgcgtcggtgtcccggtaggtggtgccgagccgggcggccagcagctcgccgacggtggacttgccgacgcccatggggccgacgaggacgaccagggggccgctcatcggatctggaggtggtcgaggtacgactggacgttgcggtgggtctcggggacgctgtcgccgccgaacttctccgcgaccgcgtcggccaggacgagggcgaccatggcctccgcgacgatgcccgcggccgggacggcgcagacgtcggagcgctggtggtgggccttggtggcctcgccggtgacgacgtccacggtggccagggcgcgcggcacggtcgcgatgggcttcatcgcggcgcggacgcgcagcagctcaccggtggtgagcccgccctcggtaccgccggaacgcccggaagtgcgcctgatgccgtcctcggtggcgacgatctcgtcgtgcgccttggagccggggacccgggccagctcgaagccgtcgccgacctcgacgcccttgatggcctggatgcccatgagcgcggcggcgagccgggcgtccaggcgccggtcccagtgcacgtgcgagccgagcccgacgggcacgccgtacgccagcacctcgacgaccccgccgagggtgtcgccgtccttgtgggcctggtcgatctcggccaccatcgccttggacgcgtcggcgtccaggcagcggaccgggtcggcgtccagcttctccacgtcggcggggacggggtagatcccgtacggcgccttggcggcggccagttcgacgacatggctgacgatctcgatacccgcggtctccttgaggtaggagcgggcgacggctccgagggcgacgcgcgcggcggtctcccgggcgctggcgcgctccaggaccggccgggcctcgtcgaagccgtacttctgcatccccgcgaggtcggcgtggccgggcctggggcgggtcagcggggcgttgcgggcgagcttcgccagctcctcggggtcgaccgggtcggccgacatgacctgctcccacttgggccactcggtgttgccgaccatgacggcgaccggggaacccatggtgaggccgtggcgtacgccgccgaggaaggtgacctcgtccttctcgaacttcatccgcgcaccgcggccgtaaccgagccgtcgccgggccagcgcctccgccaccatctccgtggtgatcgggacaccggcgggaaggccctccagcgtcgccaccagtgcggggccgtgcgactcccccgcggtcagccagcgcaacctgctcaacggtgctcctcatgctcgcgcctgaaatccaacggcgccaccgggtgcgcggccctggcccgccgcctttgatcctcccacgaccgggggcacgatccggccgccggtccagcagacggacgggcggc

SEQ ID NO: 2741 - DNA, 7521 bp, Unknown
  Kingdom: Bacteria, Phylum: Actinobacteria, Class: Actinobacteria, Order: Streptomycetales, Family: Streptomycetaceae, Genus: Streptomyces
gggggagagcggggtgttctgggtcatgtcccggggtttcccgcccgtggagggtgccctaacccctgttacacgcccgtcgacaatcccggacgacgccgtcctaaagtacggacgttcgacaaccgaaaagggccgtcacgccgggaatcgggggaggggcggctcgggcgggtgtacgagcgctgctttcacgccgcacgcacgcctcgcccgagcgcccccctcgtacgtccctcctcaaccccaccggcggtcgggggggcgggtcctatgccgcggcccggtcgcactcctggccgcgcagcgcccgcgcgagatcgtcccgggcctccagcaccagccgccgcagcgccggggcggcgtcctcgtgctcgcccagccaggcgtcggtcgccgcgagggtcgcgggactgtcctggagaccggggaacatcccccgcaccacgtgcatgccgatctggatggaccgctccgcccagatccgctcgatcacctcgaagtagcggctcgcgtacggggcgagcagctcccgctgggagggctgcccgaagccggagatcgtcgcctcgaccagcgcgttcgacagcttgtccgactccacgaccgccgcccaggcctgcgccttgaccgcctccgagggccgcgaggccaggcaccgtacgtggtggcgcttgccggacgccgtgtcgtcgcgggccagttcggcgtcgatcgccgcctcgttcgccgccccgtgggcggccagcggggagaggaaggaccagcgcagctcctggtcgacgtcgagaccgtcgatccgggccgtgccctccagcagcccgcccagcagctggaagtcctcctcggacgaggcgaccgcggcgaagaagcgggcccaggtcagctggtgctggctgcccggctcggcgctccgcagctcgcgcagcgcgccgtctgccagcgcccggccgccctcctcgcgccagtcgggagccgcgtagttgaccagcgcggactgtgcccaggcgtgcagcatctggagaacgccgatgtcggtctcccgcccggcgaacgccagcaccagcgcgacgaagtcgcgggccggcaggactgcgtcccgggtcaggttccacagggccgaccagcacagggcacgggccagcgggtccgtgatctcgcccaggtggtcgcgcagcgtggccagcgaaccctcgtcgaagcggaccttgcagtaggtgaggtcgtcgtcgttgaccaggatcagatcgggccgctcggagccggccagggcgtccaccacggtccgctcgccggccacgtccacctcggcgcgcgcgtaacgcgtcagctcgccctccgtcgtacgccggtacaggccgaccgcgacgcggtgcgggcgcagctccgggtgcgaggcggcggcctcctggacgacggccagctcggtcaggacgcccgccgcgtcgtacgtgggcaccggggtgagcacgttgacgcccgccgtctggagccaggagcgcgaccaggccgtcatgtcgcggccggacgtctcggccagcaccgacagcaggtcgcccaggcgcgtgttgccgtaggcgtgctgcttgaagtagcgccgggcgccttcgaggaacgcgtcccgtcccacgtacgccaccagctgcttgagcacggacgcgcccttggcgtacgtgatcccgtcgaagttcagcttggcgtcctccaggtcacggatgtccgccgtgacggggtgcgtggagggcagctggtcggcgcggtaggcccacgccttgcggttgttggcgaaggtgatccagccgttggtgaagcgggtcgcctcgaccatcgagaaggagcccatgaagtccgcgaaggactccttcagccacaggtcgtcccaccactccatggtgaccaggtcgccgaaccacatgtgcgccatctcgtgcaggatgacgttggcacgccgctcgtaggccgccgaggtgaccttgccgcggtagatgtactcctcgcggaaggtgaccatccccgggttctccatggcgccgaggttgtactccggcacgaaggcctggtcgtacttcccgaaggggtacgggtagtcgaagtggtcgtggaagaagtccagaccctgcttggtgatcaggaagacgtcgtccgcgtcgaagtgcttcgcgagccccttgcggcacatcgcgccgagcgggatctccagcgtggtgccgtcgtccagggtgcggctgtagtggtcgctcacgtagtggtagggaccggcgacgacggccgtgatgtacgtggagatcggcttcgtctcggcgaaggtccacaccccgccctcctgcgactcctcggccccgttggaccagacccgccagtcggcgggggcggtcacccggaagcggtagggggccttgaggtcgggctgctcgaaattggcgaagacgcggcgggcgtcggccggttcgtactgcgtgtagaggtagacctcgccgtcctccgggtcgacgaaacggtgcatgccctcgccggtcctgctgtacgcgcagcgggcgtcgaccacgagcgtgttctcgccctcgacgagcccgtccagcgccacccgcgtcccgtcgaacacgacggccgggtcgagggccgtcccgttcagtgtcaccgcgtccacacccggggccaccaggtcggcgaaggtcgaggcgcccgcacgggccgagcggaaccggatcgtggtcagcgagcggaaggtccgcggaccggcctccccctcgcccccgtcggccccctcgggctcgccgacggcggaccgcaggtcgaggtcgacctcgtatccgtcgacggtcagcagctcggccctcgtctgggcctcgtcgcgggacaggttttcaccgggcacgggcactccttcgtgacgcgcgtcatgtgtcgtgttcgaacccattgatccttgcacgcgtcttcgcgccgcggcattcagggaatgggagcctctccggaggcgttctcgcccgcaggtggaacacgcccttctgaggagagacatgtccgagaacaccccggccaacggcaagaccccggtcgacttctggttcgacccgctctgcccctgggcgtggatgacctcgcggtggatgctggaagtggagaaggtccgcgacgtcgaggtccgctggcacgtgatgagcctggccgtcctgaacgaggacaagctggacgacctgcccgaggagtaccgggacctgctggagaacaaggcatggggcccggtccgggtcgtcgtcgccgcccggcagctccacggcgacgcggtcgtcggccccctctacaccgcgctcggcacccgcttccacaaccacggcgagggccccacgcgcgaggcggtggccgccgcgctgaaggacgtcggcctgcccgccgacctcgcggagtacgccgactccgaccgatacgacaccgagctgcgcgcctcccacaaggagggcatcgacaaggtcggccaggaggtcggcaccccggtcatcgccgttcccggcgcggacggcgagcagatcgccttcttcggcccggtggtcacccccgcccccaagggcgaggaggcggcgaagctctgggacggcacgctgctggtcgcctccatcccgggcttctacgagatcaagcggacccggacgcagggcccgatcttcgactgacgtccgtcccgggccgcgaactcccgctgctggaagtcgcgctggtctgagggtggccgacaacgggccgggccggcttccggcccgttgtcagtggtgcgtcgtacggtgaggagatgcgcatctcaccggaaatgatcacgatcgactgtgccgacccccagggcctggccgcttggtgggccgaggcgctgggggtcgagggaacacaggactacgacgggttcgtcatcctcgcggcgaccccgctggtcctcggcttccagcgggtgcccgagcccaaggccgccaagaaccgggtgcacgtcgacttctcctcgcccgaccgcgcggccgacgtggagcgcctcgcgaagctgggcgcgaccgtcgtcggcgagcagtcgatgcagggaatgtcctggacggtcctcagggatccggaggacaacgagttctgcctctccgatgccggaagccactgacccggaagccactgacccggaagccaccggcccggaagctcccggcgccgggtccgctacttgaggccgaggatctgctccagcgggtcgatgatgaagtagaccaggaagagcgcggcggtgccccacagcagccagtggacttcgcgcgccttgcccaggcacgccttgatgaccacgtaggcgacgaagccggcgccgatgccgttggtgatggagtaggtgaacggcatgacgacgatggtgaggaaggccgggatggcgacgtcgtagcggtcccagtcgatgtgcttgacctgggtcatcatcaggaacccgaccacgacgagcgcgggcgccgccgcctggagcggcacgatcgtcaggaccggggtgaggaagagggcgagcgcgaacaggccgccggtcaccatgttggcgaagccggtgcgggctccttcaccgacacccgccgcggattcgatgtaggtggtcgccgacgacgaggacgcggcgccaccggcgacggcggccacgccgtcgatgagcaggacgcggccgaggccgggcacctgaccccgctcgtcgaggagcccggcctccgccgtgacgcccacgaccgtgcccatcgtgtcgaagaagtcggacaggatgagggtgaagacgagcaggacgaccgtcagaacgctgacctgaccgaacgatccgaacaggtcgaaccggcccagcagcccgaagtcgggtgcggcgaccgggttgtcgggtatcgagggcgaggtcaggccccaggacttgatgcgggcgacctcgttgatgacgatggcgacgacggtcatcaggacgatgctgatgaggatcgcgcccttgaccttccgggcgaccagcacgatcgtcaggagcacgccgaggcagaagacgagcatcggccagccggtgagcgtcccggtgccgagctggacgggcacggtggagttcgcggcgtcggggatacgggtgacgaacccggcgtccacgaagccgatgaaggcgatgaacagaccgatgccgacgctgatggcctgcttgaggggctgcggaatggcgtgcatgatcgcctcgcgcagcccggtcatcaccagaacgcagatcagcagcccttccagcacgatgaggcccatcgcgtcgtcccagctcatcaggggagcgatctggtaggcgacgactgcgttgatgcccagacccgccgccagggccagtggcagattgccgcccacacccatgatcagcgtcatcaccgcggcgaccagcgcggtggcggtgaccagctgcacgttgtccaactgcttgccgaacttgtcctcggccccgccgaggatgatcgggttgagcaccaggatgtatgccatcgtgaagaacgtggcgaatccgccgcgtatctcctggagataggtcgaaccgcgctcgctgatgcggaagaaccggtcgacggcaccccccgatccgttgggcttcgcgtcgggcggcgggctggtcgtactggggtgcatgacggagtctcctgagcctgcgaatgatggggaaggggggtggcgccggtgctgccggaggtgagtggcaggcgctgtgcgaacgcacatgcggcaccttgcgagcggatcatacgcggcgacgacgggatcgcaactacccgcgtagagcgtgcagttggtcccctttctgccctgtggcttcctacggaatcagcggtgaccttttccgccaaaccggcaggcagccgacagcgggtatggaagtggcggtgacaactcccctacgctccgtatgtgcacccaccactccctttcaacgcgcgggcagcgcgcgccttgcgcgagaaactcgggatggcacccggtcatgtcgcgtacggcatgcgcgcgtccttcggcacgtcacacgtcggtcccgagcatgtgatcgcgtgggagcgcggtacgcacgtgccggacgcggcggaattcacggctctggcaggcgcgttgtggtgccggccgagtgaactcatgggccatccgcgtaccttgctcgaacaccgcatcgcgcgcggcgtctcggccgaggacgtcgcacgcgccaccggcctcaccctcgacgcgtatctggccatggaggaatccggtcagtgggccggcgacaaacgccagtccgtcaatctcggcgaggtcctcagccttcccccgcgcgacttcatcgccatcaccaggctggaggaggaactggcccgcctcctcaccgaggcggtctccacgcgctggcaggcgcacatccgcgacatcgccaagctcgtctccatggagcgccgcgacctgaagggccccctgtccgccatgcaccaggagtaccagggcctcatggcggccaccctgagccgggccggcggcaccacggcatccggcgaggacgggcggcgcttcatcgagaacatcgtcgaccacttctggacccggctgccggggtcctcccgggcgtagcccgacgggctcgtgcgacccgccgcgttgtggagcaccgcgagcccgagcacggtgatcgactcagcgcgatccgtcgccgtcccccgggagcgcccgctggacgacgaagaccggcgtgctcacgttgatcaccggcgcctgcgtgaacccctccccggtgaaccgcccgtcacccgtgcggtcctgtcggccggttcccccatgaggttcacgcccggtccgcccccggagccgccgcctccagctccgccaccgtgcccgacatcaccgtacggatgtggcgcgtcagatgctccgccggccagtcccaccaggccaccgccagcaggcgcgcgatatccgcctcctcgtaccgggtgcggatcaggcgggccgggttgccgccgacgatgccgtagtccgggacgtccgagaccaccacggaccgcgagctgatgatcgcgccgtgcccgatgcggacgcccggcatgatcacggcctcgtagccgatccagacgtcgttgccgatcacggtgtcaccccggttggggaggccggtcagcaggtcgaagtggtcggaccaggagccgcccagggtcgggaacgggaacgtggacggtccgtccatgcggtggttggagccgttcatgatgaaccgcacccccgtgccgaacgcgcagaacttcccgatcaccaggcgctccggcccgtagtggtagagcacgttgcgggtctcgaactccgtggcgtgctcggggtcgtcgtagtacgagtactccccggcctcgatcagcggcgaggtgaccaggggcttcagctgcaccacgcgcggctggccgggcatcgggtgcaggacggtggggtcggccggtacgggcgcgggggaagaagtcatggggtcgcttccgggaagggggcgggggcagacgtgcgtgg

SEQ ID NO: 2742 - DNA, 13036 bp, Unknown
  Kingdom: Bacteria, Phylum: Actinobacteria, Class: Actinobacteria, Order: Streptomycetales, Family: Streptomycetaceae, Genus: Streptomyces
ggcggtccgcccggccggcgggatgtcgaaaccccagcgctcgccccgtacgagcctggcgcggagcatgtcgtgccgggtgagcacggcggccaggatgtcgtcgagggcgtcggcggtcagtccggccggagtgttgaggacgaccgactgcacgaagccgtcgatcgcgtttgtggtctcgcccagccactgcacgatgggcgagccgacgacggtgccggtcccgacgtcaccgtggtcgacgacggcggcggactcaccgctcgccaccgccgccagcgccccgacgacggtgttggtgaagatctgtcgcgcgctcacgtggaggccgacctcgcgcagggtgctgaggagggagatcgccaggatgctgtctccgccgagctggaagaagtcctcgtccgcgccgacgctttccagccgcagcacccgtgcgaccgcctcgcagaccaggcgctcgttctcggtggcgggggccacccgggctccggcgcccacggagggctccggcagcgccttccggtcgatcttgccgttcgcggtgagggggaactccgtcagcacgacgaggtgcgtgggcaccatgtactcgaccatgttggccgcggcccacgccttgacgtcgtccgcgctcaggtcctggtggccgccggacgggatgacgtatccgaccaggtaggtcccgcccaccgtgttcttcttcgcgacgacacaggtgtgccgtacgcccgggtgctcggcgagggatgcctcgacgtcctcgatctccagccgcatgccgcggatcttgacctggttgtcggcgcggccgaggaagtccagcgacccgtccggggcgtaccgcgccagatcgcccgtccggtacagccgggaaccgtccgaggcgaacggattggccacgaaccgggaggcggtgagagccggcgcgcccacatatccgcgtcccaggaggagtcctccgacgtacagttcgccgccgacgccgaccggcacgggccgaagctcgtcgtcgagcacgtagagctgggtgttggggttggccctgccgatggaggtcgacaggcgtgtcgccgctccccggtagatgacgtgggagacaccgatggtcgtctcggcgggaccgtagccgtggtagagcgggatgtcgaggcggtcccggaaccgctcgtacagctccggggtgaggacctcgccgccgcaccacacgtgccgcaggctgtcgagccgtccggagtcgcccgcgatctccaggaggacgtccagcatggacgagaccaggtaggcgaaggtgacgcgctgctcggcgatgacgccgagcaggtggtgcgggtcgcgttcgccgccgggtcgcaggatcacgagacggccgccggtgaccaacggcaggaagatttcgttgacggagatgtcgaaggagagcggggccttgaagagcgacgcgtcgtcagggccgaagtgaaggatctcggcggactgccacaacaggcgttcgctgatcgcctcgtgtcggatcatggcgcccttgggccgtccggtggagccggacgtgaagatcacataggcgagcgaggcgccggggacgttcgcgtcgggcgcgtccacggggtgcgccccgtacttccagtctccgaggtcgacggcgacggcgtccggttctccggcgtccgccttgcccgtggagttgagttgcagcacgacccgggcgtcctcgacgacgacaacccggcgggtggcgggccactgggggtcgagggggacgaacgcgcctgtggcccggagcacggcgaggaggccgacgaccatctcggcggagcggccgagcgagatcccgacgacctgttccgggcccagacctcgttcgatcaggtggtgcgccaactgcgcggacagccggtccacttcgcggtacgtcagcgatcggtgctcgtcgacgatcgcgacggcgtccggcctcaggcgcgcctgctcgcggaacatctccatgacggtcgggcggacgcggtccgcccgggtgtcgttccaccgggccagttcctcggcacggggaccggacgggcctatggtgccgacgggccggtcggggaagtcggccaggtcgtcgagtgcctgctgggcgtggaccgggtcgaccccggccggcacggcgatggcgagacactcggcgtcgatcggccgaccgccgggcccgccggatccgtggtgaacccgttcgaggacgtcgggaaagggcgtggcgggtgtcagctccatgccgtccggggcggaaccggtcgcccagtacgcgaggccgacggcgcacgcttcgacgatggtccggtcgctgtagtcaccgatccgccggcgtacggcggccagccgggtcgaggaaagcgctatgcgagaagcactcggttcggacatcgaagtctcagcatcctttcgcggtatgcgaccgggtccggccatcggccggaccgctctcaactgccctctcgccacgcacgccacagccgggcgtactgaccgcccagctcgaccagttcgctgtgcgttccctcctccaccacgcgccccgcgtccagcacggcgatccggtccgccgccatcgcctgggtcagccggtgggccacgaacagcgtggtccggccggagcaggcggccagtacggcgcgttccaactcggccgcgccctcactgcccgcctccgcggtcgattcgtccagcacgaccacgggtgaccggctgagcaccagccgggccagggcgatctgggcgaccttggtgacgtccaggcgttcgccgccctcaccgaccgtggtgttcagaccctcggggaacaggtcgagccatcccccggcaccgaccgtgcgcagcgcgtccctcagttcgtcctcactcgcgccgggtgcggcgagccgcaggtcgtcggcgagcgtgccggagaacacatgggtctcctgggtcaggatgctcaccagggcccgcgccccggcctcgtccgtatccgcgaggtcgtgcgtcccgatgcgcacggaaccggcctgcggcctcccgatgccggcgatgagcgcggccagggtcgacttgccggcgcccgtcgctccgaccagggcgagcgaaccgccggccgggatggacagggacaccccccgcaggaccgggtcgtcggccccgggataggtgaacgtcaggtcccgcacggtgacggggtacggcgcgatgccggccgtggccacggagccgtcacccaccagccgcgcctcggagggctccgagaacacgccgacgagccgggtgaggctcgcgccggacttctgcgcctcgtcgaaggtgaacatgatggcgccgagcggggtgaacaggcggtggaacatcagcggtgcggccgacacctcgcccagggtggcggcatccgcctccagcagggcgtacccgacgaccaggatcaggacgaggccgatgaactcggcccggttctcccggccgacgaaccgcccgaagaagcggaacacctcgacgccgaggtcgcgcacccgccacgactcgctggtgaccttctcccgtacggagtcctccatgcggtacgcccggaccgtgtcgatgccgttcagtccactgatcagcgcctgcgcgcgatcggcctgggccacccgctgcgcgcggtagagcggcgccgagcggggcaggtaccagcggagcgccagcgcgtaggcgggcagggcaccggctcccgccagtccgagccgccagtcgagaccgaacatgccgatcgtcgcgatggccaccaggaccccggccgagaacacggtgggaatggccgtccggatgcccttggagagcaccgcgacatcgtcgccgacgcgggacagcacgtccccccgccccacctgctcgacacgcgcgctcggcatccccagaacggctcgcacggcttcctcgcggagccgtgcgagcagttcggcgccgagcttcccgatcaggtacgtggaggccgcggaggctgccgcgccgaggagcgccgcacccaccatcagcactccgacggtgagcagtatcgagcgtgactcgccctcggccacgccgtcgacgacccggccgaggagcagcaccgggagcacctgcagcgcggccccggccaccgtggtgagcacggtggaggcggtcagccatcgtgctcgcccacagtgctcggccacccagcgggtggcctcgcgcccggtggccgtgcgcagggtcgtgccgacggcgggggtttcggtggcagtcacccgcggaccggatctcgccgggggaaggaccgtcgcatcgtcatcgctacttgaccgacgcgacgagctcgtcgatcgcgtacggcagggagagcagggtgccctgcgacatcgccgcgccgaccgccgggccctcgctgtccagcaggtaggagaccttgccgttcttgaccgccgggaggttgttgaacagctcgaacttcttgagcgcgtccgtgtcggccttgtcgttgatgacgaagatccggtcgacgtcgatgaggtcgatgcgctcgggcgagagctcggcggagaatccgccgtcggcgatcttgtcgatctcggtctggtagccgaatccggtgccggtgatgagccggccccggacgtcggtggaggtgaacgcggagatcgagtccttgtaccaggacagggcgacggccttctgtccgccgaactcggggtgcgccttcttggccgcgttcagcttggtctggatgcccttgaccagttcggcgccctccttctccttgccgagcgccttggcgatgtgcaccgcgttgtcctgccacggggcgctgaagagctccttctcgcccttggtgcggcccacggtcggggcgatcctggagagcttctcgtaggccgccttgtcgacctcggagtagaccgcgatgatcaggtccggtcgcagggaggcgatcttctcgaagttgggacccgcgtcaccgttcttcatgacgacctcggggcgggtgtcgccccactggtccttcacccagggccactgcgtgttgatgtcgggcgtctgcccggccgggttcgggtactggtcgaccatgccgaccggcttgacgccgaacgccaggacggcctggtcgtcggtgtagccgacggtgacgaccctcttcggcgccttgctgacctcggtggatccgaaggcgtgctccacggtgacggggaacgcacccccggcagcggcgggggcgtcgtcgttcttcttctcgtccgccgcatcggtaccgcatcccgcgaggagaccgacgccgagcgtcgcggcggacacggccgcggccagccgctgccacggcttcacaagcgtcgttcgatggagagacatccggaatcccttgctttcgcgctgtccactgcgccccggtacgagggcagccagactgtaccccgaccaagtgaggtcagcctagcctaactggataactttcctctggtcaggatgagttggatctgccgggccgtcagaagccgtccggagcaggcccttctcacggtcaggaccggacgtgcgtgcgaccgatcggcacgatgagcggccggtcgcccaccgggtcgtcgatcaccttggcccgcagcccgaacgcctcgtggagcagttcggcggtgatcacgtcccgagggtgtccctgcgccaggacggctcccgcccgcatgacgacgaggttgtcgctgtagcgcgtcgccagattgaggtcgtgcaggaccatgacgaccgtgcggcccgactcgtggagatcgtcgaccaggtcgagtacgtcgatcgcgtgggccaggtccaggtaggtggtcggctcgtccagcaacagcaggtcggtgccctgagccagggtcatcgatatccacacgcgctggcgctggccgccggacagcgagtcgacgggccggtcggccaggtcggccactccggtcatggccagcgcgcgccgcaccacgtcggcgtcgtccgacgaccactgccgcagccagctctggtgcgggtggcgtccgcgggcgacgaggtcggcgacggtgagcccttccggcgccaccggcgcctgcggcagcagtccgagcttcttcgcgacgtccctggttcggagcctgccgatgtcctcgccgtccagcacgacggaaccgccggccggcttgagcagccggctcagggtacgcaacagggtggatttgccgcatccgttggggccgatgatcgtcgtgatcaccccaggcggaacggctacgtcgagctcctcgatgaccgtccggtcgccgtacccgacggtgatgcccctggctgccagccgtgggacgtcctcgacgcccgcttcggtccgggcggtgaactgagcggccacaagacccccttgttgaggttagcctaacttctaccatttaccggaggttcgcccgtaccaacagatagacgaggaacggtccgccgatcaccgcggtgaccaccccgaccggcaggccgttaggcagcgccgcgcgggcgatcaggtcggagccgatcagcagcaacgcgcccaccaggccggaggcgatcaacggtggggtcggcccgcgcaccagacgcatcgcgacctgcggcgccaccagggcgacgaacggcaccggacccgccgcgctcactcccaccgcggccagcaggacggcacagagcagcagcacggcccgtacccgcgcgaaccgtacgcccagcccggcggcgacgtcgtcgccgaggtgcatgggcttgaacgggaaggccaccgcggccacgacgaccagcaggacgagcgtgcaccagaacgccacccggacctcgtcccaggtccggttggccagcgagccgaccagccacacctgcgcgcgcgccacgtcccggatgtcggcggaggccagcagccaggtcgtgacggcctgcatcatcgcggtgaccgagatgccgatgaggatgagccggaagccgtcgaccccgcgccgccaggcgaggaagtacaccagcagccccgtgccgaggccacccaggagggccgccgaggacagcccgaccgaaccggcgaccgccgcggcggtgccgcccgtcgtcgtcaccaggaacaccgcgacggcgccggctccggtggtgatccccaggatgtccgggctggcgagcggattgcgcgccacggactgggtgatggccccggagaggcccagggcgatgcccacgatgagaccggccagcgcccggggcatccggaggtccatgaccacgaacgcgtcgacctgttcgcctcggccgaagagggtggcgacgacccgggagaggccgatgggaaagtcgccgacgctgatggagaggcagaagaccaggaaggccgccgccgcgagcaccagcgtgaccagtacgagccagggtcgccagacgaacgacatctgaccgagccgcacgcccggcggcatcgacgccttcacttcggtcccgctcatgggctcctggacttccctcatgtgttcgtgaacccgtctcatgcgctcctgaactttcctcgccacaccaggagcgcgaagaacggagctccgagaagggcgacgacgacgcccgactccagctctcccggacgcacgaccaggcggcccgcgatgtcgcagaccagcagaacgccggaaccgagcagacccgcgtacggcaccagccagcggtagtcggggccggtcagatagcgggccacgtgggccaccatcagcccgaggaaggcgatggggccacaggccgccgtggcggcccccgccagcagcgtgatggcgacgatgccgacgctccggctcaccgcgatgttcactcccaggccgcgcgccacgtcgtcgcccaggttgagcaggttgagtgcgggcagcgtgatcagcgccaggaccagcccgacggcgatgaaccccgtcaccggccagatgacgtcgaatccgacgccggcgacggaacccgcgttccagaaccgcagcgcgttcaacgatttctggtcggacagggccaccgccgtggtcatcgccgcgaggaacaccgtgactccctgcccggccagagcgagggtcagggggttgccggcacccctgccgatgctcgccaggccgaagacgacgaccccggcgattcccgcgcccacgaaggcgaaccagacgtactggaacgggttggtgaacccgaacagggcgatgaccgacaccacggcgaaggaggctccggcgttgacgcccagcagtcccgtgtcggcgatcgggttgcgcgtgtacccctggatcagcgcgccgcccacccccagggccaggcccgccacgatcgcgaggaccgtgcggggcacgcgcacggtctgcacgatgagccggatctcggtgagcttctggtcgggctcggggtccgcgaacaggccgtgccagacctcggcgggactcaacgcgcgtgccccgacggccaacgacaccgccgccgcgatcaccagggccgtcgtgaggacgcccagtcccacggcccgccgccgacggttcccgttcgtccccccgggcacggggcgctccacctcagtcgtgaacatgtcgaggaacgatatccctttgatcagaacggtcccgcagggcccgcccggcaggccgccgggcgggccgaacgccgaactcccggtgcgtcgaaggcactcgccgcgctagcgcggggtggcgccgccggcctcctccgccaccggccgggactcgtcggaggtggacttgacccggcggtcgagcagggagtccaggatctcgccgacccgtatcgcggtgttggagagcagcgacgtcgtgatgccgtgcgtgtgctccgtacccccctggaggtagatgccgcagcgcagaccggggtcggtcgcgatccggtagtcacgctccacccgtacgcgaccggcgccgtcacgcaggcagcgctcgccgacctcgccgaggaggccgagcggatcggcggggctgtacccggtggcgaacaccaccacgtcggcgtccagttccgactcctcgtcggtcaccagggatttcacggtcgcccggacgctgtcggggttctcctccactccggtgacccgggaaacgttgaggaagcgcagccgttcgatacccaggaccttctcccggtacatctggcggtagaggtcgtcgatcaggtcgatgtccaccacggagtagttggtgttgccgtggtaggccatcagacggctcttgacctcgtcgggggcggcgaagtaatcgtcgaccgcgtccgggtcgaagatccggttggcgaagctgctgtcgtcggcgggactgtagccgtaacgggagaagaccgcgcagacctcggcgtccgggaaacggcggtgcaggtaggcgacgttctcggcggcgctctggccggcgccgacgacgacgaaccgcgagggtgaggagctctccaggccgtcgaccttccgcagcaggtcggagttgtgccagacgcgttcgccgcgttccacgccttccggcatgagggggcgcagaccggttccgatgacgaggttgcgggcccggtggacagccagtccctctccggaccggacggtcacgtcgaggtactccaccgtcccgtcgtgcacgaacggtgtgacggcgacgacttcgtggccgtaggagaccaggtcgtcgaccttggccgcggcccactcgaagtagtcgtggaactccacccgcagcgggaagaggttcttgtgattgatgaagtcgatcagtcggcccttgctctgcaggtagcagaggaaggtgaattcgctggccgggttccggagcgtcaccaggtccttgaggaaggacacctgcatggtggcgtcgtcgatgagcatgccgcggtgccagccgaagctcggctgctgctcgaagaagtgggcggtgaccgaatcctgcctgccgactttgctgttgtgctcgctgagcgcgatcgccatggccacattcgacgggccgaagccgatgccgatgaggtcgtggaccagtggtgtgtcgccaggaagaacctgtgacatgtcactcccattcgtctgggaaagacgcctgtcaggcgtgagggttgatggcggaaggtgggcaggccgacggagccgccactgagacttaggtgagcctaagctgaccaacccgccttgtcgatagggcaaatgggggcggtacgcactgacgggtcgtcatatggcgggaagagcgggcagtgttgcctactcaggtgaggcttgctttacttgcccggcccatccctgccccgaggaggaacccatgcgggtcgtcatgttcggttaccagacctgggggcaccgcaccctgcaggccttgctcgactcggagcacacggtggtactcgtcgtgacgcaccccaggagcgagcacgcgtacgagaagatctggagcgattccgtggccgatctcgcccaggagcacggggtacccgtcctgatccgcgaacggccggacgacgaggagttgttcgagcgcctcaaggaggcggacgcggacatcatcgtggccaacaactggaggacctggataccgccgcgcatcttcggactcccccgccacggcacgctgaacgtccatgactcgctgctgccgaagtacgccggtttctcgccactgatctgggcgctgatcaacggtgagagcgaagtgggcgtcaccgcacacctgatggacgacgaactcgacgccggcgacatcgtccgccaggaggcgatcgccgtcggcccgacggacaccgccaccgacctcttccaccggaccgtcgacctcatcgccccggtcaccatcggcgcgctcgacctcatcgcctccggacagaccgagttcaccccgcaggaccggtcgaaggcgaccttcttccacaagcgggccgccgaggacatccgcatcgactggaactggcccgccgaggatctcgaacgcctgatccgcgcccagtccgccccctatcccagcgccttcaccttccaccggggcaagcggctggaggtcctctccgccgtcgtgtcccagaaccactacggcggtacgcccggccgggtgttctaccgggagggcgaaggcgtggtgatcgtcgccggggcggacgcccgcaccggccgcaaccacggcctggcgatcacgcgtgtacggaccgaggacggccgcgagctgcccgcgaccgagtacttcacctcgatgggcggctatctcaccggccgtccctgatccaggggaagcggaccgccgaccggctcccgctcagcggaccgggtcggcgcgcgacgccttcggggcatcgacgcggaccagccgataccccttgagctccgccttcttcttccgggccggcggcatggtccggcggcgcgcgttctgcgccgcgccgaacagcgcgccgagtcgggggttgccacgcctcaggcggtagaaggcgtcccgcttcacccccaccagagcgcccgccgagacgaacggcacgccgctcaggatggcgtccagcgccaccctgagcactgccgggttgccggcgacgtccggtaccacgtcatgcacatgagccagggacctggccgccgacagggcggcgtcgaagaccgggtcctcggcgcgccaggacgcgagcagccgcgtcgagactcccgcggcggacgcgcagccttcggggccgagacccatggccgccgcccggaccgcctcggcccgccgttgtgccttctcctccttcagggacatggccggtcgcagggcctccgcgagggcgcgctccgcgaccctcgcggcatccagcccggccaccaccgcctcggcccacgcgtccggtcgctcggccgccctgtcgcccaccggtcgatcgctcaagggaccgctcctctctcacgacatgagctgttcaaggggcaaccatatggggtgctatccgtggagagagtgtccgggacggcgggcgccctggacggaggggccaccggcctgtcaggcgccgcccgcctccggggcgaacggcccgtccagagccgcccattgcagcagcaggatggtcttgccgtcggcgatgcgcccgtcacgggtcatggcgagggcctcggcgaagggcagctccaggacttcgatgtcctcgccgtcctcctcgaggccgccgccgggccccgtcaggtcggccggggtgtagggagcggcgaagaagtgaagacgctcggtgacggaaccggggctcatataggccgcgaggacccgggtgagcggaccgagggtgatgccgagctcttccgcgctctcgcgccggacggcggcggccggatcgtccgcgtcgagcagccctgcggccgcttcgacgagcatgccgtcggggtggtcgttgacgtaggcggggtagcggaactgccgggtgagcaggacgacaccgcgcgcggtgtcgtagggcaggacgacggcgccgtcgccacggtcgtacgtctcgcgctgctggacctcccaacggccgtcgcggcggcggcggtcgaaggtggtgcgccgcaggacgtgccagccctgggaggtgagttcgacatcgcggatcacgacgtcgcgattgcggtccaggccgcgtccggcccggtcgaggccggtgcggccgcggtggtcggggatgtcgatgccgggtcggccggtcacacggccccctgcggaatgcggcgaggaatctcggtcggtcatgggcggctacactacaggcagaaacgtgcaagaacaggagagagtgtgcatgctggctgctgaacggcgcgaccacctgctcggccttctcgcccgcgagggcaagatcgtcgccaaggacgtcgccgccggactgggaatctccgaggacagcgtgcggcgcgatctgcgcgacctcgcctccgagggcctgtgccagcgggtctacggcggcgccctccccgcctcgcccgcggtggtcgactacgcggcacggcggaccgtcgccccggacggcaagcggaaggtcgcggcggtggccgccggcctggtgcggcagggcggttcggtgatcctcgacggcggcaccaccgccc

SEQ ID NO: 2743 - DNA, 14231 bp, Unknown
  Kingdom: Bacteria, Phylum: Actinobacteria, Class: Actinobacteria, Order: Streptomycetales, Family: Streptomycetaceae, Genus: Streptomyces
acgcgacgggaagagcgggcgcgacgggcagggcgggcggggtggaccagcaggaggctccggccgtccggggcggtcgggccgtccggaacgcaaggcgttcggggaccgggccgcctggttcctggtgctgcccgcgctcatcccgatcctgatcctcagcgtcggaccgctcctctacggcatcgcgctctccttcaccgacgcgcaatccggccgcacccgctccacccagtggatcggcaccctgaacttccaggacctgctgcacgacaccctgttctgggactcgttccggatcggtctgatctgggccgtgggcgtcaccgtcccacagttcctgctggcactcggcctcgccctgttgctcaaccagaacctgcggatgcgctggctggcccgggcgctggcgatcatcccctgggcgatgcccgaggtcgtcgtcggcatcatgtggcggctcgtctacaacccggacgccggcatcctcaacgagaccatccgcgacctcggactcggcgacggccgggactggctgaccggcctcgccaccgcactgcccgccgtgatcctcgtcggcgtctgggcgggcatgccacagaccaccgtggccctgctcgccggactccagaacaccccgcgcgaactccacgaggcggcggccctggacggagcgggcgcgtggcgtcgcttccgtacggtcacctggcccgccctgaaaccgatcgcgctcgcgatctccgcgctcaacctgatctggaacttcaactccttcgccctggtctacgtcctgaccagcggcggacccggcggccggacccggctgccgatgctcttcgcctacgaggaggccttccgttacgggcagttcggctacgccgcggcgatgggctgtgtgatggtcgcggtgatctccgtgctcctcgccttctacctcgtcggccggctcgggggaggcgaggaccgatgaagcgaggaccgctgccgggacgagggccggcgaggcgcgaatcgaccgggctgcgcaccggcaggcccgcgcgggccgctcagtacctggccctgctggcgtatctggtcttcctcgcgttcccgttcgtgtggctgatctcgaccgccttcaagcccgcccgcgaactgggctcgctgcaccccacctggatccccgagcagcccaccctggacaacttccggcaggccttcgacgagcagccgctgctccaggccgcggccaactccctgatcgccgccgtcggagctgccgtgatcgccgtcgtgatcgccaccccgatggcctatgtgatggcccgccacaggggccgcctcgccaccgccgcgaccggctgggtgatggtcagccaggcgttcccgttcgtcctggtgatcattccgctcttcctggtcctgaagaacctgcacctgatcaacaccctgtgggggctgatcatggtctacgtcgtctggtcgctgcccttcgcgctgtggatgctcgccggctacgtacgggccgtgccggccgagctggaggaggccgccgccgtcgacggtgcgggccgggtgcggacgctcgtctcggtcgtggccccgctgctcgcccccgggatcgtcgccaccgcgctgttcgcgttcatcaccgcatggaacgagttcttcttcgcgctcgtcctgctcaagaccccggagaagcagaccttgccggtcgtcctcacccacttcctcggcgcggagggcgtggccgacctcggcccgctcgccgcggccgccttcctcgccacgctcccctccctcgtcctcttcgccctcatccagcggcggatcaccggcggtatgacggccggggcggtgaagaactgatgcgtggcgcgatccggcgggcggcgaccgccgccgccgtactggccctgctgctcaccggctgctccggcgacggcgacgacgggcgggacgcggacggcacgatccgcctccggttccagtcgctggcctggcagaaggagtccgtcgacgccaacaggcacctggtgaaggagtggaacgcggcccaccccgacgtccaggtggactacgtccagggcagttgggacagcgtccacgaccaactgctcacctccttcgagggcggcgaggcgcccgacgtcatccacgacgcctccgacgacctggccgacttcgcgtacgggggttacctcgccgacctgcgccccttcctccccgaccggctcagggccgacatccccgaacagtcctggcgcaccaccacgttcggcgagggcgtgtacggggtgcccttcctccaggagccccgggtgctgatcgccaacacgaagctgctgaaggcctcgggcgcgcgcgtcccgaccccggagcacccctggagctgggaggagttccggcaggtcaccgacgagctgacgggcaaagggcgctacggggtcgcctggccgctgaaggagccggtctccgtcaccctcaacctgggcctgtccggcggcggacggctcttccaccgcgacgacgacggcaaggcggtcctgcgcttcgagccgggcgacggcgtggtgaccggcaccatccgcgaccaggtcaacaccgacggcagcgcggcccgcagcgcgctgggcatgggcgggtcggacgcgctgcccgggttcttcggcggcaagtacgcgatgctcccgctcggattctcctaccgccagcagatcatccagcaggcccccgaggggttcgactggacggttctgccgatgcccgcgggcgccggcggcggggtccagggcgtgagcccgcagacgctgtcggtcgccgaggagagcccgcacaagaaggaggccgtcgcgttcatcgacttcctgctgcgccctttgaacatggtgcgcctcgcccggggcgactggatgctgcccaccggcacggaggccctggccgacccgtcgctgcgtgggaccgagcacggctgggccgtcggcaccgcgctcgcgcgggggctgcggccgtcgcccgcccagtcggtgcgcggctaccccgagtggaaggacaaggtggcgacccccgcgctccaggagtactacagcggcgcgatcgacaccgacgagctgcgaaagcggctggtggacgacgggaaccgggtgctgtcccgctaccaacgctgatccggccgggcaaacaggttgcacgagacgtctcgtctcgcatacggtgagcggcatgacggaatccccgcgtgcccacatcgccatgttctccatcgccgcccacggacatgtgaacccgagcctcgacgtcatccgcgagctcgtcgaccgtggacaccgcgtcagctacgccatcccggcctccttcgccgagaaggtcgccgccaccggcgcccggccggtgatctacacctcgaccctgccgaccgacgacgaccccgaagcctggggcaccgagctgatcgacaacatcgaacccttcctcgacgacgcgctccaggcgctcccgcagctcgtcgaggccttcgcgggcgacgagcccgacctcgtcctgcacgacatcacctcctatcccgcccgggtcctcgcccaccgctggggcgtccccgccgtctccctctggcccaacctggtcccctgggaggggtacgaggaggagatcggtgaaccgatggccgccgagctgaagcagaccgagcgcggcaaggcgtactacgcgcgcttcgacggctggctcgccgagaacggcctcggccatgtcccgagcgacgacttcgtcgcccgcccgcgcctcggtctcgtcctgatccccgaggcgctccagccgaacgcggaccgcgtgaaccgcgagatgtacaccttcgtcggggcctgccagggtgaccgcgcggaccagggggagtgggtccgtccggccggggtggagaaggtgctgctggtgtcgctgggctcctcgttcaccaagcagcccgccttctaccgggagtgcgtcgaagccttcggcgggcggcccggctggcacgtggtgctccagatcggcgcgcacgtcgaccccgccgaactcggagacgtaccggacaatgtggaggtgcgcacctgggtgccgcaactggccgtcctcaagcaggccgacgccttcatcacccacgccggcgcgggcggcagtcaggaggggctcgccaccggcaccccgatggtcgccgtcccccaggccgtcgaccagttcggcaacgcggacaggctccagtcgctgggcgttgcccggcacctcccgatggaggaggccgacgccgcgagcctgcgcgaggccgtcctcgcgctggtggacgaccccgacgtggccgcccggtgcggtcggctgagcgagcagatggcgcgggagggcggcactccgagggccgccgacctcatcgaggccgaactgtcgcgctgagcggaatcgcctgactgttatccggacgttctccgtcccgccccgtatgccgcgcccagtggttttccgggacgggacgtccgtgtttcggctccgtgaagcctctgccacgacgggtccggtcagcgcatctgcacgcaccccctcgcgatttcacaccgggggccgggtgttcacccctctcgcgcacaccttcaccgatcttcacgggtcttcacgcgtggtcactcctgtcccacagaccccggtggcgacccggcgatcgccggaccggttgcgcccgacccttcaagtacggctctgagcaggcaatatgggagaactggtgctcccgtggggcagctcgcgaccggtcgatccggccgagccggacgcccgtcggccctccgtgctggtggtgaccggccatggccgatttcttattaagaaaccttgttgagcaagtcacacccgcatgaaggtcttgatctgtgctcgtcaatcggtcagggtttcgagccagcccccggagatcttccggccgagggccaatccccccacagagtttgacgaggagacccctcttcatggccaagcaccagcgcacccgtcgcatcaagctgaccgccgcgatcaccgccgtggcggccgccgccggagtcacccttctcggtacctcgtacgccggagccgcaccggctcccatgggcacggtctatggtgctgacgccgcgaccgcggtgtccggcagctacatcgtgatgctggacgagaagaaggccgacaagtccaagctcgccgaggagtacggcggcaagctcaagcgcaactactcctccagcatcaacggcttctccgcgagcggcctttcggagaccgaggccaagcgcctcgccgccgacccggccgtctccaaggtggtgcagaacaagaagttcagcatcgacgccacccaggacaacccgccgtcgtggggtctggaccggatcgaccagaccgagaccgcgggcgacagcgcctacacctacccggacgccggcggcgagggcgtcaccgcgtacgtcatcgacaccggtgtccgcgtcacccacgaggacttcgagggccgggccacctccggcttcgacgccgtcgacaacgacgacgacgccgacgacggcaacgggcacggcacccacgtggcgggcaccatagccggggccgcccacggcgtcgccaagaaggcgaacatcgtggccgtccgcgtcctggacgacaacggctcgggcaccaccgagcaggtcatcgccgggatcgactgggtcgccgagaacgccaccggcccgtccgtcgccaacatgagcctcggcggcggggccgacccggccctcgacgaggccgtccagaaggccatcgccgcaggcatcaccttcggcgtggccgccggcaacgagtccagcgacgccggccagggctcgccctcccgcgtccccgaggcgatcaccgtcgcctcgtccacggaggccgacgagcagtcggacttctccaactacggtccggtcgtggacatctacgccccgggctcggacatcacgtccacctggaacgacagcgactccggcaccaacaccatctccggtacgtccatggccaccccgcacgtcgtcggtgcggccgccgtctacctggcgggcaacccggacgcgaccccggaggccgtcgccacggcgctcaccgagggagccaccccggacgccatcagcaacgccaccgagggcacggccaacaagctcctcaaggtcgtcgagtagtaccccggttccggccggacgccgggcggcggtggtcacagacccccgccgcccggcccccgcgcacagcagccgccgcgctctcccccacggggcgcggcggctgcgccgtttcccgggcggacccgacgcggccgtcccccacgggagctacgcacgggtgtccaccggggggtgacgctttcgggccgggagctccataacgttctgatcagccgggacgtcacggtctgtcgccacagcacaggcccgggacccggccgcatccgcgaaacgttccctggaggctccttcgtgttccgcacccttctcaaggccctcgccgccatcgccgtcgtctgcacggcgggcggcatcggcctgatcggctacgaggagttcaccacgcgggagtcggacgggacacgctccgaatcctccctcggcgacccgttcaccggaaccaagaagattcggaccggcggccgttcggtccatgtctcctgctccggagacgcctcccacgacggtcccctcgtcctgctgatggccggcggcggagacggcctggagaccatggccccgctcggcaagaccttgagcaaggagttccgggtctgctcctacgaccgtcccggcgagggcgcgagcgacaagccggacgggccccagagcatcgacgacagtgcgaagctcctcacgtcggtgctcgaccggctggccggcgaccggccggtcgtgctggccggacactcgctgggcggccacatcgccgcccgctacgcacccgaccacccggaccggatcaagggcctcgtcctgctcgacgccaccatcccgacactgaccgccgacatctcccggacgatccccgcctccgccaccggcctgccggcgcagttgcgcgcccaggccatcgcgctcaacaagggcgagaatcccgagatgctggtcgtcgcggacggcgaggtccggcccgccggggagattcccgtggagatcctccagcacgagtcccagtacgcggaggtccccgactacgggcccgccctggagcgcatgtggtccacgggccagaagaagtggctgcggctctccggcaacagcaagctcagcaccgtacccggcagcggccactacatccacgtcgaccgcccggacctcgccaccggcgccatccagcgggtcgccggcggcgcggacgactaggctcgcccgatgaccgatacggggagaaggctcggggtgctggaacaggtccggcatcggtgggcctccgcacggtggcagcggttcgatgtcaccaactggtatgtggtactcgggccgttgctgctggccgcctcgttcgtaccggcctttcacgcccatggcacacaggtcggcggagtgccggaccggcccgacgatctgctcgccgtggtggccatcgccctccagtgcctcccgctgacggtgtgccgcagatggcccgcgaccgttctctccctggtgtcggcgggcttcgccgtcgaccaactgcgcggataccactccctggcgggcaccgccttcgccttcgctctcctcggcgtcggatcgcggctggagaagcaccgtcgcaccgccaccctggggctctccctcgcctatgtcccgctggccgtcgccctcgcgcggctcggctccggtgagcccgcgagcgagttcgtcgtgttctacctggcgtgcgccctggtgtggtggatcgggtcccggctccgttccgcgcggaacgcccaggcagagcgtcggcgccgggtggcggaggagacccgggacgcggagcgcacccgtatcgcccgggagctgcacgatgtggtgacccatcatgtgaccgcgatggtggtgcaggccgaggccgcccgctatctcaccgccgcgcccgaccggctggaagagtccctgacgtccgtcaccgccacgggacgcgcggccatcgccgatctgcggcagatgctcgatctcctcgaccccggccacgggccgggggacacgtccccgcactccggccggctccgcgacctcgtcgaacagacccgccgggcgggccagcccgtggagttcaccgagcagggcgccgccgcggagccggcccgcgacgcggaactcgtggcctaccgggtcgtgcgtgaggccctgacgaacgccctcaagtacgcccacggcgtcgacacctcggtccgggtgtgccatggcgagagggagatagccgtggagatcagcacccgggcgtccggcccccggggaagatcgcccggcggaagcggacggggcctggccggactgcgggaacgggtggtcgacaccctgggcggcgaattcaccgcgggccgcgagccgggcggccggttcgtcgtgcgggcctccatccccgtggcgggtacgcggtgaccgccccgacccggatcgtcgtctgcgacgaccaggcactgatccgcacgggactggtgacgatcatcaacgcccagcccgacatggaggtggtcggcgagtgcggcgacgggcaggccgccgtcgacctcgccgccaccgtgcggcccgacgtggtggtgatggacctgcgcatgcccggcctcgacggcatcggagccaccaggatcctggccggagccggtacggaccaccccgtcaaggtcctggtggtgaccacgttcaacctggacgagtacgtctacgaggcactgcgcgcgggagcgagcggattcctcctcaaggacgcgccgccggaccggttgctgcacggcatccggaccgtggcctcgggcgcggccctgctggaccccgaggtgacgcgcgagctggtgggcagattcgccgcccggatcaggcccgcccggcccgaagccgaccgggcgaccccgctgaccccccgtgagctggaggtcctccgcctgatcgccgacggtctgtccaacaccgagatcgccgcggccctggtgatcagccgggagaccgtcaagaccttcgtgtcccgcatcctcaccaaactcgccctgcgcgaccgtgtccaggccgtcgtctacgcctaccggaacggcctggtccactgaccggaggcggcccgcaccgggccccgttccgcgatggggctcgcgcgagggcctagggtgggtggccatgacgacgatgtacgcggcgctgctgcgggggatcaacgtgagcggcagcaagagggtcccgatgcccgaactgcgcaccgtgctcaccgaactgggacacaccggcatcgccacttatctgcagagcggcaacgccgtcttccggagcgacagcgacgacgaggacgcgttggccgccgccctggaacaggccctgcgccggcagttcggcttcgatgtcgactgcctcgtccgcgacgccggctatctcgccgccgtcgccgaagcctgccccttccccgccgcggagctggagggcaagcagctccacgtcacctacttcgaccggcccgtggacgcggaccgcttcgcggacctggaagcggaggacttcctgccggaggagttccggctcggcgaccgctgcctgtacctgtacgcccccgacgggctcggccgctccagactggcggtcgcgctgggacgcccccgtcacgtcaagggcctcaccgccaccagccgcaactggaacaccgtggcgaaactcgtggagatgacccgtggctgagccgtcgcccgccgtggccgcagcgatcgagggcgagctacgcctgctggatccggcggtacgggcctccgccgagctcctcgcctcgatgctgcaccccgagttccgggagatcggcaccagtggccggctctggacccgggaggagatcatcgcctcgctcaccgcggacgacgccccccgcccccgtccgctcacggcctcccggatgcggggggcgcagctcggcaccgatctggtgcacctcaccttcgacaccgagtccaggggaatccgctcgcaccgcagctccctgtggcggctgaccccggagggctggcggctctacttccaccaggggaccccgttcgacgacgatcccgtcggcgaccccttcgccgagacctgagccgcccggggagaccggactcgccgggcggccggcaccacaccccggaccccgaggagcggtcgcgggacagcccggtccgacggtcgcggtcctcaggccgacagcgaggcccgctcggtcatccgtgcctcgtcgtaacgggtgagcagcagccgggccaactccggagcggggcccagcacatcggcgagcacatcggccccggccgcctcggcgcccgccgcgatgcggtcggggagccggccgggcgcgatgacgtacggcgccaccgccacccggcgtacgccgtcggcgcgcagcgcccgtacggcttcctcggtgctggagatgccaccgggatgaacagcggaggcgaacgcaggccgcacggcgcaccaaccggtgtgccgcagctcccgcgcgatttcagcgatcactgcgatcgcctccgggtctgtggatcccgccgaggccaggacgagcccggtccgggggatgtcgccgggacggatcccggcctcccgcagccgccgccccagcgtggcgttcagcagcggggacgggccgagcacgtcggcctgccggatgcgcagccgcggcagccgggcgcgggcctcgcgcaggaccgaggggatatcggtcttggcgtggaacgcccgggtgagcagcagcggaagggcgacgacctcgtccgcccccgccgccgccaggcgctccagcacccggggcacggaaggggcgttgaactccaggtacgcggtctccacgcgcagccccggccgctcggcccggacccgctcggtgagcgcgtgcacggtcgcggcgtgccgcgggtcgcggctgccgtgggcgatgacgaggagcgtggggtgcgtcatgggagagctcagttcttgacgaggagtccgcggctgcgcagtacccaccgctccagcggactgaagatgagcaggtcgatcgcgatgccgacgaacaggatgagcaggatcgagagaaagatcccgggcatgtcgaagttgctgcggccgttctccagcaactgccctagccccagacccagttccggggaggaggcgatgatctcggcggccatcagtgagcgccaggagaacgcccagccctgcttgaggcccgccagatagccgggcagcgccgccgggagcacgatgtgccaggtcccgcgcagcccggtcgcacccagcgtgcggcccgcccggaggaacagcggcggcacctggtccacgccggagaccagcccgttggcgatcgagggcaccgcgcccagcaggatcaccgcgaacatcatctggtcgttcagcccgagccagatcaccgccggggccacccacgccaccgacggcagcgactggagcccggacaggatcggaccgatcgcggcccggatcagcttgacccgggcgaccagcagtcccagcggcgtaccgatggcgaccgcgagcaggaagccgagcagaccgcgcgagacgctggtccagacgacctccagcagcgtgcccgccagccacatctcccgcgcgctgtcccacacggcggacggcggcggcagcttgtagacctccgtgacctcggcgcggaccagcagctcccagatgaccaggacgagcgccaccgccacgaccggcggcagcaccttgcggagcaggacctcgcgcaccggggtgcggcggatctgcacggcgtccagggcgtcgagcccggcctccaggcccgccagatcgtcgggcttcgcgccgaccggtccggccgctccgtccggccgcttccggctcgacgtgatgtcagtgctggccatgtcggcggatctccccacgcagttcttcggtgatctcgacggacagctccgccacggcggtgtcctcgatacggcgcggctgctcgatgtcgaccgtccactcccgggcgatccggcccggccgggacgagagcagcacgacgcgctgcgcgagccgtacggcctcacgcacgttgtgcgtgacgaagaggaccgaggcgttcgtctcccgccagatccgggtcagctcgtcgtgcagcacatcgcgggtgatggcgtcgagcgccgcgaacggctcgtccatcagcaggagttgactgtcctgggcgagggcgcgggccatcgcgacgcgctgccgcataccaccggacagctcgtgcacccgcttgccgtacgccccgcccaggcggacgagttcgagcagccgctccgcctcggtgcggcgcgcggccttgggcaccccgcgcagccgcagggccagttcgatgttcttgcccgcggtcagccacgggaagagggcgtgctcctggaacatcagggccggccgcccgccgggggtctcgatggaccccgcggacgggcggtcgagtccggccaccagattgagcagcgtcgactttccgcacccggaggctcccaggagggtgacgaactcgcccggagcgacatcgagcgtgatgtcgtccaggacgagctgctgaccggtgggtccggcgaaggacttcgagacgtgcgcgagacgggcggcgtgctcgaccgtcgtacggtcctcggccttggtgagggtggtggtcgccatggtcgtcacctcctggggatccttacgtcctggtacggatgggcggggttacttgacgccgaggccggcgtcggcgacctcgggccggccctcggcctcgaggatcttgttcagcgggcccaggtcgtagatgccctggaggttcggctccttgagcagaccggacttcaccgagtacccggcctgcgtcttgagcgtctcggccagcgggtcgtcggtgatctcgatcgagtcccacgccgggtcgaggatctccttcggcagcggcttgccgctcaggttctccagcgccttgttggcggacgccttcgcctcgtcggggttggcgttgatccacttgttggtggcgaccgaacccttcagcaccgcctcgaccacgtccgggtgctcgtcgaggaacttctgcgacacgatgatgttcgtgatcacgaacttcttgtccggccacaggtccttctcgtcgaggagcaccttcgcgccctcggacaccagcttggacgcggtcggctcgggtacccaggcgccgtccaggtcaccggacttgtaggcgtcgggcgtcaccttgttgtccgagcggaccacggagacgtcgcccttgccgctctgggcgtcgaccttccagcccttctcggagatccagttgaggaaggccacgtcctgggtgttgccgagctggggtgtggcgatcttcttgcccttgaggtcgtccagggtcttgatcttgtccgggttgacgaccagcttcaccccgccggaggccgaaccggagatgatccgcagtcccttgccctgggacttgctgaagccgttgatggagggggacgggccgatgaagccgatgtcgatggacccggcgttcagcgcctcgatctcggagggacccgcgttgaaggtcgtggactcgacctgggtgccgcccagttccttctggatggtgccttcctggataccgaccagggcggtggcgtgcgtgaggttcgggaagtagccgatcttcacggtgtccgtggagagcttcttccctccggcggagacgttcgccttctcggcgtcgtcgtccttggcctcggagccgtagccgcaggcggtcgccgccagggcgagcagcggcagcgccgcgacggcggcgacggagcggcgaacggtggaacggggggcaggcacgggaggctttcctctcgttggcccggtacgcacgccccgctgtctggtcaggggggcgcggccgggaggtcggcaggtcttcggcggtacggacggtgcgggtggtgcgggagggcgcgcgagcagtgcgcgtacgtcatcacgcacatcgcccgaccccgccctgaccgctgccgagggcaccgctgcccactcggccgccctccttcgcgaaggtggagaagaagtcggtggccatcagaagtcccactcggcgtcctcgtc

SEQ ID NO: 2744 - DNA, 2404 bp, Unknown
  Kingdom: Bacteria, Phylum: Actinobacteria, Class: Actinobacteria, Order: Streptomycetales, Family: Streptomycetaceae, Genus: Streptomyces
gtcctgcccggcgcggactgcgccgggcaggaccccgaggcgatgggctgcggcggcgagttcgcccgtacggtggccggcgccgtggtcggcggcagcaagatcgaggtccgttacagcgaggtctgctccgcctcctgggcgcggctcaccgaggcggccatcggcgacaccgtgcggatcaccgccggcgagggagcgcagaacggcgaggtcatgggggacaccgacgcgtacaccccgatggtcgcggtgaagaaggcgtccgacgcgaaggcctgcgccacgctcacctccggcacgaaggggtgcaccgacccgggtgagtgacgacgccacggcacccccgccttgtggcgctctccgtcgcccccgccgctctccgtcgcccgtgcgtgcggtgcgtgcggtgcgtgaccggttgtgtgcggtgccacaggggggtgggcggcccggcccggccgggtccgatagcctgaccgctggatatctcttcacgtcaagattcgtcggggcgcggagggtgtccagcaccagggtccggcaccaggggccgggacccccaccgccagctgtctaaacggagaccgccatgacccgcactcccgtgaatgtcaccgtgaccggcgcagccggccagatcggctacgcgctgctcttccgcatcgcctccggccacctgctcggcccggacgtgccggtcaacctgcgcctcctggagatcccgcagggcctcaaggccgccgagggcaccgcgatggagctcgacgactgcgccttcccgctgctgcggggcatcgagatcaccgacgacccgaacgtcggcttcgccggtgcgaacgtcgccctgctcgtcggcgcccgcccgcgcaccaagggcatggagcgcggtgacctgctcgccgccaacggcggcatcttcaagccgcagggcaaggccatcaacgacaacgccgcggacgacatcaaggtcctcgtcgtcggcaacccggccaacaccaacgcgctcatcgcgcaggccgccgccccggacgtaccggcggagcgcttcaccgcgatgacccgtctggaccacaaccgcgcgatctcgcagctggccgccaagaccggtgccgccgtctccgacatcaagaagctgacgatctggggcaaccactcggccacccagtacccggacatcttccacgcggagatcgccggcaagaacgcggccgaggtcgtcaacgacgaggtgtggctggccgacaccttcatcccgaccgtcgccaagcgcggcgccgcgatcatcgaggcccgtggcgcgtcctcggccgcgtcggccgccaacgccgccatcgaccacgtgcacacctgggtcaacggcaccgccgagggcgactggacctcgatgggcatcccgtcggacggctcctacggcgtccccgagggcatcatctcctccttcccggtcaccacgaagaacggtgtctacgagatcgtccagggcctggacatcaacgagttctcccgtaagcgcatcgacgcgtcggtcaaggagctcaccgaggagcgcgacgcggtccgcgagctcggcctcatctgagacccgcacccgcgacacgtcgagcgcccccggcggcatcagccgccgggggcgcttccgcgttcccgaccggtgcgggcggtcagctcttgtggtcgccgggcgtgtagtggccgggggccaggcggccggtgacgccgaagcggttccaggcgttgatcacggtgatggccgcgatcaactgggccagctcggtctcctcgaagtgcttggcggcctccgcgtacacctcgtccgggacgaagccgtcggtcaggacggtgaccgcctcggtcagggcgagcgccgccagctccttcgcggtgtagaagtgctgcgactccttccaggcgctgagctggacgatccgctcgacggactcgcccgccgcgagcgcgtccttgctgtgcatgtccaggcagaacgcgcactggttgagctgcgaggcccggatcttcaccagctcgaccaggacggggtccaggcccttcctggcggcgatgtcgagccggaccatcgccttgtagacgtcggggagcaactgggagacggagatccggggagggtgctcgggggcgaggtcggccggggcgtgatggtgctcgtgcgtcgaggtcatgaggacgacgctacggccccggtggcaccccggtatggtccattggcatgacggattcctgggccactttcggcgcggacctgcatctggaaccggtcggccaggggctccgcagcgggctgatggaggcgctgcgggaggcggtgcgtaccggccgcctgacccccggcacccggctgccgtcctcccgggtcctcgccgccgacctgggcgtcgcccgcaac

SEQ ID NO: 2745 - DNA, 4312 bp, Unknown
  Kingdom: Bacteria, Phylum: Actinobacteria, Class: Actinobacteria, Order: Streptomycetales, Family: Streptomycetaceae, Genus: Streptomyces
gtccggggcagggtgaacgccccggcggcgaccaccgcgaggacggaggcggaggcggcggcccggcggcgcctgcggatccgggcggccttcgcgtacacggccccggcggagatcgcgggcttccccgctccctcgacggcgcggccgagcagttcacggacgtcgttcataccaattcctccgccatcccggcgcgcagcgccgccagaccccgagccgtgtggctcttgaccgtgttcgtccgcatcccgagcgcctcggccgtggcctccacgctcaggtcctcccagtagcggagcaccagcaccgcccgctgcctggccgtgagccgggcgagcgcctccctgacgaccaggccggtgtccgtgtcggtcgtgttcccgggacggtcgggcagttcgccgtaggcccgctcccgccgccagaaccgccggcggctcgcgatgaacgtgttgaccagcgtcttacgggcgtacgcctcgatgttgtcgagccgcccgtggcgccggccaccgaggacgaccttgaccagggtgctctggacgaggtcctcggcctcgtgccggtcgccgcagagcagataggcgctgcggaacagcgcggtgcgtctgccctccacgaagtcgtgcagcgccgcgtcgtcatcggcccgcattcgggcccctctccggaattcgcatgccccgccccctcctcttcccgctccccggcccgcggaggcgaaccgtctcccccttccagtgcgccggggcccggggcaggttgcgggcggcgacagaaaaaggggcggtacgggctccacgcccgtaccgcccctctcaccgctgtacggctgccgcccttggccggcggctacttcacggcgaggaccagggtgtccgagggggacgcccagaccgcgcgggcctcgccgaagccggaggccagcagggtgcgggcgtgccagtcggcggagggcatgtcgccgtccgcgtgctcgccgtagatcgcgaaccgctcggccgtgggcgcggccaggacggggtccttcgcggcgacggcccaccactcggcccagtccagagcgccggcggccttggcgcggtccatcgcggcgtgccggtgggcgcgtacggcggcgttgatgcggggcgtacccgtgtcgatcatgtggtcggcgttcatgaacaccccgccgtcccggacgaggccgccgagctgcccgtagagcgtggcgagcgggtcgctgtgcagccagtgcagggcggtggcggtgaggacggcgtcgtacgaggtgtggggcagccgggcggtccagtcggggtccttgaggtcggcggtgacgaaggcgacccggtcgtcgccgtcgaaggtgccgcgggcgatggccaggagcgcggggtcgaggtcgactccggtgctcgtggcgttcgggaaccgcttgaggagccggtccgtaatacttcccgtaccgcacgcgaggtcgagcacccgcggttccggtccgacgaccgcctcgaccatgtccagcatcacccggaaccgctcctcgcggtcgggcatgtaccactcctgctgccggtcccagctctcctgccaggactgccagtcggtgcccgtagccgtctccgtcacgccaacctccacgtaatgcccgtttacgacaatcgaccattacactggccgacaccccgactctagaccgacaccgtaaggactacaagtggaactggcctattactcggactacgccgtgcgcctggtcaacaccgaggagccggcccgcaacaaggacaccctcacctccgtcgaggcggtccgggagctgttcggagcgaatcagcaggcggcacggcggacgacggacgcggacgtgacccggttccgttccgtacgggcacggctgcgcgccgtgttcgacgcggcggacggcgacgacgagacactcgcggtcgacctgctgaactcgctgctgctggagttcccggtgagcccgcagatctcggggcacgacgtacgcgaccaggacggcaggccggactggcacatgcacctggccgaccacccgtcgaacgcgaccgccggctacgcggccatcgcggcgatgggcctggccttccacctcaccgagcacggcgtggaccgcctcggcctgtgcgaggcggcaccatgccgcaacgcctatctggacacctccaccaatcgctccaggcgctactgctcggaccgctgcgcgacccgcgcgaacgtggccgcctaccgggcccgcaagcgcgaggaggccgagcgcaccggccgcagcgccgagaccgcccagcccagcaccgccgtcaccgaccgctgacccttcgccaggggccggtagcggagccgcacccgggccagcaccagctcctccggcacggtcccgtagtcggtgctgtccccgcccgcgaaggtgttgtcaccccgcacccaccagccgccgggccgccgctcggtggcccgtttgaccaccagcaggtcctgctggaaggggtgccgcaggatcaccacgtcaccgaggctcacgggcgccccgtactgcacgagcagcaggtcgccgtggtagagcgtgggcaccatcgagggacccgtcacctccacgacccgcaacggacgccgcgtcacccgcccgcctccggacacctgtcgccgctccggcatctccggcacctcccggtccatcctccagcacatcgtcagtacatcgcccgcgcaccgctccgtacattcggccgacggcccgattctcacaccggacttttgacctaagcccctggggcagccacggaaagcggcgctccacggagtaatgtcccacctgagaagacgatcacgaggaggacagctccatgctttcccgcctgtttgcccccaaggtgaaggtcagcgcccactgcgacctgccctgcggcgtgtacgacccggcccaggcccgcatcgaggccgagtcggtcaaggccgtccaggagaagtaccaggccaacgaggacgcggacttccgcacccgcgccgtcctgatcaaggaacagcgcgccgagctcgcgaagcaccacgtctcggtgctctggagcgactacttcaagcccccgcacttcgagaagtacccggagctgcaccagctggtcaacgacaccctgaaggcgctctccgcggccaagggctcgaacgacccgaagacgggccagaaggctctggacctgatcgccgagatcgaccggatcttctgggagaccaagaaggcctgatcgcccgcacagggttcgacggccccggtccacgcgtttcgcgtgcggaccggggccgttcctcgtccggccaccggtcccggcccgaaccccatcggctttcgacgccacccctggccccggatccggcgatgcgctaacctcaaagcgagacgatacgtctcgtctatttggccgtctccgtctattcgaccgactccccagagctgcgaggtcccccatggaacgcttcgtcgaagtcgcccccggcgtacgcctttgggcggaggaccacggcgctcccgacgcccccgccctgctgctggtcatgggcgcgcaggcgtccgggctcgcctggcccgacgagctggtggagctgctcgccgcccggcatcgcgtgatccgttacgaccaccgggacaccggacggtccacctgggccttcgacgagcggccctacccgctcaccgcgctggccgaggacgccgtggccgtgctggacgcgttcggcgtggagcgcgcgcacgtcgtggggatgtcactgggcggcatgctcgcccagttgctgatcgccgaccaccccgagcggctgctgagcgccacggtgttcgggacgcgagcgctcagctccgtcccctacaccgcgccggacggggcccgcatcccggccgagcaacttcccggggtcgcgcccgccctgctggagatgtggtcccggccggtcgaggaccggggccccgaggccgagttggagcggcgcgtggagcactggcgggcgctcggcggcggcgtgatccccttcgacgccgaccacacccgtgcccgggagcgccggatcatcgagcacaccgggcaccacgacgccggctccgcgcacgcccgcgccgaccactccggtatggagcgcaccgagcagctcgcccggacccgcgtgcccaccctggtcgtctcggccctcgccgaacccgtcttccctcccccgcacgccgatcacctcgcccaggcgattcacggcgcgcggctcgtcgagatccccggcatgggccacgccctcccccgtgaggtccacgccccgctcgccg

SEQ ID NO: 2746 - DNA, 7506 bp, Unknown
  Kingdom: Bacteria, Phylum: Actinobacteria, Class: Actinobacteria, Order: Streptomycetales, Family: Streptomycetaceae, Genus: Streptomyces
gcgaggaggtcgacgcccagatcgccgcgtttcccgccgcgctcttcgtcgacccgctgaccggtcccatcacccgtaccgcgttgcagtcgctgcgtcaggcggccgtcgcggccgaggtcccggtgctggtcaccgccggtctggggcaggcgacccgggaagcggcgtacggcgccgacccggccgtcctgctcaaggcgctggctccgcgcgacagcgaacagcatccctcgcgggtgctcctgatcgaggagcacgaggagatcgcggtggcgctgacgcagaccctggagcgacgcgggatgcaggtggcgcgtgccgcgacggacagcgaggccgtcgacctggcgggccggatgcggccgaacctcgtggtgatggacctgatgcaggtacgccgccggcgcgccgggatcatcgactggctgcgggccaacgggcagctgaaccgcaccccgctggtcgtctacacctcggccgggatggaccacgcggcgctgccgctgctcgcctcgggcgaaaccgtcctcttcctggcggaacggtcgaccagcgacgaggtccagtcgcggatcgtcgacctgctggcgaagatcggcaccaactaggggcgtgcggagagcagaacagggcgggggcggtacgggtttcccgtaccgcccccgccccgccctgtttcacgtgaaaccgaagagcaaccggagcctcagagctggatggcgtcagagctgggttgggtcagagctgggttgggtcagagctgggtgacgtccagcttgccttccgcgtactgcttgcggatcaccttcttgtcgaacttgccgacgctcgtcttcggcacggcggcgatcaccgaccagcgctccggcagctgccacttggcgatgcccgactcggcgaggaacgccttcagcgcctcgtagtcggttccggcggcgccctccttgaggacgacggtcgccagcggccgctcgccccacttctcgtccggcacggcgacgacggccgcctccgcgacgtccgggtgggccatcagcgcgttctccagctcgacgctggagatccactcgccgcccgacttgatgacgtccttggcccggtcggtgagggtgaggtagccgtcggtgctgatcacgccgacatcgccggtcttcagccagccgtcctcgctgaacttgtcctcgggacgcaggtgctcgccgtcggccccgccgtagtaggcggaagcgatccaggggccccggacctccagttcaccggccgactcgccgtcccacgggaggtgttcgccgccggggccgaccagccgcgcctcgactccggcggggaagcggccctgggtgacccggtacggccactgctcgtcggcgctcaggccggcgggcgggtgggccatggtgccgagcggcgaggtctccgtcatgccccaggcgtggcagaggcggacgccgagcttgtcgtacgcctccatcagcgagggcggacaggccgcgccgccgatggtcacgttggccatggaggtgaggtcgcgagggttggcggtgacctcggcgagcaggccctgccagatggtgggaacggccgccgcgtgcgtcgggcgctcgctctcgatcatgtcggcgagcggtgcgggctgcaggaagcggtccggcatgagcatgttgacgccgctcatgaacgtggcgtgcggcagaccccaagcgttcacatggaactgcggcacgacgacgagcgtggtgtccttgtcggtcagccccatcgactcggtcatgttgacctgcatcgagtgcaggtagatcgaacggtgcgagtagacgacgcccttggggtcgcccgtggtcccggaggtgtagcacatggccgcggcctggcgctcgtccagttcgggccagtcgtacgtggtggggcggcccgcgatcagttcctcgtactcgtgcacgcgcggcgtgacgccggcgagggcggagcggtcaccggggccggacacgaccacgtgctcgatgctcggcaggtggggcagcagcggcacgaggagcggcagcagcgagccgttgacgatcaccaccttgtcgtccgcgtggttgacgatccaggcgagctgctcgggtggcagtcggaggttgagggtgtggagcaccgcgcccatggagggaatggcgaggtacgcctcgacgtggaccgagttgttccacatgagcgtcgcgaccctctggtcgccgtcgacgcccagctcgtcgcggagcgcgttggccagccgggtggcgcgcgcgccgatctcggcgaaggtgacgcggtgcggctcgggttcgccggtccaggtcgtgacctgcgacttcccatgaatcgtcatcccgtggtgcaggatgcgggtgacagtcagcggtacgtcctgcatggtgctcagcacggcgtcctcccggtaggcgctacgcggcagtaaggttccgctgattctgcgcacataccactcggtatgtcactactcgcgggaagattcctgccgggtgccctgctggggagccaggtccggggccccgtgggggagcgtgccgggtcgtccggatctcgtgccgcgcccgcccggactcagcggaccggcgtcagctccgggtcctcgcggagcttgcccagggcacgggagacggcgctcttgaccgtgccgatcgacacgccgagcacctccgccgtctgggcctcgctcaggtcctcgtaatagcgcaggacgaccatcgcgcgctggcggtccgggagcttgagcaccgcgcgccacatcgcgtcgtgcaacgactgctgctcggccgggtccggcgccggaaaggcctcccgctcgggcagttcctcgcaggcgaactcgtcgaccttgcgcttgcgccactgcgaggtgcgggtgttgagcagcgcccggcggacgtagccgtccagcgcccggtggtcctcgatccgctcccacgccacgtacgtcttggcgagcgcggtctgcagcaggtcctccgcgtcgcacgggttcgcggtgagcgagcgcgcggtacgcagcaggaccggcccacgggcccgtacgtacgaggagaacgacgcgtagggcgcgtgggggtggccggcggcggtggcagaggccgccctggaggcgcccgtgcagactggcgtggtcatgtatcccacgctaggagcgagctccgccgaggggatcgcccccaggtcccgaagcgtcgtccgcctcaggttgtagggggtgtgcaccctgcacctcctgaaggtggacggacctccgcgctgccgtaggggtccgcccccgagagcccccgggagccgggcgtcgccgctcagccgtccgcgccgatgaccaggcccgacgtcggcacccccgtaccggccgtgaccagcgacctcaccgcccccgccacctggttcaccgacgtcccccggatctgccggacggcctccgcgatgccgttcatcccgtggaggtacgcctcccccagctgacccccatgggtgttcaggggcagggcgtccgccgcgacgaacgccccggcctcgccgggaccgcagaaaccgaactcctccagctgcatcaggacgaacggggtgaagtggtcgtagaggatgcccacgtcgatgtcggccggggacagcccggagctgcgccagagctgccgggcgaccacggcggtctccggcaggcccgtcagcccgtcccggtagaagctcgtcatctgctcctgcgaccggcccgcaccctgcgccgccgcgacgacgacggcgggcggccggcgcaggtcccgggcgcgctccaggctcgtgacgacgagggcctgaccgccgtccgtctcctggcagcagtccagcagccgcaacggctccacgatccagcgggaggcggcgtggtcggcgagggtgatgggcttcccgtggaagtacgcggcagggttccgcgccgcgtgccgccggtcgaccaccgccacgtgcccgaagacctccgggtcgaggccgtacgcgtgcaggtagcgccgggccgccatcgccacccaggaggccggggtgagcagcccgtaggggaggttccagccgagcgccgcgccctcggcggtcggctcgcgccgcttgaccccggagccgaaacggcggcccgagcgttcgttgaaggcccggtagcagacgacgacgtccgcgacgccgctcgccaccgccagggcggcctgctgcacggtggcgcaggccgcgccgccgccgtagtggatccgggagaagaacgacagctcgccgatcccggccgcctgggcgacggtgatctcggggctggtgtccatggtgaaggtgacgagcccgtccacgtcggcgggggtgagacccgcgtcgtcgagggcggcgcggacggcctcgacggccagcttcagttcgctgcggccggagtccttggagaactcggtggcgccgatgccgacgatcgcggccttcccgccgagcgagtcggctctgcggatgctcacgctccggccctttcgccgctcggggccgggagggccacggtgaccgtgccggtgacgtggcggccgatgccgttgtcgccggtgacctggacggtcgcttcgacgggttccccggccggcgctccggcgggtcctccggttggttccccggccggcgctccggcggccagcccggtgatgcggccggtcagccgcaggacgtcgcccgggtagttggggacgcccaggcggatcgcgaccttgcggaggacggcggtcgggccgaagtggtcggtgatgtagcggccgacgagcccgttggtggtgaggatgttcatgaagatgtcgggcgagcccttctcccgcgccagatccgcgtcgtggtgcacgtcctggtagtcgcgcgaggcgatggccccggcgacgatcagggtccgggtcagggggatgtccagaggcggcagctcgtcgccgacgcggtacgcccgcgtcatgacgcctcctcctgccggaccgccgcgagcaacaggccgagctcctccaggacttcgccgccgcagccgagatacgcgtcgagctgacgaccccagaggaagtgccggtgcaccgggtggtcgaggtcggccccggtaccgccgtgcaggtgctggcccgcgtggacgacccgcttgcccgcctccgaggcccaccaggcggcggtcagcgcctgcgccgcgtactccctctgatcgtcgtgccgccaggccgcctcgtacgcggtgacccggatcgcctcggtgtccatgtgggcgtcggcggcgcggagcaggacgccctggttggtggagagcgggcgcccgaactgctcgcgggtgacggtgtgctggaccgcgcgcgcgagcgagcccgcgcacactccggcctgaagccccgcgaacgcggtgcgggcggcggcgaggacggccgcgtacgcctccggccctccccccagacgctccccgcgtgcaccgtcgagaaccagccgtcccgccgcccagggcgcggtcgtctccaccggggtcacctccacacccggcgcgcccgcctccacgatccacagggcccggtcggcgtccgcgaccaggaccagggtggcgtcgcgcagccacggcacccagagcacggccccgtacagcgcgccgtccgaggtgtgtacgccgccccgcgccgggaacgcgcccgtcgccaccgccgtaccgtcgcgcagaccgggcagcaggcgttcgcgctgctcggccgtgccgtgctcggcgaccgcgagcagcccgtacacacaggtggccgcgaacggcacctgggcggtggtccggccctgttcctccaggagcaggacgaggccgagcagcccgatgtcctcgaccgcgccgggcagtcccgccgcgcacagctccttccacagctccgcgtccgtacccgtcccggccgccgccagccgatcgtgcgtggccaggtcgccgaagacgctcgcggccagtccctgcgcggcggactgctcctcgctgggggtgaagtccatctcaaccgccttcgctcgcccggaagaccggaagttccaggtcggggtccgtacggaggaactccaggtgtacgggcatgccgacgcggaccttgtcgtacggcacaccgatcacgttgctgacgatgcggacgccttcggccagctcgatcagcgcgacggcgtacggtccgccctcgccggacgggtcgaaggcggggaacggcgggtgatgcatcacgacatggctgaagaccgtgccctccccgcccgcctcgaccgtgtcccactccgcgccgccgcaggcgttgcagccgggcagccaggggaggcgcagggtcgcgcagtcggtgcagcgctggacgaggagccggtgctcggcgactccggcccagaatccggcgttgtcgcgattgatcacgggccgggggcgcagagcaggcccgacgggctgtctccgttgggcggggcggtacttgaggatgcggaatcggtgcgttccggcgggttcgccgtcggcgcggacgtccgtgcgggtggtgatgaagtagccggtgccgagcttggtcgccttgcgccgggagacggactcgatgaccgtgtcgaaggtgatccggtcgccgggacgcagcggccgcaggtactcctgctcgcagtcggtcgcgacgacggaggtgtagccgccgccgtcgagcagggcgaacatctcgtcgtacgccgcggagcgccctgttccgcccgtgtgccctgagagcccgcccatcgtccacgcctggagcatcgtgggcggcgcgacggggtccggaccccggtaggcggccgaggtgtcgcccatcgcctcgcaccagtgccggatcatgggctcgttgaccgggtccttgcccctgccctcggtggcggcggcgcggccttcgtagtcggctagctgctcgtacagctgatcccgggcctcgtggtcctgaacatcgggttcccggacctcgtgctcacggacgtcatcctcatcctcccgctcgctcatcgcttgctccgggtcatcccgagccgggccgtcgcgacgatctcgcgctgcacctcgccgacgccgccaccgaaggtgttgatctgcgccgcgcggttcatccgctccagctcaccgccgggcccgaagcagccgggagaaccaccccggagcagcgcggcgtcaccgacggcctcctggcacatccggtagacctcgacggcgctctcggtgcccgcgaacttcaccccgctggcctctccgggggagggcgctccggcgccgacggcgtcgaccagccgccagttcagcaggcgcgtcgccgcgagccgggcgtacgcctccgcgagccgggcgcgcacccacggctcgtcgatccggcggcgcccggtcacgggatcgggggtacggacgtgggcgagtgcctcctcgtagaagtcctcggcctgcatgccgatcgcggccagggcgacgcgttcgtggttgagctggctggtgatcagccgccagccctggttctccgc

SEQ ID NO: 2747 - DNA, 2392 bp, Unknown
  Kingdom: Bacteria, Phylum: Actinobacteria, Class: Actinobacteria, Order: Streptomycetales, Family: Streptomycetaceae, Genus: Streptomyces
agtggttggcggtggccacgatcgcggcgatcgtgaagagcgggtgcagcaggccgagcgccttcatccacagcttcggcgccagcatcacgatcaccacaccgcaccacagtgaccagccgaagtgcagcgacggcatcgccgcgtactgattggtgacggtggtcagcgtcccgtagtcgggcttcgcgaagtcctgcaccccgtggacggtgtcgatgaagccgaggccgggcatgagccggggcggggccagggggtagagccagaagccgacgagcgcgagcagggtggcgaagccgatggacgagcggacccagcggtagtcggcggggcggcgcgcgtacagcaccccgaggatcgtcagcgggacgatgaagtggaacgtggagtagtagtagtcgaagaactcacgcagccaggtgatctgcacgaccgtgtggttgacccagtgctcgatgtcgatgtgcagccactgctcgatggcgtggatctgccggccgtgctcctcggcgagcgggcggcccgccctggcggcgagacggacctgggcgtaggcgtcgtagacgacccggatgagcaggagttccagcagcaggttgggacgggtgaggacccggcgccagaacggcaggagcggcacgcgtctccagcgcgccgcgaccggtttcgcgtagtcggtggggaccgggtgctgccagtacggcgaggtgcggggcacgaacggcgcgaggcaggccgcgccgagcgccacgaggagcagcacgttgtcgcggaccgggaagagcgtctcgatgttcggcagcagcatcgttcccggcagggtcacgaccagcagcaccacggacggccagaccagccggtcggaggcccgcttgccgaccttgccgacgaccgcgaggagcacccagagcagctggtgctgccaggcggtcggcgagacggcgaccacgacacagccggtcacggccaccgagaggagcagttgcccgtcctgcgcgtaccgcaccgcacgccgcaggccgaggaccacgacggcggcggagagcaccaggaacagggcgatctccacggggccttcgaggccgagcctgagcagcgccccgtgcagggactggttggcgaggctgtccggccgctcccccaggccggcgcccgcgaggtggtgcacccagtacgtccacgagtcccgcggcgacgcggcccaggcggcggccgtggcgagggcgaaggtcacgcccgcgctcagcgacgcctgccgtctcccggtcagccagagcagggcggcgaagagcagcagcaccggctggaaggcggcggcgagtccgacaagaacacccgccgcccggtgctcgcggacgacgaaccaggccaggagcaccagcaggacgggcaggacgctggtctggcccaggtgcagggcattgcggaccggcagcgacagcatcagcaggctgatcgcgacgggggccgcgaagagggccgtccggcgacccaccggcgagggcagggcccgggccgcgacgaggccgagggcgacgacgagcagcagggacccgaacgtccacgcgacgcccagcgcctcctgggccgaagcggtgagaggtttcaggaccagcccggcgaagggcgtgccggtgaaccggccgctgtcgtagagcgagcccgccacgtgcaggacaccgctctccccgagccaggtctccagatcgaggagccgctcccccgggggctgccggagcaccaccgccacctgccgtaccgccagcacggccacgaccagccagagcagggaccgggtcagcccggtccccgctcccgtgtccgccgccgcgtcaccgcgcacactgtgatccgcattcaccacgctgcgccgaccctcccaccgttccatgcatcgccccttcgagtggggccatgccggatgaagcctcgcattgccctacgaggtagacacaatcaaccccctctttgcctgactgtcatcatgcttcggtccggaagtagtcgtccgccgggatgacgaaggccctgacccccgcctcaggaacccgccgggcctgaggaaaccctggctgaggagccgcggggctcacgctttcgggtcggcaggggcctccgcctgccatgcggtgaacaacggggtgtccccggtcccggacagcacgatgacgccgaagggacggtcgaaggcgatgtggtgcacccgctgcggccggggggcggcgcccgcccgcatcgcgaccaccgtcacggccgcggcctccacgccctcctcggcgatcttcagcacggcttcctgcaccacctcggagacggcgaggcgttcgggtgagagaccggagaagtccgcggcgtccgtcagggccagccggacgccgcggacttctcc

SEQ ID NO: 2748 - DNA, 720 bp, Unknown
  Kingdom: Bacteria, Phylum: Actinobacteria, Class: Actinobacteria, Order: Streptomycetales, Family: Streptomycetaceae, Genus: Streptomyces
tcggtctcgccggggaagccgacgatgaagttggagcgggcaccggcctggggggccttgctccggatggtgtccaggagctccaggaagcggtcggtgtcgccgaagcggcgcatcgcgcgcagcaccccgggggcggagtgctggaaggagaggtcgaagtacggagcgaccttcggcgtcgaggtgaggacgtcgatgaggccagggcgcatctcggcgggctggaggtagctgacccggatccgctcgatgccctccacgtcggccagctcgggcagcagggtctccagaaggcggatgtcgccgaggtccttgccgtaggaggtgttgttctcggagacgagcatgacctccttgacaccctgttcggccagccagcgggtctcctggagcacgtccgaggggcgccgcgagatgaacgagccgcggaaggaggggatggcgcagaaggagcaccggcggtcgcagccggaggcgagcttcaccgaggcgacgggactggtgccgagcctgcggcgcagcggcgccctcggcccggagaccggcgcaaccccgtcggggaggtcctcgggcgcgggggcgggcgtctcctgggcgtggccgggcagcgccacggcggcgtcctgccgctcggcggggctgatcggcagcagcttgcggcggtcccgcggggtgtgcgaggcgtggatgccgccgttgaggatggtctggatccgg

SEQ ID NO: 2749 - DNA, 5672 bp, Unknown
  Kingdom: Bacteria, Phylum: Actinobacteria, Class: Actinobacteria, Order: Streptomycetales, Family: Streptomycetaceae, Genus: Streptomyces
gaagcggcccaggaggcgtgcggccgcttccgcgcgctcgccgcacagcggccggacgtcttccgcccggagctggccacagcgctcgacggcctggcccgtcacctcgacaaggccggtgacgcgggggcggggctccgggcggcggaggaagccgtcgtcctgtgccgcgcatcggccgcgcagcgccccgaggccttccgccccggcctcgccgccgcgctgcgcaccctcgcccggagcctggccgccgccggcgacccgcaggaggccctgccaccggcgcgggaggccgtcggcctcctgcgcgaggagggggacccggtcctggccgatctggccgacgccctccaggcactcggcacgtacggggagcagaacggggacgccgagggagcggtggaggccttccgggaagcggtggtcctccaccggtccttggcgctggaggccccaggcgctcccgacgcccctctggtctccgccctggacgacctggcacgggtgctcgcccgtaccggcgagcacgcggcggcggtcggggagttcgaccggaccgtcgaggagttcgcccgggtggccccggcgatcgcccggcggctgggcgtggagcggagcgctttcctgctccgctgcccggccaccctgcccgcgaccggggtggccgagctggtgaactggctcgacgaggacgcggagcgggccgggagcccggacaccgtgaccgtccgggcccggcaggcgctgcgcgcgtacggtgacagggcggcggtgcacacggcctgggaggaggagaccttcacgtccgtgccggactggctcgccctggcgccggagacgctggagctcgtcagcgcctggatgttcgcgcccgactggccccggtcacgcgacttctggtcccgcaacgccgatgtcctcggcagcgagggtgcggcgacggccctcgatgagctggcggtcctggacccgcgcggtgcgcagcggcacgccctgctccgtgaggccgtcctcgcccacggggtgaccgccgcctacgatccgctgatcctgcgggagcagttggcccagtggctggagtgcgtggactggaaggagtcgcgggcctgtctggaggagcacccgcgtctcctgaccgtgcggccgcccgacgccaccccgccggcccacgtcgcgatgctggacatcggccgcaccgagggcctggacgccgcgtaccgcctcgtcgaggaccgggaggccctccaggcgtacgtggaccgggcgttggcggacggggacggcacggcgctgatgcacggcgggggcatcgagggccaggtcttcggcgaccggctctcctcgctcacccacgcgcaggtggccctggtgctcgcgggggccaccgagggcttcgaaccggacgacctgaccgcactccggcacaaggcccccgaggagacccgtgcccggctggtgcgggaaacggtcgccctgagcgtccgccgtcccgacccgcacggggagccatggctgcggatcatccgggcgctcggcggggacggctgataccggcgcaggagaaccggaaggggcctgtcccacgcggctgcgtgggacaggccccttcggcttccgggtcaggcctgcgcgggttcggcctcgcgggcctcctccggctccggccggtccggaacgcccgcctgcgcggcgcgcttggccgccttcttcttggcgcggcgctccttgcggagctcgaccatcgcgtacagcgtcggcaccagcagcagggtcagcagcgtggagctgatcagaccgccgatcaccacgacgcccagcggctgcgagatgaagccgccctcgccggtgacgccgagcgccatcgggagcagggcgaagatggtcgcgagcgccgtcatcaggatcgggcggaagcggtggcggccgccctcgatgacggcttccacgatcccgaggccctgggcgcggtactggttgatcaggtcgatcagcacgatcgcgttggtgaccacgatgccgatgagcatcagcatgccgatcatcgcgggaacgcccagcggggtacccgtgacgagcaggagggccagggcgccggtcgccgcgaacgggacggagaccagcaggatgagcggctggacgagcgaccggaacgtggccaccagcagcatgaagacgatcgcgatggccgcgagcatggcgaggccgagctgcgcgaaggcttcgttctggtccgcggtgacgccgccgatggtggcggtggcgccctccgggaggtccagggcgtcgatcttcgtggcgagatcggtgctgaccgcgccggtgttgtcgccgacgggcttggcggtgatcgtcgccgatcgctgtccgtcgatccgggtcatcgagaccgggccggggaccaccttcacgtcggcgatgtcgccgagcgcgaccgggccgagcggcagtgccttcagctcggccacggtggcggccggggtggacgagcggatgacgatgtcgcgctcggtgtcgtccagcgtcgccgtgccggccggcgtgccgcgtacggcaccggcgacgatcccgcccagggcggcggagtcgaatccggcggcggccgccttgtcgttggcggtgaccgagatgcgcgggacgctctgcgccaggtcgctctggacgtcggtgacgtccttgatggtggcgacctcggtgcggaccgcctcggccgccttcttcaggatgtcgccgtcggcggccttgaccacgacgctcaggtcctgggagccgaagccgtcgcccgcggcgatggtggtgtcgccgatgccgtcgagcttgccgagggcctcggcgatgcggtcctgggcgtcctcgtagtccgcggcgtccttcagggtgacctggtaggaggcctggttggcacccgtgccgccgccgaaggcggccatgaagccggaggaaccgacggtgacctggtagtccttgacgcccttgtcctgctcgatgaccttctcgaccttgcgggccgcctcgtcggcggcttccaggctggtgccgggggtgagctcctgcttgacggtcaggacctcctgctcgccggcgtcgaagaagttcgtcttcagcagcgggaccatcccgaaggtgccgaggagcacggcgacggcgatgacgaggctggtgacccggcggcgggtcgcgaagcgcaggaccgggacgtagatccgctggagcttgctggccgcctccttctcctccgcgagacggcgggcctccgccgcgtcctcgggggtgcccttgggcgcgcgcaggaaccagtacgacagcaccggcaccacggtgagcgagaccagcagggaggccagcagcgccgcggtgacggtcagcgagaacgagccgaagagctggccgaccataccgccgaccaggccgatgggcaggaagacggcgacggtggtgagggtggcggaggtgaccgctccggcgacctccttgaccgcggtgacgatcgccgcgtggcgctcctcgccgtagccgaggtgacgcttgatgttctccaggaccacgatcgagtcgtcgacgacccggccgatggcgatggtgagcgcgcccagggtgagcatgttgagcgacaggtcgcgggtccagagcacgatcagcgcgaggacgatcgagagcgggatggagaccgcggtgaccagcgtcgaacggatcgaggcgaggaagaccaggatcacgacgaccgcgaagaccaggccgagcgcgccctccgtggtcaggcccgagatcgacttggagacggcggggccctggtcggagacgaccgtcacctccgcgtccgcgccgaggtccttgcggaggtcggggagcttgtccttgacggcgtccgagatggtgacggcgctgccgtccttgtccatcgtcgccatcacggcgaggctcggcctgccgttggtgcgggtgatggagaccgccgcggacggctcctgcttcacctcggcgatgtcgccgaggcgcaccggctttccgggtgcaccgcccgccgggtccttggcgacgacctggaggtcctcgatctgcttcagcgaggtgtaggcgccgccgacctggatggtgcggctcttgccggactcggagaaggaaccggcgggcacggtggcgccgcccgcctggagggcctgggcgagcgtgcccgcgttcagaccggcctcggcgagcttcctgtcgtcggggacgacggagacctggaggtcccgcacgccgtccaccgtgacctggccgacgccatcgatgtcctggagggccgggacgacggtgcggtcgagctggtcggccagcacctgctggtccttgtccgaggtgacggcgaggaccacggtcgggatgtcgtccgtggaaccggccacgacctgcgggtcgacgccgtcgggcagctgggcgcgggcccggttcaccgcctgctggatgtcggcgacgagctgcttggtgccctcgtctccgaagtcgaaggtcgccatgatgagggcgttgccctcactggcggtggaggtgatgccctcgacgccgtcgacggccttgagggagttctccagcggctcgacgacctgcttctcgaccacatcgggagacgcaccctggtagggcgccagcaccgagaccatcggcagttcgatggtgggcatcagctgctgtttgagctgcgggatcgctatcgcgccgaagaccagcgcgacgatcgagatcagcccgatcagggccctttgcgcgaggctgaatctggacagccaggacatgggtgggtctctcttctgtggcgtacgcggcagagggcggggagggggaaaacgtcagggacctgcacctccagcccagtcctacgatctccgctccgcgccgccgaaacgtcgccccccgggctgctttcttatgccgcgcataccgcaggtggagtacgccgcagtacgccggaacgccacccggtcagtccgcccggggacgcaccaggcccgattcgtaggcgattaccaccaattgagcccggtcccgggctcccagcttggccatcgcccggttcacatgggtcttgacggtgagcgggctgaccgcgagccgctcggcgatctggtcgttggagtggccgcccgcgaccagcaccagcacctcgcgttcgcggccggtgagcgccgccagccgctccgcgtactccgtgctgtccggcccttcccccgagctgccgccctgggccaggaacgtggcgatgagtcccttggtcgccgccggggagagcagcgcctcgccggccgcggcgatccggatggcgttgaggagttcgtccggctccgcgcccttgccgaggaacccggaggctccggcgcgcagcgactggaccacgtactcgtcgacctcgaaggtggtgagcatgaccacccgcaccgcggacagctccgggtcggcgctgatcatgcgggtggcggcgagtccgtcggtgcccggcatccggatgtccatgagcaccacgtccgcacccgtggcgcgggccagctcgacggcctgggccccgtcggcggcctcgccgaccacttccatgtcgggctcggagtccaccagcacccggaacgcgctgcgcagcagcgcctggtcgtcggcgagcagcaccttgatcgacgccccgggcgccgatcaaggtgctgctcgcc

SEQ ID NO: 2750 - DNA, 5321 bp, Unknown
  Kingdom: Bacteria, Phylum: Actinobacteria, Class: Actinobacteria, Order: Streptomycetales, Family: Streptomycetaceae, Genus: Streptomyces
gagcacggcaccgccgcccgggccggtgccggggtcacgttcggggcgcccgctccgtccggcaccccgctcacctccaccgcctcgctcgacggatcggggcacggtttcctgaccccgggcgccccggtcgtcgccgacaccgcgaaggacttcgccgtgggcggctgggtgcgcccggcgcgtgtggacggcactcgtacggtcctctcgcaggacgccggcacggcacgcgccttcaccctggggctgatcccggcgggctccgggcccgcctggtcgttctccgtcggcggtgcgcgggtcacgggcgggctgcccgaggccggcgactgggcgtacgtgctcggccagtacgacgcggagaccggcacggtccggctgtacgtgaacggccgcgaggtcggcgaggagacggccgccgtccccgtggcgggcgagggcgacttccagatcgggcgggcccgcggagcgcagggctaccgggaccgctggcagggcgagatcggtgacgtacgggcgttcgaccgcatcgtggtgccgggtgagctgacggccctcgccacccgtaccgcgctccgggtcggccactgggcgctggacagcgccccggacggcctctccccggagacgggcgggggcacccccctgaagctgggtgccggcgcctcggtcttccgcctcgacgacgacccctgcgacatcttcgacccggactgcgtccaggactggccgctggagggtgacggacacctcggcctcgacggcgtctcgggccacgcggccaccgacgcgcccgtcgtggacacggccggcagctacacggtcagcgcccgcgtccggctcaccgacgacgctccggccgggccgatgacggcgatctcccagggcggcgagcacggcgacgccttcaaggtgcgcttcgccccggagacctccagctgggacctggtgctggcgcacgccgacgagccgggggctccggagacggtgctcagccggatcgagcagccggacggcggcttcggggtcgggcaccgggtgaccgtcgtccatgacgcctcggcgaacgaggtgtccttctacctcgacggggtgaaatacgcggagggcggcacggccgcgttcgacgcgccctggaggagcaccggcgggctccagctcggccgggcccgtaccgccgaaggctggggggagcagctgaagggcgtggtggacagcgtgtacgcctacgagggcgtgctctccgagacggagatccggcagctgccgtaaccggaggtgtcccggctcgcgcgttccgtacggagggtgtgggctgggacacaaacgggagtgctcccggggtgtgcgggcagcagccccgtacgagcagttcggagcgacacgccgtaccgggtggtgagcgggacatctcaccatctggtaaggacgggtctattccggactgctcgttaaactgagccgaccgcagtaatgactgagcgaggagcgcacgtgggccttgtcgtgcagaagtacggaggctcctccgtagccgatgccgagggcatcaagcgggtcgccaagcgagtcgtcgacgccaagaggaacggcaaccaagtggttgtcgtggtgtccgcgatgggcgacacgacggacgagttgatagacctcgccgagcaggtgtctccgatgcctaccggccgtgaattcgacatgctgctgaccgccggtgagcggatctccatggccctgctggctatggcgatcaaaaacctgggccacgaggcccagtcgttcacgggcagccaggccggtgtcatcaccgactcggtccacaacaaagcgcgcatcatcgacgtcacgccgggccgcatccggacctcgatcgacgagggcaacatcgccatcgtcgccgggttccagggcgtgagccaggagggcaagaacatcacgaccctcggccgcggcgggtcggacacgaccgccgtcgcgctggccgccgcgctggacgccgaggtctgtgagatctacacggacgtcgacggcgtcttcaccgcggacccccgggtcgtgaagaaggcgaagaagatcgactggatctccttcgaggacatgctggagctggccgcgtccggctccaaggtgctgctgcaccgctgcgtcgagtacgcacgccgttacaacatcccgatccacgtccgctcgtccttctccggactgcgcggcacctgggtcagcaacgagccgcaaggggaccagcaggtggagcacgcgatcatctccggagtcgcccatgacgtctcggaggccaaggtcaccgtcgtcggcgtcccggacaagccgggcgaggcggccgcgatcttccgcgccatcgcgaacgccgaggtcaacatcgacatggtggtgcagaacgtctccgccgcgacgaccggcctgacggacatctccttcaccctgcccaaggcggagggccgcaaggccatcgacgccctggagcggaccaggagcagcatcggtttcgaatcgctccgctacgacgaccagatcgcgaagatctccctggtcggcgccgggatgaagaccaacccgggcgtcacggccggattcttcgaggcgctgtccgacgccggcgtgaacatcgagctgatctcgacgtccgagatccgcatctcggtggtcacccgtgccgacgacgtcaacgaggccgtgcgcgccgtgcacaccgccttcggtctcgacagcgactccgacgaggccgtcgtctacggaggcaccggccgatgaccggacaccgcccttcgctcgcggtcgtcggcgcgaccggggcgatcggcggtgtcatgctccggatcctctcgcagcacgcggacgtctggggcgaggtcagactcgtcgcctcgccgcgctcggccggccgcaagctggccgtgcgcggtgaggagagcgaggtcctcgcgctcgccgaggacgtgttcgacggcatcgacgtggccctcttcctggtgccggacgaggtgtcggcccgctgggccccgatcgccgcctccaagggcgtcgtcgtcatcgacgactcggcggccttccggctcgacgaggacgtgccgctggtcgtcccggagatcaacccccatgccgcccggctccggccgcgcggcatcgtcgcgtccccgaactgcaccacgctgtcgctgatcgtcgcgatcggcgcgctgcacgccgagttcgggctgcgcgagctgatcgtctcctcctaccaggcggtcagcggcgcgggccgagacggcgtcgcggccctgcgcgagcagttggcgctggtggccggcacggagctgggcacccaccccggggacgtacgccgggccctgggggacggtacggaagccacggcgagtccgttcgccgcacccgtcgcgctgaacgtcgtgccctgggccggtagggacgccggggacggctggtcctccgaggagatcgcgatccgcgaggagtgccgcaaggtgctgggcctgccggatctgaagaccaccgcgacctgcgtgtacgtccccgtggtcgccacgcactcgatgtccgtccacgcccgcttcgagaacgaggtctccgtcgacaaggcgcacgagatcctggcgaccgctcccggtgtggtgctcttcgacagtccggcgtccggagatttccccactccgtccgatgtggtgggcaccgaccccacctgggtgggccgagtccggcgttcgatggacgacccgcatgccctggaaatgttcctttgcggtgacaatctccgaaaaggtgcggctttgaacgtggcgcagatcgccgaatcggtcgccgccgaatttccccgtggctgatcgaacctgttttgtaggatctgtgaacgccctatgagtaatttgctggtctgaaccccttgagctgggacgttgtcgtatccgacgatgatctcccggccatctgcaaccgcacctcggccgggctgcgtctatgcggtcacttcttgcgtggccagacgcgatgacggggcatttggggaagagcaggtacgtatgagggcatgtcgcacagcgtcgaacgtggcgccgtacgcgtacaaccctgacggggggcagcgtgtccaacaggcgtggcagaggttctcgacatcacagtggtgggcccgttgcgaggcgcgtcggtgcgtccgctccggcggccccgtgcgcccggcggcatgccggtgatcgcgcccatgcccgccgcgcgcccggcaccgctgccctcgcagcgcgggggtgctgaagagacggtggcagctggaaccacggtcgaccatctcaccgagacctatcgcgcccactaccgttccctgctcggcctcgcggccctgctgctggacgacaccgcgtcctgcgaggacgtggtgcaggaggcgttcatccgcgtgcactcggcgcgcaaccgggtccgtgaaccggagaagaccctcgcgtatctccggcagacggtggtcaacctctcgcgctccgcgctgcgccgccgcattctcgggctgaagctgctctccaagccgatgccggacatggcgagcgcggaagagggcgcctacgaccagctggagcgggacgcgctgatcaaggcgatgaaggggttgcagcgacgccagcgcgaggtgctggtgctgcgctacttcgcggacatgacggaggcccaggtcgccgagacgctgggtgtctcgctgggctcggtcaaggcgtacggttcccggggtatcgcggcgctgcgcgtcgtgatggaggcccaggcatgagcgggcccgagcagcgcgacgagcacaggcacgagaatgacccgacgggaaacggaattgtgaaccacgggccggagaagactccgcacaccgatccggaccggccgcacgaggcgagtgcggggcccgagccgggcgagaccccggaacccgcgccacccgagcgggtggacagcgaggtcgccgaggaccccgacgtgcagggcccggggccggggacggcggaagccgcggcggacacgggtacggaagccgcggcggagaccgtcgccggcaagggctccgacaccgcctccggttccgacaccgcgtccggctccggcaaggaccccggctccggcaagggctccggagcgccggacgacgacctcgtcggcacgctgaccgacctcttcgcccgtgaccggggcgcacccgcctccgacgagctggacgaggtggccctgcgggcggggacggcgcggtggaggtggtcgagggtcccctcggagggggccagctcccgcaccgcaccgtgcagcatgcggcgcagggccacctcgtccag

SEQ ID NO: 2751 - DNA, 4040 bp, Unknown
  Kingdom: Bacteria, Phylum: Actinobacteria, Class: Actinobacteria, Order: Streptomycetales, Family: Streptomycetaceae, Genus: Streptomyces
acgccgcgcaccgccgcggtctgcgtctatcccgacatggcggccaccgccgccgccgcgctggccggctccggtgtgaaggtggcgtccgtggcgaccgccttcccggcgggccgtgccgcgctggacgtcaagctcgcggacgtccgcgacgccgtggcggccggggccgacgagatcgacatggtgatcgaccggggggcgttcctctccggccggttcctgaaggtgtacgaggagatcctcgccgtgaaggcggagtgcgggaccgcccgcctcaaggtgatcttcgagaccggtgagctgtccacgtacgacaacatccgccgggcctcctggatcgggatgctcgcgggcgcggacttcatcaagacctcgaccggcaaggtggccaccaacgccacccccgccaacaccctcctcatgctggaggccgtccgcgacttccgggcgcagaccggcgtacagatcggtgtgaagccggccggcggcatccgcaccaccaaggacgcggtcaagttcctggtgctggtgaacgagaccgcgggcgaggactggctggacccgcactggttccggttcggtgcgtccagcctgctcaacgacctgctgatgcagcgccagaagctcagcaccggccgttactccggccccgattacgtgacggtggactgatagccatggcatccgcattcgagtacgcaccggcgccggagtcccgttccgtcgtcgacatcgccccctcctacgggctgttcatcgacggcgagttcaccgaggccgccgaaggcaaggtcttcaagaccgtctcgccgagcagcgaggaagtcctctccgaggtcgcgcgggccggcgcggcggacgtggaccgggccgtgaaggcggcccgcaaggcgttcgagaagtggtcggcgctgcccggttccgagcgcgccaagtacctgttccggatcgcgcggatcatccaggagcgcagccgtgagctggccgtcctggagacgctcgacaatggcaagccgatcaaggagacccgcgacgcggacctcccgctggtcgcggcgcacttcttctactacgcggggtgggccgacaagctcgaccacgcggggtacggggcgaacccccgtccgctgggtgtggccggccaggtcatcccgtggaacttcccgctgctgatgctcgcgtggaagatcgccccggcgctcgccacgggcaacacggtggtcctgaagcccgccgagacgaccccgctgagcgcgctgttcttcgcggacatctgccgccaggccgggctgcccagaggcgtcgtgaacatcctgaccgggtacggcgacgcgggcgaggcgctcgtctcgcaccccgacgtcgacaaggtcgccttcaccggttcgaccgccgtgggcaaggcgatcgcccggcaggtggcggggacggacaagaaggtcaccctggagctgggcggcaagggcgcgaacatcgtgttcgacgacgcgccgatcgaccaggccgtcgagggcatcgtcaccggcatcttcttcaaccagggccaggtctgctgcgcgggctcccggctgctggtccaggagtcggtccaggacgaggtgctggacgcgctgaagcggcggctgtccacgctgcgcctgggcgacccgctggacaagaacaccgacatcggcgcgatcaactccgccgagcagctggcccggatcaccgcgctggtggagaccggcgaggcggagggcgcggagcgctggagcgccccctgcgaactgccgtcgtccgggtactggttcgccccgacgctcttcacgaacgtcacccaggcgcacacggtggcccgcgacgagatcttcggcccggtgctctccgtcctctccttccgtaccccggacgaggcggtcgccaaggccaacaacagtcagtacggcctctcggccggcatctggacggagaagggctcccgcatcctcgcggtggcgaacaagctccgcgcgggcgtcgtctgggccaacacgttcaacaagttcgacccgacgtcgccgttcggcggctacaaggagtcgggctacggccgcgagggcggccgccacggcctggaggcgtacctcgatgtccgataacaaccgacttggcgtcttcaagacctacaagctgtacgtcgggggcaagttcccccgctccgagagcggccgggtgtacgaggtgacggactccaagggccagtggctggcgaacgcgccgcagtcctcccgcaaggacgcgcgcgacgcggtcgtggccgcgcgcaaggcgttcggcggctggtcgggcgcgaccgcgtacaaccgcggccaggtcctctaccgcgtcgcggagatgctggagggccgcaaggaccagttcgtccgcgaggtggccgcctccgaagggctgtcgaagtccaaggcggcggccgtcgtcgacgcggcgatcgaccgctgggtctggtacgcgggctggacggacaagatcggtcagatctccggcggggcgaacccggtcgccggcccgttcttcaacctctccacccccgagccgacgggcgtcgtcgcggtcctcgcgccgcagaagtcgtcgttcctcgggctggtctcggtgatcgccccggtcatcgcgaccggcaacaccgcggtcgtcgtcgcctcggccgacgccccgctgcccgcgctgtcgctgggtgaggtgctggccacctccgacgtgcccggcggcgtggtcaacatcctttccggtgtcacggcggagctggcggcgccgctcgccgcccaccaggacgtcaacgcgatcgacctcaccggagcggacaccgcgctggcgaaggagctggagatcgcggcggcggacaacctgaagcgcgtactgcgcccggggccggtggacgcggacggcgcggcggactccgcggactggacggcctcgcccggcacgcaccgcctgacggccttcctggagaccaagacggtgtggcacccgacaggcgcgctgggagccgcgggctcctcgtactgacgcccgcccggtgcccggacggggccgccctcccaccccggggcggccccgtccgccgtctctccgcgccgggcgtcagccggtgatgagcccggtgaccgtccccaccacgggcaggtcgcccagcgagccgccgctggtgatcgggtccgtgaggacagccgtggtcagcggcttgaagtccgcgatctgggtgcccacggcgttgtccagcgggtccaccccggtgttggccagcgggtccagctgaaggtcggtgatcggggcgacactgctggccagcgaggtcccgagcgcgctggtcaccgccggcccggccgtctcggcgaccgcctggagggccgaggttccctggtccgggatctccgccaccgggggcagctggacggcccccgcggagcccgcaccggcccccagggcggcccccagcgcggtgatggtcagaccggcgcgcagcaggacgcgacgttcgggcttacgtgcatgaagtgccatgttttccaccggatcgatctggtcgggtaatcgtctgtgcgcgcagagtagttgaggtgtgatgctggataccaacaggaggcccgaggggtcccctgcgcgggtcaatgcctcacacttctgttctgtgagttcccaaccgatcccgacccgcgtcgtgctgctcgcgggcccctccggctccggcaagtcgtccctcgccgcccgcaccggtctcccggtgctgcgcctggacgatttctacaaggagggcgacgacccgacgctgccccgggtccccgggtccccggacatcgactgggactccgccgggtcctgggacgcggaagcggcggtggccgccatcgccgagctgtgccggtgcggccgtacggaagttccggtgtacgacatcgccaccagctcccgtacggaccacgaggccttccacatcgagcggtcaccgctgttcgtggcggagggcatcttcgcggcggacatcgtcgaacgctgccaggaactggggctgctggccgacg

SEQ ID NO: 2752 - DNA, 3197 bp, Unknown
  Kingdom: Bacteria, Phylum: Actinobacteria, Class: Actinobacteria, Order: Streptomycetales, Family: Streptomycetaceae, Genus: Streptomyces
tgacgacggcggtgcggccgaccaggcggcggcagacggaagaagtgtcggtcatggtgctcaggcctccgtgctgatgaagacgttcttggtttcggtgaaggcggccagggcgtccgggccgagctcgcggcccagacccgattgcttgtagccgccgaagggggtcgaatagcgcacgctggaatgcgagttgacggagagattgcccgcacgcagcccctggccgacgcgcagcgcgcggccgacgtcccgggtccagaccgagccggcgagtccgtagtcggtggcgttggcgaggcgcagcgcgtcctgctcgtcctcgaacggcaggaccaccgcgacgggcccgaagacctcctcgaccgccaccggcgcctcggccgggaccccggtgaggacggtcggcgggtaccagaacccggagccctcgggagccgttccgaggatggcccggccgccctcggctccccggccgccgtcgacgagcccccggacccggtcccgctgcgcggccgagatcagcggtcccatctgggtcttctcgtcggccgggtcgcccaccacgacggcggacacggccgggacgagcaggtcgaggaagcggtcgtacacggaccgctcgaccaggatccgggtgcgggcgcagcagtcctgaccggcgttgtccaggaaggacatcggtgcggccgccgcagcggcctccacatcggcgtcggcgaagacgatgttggggctcttgccgcccagctccagggtgagccgcttcacgcgctccgcgcagcggctcatgatgtgcttgccggtccgggtggagccggtgaacacgatcttcgcgacgcccgggtgctcgaccagggcgctcccggccaccggcccctcgccgggcagcacctggaagagaccctcgggaaggccggcctccagggcgagttcggccagccggagagcggtcagcggcgtcgtctcggcgggtttgagaaggacggcgttgcccgccgccagggccggagcgagaccccaggcggcgatcggcatcgggaagttccacggagcgatgaccccgacgacgcccagcggctccaggatcgtgaagtcgatgccgcccgccaccgggatctgccggcccagcagccgttcggccccgcccgcgctgtagtcgaggagatcgcgtacgttgccggcctcccaccgggcgttgccgatggtgtgtccggcctcgcggacctccaaccacgccagttcctcgatgtgttcgtcgacgacgacggcgaagcggcgcagcaggcgcgcccggtcggcgggcgcggcggccgcccagcggcgctggaccgcggcggcacggatgacggcggcgtccacatcggcggcggaggccgcggggacggtggcgacgacctcggcggtcgccgggttcaggacgtccagggtgggctgtgacacgtacggaccccgatcacggaagctggtggtggtgcggaggtgttctggctgtcagaggcgttcgaaggagcggcgcagctcccagtcggtcaccgcggagtcgtacgcggtcagttcgacgcgggccatgttcaggtagtgcgccacgacctcctcgccgaacgcctccttggcgatggggctggcctcccacagctcggcggcctcgcgcagggtcgtcggcacctggtcgtagtccccggtgtaggcgttgcccgtacaggcctcgggcagcggcagccggtgctcgaccccgtacagtccggcggcgaccagtccggcgacggccaggtgcgggttgacgtcgccgccgggcagccggttctcgaagcgcatcgagcgcccgtggccgacgacccgcagggcgcaggtgcggttgtcgacgccccaggcgacggcggtgggggcgaaggagccgggctggaagcgtttgtaggagttgatggtgggcgcgtagaggagggagaagtcccgcagcgcggccagctgaccggccaggaagtaccgcatcagctcggacatgccgtcctcgccctcgcccgccatcaggttcgtgccgtccgcgtcggtcagcgagaggtggatgtggcaggagttgccctcgcgctcgtcgtacttggccatgaacgtcagtgagacgccctcctgggccgcgatctccttggcgcccgtcttgtagacggcgtgctggtcgcaggtggtgagcgcctcgtcgtagcggaacacgatctcgtgctggccgggattgcactcgcccttggcggactcgacggtcagcccggcctcctgcatctcgttgcggatccggcgcagcagcggctcgacgcggccggtgccgaggatcgagtagtcgatgttgtactggttggccggggtcagcccgcggtagtcgcggtcccaggcctcctcgtagctgtcccggaagacgatgaactccagctccgtgcccacctgcgccgtgtatccgagctccgccagccggtcgagctggcggcgcaggatctgacgcggggccgccaccaccggactgccgtcgtgccatgcgagatccgcgatcagcagggccgtcccctcgtgccaggggacggggcgcagcgtggcgggatcggggaccatgccgaagtcgccgtagccgttctcccacgaggacatcgcgtagccgtcgacggtccgcatctcggtgtccacggccaggaggtagttgcagccctcggtgccatgctccagcacctcgtcgaggaagaacccggccgcgaaccgtttcccctggagccggccctgcatgtccgggaaggccagcaccacggtgtctatcgacccgtccgcgacccgtgagcggagctcgtcgacgccgagcgggggtgtgcggtctgccacgggatgcctccttgggtgaaccgggaggcataaggtatgacagagaaccattgcttgggaaggggatccgccagtggccacgaggagaagagcggacgacacccgtccggcggcaggtacggtgggaacggccgtggccgacggggtggcggccgacgcggccgggggcgggagcgacgccgcggcgggccggctggactccgtgctgcggcccgtccgcgcgggcaacggcttcgaggaggcgctggagcaggtcctccagctcctgcgcctgggcctggtcccgcccggcgaacggctgccctccgagcgcgagttgtcccagcacctgcgcatca

SEQ ID NO: 2753 - DNA, 9348 bp, Unknown
  Kingdom: Bacteria, Phylum: Actinobacteria, Class: Actinobacteria, Order: Streptomycetales, Family: Streptomycetaceae, Genus: Streptomyces
accggcggcaaggtcgtcgaggtgaccgagctggtctcccgcaccgaccgtgatctggtgatggccaagctggcccagccggtcacggacatcgccccgctgctgctcgcggactccgccccggtggcgggcgagagcctgcgcgcgctcggctacggccgtaccgcgacgtcctgggtgccggaccggctccacgccggcacgatcgccgtgaccgcgaccgatgcgacgacggtggccgtcacccgggacggcggcgcgatctgcaagggcgacgcgggcggtcccgcgctgcgcgagcaggacggcaagttcctgctcgccgccgtccacagcgcctcctggcaggcaggctgcttcggctccgacgagacccgcgacggtgcggtggagacccgcaccgacgacctcgtggactgggtcacccaggtccgcggactgccgaaggacccgcaggtggcatccggggacttcaacggcgacggcaaggaggacatcgccgcgttctacgacaacggaaccggaaccgacggcaggaacaggtcctcggtcttcgccttctacagcaacggcaccggcttcgccgagcccaaaaaggtctgggccagtaccggttccttcagcggcgccgccagcaaactgacctcgggtgacttcaacggggacggcaaggacgacctcgccgtcctatacaactccggccaggccgcggacggcaagtacgtcaccaccgtgttcacctacaccagcaacggcaccggcttcgccgcccccaagcaggcctgggtcagctcgggctccttcgactggagcaaaagcaagccggtctcggctgacttcaacggggacggcaaggacgacctcgccgtcctatacaacggtggtcaggccaacgacggcaagcacgtctccctcgccttcaccttcacgagcaacggcaccgccttcaacaaccccaccacctcctggaccagcaccggctccttcgactggagcaagagcaagccggtcccgggtgacttcaacggggacggcaaggacgacctcgccgtcctatacaacggtggtcaggccaacgacggcaagcacgtctccctcgccttcaccttcacgagcaacggcaccgccttcaacaaccccaccacctcctggaccagcaccggctccttcgactggagcaagagcaagccggtcgcaggcgactccaacggggacggcaaggacgacctcgccgttctgtacgactccggccaggccgcggacggaaagcacttctccacgctgttcgccttcaccagcaccggcaccggcttcgctgcccccaagcagacctgggccagcaccggctccttcaactggaacgtgagcctgccgacgtccggcgactacaacaacgacggcaaggacgacctcggcgttctctacgaaggcagcactacggccgacggccgacgtctcgactcactgttcaccttcaccagtaccgccaccggcaccaaggcgccggtgctccactggtcgggcagcgtcgtctgaccaaccggtcccgcacacgcgggagggtgggccggaccttatgctttccgggcgcatcagctctccgaaaggcatgccgtgaattacagggtccagcccaccgcccaggtcgacgagaccgccgagatcggggccggctccagtgtctgggagctggcgcagatccgtgagggagccaggctcggcgaaggctgtgtcatcggccgcggcgcttacgtcggcaccggtgtgcgcatcggtgacaacgtgaagctgcagaactacgcgctggtgtacgaacccgcagagctcggcgacggcgtcttcgtcggccccgccgtcgttctgaccaacgaccacaacccgcgctcggtcgaccccgacggcaagcagaagcgcggcggcgactgggaggccgtcggagtgaaggtcgccgaaggcgcgtcactcggcgcccgctcggtctgcgtcgcgccggtccggatcggccggtgggcgatggtcgcggccggcgccgtggtcaccaaggacgtcccggacttcgccctggtcgtcggcgtgcccgcccgccagatcggctgggtcggccgcagcggcgtccggctggtcgagcgcgacggcgaaccgggggtgtgggagtgcccgcagagcggctcgttgtacgaggagaaggacgcgctcctcaccgagcggacggtctgacgccatggccgaccatcggtgttccaccatcgcggacgtgacgacttcgcccgagtggttcatacgtccgcgcagaagaggatgacgctcatggcgggagccccttcgccacagaccgccgggcactcacggctggactctctcaccgggctgcgtttctgggccgcgctggccgtcgtgctctaccacctgtcccgacaggccggtcagcttccgtggatcagtgacatcacctggtacggaaggagcggggtcaccttcttcttcgtcctgtcgggcttcgtgctggcgtggacgtacgacggcaaggtcgtgcccgcggtcgtcttcctctggcgccggttcgccaggatctggccgctgctggccgtctcggtactggcctccgtgaccgtctggcatgcgctgggcaccgacttctcactgcgcgggaccgccgcgacgctgggcctcgtgaacgcctgggtgccggatcattcctacctctcgggcggaaaccccgccgcctggtcgctcagcgacgaggcctggttctatctgctcttcccgctcctcctggcgttgcccctgatgcggagcgcccgggggcggatcgtcgtcgccgtcgccgtgagcgcggcctcgctggccgtctggctgagcggcgccttgatcacggattcgctggtgcgggtgtgggcgctcgactacttcccgccgacccggacgctccagttcgtcctcggcgtcaccgccgggctcgcggtgaaacggggctggcgtccggcgggcggcctgcccgtagccgtcctggcggtcctggcctggcacctggcgctgatcccctggtcccacgccgtgccggacagcctctggtacagcccctacagcgcttcccagctgctgtcagcgccgatcttcgcgctgctggtcgcggccgcggccgcggccgacgtggaaggacgccggaccacccttgccggacccgccatggtcaggctcgggcagtggtccttcgcctggtacctcttccacgagatcgtgctgagggccctggtcggcgtgtacggcaagccggtgggccgactcgagacggccggcatctgggccgccaccctgctgctgagcctggctgtggccgccattgcttaccatggcgtggaacatccgctcgaacgcctgcttcgccgtcgaggcccgggcgggtccgcccgctcccgagcggtacacgccgtgacgcaggagcccggtgcgcaaccgccgggtgcacacaccttttcctcatctccacatcaagcgattcagaagaagagcgtgcaatgaaagtcatcagcatcgtcggtgctcgcccccagttggtgaaactggctgctgtcgcggcggcattcgccgggaccgatcaccagcacgtcatcgtccacaccggacagcactacgacgcggacctttcggacgtcttcttcgaaggtctcggcatcccggaccccgacgtgcacctcggcgtcggctccggaagccacggcgtacagaccggatcggtgctctccgcgctcgacccggtcctggaagcggagaagcccgactgggtcctggtctacggtgacaccaactcgacgatcgccggggccctttccgcggtcaagcagcatcttccggtggcccatctcgaagccggtctgcggtcgttcaaccgccggatgcccgaagagcacaaccgggtcctgaccgaccactgtgccgatctgctgctcgcgccgaccgaggaggccgtacgccacctcgcgtccgaaggactctccgagcgcacggagttggcgggcgacgtcatggtcgacatctgtctccgcatccgggacgccgtgcgcgccggcgagcacgcggcaccggccctgcccgagggcatcgacccctcgcagccgttcctgctggccacgctgcaccgcccggacaacacggacgacccggctcgactggccgcgatcatcgacgccctcgcgggcctgcccgtgcccgtcgccctgctcgcccacccccgcctcgtggcgcgcgccgaggcgcatggcatcgagctggcgaagggagccgtccacgtcggccggccactgccctacgcgggcctcatcgccgccgtcctcgcctcgtcgggcgtggtcaccgactcgggaggcctccagaaggaggccttcctcctggagcggatcaccacgaccatccgtcccgagaccgagtgggtggaaaccgtccacaccggttggaacgtcttggttcccgacccgcacgagatggacccggtccagtgggccgccaccgtctcccgccccgtgcccacgagcgaccccggtacgccgtacggcgacgggcacgctgcggaaaacgtcgtccggatcatggaagagtggaaagggggcagccggtccgcgtgacatgcgcagcgccacgtttggtgctaataggcatatgtcaccgtgctagcgtcaccatttatgtcagtgtctcccaggtccgggctgcccgcgaaaggcacgcgacctcatgtgatctatttcgccatcggttttccaccggctgcaaaaagctgtgcctaccgcatgcgcgaaaccgcgaaccagttcatcaatatcggctgggacgtcaccgtcgtcaccatcgcccaggactcctgggagctggactccggcatcgacctcaccctgctggagcaggtcgatccgcgcgtgaaggtcgtcgagctgccgctctcgcgcgaggacctggagacggacatccgtcgcttcgacgaagcacgggctctcaaccccgccaagtgggtcacggagctgcgcaagcgccaggccgagaccttccccgaggccagtttcggtgagtggcgcgaagccttggaacaggcggcgctggacatccaccgggaacaccccgcagacctcctggtcgccagctgcgtgccgtacgtgaacctggccgccgcctggaagctgtgggaggaggcgcacgttccctacgccgtcgacttccgcgacggctggtccatcgacgtcatcgacggcacggaggccttctcccgcgactccgagctgggccgctgggagcagaagatcctggatcacgcggtctcgctgtgggtggtcaacgacccgatcgcggagcactaccgcgcccgctacccggacttcgccgaccgcgtgcgggtcgtgcgcaacggctacgacgcggacagctcgccgggccacgcccacaagcccgacctcgacgcgggactcacctttggttacctcggcacggtgaacttcaccgccacacacctcgaaacggtgctggacgcctggcgcgcggcgcgcgcacaggagccgatgctcgccaacgcccgtttcgaggtccgcggtcatatcggcaacggcgcgggccgcggggccacacggcacgccgagatactcaaagaggcggaggcggacggagtccatttcggcggacccgcttccaaggccgaggtcgccgagatctatgcgcgctgggacgccatggtcctcatcctcatcggagggcgcttcgtcacctccggcaaggtctacgagtacatggccacgggactgccgatcgtctccgcccatgtcgtggaacacgacgcctcgaacgtgctgaggggccacccgctgtggacgggagccgtgggcctcgacgtcgaggccatgaccgacgcgttcgtccgcgccgcgcacctcgcggtcgacaccagcgatgaggcccacgccgaggcgatggcccacgccgaccagtacacccgggagtcgctcatgaccgtggcggtgcgcgagctggtcgaccggctggcagcggacaaagccgagcgcgtcagcgtcaagggcgtgtcagccctccccgagaagtcgatcgtcaccggaggacccgcgtcgtgaccgacgtcctgttcatcgccaccaagagaccccaactgggtgtcttcaccgactccctggtgaagttccgggaccggggcgccaaggtgtacctcgccggtaccttcaagatgacctcggtcgccgaagagctcacccgcgccgaactggacggggtccaccagctgccgcgcaatctcaacaagcgcagctccgccatgcgccgcaaggccaagaagtccccgaccggcatgcgcgtgtggatgcagtcgcagcgggaccgctggctgcgtcagcaggcccgcaccgcccatgtgatcgtggcactggaccccggcgccgtctacaccgtctggcggctcgcccagtacaacaccacggccgaggcgcacttcggtctcgctccggcgctcagggccgtcgaccggatctcgggcggaccgctccgtcccccgacgctgcctccggtcgccgccgtcgcccaggatgtacggcgctccatcagcggcattcccgccgcggtgatgcggaccgccacctcacgccccgtcatgcgctcgaccgtgggagcccgactctggcgttcggccgtgaccgtccctggtatgccggggacggtccgggcctcggcctcgcgctatgtggccgagggcatggaggacgcgggacggatcagcggcgcggccatagcgctcagtgccgcggctgccaagatccccgatcccgcgctcaaggcccaactgctccacgagagcgcgatgaccgaggtctccaagggcatcagcccccgtgatctcggcaaggccgtcaacgggcacctcgcccacgccgacgaccagttcgccaagggcctgcacgaatcggcgtcggtgtccctgtaccgggcactctccctcggcttccaccgtgtcctgcacatcgaccagctgagctcaccgctggcgaaggacgcggagggcttcgtcgcgccgttccagcagtctgccgcctaccgggctgtcgcacggccccgcggcaggaagacgccgcccaagagcccgccgtcggatcggccgctgcgattgctggtgaccaccagcaccaatgccaacttcctccatcacatcctcgccaggtacggagaccaccccggggtcgaactgaggttcctggacctcggcgcacacaagccgttcaagaagatcgcctgggcagcgccccagatgttggaggaccggctgtccgacggcacgtcggggtaccagagcgacgtggagcggctgatgcggccgcatctcgactgggcggacacggtgttcgtcgactggtcggtgggaccggccgccatgctgaccgcgatcgatcccggtgacaccaggatcgtggtgcggctgcacagctacgaggcgttcacccgctggccgcacatgaccgacttctcccgggtggacgatctcgtcttcgtcgccccgcacgtgaagaatctggtgacgtcgctggtgcctcagctgcgagaggcgtccgcacctcggatgcacgtcctggacaacgcgatggagctcgagggattccgccgcccgaagccctccgaggcgcgcttcaacctgggtctcatcgggatcagccaggtcgccaaggacccgcggtgggccgtggacgtgctcaaccgcgtacgcgagcacgacgatcgttaccggctcctcctggtcggcaacgacatgaacccgaagacgagcaaggccaccgccgactacctgacgctgctgcagcgggagctgaagccgctggaggcgtccggcgccgtcgtacgtctgggacccaccgacgacgttccggccgcgctcaccgacatcggagtcatcctcagctcgtcggtgcgcgagggatgccacgtgggtctgatggaaggggctgccagcgcggcggtgccggtcgtccgcgactggcccttctacgccgggaagccgcacagcgcccgcacgctctacccggagggctgggtcgtggactcgccggaggaggccgccaagcgcatcctcgacgtcaccgcgaccgaggaatcctggcgcgaagcttgcgagcaggcatccgagcacgcggtcggtacatgggactggtccgtcgtccagaagcgcttcgacgacctgttcctgggctgaccaccggctcagcggaatcgatacggcggagggccagcaccccgtggggtgcgggccctccgccgtatccgcgtgcgaggccggtcaggcaagaacgccggggtgccgcaggcgccaccccgcccaggccgactcgaccatggtgcgtatgtcgtgccgggccgaccagtccagctccgcggcgatgccggccacggaggcgaccacccgggccgggtctccggggcggcgggcctcggtgaccgggggcgggccggtgcggccggtgacgtcgaggatgatgtcgaccatctcggcgacggaggctccctcgccccggccgatgttcagcaccagttcggccgacgggtcccgggccagccggtgggccgcggcgacgtgtgcggaggcgatgtcctccacgtggacgtagtcacggacgcaggtgccgtccggggtcggatagtcgtcgccgaagatccgcggggcctcgtcggcctccaggcgttcgaagaccatcgggaccaggttgaagacgccttcgtcggccagctccgccgaggcggccccggccacgttgaaatagcgcagcgaggcggtggccatggcgtgcgcccggccggccgcggccaccagccactcgcccgccagtttggtctcgccgtacgggctgagcggcaggcacggggtgtcctcggtgaccaggtcgacgtcgggcatgccgtagaccgccgccgacgaggagaacaggaagcgccggacaccggcggcggccgccgcctccagcagggtgcgcagtccgtcgacgttctcgcggtagtagtacagcggtcgttcgacggactccgccacctgcttcttgcccgcgatgtgcacgatgccggtcaccgcgtggtcgaccagcacccggtcgagcagatcccggtccaggaccgagcccacgacgagcgggacgccttcggggaggcgttccgctcgtccggtgctgaggtcgtcgaggacgacgaggcgctcctcgcccgccatctgcgcgacgacgtgggatccgatgtagccggccccgccggtgatcagccaggtcatcgtcagccgccgatgacgacgcggcgcacgcccgcccagttcgccgggtacgtggtgcgccg

SEQ ID NO: 2754 - DNA, 1678 bp, Unknown
  Kingdom: Bacteria, Phylum: Actinobacteria, Class: Actinobacteria, Order: Streptomycetales, Family: Streptomycetaceae, Genus: Streptomyces
cgccgaccccgaccaccccggcgacgaggtcttcgacgtgtacctgagggccaagggcgccgccgacgccgacgtacgctcccgcaccgcactggactggacgatcctgcgtcccggcatgctgaccaacgacgcgggcaccgggcaggtcgtgctggcagcctcgacgggtcgcggcccgatccctcgcgacgacgtggcggccacgttgctggagctgctggacaccccagcgacggcgggcctcaccctcgaagcgatctccgggaacgtgccggtgacggtggccgtgaaggacgtcgcgggcaactgatccgcagcggattccccgcccggacaacgaggaagcccccgaccggaagaaccggtcgggggcttcgttcgcgtggcggcgccagggttcgaacctgggtaggctgagccggcagatttacagtctgctccctttggccactcgggcacaccgcctcgaacgacgcgttggatctcgtggtgagttccttggcgacgacgtaaacgatacctgatggccaggggtgctccgccacctgattgatcagcggccggagggggcggcggtggctaggcttgcgctgtatccccagcattcgacgcaaggagccacacgtcatggccgactccagtttcgacatcgtctcgaaggtcgagcggcaggaggtcgacaacgccctcaaccaggccgccaaggagatctcccagcgttacgacttcaagggcacgggcgcctcgatctcgtggtcgggcgagaagattctgatggaggcgaacggcgaggagcgcgtcaaggccatcctcgacatcttccagtccaagctgatcaagcgcggcatctcgctgaagtcgctggacgccggtgagccgcagctctccggcaaggagtacaagatcttcgccacgatcgaggaaggcatctcccaggacaacgccaagaaggtggcgaagatcatccgcgacgagggtccgaagggcgtcaaggcgcaggtccagggtgacgagctgcgggtcagctcgaagagccgggacgacctgcaggccgtgcaggcgctgctgaagggccaggacttcgacttcgcggtgcagttcgtgaactaccggtgatcaaccgcctcgatccgtacgggcgttgccggatcgcttgagtcgaaccgggccgggccgaaccgggctgagcacgatgggggcacaccgccgaggccgacctcgacggcgtgccttttcgtgtgtccggcccgggggtgcgggtgtgatgtccgaataccgccggtagaggtgcggtgagcgggcgcagactggacgcctggaccggggaagtgagaaggcatgacgacgacggtgtacgcgcgggtggagagcccgctgggcgagttgctgctcgtcggcgaggtagtggcggacgggccggacgcggtcggggtggccggggtccggctgcgctcgttgtcggtgcccggccagcagggcggcgcggtcgtccaggacggctggcggcacgcacccgaggcgttcgcggaggtcgcccggcagttggaggcgtacttcgcagggcgctcgacgcggttcgacgtgccgttggcggagggtgcgggcacggagttccagcggcgggtctgggcggcgctggagtcgatcccgtacgggagcacggtgtcgtacgggg

SEQ ID NO: 2755 - DNA, 22466 bp, Unknown
  Kingdom: Bacteria, Phylum: Actinobacteria, Class: Actinobacteria, Order: Streptomycetales, Family: Streptomycetaceae, Genus: Streptomyces
gcaggaaagatgtcctcaaacgccggacgggctggaatcgcgcaacgcgatcgctcgttgcatcgccttgcgggctctcggcgtgtccctcgcgtcctggtaggcgaccgccagccggaaccaggtacgccagtcgtccggggcgtcctcggtctcctcgcggcgcttggtgaagaccgcgtcggcggagtcccggtcgatgcggccggacggggtgcgggtcagttcgtcgaccggcaggccgccctcggcgtccagctcggtggccagggcgttggcgcggcggacgaactgggtgttcttccagaggaaccagacgccgatcaccggcaggatcagcacggcgatcccgaaggtgaccgtgaccagcgtgccgtgccggatgagcatcaggccgcggctgccgaccaggacgaagtagaagaccaggacggcggccgtgacgatgtaggtgatctttgcgcgcatggtgggctcagtcagttcaggtcgaggaagtgttccaggccgaacgtgaggccgggagtggtcaccacacggcggacgccgagcaggatgcccggcatgaagctgctgtggtggagggagtcgtggcggatggtgagggtctcgccctcaccgccgagaagcacttcctggtgggccagcaggccgcggagccggatcgcgtggaccgggacgccgtcgacgtccgcgccgcgcgcgccgtccagggcggtggcggtggcgtccggctggggtgcgctgcccgccttggcgcgggcagccgcgatgagctgggcggtgcgggtggcggtgccggagggggcgtcgaccttgttcgggtggtgcagttcgacgacctcgacggactcgaagtagcgggcggcctgctccgcgaacttcatggtcaggacggcgccgatcgagaagttcggggcgatcaggacgcccgtccccggggagttgtccagccaggtggtcagctgcgcgagccgttcgtcggtccagcccgtggtaccgacgacggcgtggatgccgtgccggacacagaagtcgaggttgcccatcaccgacgcgggggtggtgagctcgacgacagcctgggcgccggtgtcggcgagggtctccagcttgtcgccccggcccagcgccgccaccagctccaggtcgtcggcggcctcgatcgcggtgacggcctcggagccgatgcggcccttcgcaccgagaacggctacgcgcagcttgctcatcttgattccttaggggattaggagaccgcttcgtggaggcggtccgcctgcttgtccttgagcgggccgatgaccgagagcgagggccgctgggtgaggagctcgcccgccacctcccgtacgtcgtcgggggtgacctccgcgatgcgcgcgagcatgtcgtcgacggacatctgctcgccccagcacagctcgctcttgccgatacggttcatcagcgcgccggtgtcctccaggccgagcacggtggacccggagagctggccgatcgcacgggcgacctcgtcgtcgtccagaccgtgcgtggccacccggtccagctcgtcgcggcagatcttgaggacgtcgtggacctggctgggccggcagcccgcgtacacgccgaagaggccgcagtcggcgaagcccgaggtgtacgagtacacgctgtaggccaggccgcgcttctcccgtacctcctggaagaggcgggagctcatgccgccgccgagggcggtgttgaggacgcccagggcccagcggcgctcgtcggtgcgggcgaggccgggcatgccgaggaccacgtgggcctgctcggtcttgcggttcagcagctcgaccttgccggcggtgcgcagggtgcgggagccctcgcgcggcgccatcgggacggcgtcgtgacgggagagggctcccgcgcgttcgaaggcgcgacggacctggcgtacgaccgtggcgtggtcgacgttgcccgctgcggcgacgacgaggtgcgtggggtcgtagtgcttcttgtagaagcgggcgatctggccgcggttcagcgcgttgatcgtgtcgacggtgccgaggacggggcggccgagaggggtgtcgccgagcatggtgtgcgcgaacaggtcgtgcacgcagtcgcccgggtcgtcctccgtcatcgcgatctcttcgaggatgacaccgcgctcggcgtcgacgtcctcgggggcgatcagcgagccggtcagcatgtcgcagacgacgtcgatggccagcggcaggtcggtgtccaggacccgcgcgtagtagcaggtgtactccttcgccgtgaaggcgttcatctcgccgccgaccgcgtcgatcgcggaggagatgtcgagggcggtgcgcttggcggtgcccttgaagaggaggtgttcgaggtagtgggtcgcgccgttcagggtgggcgtctcgtcgcgggaaccgacgttggcccagatgccgaaggtggcggaccggacggagggcagggtctcggtgacgatccgcagaccgccggggaggacggtccggcggacggtgccgatgccgtccttgcccttcagaagcgtttgggtacgggcgacggcccgcgcctccgaggaggtgcgggccgtcgtcgcggaactacgggacgtcacttgtcggtgtcgtccttcttctcgtcctcttcaccctcgacgaccgggatcagggagagcttgccgcgggagtcgatctcggcgatctcgacctggaccttggcgccgacggcgagcacgtcctcgacgttctccacgcgcttgccaccggcgagcttgcggatctgcgagatgtgcagcagaccgtccttgcccggcatgagcgagacgaacgcaccgaaggtcgtggtcttgacgaccgtacccaggtagcgctcgccgacctccggcatggtcgggttggcgatcgcgttgatcgtggcgcgggcggcctcggcctgcgaaccctgctgggcaccgatgtagatggtgccgtcgtcctcgatcgtgatgtcggcgccggtgtcctcctggatctggttgatcatcttgcccttggggccgatgacctcaccgatcttgtccaccgggatcttgacggtgatgatccggggggcgttcggggacatctcgtccggaacgtcgatggcctcgttcatgacgtccaggatgtgcagacgcgcgtcacgggcctgcttcagcgcggcggccaggaccgaggcggggatgccgtcgagcttggtgtcgagctggagcgcggtcacgaactgcttcgtgccggcgaccttgaagtccatgtcgccgaaggcgtcctccgcaccgaggatgtcggtgagggcgacgtagtgggtcttgccgtcgatctcctgcgagatcaggcccatggcgataccggcgacggcggccttgagaggcacaccggcgttcagcagcgacatggtggaggcgcagaccgagcccatggacgtcgagccgttggagcccagcgcctcggagacctggcggatcgcgtaggggaactcctcgcgcgagggcagcaccggcacgatggcgcgctcggcgagcgctccgtggccgatctcgcggcgcttgggcgagcccacgcggccggtctcgccgaccgagtacggcgggaagttgtagttgtgcatgtagcgcttgcgggtcaccggggagagggtgtccagctgctgctccatacggagcatgttgagggtggtgacgcccaggatctgggtctcgccacgctcgaacagcgccgagccgtgcacgcgcgggatggcctcgacctcggcggcgagcgtacggatgtccgtgacgccgcggccgtcgatgcggaccttgtccttgatgacgcgctcgcggaccagcttcttggtcagcgagcggtacgcggcggagatctccttctcgcggccctcgaaggccgggaggagcttctcggcggcgatctccttgacgcggtccagctcggcctcgcggtcctgcttgccggcgatggtgagcgcctgcgtcagctcggaggtgacggccttggagagcgcctcgaagacgtcgtcctggtagtccaggaagaccgggaactcgccgaccggcttggcggccttggaggccaggtccgactgggccttgcagagcgccttgatgaagggcttcgcggcgtccagaccggcggcgacgatctcctcggtgggagcctcggcgccgtccttgacgagctggatggtcttctcggtggcctcggcctcgaccatcatgatcgcgacgtcgccgtcctccaggacgcgaccggcgacgaccatgtcgaagacggcgtcctcgagctcggtgtgcgtcgggaaggcgacccactggcccttgatcagggcgacgcgggtggcgccgatcgggccggagaagggcaggcccgccaggatggtggagcaggaggcggcgttgatcgcgaccacgtcgtacaggtggtcggggttgagcgccatgatcgtctcgacgatctggatctcgttgcgcaggcccttcttgaaggaggggcgcagcggccggtcgatcaggcggcaggtgaggatcgcgtcctcggagggccggccctcgcggcggaagaaggagccggggatcttgccggccgcgtactgccgctcctcgacgtccaccgtgagggggaagaagtcgaggttgtccttgggccgcttggaagcggtggtggccgacagcaccatggtgtcgtcgtccaggtacgcgacggcggagccggcggcctgcttggccaggcggcccgtctcgaagcggatggtgcgggtgccgaaggttccgttgtcgataacggcctcggcgtagtgggtctcgttctccactagtgatttctccatactcgtcgtctttcgtcctcacgcccgtgtggcgggggacggtgcgggagaggcgcaccgtggatgcgggccggtcttcgatcgaagctcccgggcatgttcccgggggccactaccgaggaccggcggcggcgtcgtcgcgcctctccctcgtcttgcgtcgcgcgtgttcgtcgcgctaatcgtgcgggtgtcgctgcacccaggttactgagcttgacaccggtcgtgcacgtacggcaaagggagcggtcccctcaaacgcgggaaccgctccctttccacagcgttcttacttggcgccgccggccgcgccacggcggatgccgaggcggtcgacgagcgcacggaagcgctggatgtccttcttggccaggtactgcaggaggcggcgacgctggccgaccaggatcagcagaccacgacgggagtggtggtcgtgcttgtgcgtcttgaggtgctccgtcaggtccgagatccggcgggagagcatggcgacctggacctcgggggatccggtgtcaccctccttctgggcgaactcggacatgatctgcttcttcgtagcggcgtcgagcggcacgcgtactcctcttgatgttcgaagcgcccacgagtgcccctggtcttgatctcaggggagcttccgtgactcggaggcgaaggtccgatgagcgcagcccccaggatgatccgaggacgcgtacacaaacggccactggacagagtaccagccattcgggtcactccccgccgctgatcagccggtggccgccactgaccggccggcgcccgccgacgatcagtggacgcccctttgatgatcagctggtgagcgcgcggatcgagtggtagacgtcgaagaccgcgaggcagagcgggagcagcgtcaagaggacgactgtttcggcgatctccaggaagcgtccccagaacggggtcacccccttgcgcggaacgatcaggccgatggcggtgatgaggacggcgacgccggcgacggcggcggcgagccacaccgtacggatgtcgagtgcggcgctctccccccgcatcgcgtcgcgcaccatggcgaccggcgggttgagggacaggcccaggcccagcaggacgagggagccgaggcccgcggcgagtgtgcagccgacctgggccgtgtagcggaacaggtgggcgcgcatcagcatggcgacgccggtggccagtgcgagcagctggccccagacgttgttcgagaaccccagcaccgcggcggccgccacggcgaccagggcgcagccgccgaccaggccgaggagcagttcatggccgcgccgcgcctgggcggcgaggcgtaccgcgtccaccgcgcccgtgggcgcgggctcggaggtcccgtagtcgccgaccgtggtgcggggcggctcgaatccgatgggcagccgggcgaagcgggtggagagtcccggcaggaaggcgagcgcccccacggcgagcggggagcacacggcggcggcctcgatcggcttcatgtcgctcaggatcgcgacgaaggtgaccaggaggccgacggtgctcgcgaagacgaacgcgacgaacggcccgtcccctccgggcgcgacgatcatcagaatgaccgccacgaccaggaccgccgcgcaggcgagcaggaactgcagccgtccgacgccctgtccggtgctcagcggcagcaggccggagccggcgaccgccgcgttcaccagggcgccggtgccgagcgcgatcgacgaggcccggtcgtcgtacacccgcgcacgcacgcaggcgaaggcgagcaggagcagggcgacgacggccgccaggattcccggcagtccgttcatgtcgtggagcgggtcggccgtccacagcacgaagccgagcagcgccagcaggacggagccgccgaagaggccggctccgcgcatgagggcgtcgccccagagcgtgcggtccttggccacggcggtggcgacggcgtccgatacgtcgtcgaagacggcggggggcagcgattcggagaagggccgcatcgacagcagctcgccgtcgagaatgcggtgaccggcgagcgtacgcgcgctgtccaggacggtgccgtcgcggcgcaccaggtggtagccgaccggtgcgccgggggcggggctctgtccggacagccggaggatctcgggatacagatcggctacggggatgtcctcgggcagggccacgtcgacacggctgtcgggcgcgacgaccgtgacccggcagaatccggtgccgctgccggacggggtcccgtgactttgccgacctgatccggtggctgccgcttgggccgtcatggtcacctggtgctccccctactggcttgttctgcgcttctgctgctgtcgtgctgcttgtgcggttcgttcttctgccgtcttgctgctgcttctgctgcttttttgcgccgttgtcgccgcagctcccgccgtccggctttccgccgccgctgctcccgcttccgccgggccgcgtccgcttctgccggaaacacaccgccgggaccacggatcgcaccgcacgtcccgaatgaccgtcttctcgcgacagttagcggatgcgtacacgcgtcgcgacaccctaccgccaagggaccgccgtcacgccagtaggatccttcccgcggatggagcccgtcgccacgggggcgccgataggaacacttccgtccggcaagggaattggtgagctgtgagccagatcgtcgtcaagcgcccaccgcgggccctgcccaccgaagtgccggtcgagcaggtgcagttgcaacccccgccggaactcccccgaggccagcaggagggggcgctgatgcagctcctgccgatgctgggcatgggtggttccgtcgtcttcttcttcatgacgccgaacccgatcatgcggatcatgggcatgatcatgatcgcctcgacgttggccatggccatcgcgatgctcgtgcgataccggcggggcactcagggagagctggcggacatgcgccgcgactacctgaagtacctgacgcagacccggcgcacggtgctgaggacggcccgcaagcagcgggacgcgcagttctacctccacccctctcccgagcagttgtgggcgctcgtcgccgagggcagccgcgtgtgggagcggcgtgccggtgacgcggacttcgcgcaggtgcgcatcgggctgggcagccaggagctggccacgccgctcatcgcacccgagacggcgcccgtggacgaactggagccgctggccgcaggcgcgatgcagcagttcctggcgacgcactccacgctggacggtctgcccatggctgtctcgttgcgggcgttctaccacctgacgatcagcggccacgcggagtccgcgcgctccgcggcgcgggccgtggtcggcgggctggcctctctgcactctccccaggacctggtgatcgcggtcgcgaccggcgcggaggccgctccgcagtgggagtgggcgaagtggctcccgcacgcccagacctccgggcccgtggacggagccgggagtcggcgcctcatcaccaccaacgccctggccctggaggaactcctggcgggccgcctggagggcaggccccgcttccagcccggtggacagccgctcctggagcagccgcacgtcgtcgtgatcctggacggtgagtcggtgccccccatgtcggtgctcgcctcggcggagggcctgcagggtgtgacggtcatcgaggtggtgccgggtgaggtcaccgggtcccgcgggggcctgtccgtcgtggtgcagccgacgtcgttgcagctggaatcgggccaggggctcgtctacgacggggttccggacctgctgagctacgaggccgccgaggcgctcgcccgccagctggccccgctgcacatggccacgggcggggacgacgacgaacctctgctggccaacctggagttcaccgatctgctgaacctgggggacgccgcctcgatcgaggtcagccggacctggcggccgcgatcgcaggcggagcggctgcgggtaccgatcggtgtgggcgaggacggctcacccgtgatgctggacctcaaggaggcggcccaggagggtatgggcccgcacggtctctgcgtcggcgccaccggttccggcaagtccgagctgctgcgtacgctggtgctcggtctcgccgtcacccacacctcggagacgctcaacttcgttctcgccgacttcaagggcggcgcgaccttcgccggtatggcgcagatgccccacgtagcggccgtgatcaccaacctcgcggacgacctgacgctggtcgaccgtatgggtgactccatcagcggtgagctcaaccgccggcaggagatgctgcgcgacgcgggcaactacgcgaacatccacgactacgagaaggcgcgcgcggccggcgccccgctgcagcccatcccctcgctcgtcctggtcatcgacgagttcagcgaactcctcaccgccaaacccgacttcatcgaaatgttcgtccagatcggccgtatcggccggtcgctgggcgtgcatctgctgctggcctcgcagcgcctggaggagggacggctgcgcggtctggagacgtatctgtcgtaccgggtgggcctgcggacgttctcggcggccgagtcccgggccgcgatcggtgtgcccgacgcgtaccaccttcccaacgtgcccggttccgggctgctcaagttcggtacggaggagatggtccggttcaaggccgcgtacgtctccggggtgtaccgctcgggcgcgcaccgggccgccgcgccgggtgcgccgcttccggtggaccgcaggccggttccgttcacggccgcgccggttccggtgcggtacgtccagccggcggcgcaagccggaggcgtaccggatcagcgctcggcgcaggacgacgcgctggcggacacggtgctcgatgtgatcgtgcgccgtctggagggccgcggggcctccgcccaccaggtgtggctgccgccgctggacaatccgccgtcgctggacgagctgctgccgggactctccccggtgcagggccgggggctgacccagcccggcttcgagggagccggccgactggtcgtgcccctgggcgtcatcgacaagccgttcgagcagcggcgcgacactctctaccgggacttctccggtgccgccggtcatatgcagatcaccggtgggcctcagtcggggaagtcgacgctgctgcggacgctcatcgccggtttcgcgctcacgcacacaccggaggaggtccagttctacggcctcgacttcggtggcggcggcatgtcctcgatcgcgggtctgccgcacgtcggcggcatcgcgtcccgcctcgaccccgagcgggtacgccgtacggtcgccgaggtgtacggcatcatggcgcggcgcgaggagtacttccgcagcgccgggatcgactccatcgccacgttccgcaggatgcgggcgcgcggcgacatctcggtgacggaccagccgtggggtgacgtcttcctggtcatcgacgggtggggcagcttccggacggactacgagggactggagtcggcggccacggacatcgcggcccgcggcctgggttacggcatccacctgatcgtcacggcgtcgcgttccatggaggtgcgggccagcctgaaggaccacctcatgaaccgcctggagctgcggctcggcgacgtgatggactccgaactggaccgcaaggtggccgccaacgtgcccgccggggtgccgggccgcggtctgaccccggagaagctgcacttcatggcggcggttccgcggatcgacagcatcaactccgacagtgacctctcggaggccaccgcggcgatgaaccaggaggtcgcccgccactggacggccgcgcccgcgccggcggtgcgtctgctgccgcgcgcgctgccggcgagtcggcttccggccggctacgcggtaccggagcgcggcgtcgccttcggtatcgacgagaacaacctggagccggtgttcctgaacttcgagcaggacccgttcttcctggcgttcggcgagagcgagtccgggaagtccaacctgctgcggttgctcatcaagcagctgaccgagcggtacgacggtgattcctgcaagctcttcgtcatcgacaaccggcgttcgctgctcgatgtgaccccgcggtcgcacctggcggagtacatcccgatgtccaacaacatggaacatcacatggcggcgctgcacgacctgatgaagcgccgcacgccgtccgccgacgtcacggcgcaggaactgcgcgaccagagctggtggcagggtcccacggtgtacgtcgtcatcgacgacttcgacctggtctccacgtcgagcggcaacccgctgtcaccgatcacggaactgctgccgttcgcccgcgacgtgggcgtccgcttcatcatcgcccgcaatacggcgggggccagccgggccctgtacgaacccttcctccagcgcatgatcgagctgggcgcacagggcgtggtgctgtcgggcgacccgaacgagggcgacgtcctcggcaacgtacgaccgcgcccgatgcccgcgggccggggaatcttcgtcacccggcgacgggggaacccgctggtgcagacggggttggtggaggtgtagcggcaggcccgcgaagcggggagggggcgggacgcacggatgttcgtgcgtcccgccccctctcgctttcgccgccggccgggcggaccgccgggcgcaggctcgggggccgcggaccggcctcgggacacagctcagggtggacacctcccgcgcgtgtccaccctggtgtgctgtgcttggtgctttggtgctgcgttctggtgctgtgtgctttggtgctgcggtgctgtgtgctctggtgctgtgtgctttggtgctgggcttgaactccgttagaagttcgctgccgcccgcttgtcaccgctgcggtagatgggcgacgcctcgctgaccttctgagcgatgtcgttgaggttgtcgcggatggcgctggcgtcgttcctccaccgctcctgggcgtcggcgtaggcccgcttcgcctcgccctcccacagctccgaaacccccgcgatcatggtcctgatcgcttcgaggtcctcggcgagctgcttgccctgtcgcttgatctcggcggccgcgagatccaggctcgcgtaagtgacgaccgtcgtaccgtcgttgttgcccatgtgatcctccgctgaattcgagttacgggatgaggctcagaagtcgttcaggctggacgcccggttcgtcgccgcgctggagtggccttcgacgacgtccacacccttgagggccgcgaggatctcgtcctcgttgttgcccgagatcgtacgggcggccttgatggactcctggaagtggagaagctgcttggccaggctgaccatgcggttgttgatctgctcctgcttcgcgttgaagtggttggcgccgatgccctgccacttgccctcgaggccgtcgatcgtcgcgtggagcttctggagctggcccttcaccgagtcgaacttgatggagaggtcgccttccagcttcaggagcgcggcatctgagaccttctgatctgccatggttctctttccctttcggttggttctgcaaggccggcacaggccgccggccggtacatgcggaacgtgcggtcaagcggccttacgcctgcggaccacggcgtaggccactccaccgagcacgaccacaactgcggccactccgaggaccaggcccaactggctttcgtcccccgaggacttggtaccttctgccgccacgggcttgtcggcctccgcgccgttcttggcgggctgctgcgaggcggagtcggcgggcttctcggacgactcggcggggccggtcgtcctctccttggtcagcgggctgacgtccgggtcgccgggctcacccttgcccttgaggatgttcatcgaagggcggatcagaccgtgaccgaggtacttgctgcgctcgccgtccttccagtcgcggctggctgtgtcgaagaggacgttgagtacctggttggcggtccagtcggggtggagggaccagaggagggcggcggaggcggaggcgatggcggtggcggcgctggtgccgccgtcgccgtcgcagtagctcttgaaggagttgtcgcaccacccgggaacgtcgctcccgggggaagccacgtccaccgacccagagtgctgcgagtagtacgagacctttccctgacggtctgccgaggcaacacccacgacctcaggataggaggctgggtactgcttccggttctccttgttccccccattgccgacgccggcgatgaccagcttccccttgctttcggcatatttgacggcttcatgctcctcgagcccggagaaatcatcagccatggacacgctgataatctgcgcatcgctgtcggctgcggctcggatggctttcttcatgtcaccgatgacagttctgcgcttcgacataaagccgacgtcgctcatgcgcacaggaatgatctcggctcctggggcgagtcccttcagaccgcctcccttgcctgtcccggcgatcaactcagccatcgtcgtaccgtgaccgcggtagtcgtcggtttcgtcgccgggcgcccctgttgcgtcgaagcccttgagtacctgcccttgcagggacggcgtggccgagttcacgcccgtgtcgatgacagcgactttgatgccttcgccggtcgtgactttccacatgtcctcagcctgcatcgcactgaggtaccactgcttcgactgtgtgtcggctgcggcgggctgcgccgcgccgacgaacaacacactccacgaagcggccacagccagcgcgccgagcccacgcacgcgccgctgagctcggcccattcctgctgtcatcccgacttccgaaccttccctgggactgctactcgaccaccggcggcacggctccgcgccgaccggcattccacgtctcttcgtcttccgtcaggtagtcgggacgggtcgaaccgttgtcgtcctcttcctcccggccggaattccgccgaccggcagggccacggacgagccctgccccaccggccgtgaagcccttgttattcgatccggctcccccagccttgcggggagcgcccacgactccgttggctcccgaagcctgagcgggccgtccgccgggccgggatgcggcagccgccgctccgcgtcctccgatcacgccccgctggccggcagctccggtccttccctgaggcgcattctgaggggttccgccgacgatgccggttctccctcccccacggtggcctccgactgtggacgttcctccttggccggtaaccggtcgtccaccggtcggagtggatcggccagtgatcggcgactggggcccgaccggcggacgggtggacgtccctccacctcccatggggctgggacggccgaccgggggcccacccgggcccttggccacgggccctcccccggtgggctgcgccttacccaagccggggcctgccgggttcaccgtccgttgcgttgcaggccctgtcgtacgcggggggttcccgtgcgtggtagtcatgaaggggggcggcacggccgtcggcggcaaccccgtcggcccggtggggggcgtgggagacggtagcgatggtgcgctggggattgtcgtcggagcctgagggggcgcaacgttgtttatttccgtagcgatgcccgtgcccaccgggggagcatcgccgagaacttcaacctgcggccgaccggcggccgctcccgtggtggagctgccggcgaccgaatggttcgaagagcccggtgcggcaccgtaaccgagagtctcggggctcgccgaggcggaggaggagggaaggggagcccggccgacatcaatcggctgcggcatgctgataccgaggcttttgtcgaaccgcggcggctcctgccccgccagcacttcctcggagaccgagtagtacgacgccaaccggttgatctggttgatcgcctcctggcggttcttctccacctcaagcgcagccgcgtactgcgggttcgtctcggtccgggccgggaacaggatgtccttcacgtccgtctggatcatccggctgtcacgcggcggcatggcgctcttcactgatgccaggccggtgcccgcgaccgtgatctgggtgccggccgcgtccgcgaagtcgcccagcttctcggcgtgggcgaccaggcccgtgccgaaggcccggaaggccgtaccggactcaccctgccagtcgacccccttgaggtggtccttcagttccttcgccgcgcgccggatggcgtccctggccttccagagtgcctcgccggcgctctccaggtgttccgggttggagttctccaccatgtcgatgagggcgttgagctcgtgtccctcgaaggaggtacggcctccggtgcgggggttgccgaagccgaaggactccatggcccggccgagcgtctcggtcatgtccgtgacgacgatctgggtctggacccgtccctcgtcctgcttcacctgctcggcaggcgtcaggctctcctggttctcgtcgctcattccgctgcccacccggagtccgactgctcgtcattattggtctgttcaggcttggactgctcggccttcgccgccttcgcgtgcttctcgcgttcctgttccatgcgggtctggatctcgtagaaccgccgcctgatgtcgtcctcgacgttgtcgaagccgaccgccgccgcgtgcacacccaagctcaggtactcgatctggtcgccgagcgacttggagagcgagacgagggaggagtggacccggttgtactgggtgtagaggccgtccgcctcggcgaagcgcgcgttcgggccgctcagtgaggcccgcgagaccttctgttcggcgaccttcgtcttgctggccgccgagccctcgaagtctgtcagcaaggcgtcgacacgcttcttgaacgtctccagcgctcccactccgcgcctgaggtcccccgtaccgccaccgccacctggatcggtcacaatgccgtcctccccgttccgcatccccgtttgctcggatcatcccgcgttgctaatgcactgccgcggtccggtccgatcccatcccgacaactctagtcactgcctacgacagcgccaatcgacttgagcgccacgtgacttgtctcatgactggctcttcaccgttcttcaccgttcccgtcgctacgcctcgcccgccagtcgccccgcgcgtcgccgcttgtcccgtaccgccacagccgtacccgcgatggccgccaccagggcgccgccgccgaccatgacgtacgtcgccaggcgggcgttccgctcgtcggccgtttcgcccaggtggagttctgcgggggtgggggctttgcccttgctcatcccctcgccggcgatcgggcggtcgatcggtctgtcgtcctcggtgagggcgcgtaccgggtccaccacgccccagccgaccaggcggtcgtggcccgccaccgagcgttccgccgtctgttgcatctgcgcgacgatctgctcctgcgtccagccggggtgcttcgccttgatcagggcggcgactccggcgacgtacggggcggagaagctggttccgttgtcggcgcagtggccgccgccggggaccgtggagaccatgtccaccccgggggcggcgatgccgacgaagtcgccggactgggagaaggccgcccgttcgttgttccggtccgaggaggcgacggcgaggacgccgtcgaaggacgccgggtaggtctccttgacgttgccgccgagcccgtcgttgccggccgaggcgacgaccacgatgtcctgggcgagggcgttgtccacggcctgcctcagggccggggacggcttcacggcgtccgcggtgtcctgggagatgttgatgatgtccgcgcccgccttctcggtggcgtagcggatggcgtcggcgagggtctcggtcgttccgtggccgtcggcgtcgttctgctggagcgggatgatcgtcgcgtcgggggccaggccgctgaagcccgtgcccttcatctcgcgcgcggcgatgatgccggcgaccttggtgccgtggcccacggtgtccgtggtgccgttctccttgccgcgttcgatcttcgttccgtcgtcggccttgaggttcttcggcaggaagttgcggcccgccccggtgtccacggcgggcttgagctgtttgttcctgacgtcgacgccggtgtcgatgaccgctacgcgtacgcccttgccggtggactgcttccacacctcgtccagcaggacgcgttgcaacgcccaggggcggcccgggtagttcttcgaggggaacgtgcactgggtcgagtcggccgcggccgccgggagcgccggcagggtgacgacgaggacggccgctgccgccgtggcggtgagcaggcggcgggccgggccgtggtggtgggtcgccatgtccgtgcccccgctcacgaaccctgcggctggctggccgcgccggtggagagccgggggccggtcggcaggagggcggaccagaccgccggtacggggttggggtcgacgtccttgtagccgagccggttctgcgcctgctgcgcctcctcctgctgggactcccgctccttcttcgagccggattcgccgatgccggagtcgtcctggccgctgtcgctgttggactgcatcgcgtagcgcaggccggtgtcggtgaccaggaacaggaagccggcgctggtggtggatcccttgaactgacggaagaactcgcccgatcccggtgtgacgtaggcgctgctggagccggtggggagcgtcgcggggaagctcgtgcccacccaggtgctcagcgtggtggcgccgctgtccgcgtcgacgccgcgcagtacgttgcacacggtgtttcggctgcccttcgtgacgtccggggagttgacgggctcgggcttgctgaccggccagtccctcttctggttgaagggggctcccggttcgagttcgccggcgctcacccccttggcgttgcccgcctgcttgagggataccagctgccggctgctgagcaggagcttggcggtgaagtccgagacgggggcgaccctgcccggcaggacgacgtaactctgggtcttggttcccgccgtcgcggccaggaccatgccgaccctgttcgtctgatcgtccagggtgccgggagcgcccgcgggggctccgggggtgccgtccacggtcgggaacgtgatcggggccccggtgtggagcgtggccagccaggcggccgagacccgctggggcttggtgtcctggccgaccagggtgcgcaggagcagttcgtccttctggacggggtaggccttgccggcggcgtccacgatgtagcgggtccggtccggtccctcgacgtacatcagttcaccgccccccagggcgttcttgccctcggtcttcttctcctcgcgctcggcgaagatgaaggtcgccttctggatggccctgcctccctcgccgggccgctcgcagaccgcccagcgcttggccgcgcccgcttccttggagtcgggcagccggtcgggggcgtacgggatgccgagcgtcgcgccgtgcggaatcttgccgctgtccaggaccgattcgttgacgttgacgaccgtgcccttgtccggggcgagcaggagcttggcggaggccatgttcaggacggggtgcaactgcttcttgccgtcggtctccaacaccacgtagcgggtggtggatttgctggcgatgatgacgtgttccttgggggcgtcccacttctggggggccaccggcttgaacatgccccaggcgccgaaaacggcgagaaccacgacggcgatgatggccccgggcagaaccgcgcgcagcggtttgggggcgccttcctcggaacctgtggggttgggttgcaggaactgtgcgatcaacctccgcttcgcaaaggtataggcgttgagctcatcccgccgtgatgccatgtgtccgctgacccttctccccagtgatcgaacagggtcccacacgcaccgtcggcccccgctgccgtaccgcgcacccactatgcctgccggggttccgctccctgtgctcaggtagggtgacgacccgatcaacacccgtgtaaaaagcggtgaatacggacacgagggggcaacgcggcgatgggtgcagctacgcgcgagcgtaccgggcgggccggccgtagaacctccgggacttcccggaggcaacgtagcaacgagtcgcccgcgacgcctcccgctcggccttccggcacccccggacagaacgcgcccgccgcgacgacgctgcgttcgatctcacggaccgaccgggtgcgccccgtgctgcggcagatggtgatcgtcgaggtgggcctcgtgatcgccgccgtgggtgcgacgctcggcggcgcctggctgatcccctcgctcgtggtgctctgcctgctggtcgccctcgcggtggtacgccggaggggccgcgcgctccaggactggatgtcgagcgctctcgggctccgggcccggcgccgggccgccgccacgccgccctcggacgcggagccgatgctggcaccggtcgccgagaacgtgcccggcttcggcccgcaggtgtacgtggaccggactcaccggacggtgggcatgctcggcgacggcacgttcctgacggccgtggtgcgcgtggaggcgagcggcgagtcgctgcggcccgcgttcggcgcccggtcgctcccgctgtcgctgctgggcgacgccctccgggtggacgacatcgtgctggagtccgcgcagttggtgcagcaggtgcggtgcgctccggctccccatctgccgcagcagtcggtggcccggctctcgtacgcgccgttgcaggaccagaccggtgcgcccgccctgcggatgacgtgggtggcggtgaagctggatcccgagctgtgccgtgaggccatcgaggcgcgcggtggcgggctggagggtgcgcagcgttgcctggtgcgggtcgcggaccatgtggcgagccggatcacgggcgccggtttccaggccgaggtgctggaccaggacgagttgaactccgccgtggccacctccgcgtgcgccaatcccatcctgtcggggcgggcgggccggcccgacgccgcaccgcagcggcgcacgatggagacgtcccgggtctggcggtgcgacgaccgctggcacaccacgtacgcggtggaccgctggcccgagctgggccggggcgcgacgccgctgccgcagctggtcgcgctgctgacctcggtgcccgcgtacgcgacgacgttcagcctgacggtgcgccgcggggcgcgccagggctcgacgagcgtggcaggccatgtgcgggtcaccggcggttcggacaccgaactgatcggtgtgagaaggacgttggagcaggcagcccggcacgccaaggtggggctggcacgactggaccgcgagcagttgccgggcgtcctggccacgctcccgctgggaggcgcacagtgagcaaccggaccgagccccggcgcgggctgcgcggcccccgtcacgcgggtcacaccgtggccgcggatcacctgggggcgctgtccctgccggtcggcgacgacggcgtgatcatcggcaacgacgccaacaacaagccgcagttgatcggcttccaccgtccggtgccgtacgacgtcacgctgatcggcggactgtggacggcacaggtcctggcgctgcgggcggcgggcaccggcgcccgggtggcggtcgagaccggtcgcgtccaggcctggaccacgctcgcccaggcggcgggcgccgggctggagtgcgtgtccctgtacgacgtgggccgtgttccgccgacgggagcgaccgtgggcagccccgtggtcgtcgtgcgggactgcggcatgcgcccgccgcgcggccgggtggtgtcctcgccgtggcagtccgtactgacgctgcttccctatctgagccctgtcgcaccgcggttgatgcggtcgtccgcgctggtgggcatccagcgggtctcgcccggcgaggccgagcagatcggccggatcctggggctggcgcgggccgagtacgaggcactgcccacgctggcggacggtgtcaccctctgggttgcggggcgcgaacaccattgggtgatgacgaacgcgacggacgccgagaccggtctgctgggcacagctcgccggatggactgattcctgcaccgttcggcccacgaacacccctcccgccggggaacatggaccacgcaccgaatccgttcgatcgaagggacgccgtcatgggcacccagcaggaaaaggacgagctctacgctctcgacatctcggatgtgacgtggctcagtgcgcccggcaccgaggaggccgaggagcgggtcgagatcgcgcatctgccgggcggcgccgtcgccatgcgctcctcgctggacccggacaccgtcctgcggtacaccgaggcggagtggacggcgttcgtcctgggcgctcgcgacggtgagttcgacctcacgtaggtccggcgtcacgtaggtccggcgtcacgcaggtccggcgtcacgcaggtccggcgtcacgcaggtccggcgtcacgcaggtccggcgtcacgcaggtccggccccgcgggggtgcggagcgccgcgaagggtggccgccggagtgagcttccgccttcaccccgtacatgtggagtgaacttccacccttcgccctgtacgtgtatggcatgaattgaccgtctcgtcgcaccctttccgtcgcacgtggttcaccggggtgcgacacgtggcccgtggggcggggtttgccgtgccccacgccctgcctgagttcaccggatggcgattagggtgggtggggcgcggcggaagaaacctgcgagcaggtaatgcgcgtcgcaagggggagagccgggcggaccggcacatcgggaacggtcgcccccacccaccacggcacaagggtgctcgaccacaccaggaggcaaagtgaacggcgatcgggacgagatccgcggcggatgggacctgcccgtcgacgagtcgtccgacgcggatcccgccgagatgacgggtgagttcaccatcgactacacccctcccgcctggtacacgcagaacgcggcgggggactcgtcgggaggagcgggctcgcacctggccccccctccgccgccggtcgggacccctctgtcctcgcccgacctgtcggcgaggcccggcggcttcgaccccaactgggcgcccgaacctccggcgcccgccgagccggccgtccccgcagctccggaggctccggtctcccccgccgtgccggagacgccgcacgttccgactccgcaggcgcgggttccggacgctcccgctccgcagacgcacacgcaagccgcggacggtccggctccgcacacgcaggccgcggacgctccggccgccgacagcggggacacgggtccgttcggcggcgg

SEQ ID NO: 2756 - DNA, 3962 bp, Unknown
  Kingdom: Bacteria, Phylum: Actinobacteria, Class: Actinobacteria, Order: Streptomycetales, Family: Streptomycetaceae, Genus: Streptomyces
agaccggcgccgaggaaccggacgacgccggcccgggagagggccaggagctgttggaggcgcggtcccggcgggccggaggccagatagctgaagaacccgtgccaccagccgccgatgtcgccgagccggacgagctgggcgtaggcggagagcaggccgaggaagaccgcgaggtcctcgctgtgttccgggtcgtgacggcgggtcaggtcatcggcgatgtaggcgcgcagcgcttcctggagtgcctcgggcgatgcgtggctgacaccttccaggggacggtcgagtgcgtcgaggtcgagccggtcggcggggtcgggcacggcctcggcgacgatcccggccagttcggggctgcccgggtcggcggcggcgtacttctccgcgaatacctcgtgggccagggcggtgcgctcgggatgggcggtgaacagccggtggtagtgggcgtggcccagctccttcgcgaccaccggccagacatcgcgccgaaagtcgagcggcctggtccggctcagcagttcgtcggtccacttcggccccaagtgctggggcagcggcggtcgttcaccggtccagccgtagccgatcttcgcgtggtacggaacgccgcgccgcgatccgacatacagcacgggttcacggcccgacggcaggtagaccccgttctcgtggcgtccgccgcgtccttcggtgagcaggaccatcagatcgatgaaggcgagcccgaaaccccggacgatgaccggctccccggggcgcagggcgccgaggtcgctgtcggcggtgaagtcggggggcagatggaccaggccgtgccgccgggcgaaggcgctcagccgctcctgctcgggctcccgctcggcgtcgaggtggcccacggtcaggacgacgagatcggcggacaggggttcggtacggccctggagccggacgcgctggcggccgccgcgcggcccggtgacggcgagggcggtggtgcggtgctcgtgcacggtgatgccgggcggcagagtggccagagcgcggtcgtaggtccagcgcagataggcgctctggaggcgccgggtggggaagtccgctccggtgaggccgtgtatctcggccaggacggcgggatccgcgtccgggacgacacggcccgcgcggacgtcctcggcccaggcgtccagggccggacccgccacgacggggccggccagttccaccgtctcgtcggtgaacatggtgacgtcctcggccatggagttcatccacagcagcggcgactggtcgggacgccagatccgcccgccacccgccgggtagggatcgaccaggtggatgtccaggcgcgcattcccgtacagctcaccggcgttagcggcgatgcgctcgatgactccggtgccccgggggccgccgccgatcaccacgacgctgggtgcggaggtcatcgcgcacccgctgtgccacgggcgtagtaccgctccacatagcgctggccgatgctcagcagcgtcgtgacgaccgcgtaccagacggtcgcgacgagcagcagcgggatgacctggtaggtgcggtggtagacgagctggacggagtacagcaggtcctgcacggcgatgacgctgacgatggaggtgcccttgagcgtgccgatcagcatgttcccggccggcggcacgatggaccgcatcgcctgcggcagcacgatgcgccggaaccgccgccaggggccgaggccgagcgactgggcggcctccacctgtccgcgctcgacggagaggatgccgccgcgcaccacctcggcggcgtacgcggcctcgtgcagggtcagcccgatgacggcgatggtgaccgggccgaggaggctgaccgtggagacgccgaggatctgcgggtacagggcgccgatgttgaaccagaacagcagctggaccaggatcggggtggaccggaacagccagacgtatccccagccgacggcctggagtacggggttgccggagaggcgcaggaccgcgagcaccgctcccagcacgaagcccagcgccacgaccaccgcggtgagccagagggtgagccagagtccgcgcaggacggggacggtggcgaagtaggagagcacgacgtcccactggaaggcgtcgttgcggatgaccgagttcagcgccagcgcgagcagcacgaggacggcaacagccgctgcccaacggcctgttcggcgtacggggacgatgtgcggcaccgcgtcggcatcgtccttgacgagcggccgggaggagggagggggcagcgagacggtctgcgggggcatgcgggagctccgtggatgctcagatcgaacacggggcgtgccttcacaccggaaaccacacacgggccgggcccctcagcgccggtccgtctccgagataagcggcgtacggcgggagttgtcaagcctgtccacactgtgagccgtacatctcacctcggttgacgcgcactcggatgcctgttccacttggcccatgcatccgcagcagtggctggtcacccgctcccacatcgacttcggtcgcgtgtggtcctcttcctgttgagctgaccctctgctgtccggttcttcccgctcacgcctccttcccggcgttcgagccccgttccccgtgtgacttcaccttcaccacaccgcttcgccctcccctcgcgccagtgaactccttccgtcgcccctccgggccgccgctgccccgtgccgccgcgacccgggggtggtcggcctcccctgacgaacccggagaagcaccgccatgtcccgatcccgacataccgccctgttcgccctgatcaccgtggccgcgctgacactcaccgcctgcgcggagccgaccgacaccgcggtcggcgggtccgacgaggtctcctccagggggaagaccccgacgacggacgtcgtctcgaaggtccgcaaggacgaggccgcggcgaagctgctgcctgccgaggtccgtgaggcgggcacgctgcggatcgcctcctccgtcggggccccgcccggggcgttctacgaggaggacggctccacggtggccggtgcggacatcgacttcgcggacgcggcggcccgggtcctgggactggagctgaagcgcgaggtggcgtccttcgaggcgatccttccggcgctcggcagcggcaagtacgacctgggcacggggaacttcggcgtcaccgacgtccgccgcaggacgatcgacttcgtgacctacatcaacgacgggcagggcttcgctgtccgcgaggacagcggactgaagaaggtcaccgacctcacccagctgtgcgggctggacgtggcgaccggggcgggcaccaccttcgaggtgaccctccaggagaatctgccccggtgcgcggaggcgggcaagaagccgtacaacgtcaagacctacgccgaccaggcggccgtctggatctcgctccagcagaaccgcagcgatgtggtgatgtccaccatcaacgggctgcgctacgcggtgagccggcaggaggggctgcgcttcctcaacgagttcaagcggctcgacgtgggtttcgccttcaagaagggcaccccgctggcccccgccttccaggccgccgtcaaccggctcaaggaggacgggacctacgaccgcatcctgaagaagtggggcacctccgagtccgcgatcgggacatccgagatctcgccgcccgagctgaagtgagctgacgtcagccggtgggcctcagcagtcgcagccgcaggactccccgcaacagcagcagctctcgccgcagtcgccgcagcagctgcaggcctcgcagcagtcgccgcagctttggcacggcgcttcccgccgctccctgctccaggggtcctcgaagctcccgcagcacatctggcaggtgcaggcgagcccggcccagaccaggcatccggcgatcagcccgcgccggtcgcgggg

SEQ ID NO: 2757 - DNA, 1562 bp, Unknown
  Kingdom: Bacteria, Phylum: Actinobacteria, Class: Actinobacteria, Order: Streptomycetales, Family: Streptomycetaceae, Genus: Streptomyces
cgtaccggtccgcgtacgggtcctcgtacgcgtccccgtaggggtcccggtcggcctcgcgcacggtgtcccggtgattgcccaccgggctgctcaccgtgtccgacgcggagtcgaagcggtcgtcgaggctgtcggccgcccggccgggaccggtgtcctgcgcggcctcgtcgtacagcttgcgccaccagtcgtcctcgtgggcggcgggcttctccccctgctgactcatgcccatattgtccaccggcgaggcggcccgaaaacgggacatcgggaaaatgtggcccgtaaatgggtccgccgggcggccccaccccccacgggaaggacgcccggcggaccggtcggagtgatcggcaggtcggcgttgcagccgttcgcacgatcggccgatcacggattcatcggatcagcggttcacccgcccactggtcggcgccgccgcttcagcgcacgacgtacgcgtcgtcgacggtctggaccacggagttgccgttcgcgtcgctcagttccgttcgcagcgtgacggacttcccggtcgcgtccgcgtggtcgacggtcgcggtccagcggccggcctgctgtgcggtggtggccgcgtgccaggtctcgccaccgtcgtaactgaaggagaccttcgcgccggtgagttcgccgggggtgtatccggcgtgcccggtcgcgccgagcccgatcgtctggccgttcttcgcggggactgtcttcatgccgtcggacggcacgtcgtagcgcgggaagagcagcgggaggccttgggacgccacgtccggcttccgctcggaacggaacgcccaggtggtctccgtccgcgtggaccgcttccagacctcggcgggcgagccgatcttcgtggtcatcagggtgagttcgtaagcggcgtcctcggcgggcacggcgaaggcgccgaacggatagccgctgctgccgacgagttccccctcgctttcgagtcgcattccgccgatgtcgccgaacgagccctgctggccgctgtgttcggagtcggtcatgaacgccggggcgacgccgatcgtgttgtcctggcgttcaccggcgagcagctccgcaccctccgcgtcgcgcggggcgccggggaccagcaggccccggtaccactcctccttcagggcccgacctgcctggtacgtgcgggcgtcgcccgtcatcagctcgccccaggggaagctggaggagagcatcttctgccagacggtgtcccccgccgtgtagtactcggtgcgctttccgggggcggcgaccacggcgagcgaggacgcgccgaaggtcgcgccgtaggggcgggacaccagcagcgtgtcgacgaagtcggctgccacgcccatggattcatgggtggagacgaccgagccgagcttcttgtcgcggaccttgtaagtgcggtccgaggtgacctgctgctccgggaacgacaggttgtacacgaacgggctgacggccgtggcggtccaggagacctccgtcttccccttgccgagggccgtcctcagcacggcggcctcgtccgcccgcaggcc

SEQ ID NO: 2758 - DNA, 10270 bp, Unknown
  Kingdom: Bacteria, Phylum: Actinobacteria, Class: Actinobacteria, Order: Streptomycetales, Family: Streptomycetaceae, Genus: Streptomyces
cggaacggccgcgggccgcgcggtggggttcaccgtgcggcccggggcgggggttctcggggggtcagcccttgcgggtgttgatctcctcggtgagctgggggacgacggtgaagaggtcgccgacgacgccgtagtcgacgagttcgaagatcggggcctcggcgtccttgttgatcgcgacgatcgtcttcgaggtctgcatacccgcccggtgctggatcgcgccggagatacccgaagcgatgtacagctgcggcgagacggacttgccggtctgcccgacctgactggtgtgcgggtaccagcccgcgtcgaccgcggcacgcgacgcacccacagcagcacccagactgtcggccagcgcctcgatcagcgggaagttctccgcaccgttgaccccacggccacccgagaccacgatcgcggcctcggtcagctccggacgcccggtcgactcacgcgccgtccgcgacgtcaccctcgtccccctggccgcctcaccgaacgacaccgccagagcctcgaccgcacccgccgccggggccgcctcgaccggggcggagttcggcttcaccgtgaccaccggaacacccctggagacccgggacctggtggtgtacgacgcggcgaacgcggcctgcgtcgccaccacaccctgctcaccggcctccagatccgtggcatcggtgatgacgccggaacccacccgcagcgccagacgggcagcgatctccttgccctcggcggacgacaccaccagcaccgcgaccggcgacaccgcctcgaacgccgcctgcagcgcgtcgaccttcggcaccaccagataatccgcgaactccggggcatccgcggtcaggaccttcaccgcaccgtgctcacccagcaccgaagcggtcgcccccgcgccggcacccagcaccacagcgaccgggtcaccgatacgacgggccagcgtcagcagctccagggtgggcttgcggaccgcaccgtccacgtgatcgaccagaacaagaacttcagccatgacaacgcactccagacgagaaatgacgagagagaggaacagcgggaaaggacatacgggctagatgaacttctgacccgcgaggaactcggcgagctgcctgccgccctcaccctcgtccttcacgatcgtgcccgccgtccgcgccggacgctcggtggcggaatcgaccgccgtccacgcacccgcgagaccgacctcgtccgcatccagacccagatcatccaggtccagcgactccaccggcttcttcttcgccgccatgatccccttgaacgacgggtaacgggcctcacccgactggtcggtcaccgacaccaccgccggaagcgacgcctcaagccgctcggacgccgtgtcaccgtcacgccgccccgtcaccacaccaccctccaccgcgacctccgacagcaaagtcacctgcggcacacccagacgctccgccagcaacgccggcagcacacccatcacaccgtccgtcgacgccatcccacagatcaccaggtcgtacccggtcttctccacagccttcgccagcaccagcgacgtccccatcacatcactgccgtgcagatcgtcgtcctcgacgtgaaccgccctgtccgcacccatcgacaacgccttgcgcaacgcgtccctggcatcctccggacccaccgtcaccacggtgatctccgcatcgtccgccccgtcagcgatctgcaacgcctgctcgaccgcgtactcgtccagctccgacaacagaccgtcgacatcctcacgatccagcgtcaggtcatcggcgaaacgccggtcaccggtcgcgtcgggcacgtacttcacacagacaacgatcctcaagctcacgccggctctcctactgcatcgtcatttctgggctgccttgttgcacgcagcataggcgccttgtcgggccgaatccggtcaggacgaccgaggctccgagccagatattactcgccagtacacccagtctcttacccctgggcaagcgctgcgcactgtgaccttgccaacgcggcgggcctgtgcgtgcgcaccctcagtctcgcagagccgtgaaccgtccctggtggtagaccagcgggcgaccggctccggagggcgcgcccgccaccgcctcggcgatgacgatgcggtggtccccggccgggacgcgggtcacgacgcggcagacgagccaggcggacacgtcggcgagcagcggaacgccttcggggccgctgctccactcggtcgacgggccgaagcggtcggctccgctgcgggcgaaggtggcggccagttcgtgctggtgctctccgagcaggtgaacgccgacgtacgcggcctcggacagcacgggccagctggaggaggacgtaccgataccgaaggagatcagcgggggttcggcggcgacggaggtcagcgaggtggcggtgaagccgaccgggcgctcccccgcggcggtgatcacggccacgcccgcggcgtggcggcggaagaccgagcggaagagttcgggagtgacgaccgtcggggcgggggcgaggtcgggcgttgccgtcatgaacgtgtccttctgcggaagtggcgtacgggtccgtgggtgctcaggcacccggacagcgcgcactcgcgtggcgtgcgaggtccacatggacccggccgtagagaaggagttctggcggcataacgtcagactgacgatgcggggcgggcgcagtcaagggcgttccggaatgtgggagatgcgtcacggtccgtcatatggcgtgccccagcgccgcgacgacgtcgacggtgcggggctggccggaggcccggcgtaccacctcgccctcggcgtcgagcaccaggacggtcggcgtcttcgtgatgtccagctgccgcaccagcgcgaggtgcgcctcggcgtcgacctcgatgtgggcgaccccgtcgaccatcccagccacctcgccgagggtgcggcgggtcgcccggcacggctgacagaaggcgctggagaactggacgagcgtcgcgcgctccccgagttccgcgccgagttgggaagcgtcgagtcgctgtccgggtgttcggcggtccacgtggtgcctcctgatcagagctcttcgtaggggtcagcaccggtcgccgcccggacattcccgcagctcccgacgcgcatgcacgtgacgagaatctcgcgccccacgtccaccgggactggccagcggctcgcgcatggggcaccatcgccacaatgccgaaaacctacggctgcgtaacttccgccgggagaacctccccaggcgctgaagaagggtcttctccagatggcagaactcgtctatcgaccggtcatcggcgccgctcgcaccctgttcaaggcgctcgacctgaagatcgacactcagggttcggagcacatcccgaagaccggtggtgcggtgctggtcagcaaccacatcagctatctcgacttcatcttcaccggcctgggcgccctgccgcagaagcgtctggtgcggttcatggcgaaggaatcggtcttccggcacaagatctccggtccgctgatgcggggaatgaagcacatcccggtcgaccgcgaccagggtgaggacgcatacgcccacgcgcttcggtcgctgcgttccggtgagatcgtcggggtgttccccgaggccaccatctcgcagtccttcacgctgaagagcttcaagtcgggtgccgcgcgcctcgcccaggaggccggggtcccgctgatcccgatggcgctctggggcacgcagcggatctggacgaaggggcggccgcgtaatttccagcgcagccacatcccgatcaccatccgcgtcggcgagcccatggaggcgccctccgaccagtacgccggtgccatcacccggcgactgcgggagcgtgtgcaggaactgctggaggcggcgcagcgggcttacccggtgcgcccgaaggacgcgagcgacacgtggtgggtgccggcccatctcggcggtacggccccgacacccgccgaggtgcgcgagctcggctgacagccgtcccgcgacggggcgacgggtgggttcagaggtgctcggggaggttccgccagagctccgagcggtcccgggcgccccgcagcgcgtggagaatcaccccgggtggtgcagcatgaactaccgggtagtcgatttcattgaactcttcgcgcgtgacccacgccagccgctcctcccccagggagaactgcgcgtcgacgcccggcttgttgccccggggatccacccgcgcccagcgcgcggatccggggagccgcagcgcgaccagtccgtggaccatcgggttcgtcccgtcgtcgtcggcgagacgttggtagcagagcccggccgggatggagcgggcccgcagcagggccacgagcgtgatcgacttcgcgtgacagatgccggtccggacggtgaggacctcggaggcgcgccaggtgacgcgcgggtcccccgagtcggcggagtgcgcaatggtgtcgcggacgaactcgaaggcggcccgcgcgtatgcgtatgcggtgtcggcaccgtgcgcgaggcgggccgccgcctccacgacgcggggatgctcgtggtcgatggcctcgtcgacggccaggtacgcgcctatgtccggggactgctgcgtcagctccatggccggagagcgtacgaagcggccgaccagaagtccatcaatttccggtcggccgcatagtcatgcaggtatcgcgctatcgcgccatctcttccttgagcgcctggaggaaggcgtcgacgtcgtcctcgccggtgtcgaacgcgcacatccagcggacgtccccggccgcctcgtcccagaagtagaagcggaagcgcttctggagccgctcgctgaccgcgtgcggcagccgggcgaacacggcgttggcctggaccgggtagagaatctccaccccgtcgatggcccggacaccctcggcgagccgctgcgccatggcgttggcgtgccgggcgttgcgcagccacaggtccctggcgagcagcgcctccagctggacggagacgaagcgcatcttggaggcgagctgcatggaaagcttgcgcaggtgcttcatcgcccggaccgcgtccgggttcagcacgacgacggcctcgccgaacagcgcgccgttcttcgtgccgccgaaggacagcacatccacgccgaccgtattggtgaaggtccgcatcggcacgtccagcgaggcggcggcgttggctatccgcgccccgtcgaggtgcaccttcatgccgcgctcgtgggcgtggtcgcagatggcgcggatctcgtcgggggtgtagacggtgcccagctcggtgttctgggtgatcgagacgacctgcggcatggcccggtgctcgtcgtcccagccgtacgcctgccggtcgatgagctccggagtgagcttgccgtccggtgtgggcacggtgaggagtttcagcccgcccatccgctcgggcgcgccgccctcgtccacgttgatgtgcgcggactcggcgcagatgacggcgccccagcggtcggtgagcgcctggagggcgaccacgttggcgcccgtgccgttgaagaccgggaaggcctcggcggtggggccgaagtggctgtgcatgacgcgctggaggtggccggtgtagtcgtcctcgccgtaggcgacctggtggccgccgttcgcgagggcaatggccgcgaggacctccgggtgcgcaccggcgtagttgtcactggcgaaaccgcgtacccgcgggtcgtggtgacgtcgcgcgtcggtcctcacgtttgcggagtcagccacaggcgctttccgttcacttcgggggcgggcttgtcccagacgccggcgatggcctcggccagctccgtgacgtcggtgaaacccgcgaacttcgcattcgggcgctcggcgcgcatggcgtcgttcaccagtgccttgaccaccaggatcgcagcagccgccgcgggcccgtcctcgccccccgccttgcggaaggcgtcgccgagcgcgagggtccatgcctcggcggcggccttggcggaggaataggcggcgttgcccgcggtgggcttgctggccccggcggcgctgatcaggagatagcggccccggtcactgcgctcaagggcctcctggaaggccagcgaggtcgactggacggtgcggatgagcagcttctccagggcgtcccagtcggacagcacggtctcctggaacgacgggctgccgcgccagccgccgacgaggtggaccaggccgtcgatgcggccgaactccgcctcggtgcgcttggcccagtcacgggtggcgtcgaggtcgagcaggtcgatggtctcgccggtgacggtcgcgcctccatgggcgtaccgggcggcgtccaccgcctcggcgagccgttcggggtgggcgtcgcatccgacgaccgtcgcgcccgcctcggcgagccgcagcagcgtcgcccggccggcgggaccggccgctccggcgaccgcgatcacagctccttcgagcacacccgtcccctcgcccgcgccgttcgcgttcatggccaccgcctcctcgggagaatggttcacgcggctgcccgctcgtcgttcgccgcggtgattcccttggtggaggcaatcacgtgcttcagcttcttggcgagcgcctcatagaacatgctcaggggaaactcgtccggaagcacgtcgtcgacgagcttgcgaggaggaagtgtgaggtccagggcgtcggggcccttggcccagcgggatcccgggtgcggagccaggtagctggacacgaggtcgtacgcggcgaaccagtggaccagcttgggacggtcgatgccgtcgcggtagagcttctcgatctcggcgcagagctggttggtgacctggggtgcacggtcccagtcgatcttcagggtgttgtcggtccaccggacgacgtcgtgcttgtgcaggtacgcgaagagcagctggccgccgagtccgtcgtagttgcggacgcgctcgccagagaccgggaagcggaacatccggtcgaagagcaccgcgtactgcacgtcacggccgtgggcgttgccctcggactccagcttcacggcctccttgaaggcggtgaggtcacagcgcagctcctccaggccgtacatccagaacggctggcgctgcttgatcatgaacgggtcgaacggcaggtcgccgtggctgtgggtgcggtcgtggaccatgtcccacaggacgaacgcctgctcacagcgctgctggtcgccgatcatctcgcggatgtcgtcgggcagctccaggccgagcaggtcgacggaggcctccgtgacacggcggaagcgggcggcctcgcggtcgcagaagatgccgccccagctgaagcgctcgggggcctcgcgcacggcgatggtctccgggaagagcaccgcggagttggtgtcgtacccggcggtgaagtcctcgaaggtgatgccgcagaagagcgggttgtcgtagcggttcgcctccaggtcggcgagccactcgggccagaccatcttcagcacgaccgcttcgagattgcggtcggggttgccgttctgcgtgtacatcgcgaagacgacgaggtgctggagaccgtcggtccggttcttcgcgggctggaaggccagcagcgagtccaggaagtcgggaacgcggaagccgtcggcggcccagcggcgcaggtcggagacgagcgcgcggtggtaggcggcgtcgtgcgggaggagcggggagagctcctcgaccgctccggtcacccggtcgagcacctgctcgacgacggcaggggacggggcgccctcggcctcgaagtcgatggatccgtccttggactgccaggggcggatctcctcgacggcatccttgagcacgggccaggcagggtgctcgaccacccgctgggccgtagctatcgcgccgtcggcggcgtcgtgcacaagaatttccgtcataacacttcctccacgggagaacctcgcgtggattcaccgtagccgtgcggggttcctcccgacaagtggggacctgaaaattatcctgcgtaccccccatggtcaccgctgtttttcctgtcgtatcccggggaggcgcacagttcaatcagccgctcccgggtacgggcgaccgggcccgcacggcgggggacatcgcgggccgcggccgctaccctccccagtgccgtattgcctacctccgcgtcgccctacctccgcgcgggcaggagcagtcgacggaccgccgccgacggaaacgaggtcgccttgtcatttctcaccctgggtcatcgcggagtgatgggcgtcgagcccgagaacaccctgcgctccttcgtccgcgccgaggcctccgggatggacgccatcgagctggatctccatctcagcaaggacggcgcgctcgtcgtgatgcacgacgtggacgtggaccgcaccacggacgggtccggaccgatcgcggccaggaccctggcggagctgcgtgagctcgacgccggtcagggcgagcggatccccgtcttcgaagaggtgctggaggccgtctcctccccgctccaggcggagatcaaggacgtggcggcggcccgcgcgctggcggacgtgatccgcgagcgggatctcgtcggccgggtggaggtgtcctcgttccacgacgaggccgtcaccgagatcgcccggctggttccgggcgtacgcacggtcctgatcgccagccgctggggcgcggacgtggtggaccgggcgaaggcggcgggcgcggcgacgctcgcgctgaacatccgccgcctcaccctggaggtcgtggagcaggcgcactccgagggcgtgaaagtgatcggctgggtggtgaacacccaggaccacctgcgcctcgcacgggcgctgggcctggacggcgcgacgaccgacttccccgagatccgccgcgccgggcgcttcaccgcctgaggcggtcctcctcaggcgccttccccgacgtcgctcccctcgatgttcttgacgagcagttcgaaggccaggtcgtcgcgctgcggaacaccgaagcgctcgtcgccgtacgggaacggggtgagctgtcccgtacggcgatagcctcggcgctcgtaccaggcgatcaggtcctcgcgcaccgagatcaccgtcatgtgcatctcaccgacgccccaactctccctggcggtgcgctccgcctcggcgatgatcagcttgccgagtccgccgccctggagtcccggccgcaccgcgaacatcccgaagtaggccgcgtctccccggtgttcgagctggcagcaggcgacgagttcgccgccgcgctcgaccgcgaggagccggcccgccggagcgtcgaggacctcacgcacaccctgttcgtcggtccgctgcccctggaggatgtcggcctcggtggtccacccggtgcggctggagtcaccgcggtaggcggactcgatgagggccaccagcgccggtacgtcgctctcggtcgcgtcgcggaagctcagccgggccgagtcggggggcgtggccgtgtccatggtgggatgctccgtttctctgctgccgtacgcacatctctgctgccgtacgcgtttccctgctgccgtacgtacggtcggggtcttcgccgtcgcacgtgcggtcgagagtaacgcgacccggagcgcccccagcgggccccggcgcacccccttcacacccccgtgcgccggattcggcggcggtcgcccgggcatcgatgggacgacccgtaacagtgccgtacgtccgaccggggggaggcgcgccgtgcacggaggggccctggccggctggctgctgatggcgttgtgcgcggtgagcggcgcctactgcctgctgcgcgcccgcgcggggacgccacaggagcgccgcaccgcgcgctcggaggcgctcatgggtttcggcatggcggcgatggccgttccgaccgcggtgctttcacccccggactgggtctgggcgctgtacgcggtgctcttcggcacggccgctctgcggacgctgcggcccgccctgcgcggcggccaccatctgcaccatctcgtcggctcgctggccatggtctacatggccgtggcgatggcccccgcgatcacggggagcggcgggggcgggcacgccggacacggggcggcggcaggcgccggcggcatacccctgctgaccggggcgctgctcgtctactacgcgttctacg

SEQ ID NO: 2759 - DNA, 7900 bp, Unknown
  Kingdom: Bacteria, Phylum: Actinobacteria, Class: Actinobacteria, Order: Streptomycetales, Family: Streptomycetaceae, Genus: Streptomyces
  misc_feature (135)..(293): n is a, c, g, or t
gtgtcggcggacgcgctgcggccggccggggagggggagacggtgggcgatctggcccgccggatggacgcgtgggtgccggtgggcgccccgctgaagcaggcgttcagcgagatgctccagcacgacgcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgactccgtggcggacgcgtaggggtgcggacgggatacgaccatccagtcttgcccgcgcttgcacataacccgcgtatgcaattattgttgacgccagtaaccgtcgtacgccatgaatgccggtgtgcgacgcgtacgacgcacaccgcgctaccggaaggccgtcacatgtccaccgttcccaccgtcacgctcaacaacggcgtgaccatcccccagctcggcttcggtgtcttccaggtgcccgacgacgagaccagcgcggccgtctccgccgcgctggaggccggctaccggtccatcgacaccgcggcgatctacggcaacgaggtcggcgtgggccgggcgctggccgcctccggaattccccgcgaggagctgttcgtcaccacgaagctgtggaacgccgaccagggctacgacaccaccctcgccgccttcgacgcgagcctggccaagctcggcctcgatcacgtcgacctctacctgatccactggccgacgcccgcacacgatctgtacccggagtcctggcgcgccctggagaagctggcggccgacggccggatccgcgcggccggggtctccaacttccagcccgcccatctgcgccggctgctggagacgagcacgctcgtccccgccgtcaaccagatcgaactgcaccccgggctccagcaggccgagctgcgcgccttccacgccgagcacggcatcaccaccgaggcctggagcccgctggcccagggcgccctgctcaaggaggaggcgctggtctccatcgccgagcggcacggcaagtcaccggcccaggtggtgctgcgctggcacctccagctcggcaacgtcgtcatccccaagtcggtcacgcccgagcggatccggcagaacatcgacgtcttcgacttcgaactgtcggccgcggacatggacgccgtcgccgctctggaccggggcatgcgcaccggcccggaccccgacaccctcaactgatccggtgatccgggcggccgaaccgcccgtcagcgtccgcgccggtagccggcgccgtcccgggtccggaccatcaggcccgcgacgaccagatagcggcgcagcgcggcgcagtcctcgtggacggtgagcagcgcctcgttcacctcgcgctcggtgtacgcgcgctcccgctcgaacagcgtgtcggcgaggtgcgtgagcagttgctcccgccgggcctccttgcgtgggatcgcgaccaggcggccgtgcgagaagagcgcctcgacccggtggtgcgaggggtctgcgacagcggcgcaggggtctcttgttcagcgggcatggccggaagcgtcgcaggcatccggaggacgggcaacgccttttcggcgttgcccgtcctcgcgttgacagacccgtaccgcccgggttgtgatggtgcacgtgcagcgtgacgccggccaaagagatctgggccggccggcggtcaagccagcaccttcttcccagggatgacgccatgagtccactcatcgccccctgcctctgagcacctcagcctccgcgcgcttcgccgcactccgcgacgccgggccttcgcctgcccgcattcctccgggagacccagaacctccatgccccacgccttccaccagtccgtcatcaccgagttccgcgccaacgcggggaaggtcggcggccccttcgagggcgccgatctcctcctgctcaccaccaccggcgcccgctccgggaagccgcacaccacaccactcggatacgtacgcgacggccgccggctcctcgtcgtcgcctccaacctcggctcaccgcaccaccccgactggtaccgcaatctcctcgcccgtcccaccgtgcgggtggagttcgggaccacggagttcgagtccctcgctgtaccggccgaagggtccaggcgcgacgaactcttcgcccgcgtcgtcgccggggcgcccgggtacgcggagtatcaggacgccaccgaccgggtgctgccggtcgtggtcctggaactccccgaccccgacgcgacggttcccgcgatcacctcgctcgccgacaagctggtggaggtgcacacctggctgcgcggccagttgctccatgtggccgccgagacggaggcgtacttcgccgcgcgggcttcccacccgggcgggggcgaaccgcccgcacccggcctcgggctccagatccggcagcgctgtctggcgttctgccaggcgctggagttccaccacacggccgaggacggccatatgttccccacgatggaggcctaccacccgcacctgatcgacgtcttcgaccggttgcgggaggagcaccgcaccatcggagccgtgcaggcggcgctcgccgccctgctggccgaagtcaccatcgcggagccggaccgcttccgcgccggactggcccggatgaccgaggagctgaccgcccacctcgaccacgaggaggagcacctcctgcccctgctggccgatgtgccctggcccccggcgccgcccgcctcctgaggcctgggtggctcagcccttcgggaggagcttcttcgactccaggtaggtgcgcgcgacgtcctcgggcagcctgcgccagctgtcgacctgctcgttcatcgacgccaggtcggcggtggtcagcacggtgttgagccggccgagggcgtcgcgcaccccggtgctcccggcgcgggcacggttgacgacggggacgacgtagtccgcgttctggagcttcttgtcgtcctccagcaggacaagaccgaactggtccagtgtggcgtcggtcgtggtggtcaggaccatctggtcctgaccactctgcaccgcctgcttggcctgggtggtgccgacgcccttcgggtccacggcgacgacgtcgatgccgtacgtctcgcgcagcccgggtgcgcagtacggccgttgtacgcattcgtcgcccgccgccagccgtacgggcagcttcgccgcgccgacgtcgctgagggtcctgagcccgtgcctcttcgcgtaggcggcggtgacggcgaaggcgttctggtcgacggcccggccggggtcgaacacggtcaggccgcgcggggcggcgagcgcgcggagcgccttcatggtggcggtccggtcgggcgacccgacggggggtgcgtcggcgccgttggccttggcgttcagccagtcggcgaaggtcgccgcgtactccggtacgacgtcgatctggccgttctccagggcgggttcgtagatctcccggttggtcacggagatgatgtcggtggagtacccggcgtgctccaggagcagcgcgtacatctgggccagcaggtcgctctcggtgaatccggcagatccgacggtgagttccctgctgtcgccgggcggtgcggtgacctcgccctggttctccagcgtcgggccggtggtgcaggcggtggcggcgaggagggccagcgcgtctcgccccccggcgggtgcggctcatgcggcctcccgtccacgccggggggcgagacgctgcccggcctcgaagaggctctcgacgaggagggcgaaggcggccaccaggatcgctccggccaccacctgcggggtggaggcgaggttgaagcccgcggtgatgatccggcccagccccccgccgccggccagcgccgcgagggtggcggtggccaccagctggacggcggcgatccgcacaccggtgaggatcagcggcagggcgagcggcagctccacgcccagcagcatctggcggccggtcatgcccatcccccgggcggcccggacgacgtcccggtcgacctcgcgcatcccgacgtaggcgttggtgaggagcggcggcacggcgaacaggacgagcgcgatgatcgtcgaccactggccgtgggtgccgatgggggtgagcaacagcaggaccaggacggcgaaggtgggcacggcccggccgatgttggagacattgacggcgagtgcgccgcccttgccgaggtggcccaggacgagggcgacgggcagcgcgatcacacaactgatgagcagacagacggcggtgaggaagaggtgttcaccgagccggttccacacgccgtcggggccggaccagtgggcggcggtggtgagccaggtccaggcgtcggaaagggtgttcacgccggcctccccctgctgagggtgttcacgcctgcctccccctgcgcggtgtcctcacgcctgcctccgggtccagggggtcagcagccgtcccgctcccaggagcagcaggtcggcggcgacggcgatgacgacgcacagcacggaggcggtgagcacctgggccttgaagtaggtgttcatgccggagtagatgaggttgccgagaccgccgtgaccgacgatcgccccgacggtgaccagcgagaccgcggagaccgtggcgatgcgcagcccggccatcgcggcgggcagcgcgagcgggagctccacggcgagcagcaggcgcagcggcccgtatcccaggccgcgtgcggcctgccgggtctcctcggggacggcccggagcccggccaggatgttgcggacgagcagcgtcagcgagtagaggacgagccccgcgatcaccagcgcggcggagagtccgtacagcggcagcagcagcgagaacatcgccagcgacgggatcgtgtacaggaccgtcgtcagaccgagcaccggaccggccgcccagcgccaccggcgggcggcgagcgccaggggaaccgcgagcaggagagcgacggccaccgaggcggccgtcagctggaggtgttggagcaccgcgtccaccaggatctcgcggcggctggagaggtaggccccgcagatccactcgttacgggcgaggcagtcgtccgggggcgccgtcacccgtccattcgagcgcggcaggggacccgtcgcgcgtcgggggccgccgttcgggggtgtttgagcgagtgctcaaccctctggtagcgtccccgcgcacagggttgagcactcgctcaatacccgtggcgaccgggggcgggcatggggttgtacagagaagcgttgatccgtaccgatccggagcgcctgtgggcacgcacccaggatccgggtcagcatcagcggtgggatctgcgcttcaccgagatcagtcccgtgcccggaccgacgggttccgcccagcggttccggtacgcgacccgggtgctgcccttcctgacggtcgcggggaccgggacgagcgcgggcgagcggcaccgggaggacggcgagcgggtctccgcgctgcgcttcgcctccccggagaagctgtcgccgctgtccgagggcagcggctactggcgctacgttcccaccgccgacggcatccgcttcctgaccggttacgactaccggacccggtggggccgcttcggctcggtcgcggaccggctggtgttccggccgctgatgggctgggcgaccgcctggtccttcgaccggctgcggctgtggtgcgagcgtgacatcagcccggtccggtcgctgacgcacgctctggcggaggtcctggcacggagcctcgtcgtggcggtggccgtccccttcggcccggcggccgtcctgcccgccgtcctcgccgcgctgctggcacccccgtccccgctcacgcccgccgcccggcgctgcgagggacggggcggcggccgcccggccgccgccccgtccctcctcgcccggctggagcgcccgtgacctcgatcttcgcccgtgcgatgggagacgacttcgatcggctccacccccagctgcgccgacgcttctcggtcggcctggagagcggggaggcgtgcgtcgggcgcggttccatggaccggatctggcacggccgggcgttcgtgaaacccttcctcgcgctcggtgccacgcgcaacatcctggtgccgcggaccggccgcgacgtcccgttcaccatcgagaacgtgccgtacaccgacggccacggccgtgagaccgtgaccttcgtccgtacgttcgccctgccgggcggtccgcgccgcttcgacgccacgatggtgcacagccccgagcggtcctgcgtgctggactacctcggtacccaccagcacctggccaccgacctgcggctcaccgcggagcccgacggttcgctgctcatccgctccggagaacaccgcttccgcgagggacccgtcgatgtgcgggtccccgggctgatcgggggcgacgccgaggtccgcgagtccttcgacgacgccacgggccgcttccgcatccgggtcgcggtgaccaaccgccgcttcggcccgctgttcgggtacgaggggacgttccgcgcccgctatgtcgacgccctgcgccacggcgtacgggcgggcctgcgcccggtccgcgaagaggcgcgggcgtgacggggagcgcgccgggggcggacacccggacgaagcttctggagggcgcgctgcgcaccctcgccgaacaggggatcgccaaaacgtcggcccgctcggtggcggccgcggccggggtcagccaggcgctggtcttctatcacttcggctcggtcgacgagttgctggcggcggcctgccggcacggcgcggagcaacgggtggcccggcaccgcgaccggctcgccgccgtgacgaccctcgccgagctgctgaagtacggacgtgagctgcacgaggaggagcgggcaggcggccatgtcgcctttctcgcgcaggtgctcgcgggagcacagacccagccccggctggcgcccgcgaccgcggccgggctcgacctgtggaccgccgagatcgagaaggtcctggtgagggtcctggcggactcgccgctgggcgagttcaccgaccctgcgggactggcgcgcgccgtgaccgggtcattcgtgggcctggagctgtacgagggcgtcgaccccgcgggggccgggcgtgccttcgacgcactggagcggctcgccgagctggccggagtgctggacgagctcggcccggtggcccgacgcgcggtgcgccaccggctgcggcgcacggggagggcgtaggaggcgtcccgctgcgggaatgcggaacgagctgggtatcccgagcaaccctcttcgcccggctgccgtcttgatcgatgacaggacggttcgccgcgtgtgacctgcggcgtccaacccccacaagatccgggcctgcacgaccggcggactataccccccgcgtatacacggtgggtatagtcacgccggtccgggcccggcaccgcgcggaaggcccccatgcagaccaaggcactggcgcccgagtaccagggagcactcaccaagatgtcggtgaacgcctccctcaccgacgtactggccgagggagtacgccacctgaggcaggccgagctctccggatcgcaggaggaggtggcgcgttcgggcctcgccgtggccgaggcgcaccgcaggctcgggcaggtcgcggaggccgaccgggcctggaaggccagttatcgggccgcccggacggccgggagcaccggggcgatggcttgggcactgtggagcggcggcacgctggcgcgccaacgcggggcgctgcgcctcgcgttcaggctgctcggcctcgccg

SEQ ID NO: 2760 - DNA, 16899 bp, Unknown
  Kingdom: Bacteria, Phylum: Actinobacteria, Class: Actinobacteria, Order: Streptomycetales, Family: Streptomycetaceae, Genus: Streptomyces
gggttcggcgtcccggacgggcgggcgggactgccgtacgggaggctcgtccgccacccagtcgggggtgaacggctcctcctgggcgggtgccagctcctgcggcgcacggcgcgggggccgggtgccgacggggccctggatgctgaggcgcttcttgttcaggtaggcgagcgcctgtgcctccatctcgttggagtggatctggccgtcggcgaccatggagaacagccggtcgacccgctccttctcgtcctgccggccctcctggcggatcttctccaggaagttgttggccgcctcggggtccgcggccagcatgtggctgagctgctccagctcaccgccgcgcagcatccggaggtagttctcctgccgcatccgtgccagcacggcgtcgctctcgtggctccggaccttctccgtgtggccgatcgtccggtcgtccacccgcagccgtacgtacagccgcacccgcagtccgaggtcggtgccgaggtcgttccaccggccggagacgcacgcgtgggtgatcgcggtgttggcctgctccgcctggtgcaccgggaactgggcggagatctcccgcagccgctccagggccggagcggtgagccgctgggcgatgtcggtgaccacctgcaccgccaccagatgcgggtcctcgacggtccagtggatgtccacctccgccttgaagaacgtcgcgccgccggacgcggggagctccatccgcagggtggtgacgaaggtgccggtggcgatctcgcagatggtatgaggccgccaggccagcggcggcctgtcgtagtgctcgatgccggagacaccggccacgctgtagccccgccggtagaacagcaccgacgtggagcgggctccgccctgccggaacgggcccgtcggcgtgtactcccgcaggaacggacccgcgggccgcgaggggtccaccgccccgttctcggccacgccgttctcctcagccatgactctcctcctcctcggaccgccgctgccgcgcgggcacggcgagcctccacagggcgcgcgcccgttcctcggcgagcgggcggtcctgatccctcatcattcggcgcagcagccagtccagccgccgccggtcgtgctcctcggcggtcagggcgggcagcagcgcggccagtccctcccgcgtccactcgcggccgtccttgcgcgaggcggagcgcaacagcgcctccagggcatcgagcgccacatcccgggaccgtgcggtgttgagcgccgtccagaacaggtccgccagcttcccggtcagttcgggccgggtcgcggccagcgcgagcagcagcggccagtccccccggtcgcccagcggggtgccgggctcgtcgtcgaggacctcgtccacatcggtcagcgccagccggacgatgctcaccagcgcgaggtcctggtactcctcgccgcggtggccggcccagtcggccagccgccgcagtacggtggcgcactccgggagcgtcagcagccggaccacgttcagcgaggccacggccaactgctccccgtcgtcgcggaccccgatccgggccagcgcgtccagggtgtcgtccatcgagtcggcggaccggccgtagcccagtgccatggccgccgtccagcgcagggccggcgtgccgtgccgcgaccagtcctcgaccaccttgcgcaccgcccggcggtgcgaggcgtgacctgcggcctgatccagcgcggtggcggcgaagaccctgcggcgcggcgtgggggcttcggcgagcggccggaccagctccgcgtacccgtgctcgaagtcccgtacggacagctccccggcggccaccgcggcgcgcatcgacacctggggccgggggtcgtcggcgaggagccgcagccagcggacgaccggggcgcggacggggaagtgccggtcccagagctcggcgagcacggcggcgggcagcgcggccccccggtagaagatcagccgtcccgtcacctcggcacccgccacgtcgacgggcccgtcggccggccgggcgcgtgagagcgccaggtcggattccgggtcgtcgcagaacaggggccgggcgggggtgctgtccggatcgctctgtacggacagttcccaggtcagcaggtgggcggcggcggacaccgcgctgtgcgacgcgccgccgaggaccgcgagtgcgatccggaacgccaccgggtggaacagggcggcggttccggagcgcacgggcgtccgcccgtcgccgggcggcggggcggccagggcccggtccaccccggcgaaccactcgtacgcctggacggccgcgagaccgcggcagccggacagcagctcctcgcggccgacggagcccaggaggtgtccggccagcagcgaggcgaacagctcggcctcggcgggccgcaggtcgtcgaggcccaccgcctcggtgacctcggggtcctcgcgcagctccgccgcgcgctccagcagccgggagagcgaaccgggcctcgtccgggccgccgtcgctcaacccgcgttcacccgtgccgaagtggcggcgcacggtctcgccgtcggcgtccagctcgaccaggcggtgccgggtggtgtcggagaccaggaaccccccgtccggcaggagcagcgccttgccgggaaagcgcagatgcgtggcgacgggctcgggcgccacgtaggggccgtcgccacggcggagtgtgcccttggcggcgtgctcggcctccagctcctcgacgagcttctcgatggcgtgcgcgtgaccctcgcccgcgtgctgggcgacgacgtaaccctcggggtcgatcacgacgagcgtcggccaggcccgtacggcgtactgcttccaggtggccagctcggggtcgtcgaggacggggtggtggacctcgtagcgctcgaccgcgtcgacgacggcctgatgctcggcctcgtggacgaacttcggcgaatggacgccgatgatcaccacggtgtcgcggtgcttctcctccagctcgcgcagctcgtccaggacgtgcagacagttcacacagcagaacgtccagaagtcgaggatgacgatgcgccctcgcaggtcagcgagggtgtactgctggtcgcctgtattgagccagccgcccttgccgatgagttcgggggcgcggacgcgtgcacgtgatgccatgccaccagtcaacaccgtgacggcctgcacgcattccgccggaccccgggggaacctgtgacgcatgagacttctcgtacgtgagcggctgttcgccatcggcgacgactactggatcgaggacgacgggggccgcaaggtcttcctggtcgacggcaaggcgatgcggctgcgcgacaccttcgagctgaaggacgccgacggccggatcctggtcgaactgcggcagaagctggtcagcctgcgcgacacgatgctcatcgagcgggacggggaggagctggccaaggtcaagcgcaagcggctgtcgctgctccgcaaccactaccgggtgacgttggcggacggcacggagctggacgtcagcggcaggatcctggaccgcgagttcgccatcgagtacgacggcgaactgctggcacagatctcgcgccgctggctgaccctccgggacacgtacggcatcgacgtcgtccgggacgacgccgacaccgcgctgctcatcgcggtggcgatgtgcgtgatcgtgctggcggacaaggagagcgaggactgagcgcctgcccgcgcgggagttcgttgtttcacgtgaaacgtggagcccggggcggtctggtccgaccggggctcatcccgcctgtcgcgcggcggcccgccggtccgcctggacgaaggccgcccccgcgagggcgacggcggcagcgaaggagaccgcgagggccgggttgagccaggacgggacggtcccgctgttgaacacccggccgtcggtggtgcggcacaggatgtgcaccgggaggtagcgcacctcgtgcgtctccacctgagcgcgttccggcacgtcggacgcgtacacgcactggtgcatgggcgtcgagttcgttcccgacccgacctcgctgaccgtgaggccgacgaggaggagcccgagcaggtagaggacggccgtggcagcgccggcgaagatcgccgtgccacggagcaacgtcgattcggcggcgccctgttcagccatggcgctcactgtagacagggcgtcgcgaccgcccccacgggcagccctcagagcggcggggccagccccagccgccggtccttcagcgccgggaactgctcccgggtcgcacgcaccttgtccgggtccagctcgacggtcaggacctcttcgtccgcgccggcctgggccagcacctcaccccaggggtcgacgacgatgctgtgcccggcctgctggatgtcgccgtgggtgcccgccgtcccgacggcgagcacgtatgcctggttctccacggcgcgggcctgcgccaggagcgtccagtgggagcggcgacgctcgggccagcccgccgcgacgaccagcgtctcggcgcccgcgtcgacaagtccccggaactgctccgggaagcgcaggtcgtaacaggtagcgagtcccagggtggtgtccggcagggcgacggtcaccaactcctcgcccgcgcccatcatcaccgcctcgcccttgtcgaagccgaagcggtggatcttgcggtagacggccgtgcgctcaccctggggcgagaagaccaggctggtgttgtaaagggtgccgtcggccgcccgttcgacgaaggagccggcgtgcagccaggtcccggcctcggcggcggccttcgccatcatctcgtgcgtgggaccctccagcggctcggcctccgcctcgaaggcggtgtaggcgaacgccccgaccggccatagttcagggagaaccaccaggtcagcaccccgctgggccactactgacgaggccactcgtaccctgcggtcctcgacggattcgtccgggtccactgcgatctggatgagggaggcgcgcacactaccaccgtcctggcattcgagccgtcaacacgggcctacgatcgtcacacgaaagcactgccggggtgcctgctcgcagcgtaacttagcggtcgaacctcccacgcagctcgccgacagcgccgtcagtgccagcccacccgccagcactccctgctctccagcccatgcaccgcagaaccgcacgaggggtcccgtgaccgtccatcccagcctccagccctacaccgacgccgcgacccactccatcgaggcgatagccgagctggtgaagcccctccccgagggcgagtggaaccgccgtacgccctgcccgggatggtcggtgcgcgacatcgtgtcgcacgtcatcggcatggagtgcgagatgctcggcgacccgcggccgatccacaccctgccgcgcgacctctaccacgtacagagcgacttcgcccgctacatggagatgcaggtcgacgtccggcggcaccacacctccccggagatcaccgccgagctggagtacgtcctcatccgccgggcccgccagatccgcaacgagtcgcgcagccccgagaccaaggtccgcgcgccgctgggcgccgagcagaccctcgaaacggcgctgaacctgcgggccttcgacgtctgggtgcacgagcaggacctgcgcgccacgctcgggcagcccggcaacctcgactcccccggcgccctgatcacccgggacatgctgctcgccggactgccgaaggtggtcgccaagaaggccggcacgcccgcgaattcggcggtcgtcttcgacgtgcacgggccggtggagttcctgcggacggttcgcgtcgacgcggagggccgcggttcggtggacggcgcgccctcgctgggccccgccgtgacgctgtcgctggactgggagacgtacgtccggctcgcctgcggccgggtccgtcacacggcggtcgccgaccggatcaaggtcgagggcgaccaggagctggccaccgcgatcctggacaacttcgccgtgaccccgtaacaccggtcccgcgccccggcggcgcccgtcccggaccatgggcgacgggcgcgccgccgagcgcgaaggagacggctacgccggtacgtgcacggcctcgacgcggctcaccacgtggtgctcacgctccctgagcgccgcccggcggcgcagccgcaggatctgggtgacgccgagcgcctccaggacgaagaccgaggcgaacgcgatgcggtagttgtcgcccgtggcgtccagcaggaccccgacggcgaacagggtggtcatcgaggcgacgaacccgcccatgttgacgattcccgaggcggtgccctggcgctcgggcggattggccggccgggcgaagtcgaagccgaccatcgaggccggtccgcaggtgccgagcaccacgcacaggacgaccagcagccacatcggcgtgtggtcggccgggtagaagatcgcggacgcccagagcagagccgtcgtcgccaccgtgcccagcgcgatcgggacccgtgcctcgtggtggcgcgcgatgatctgcccgtagacgagccccaccaccatgttggacagcaccaccagggtgagcagtgtgcccgccgtgccgcggctcagcccctgcgcctcgacgaggaacggcatcccccacagcagcaggaacaccatcgccgggaactgggtggtgaagtgcacccacatccccagccgggtccccggctcccgccaggaggcggcgatctgccgacggacgtacgcggccccggcgtgctcggcgggcggcggctcgtggccctcggggtggtccttgaggaacagcaggagcggcaccagcacgacgacgccggccagcgagctgccgacgaacgtcgcggtccagccgtagctgtgcagcgcccgcgcgatgaacagcgtcgagacgaggttgcccgccatcccgaacagcgccgcgacctggccgatcagcggcccgcgccgggccgggaaccagcgactgccgagccgcagcacgctgatgaacgtcatcgcgtcgccgcagccgagcagcgcgcgggccgccagcgccatgccgtacgagggggagagcgcgaagccgagctgcccgacggtgaacaggacggccccgatggtgaggaccttcttggtgccgagccggtcgaccatcaggccgacgggtatctgcatgcccgcgtagacgaggagctggaggatcgagaacgtggacagcgccgaggcgttgacgtcgaaccggtcggcggcgtcgagtccggcgacgcccaggctcgtacggaagatgatcgcgacgaagtagacggcgacgccgatgccccagatccagccggcacgccggccgccgggcgggtcaccgggcagcgacagggtgggcgcggccgccgaactcaccggtcctcaccccgcaccagcacccggacccggccgacatggcggcgcacgaccagcgcagccccgtcggcgtccccggcccggatcgcctccagcagctcaccgtgctcggtgatgttggccgcgatcctgcccgggtgggcctccatcaccgcgacgcccatccgcagctgacggtcgcgcagctggtcgtagaggcgcgagaggatctcgttgcccgcgttcttcacgatctccgcgtggaaacagcggtccttgacggccacggcggccaggtccccaacctccgccaactgccgctgctcctccaggagctgttccagccgggcgatcaactgcggagacgcgggcaccgccttgcgcgcggcgaactcctcgaccagcagccgggtctccaccacgtccttgatctcctgcgcggagacggcgagcacgagggcgcccttcttcgggtagagcttgatcagcccctcgacctccagccgcagcagcgcctcgcgcaccggcgtccgggagacgccgaccgcgtcggcgaggtccccctcggtgagcagcgtcccgccctcgtagcggcggtccaggacggcttccttgatgtgcgtgtagacgcgctcggcggcgggcggacgcttcagggaggaggtcggcggctgtacgggggcagagggcgcggcaggcatgcacacagcatagatacaacatgcacgcatgtcggcccccgtccggattctggacctccggcgggcctaccgaaagaacccgaacagttcaggcttctctgaattcaggctttcctgtactgtctgtcccatgctgaccctcgcttccgacatcgaggtgctcgcgcggttcggccgcgcgctcgccgacccgatccgctgccgcctgctgctcgcgctccgcgaggcgccggcgtacccctccgacctcgccgacaccctgggcatctcccgcacccggctctccaaccacctggcctgcctgcgcgactgcggcctcgtcgtcaccgtgccggacggccgccggacgcgctacgaactggcggacgaacgcctcggcagcgccctggacgacctgcgctccgtagtggttgccgtcgaatcggaccgcacctgcccggacgcggagacgaagggctgctgctgatgaccgtgctctccctgggcccctccccggcccgccgggacgcgctcacccgccggatacggcttctggtcgcggtcaccatcgcctacaacgtcatcgaggcggcggtcgccctcaccgccggaacgatggcctcctccagcgccctgatcggcttcggcctggactccgtcatcgaggtctcctccgccgccgcggttgcctggcagttctccgcccgggagcacgcggtgcgtgagagccgggagaggacggctctccggatcatctccgtatcgttcttcgcgctcgccgcgtacgtcgccgtcgacgcggcccgagcgctgaccgggaccggcgaggccgaaccgtcccccctcggcatcgtcatcgccgccctctcgctggcggtcatgccgttcctgtcggccgcccaacggcgggcgggacgcgagatcgggtccgcctcggccgtcgccgactccaagcagaccctgctgtgcacctacctgtccgccgtcctgctggtcggactgctcctcaacgccacgctcggctggacctgggccgatccggtcgccgccctcgccatcgccggcctcgccgtcaaggaggggcgcgaggcctggcagggcaagggctgctgcgccccgacggcccatggtcaagcctgcgcaaattcacccgatcagtaacacatccattgcccgccctcaggagtctcacctccgagcggcacccttatgtggccgcatatcaggggcatttggagcgttcagttgaatatcggcatcaagcgcatcaatcgcgtcaccgtcacggccaccgtgacgctcaccgccggtgcggtgctcgcgggcagcgccttcgcctccacggcgcacgctgccacgccgccgactccgaagatcgtcgccaagggcggcttcgtgatgaacaacggcaccggcaagaccctcttcaccaagtccgcggacactcgtcgcgccacgggctccaccaccaagatcatgacggcactggtggtcctgtcgcagaagaacgtgaacctgaaatccaaggtcacggtccagaaggcgtacagcgactacatcgtcaagaagaacgcctcgtccgcccggctcatcgtcggcgacaagcccaccgtgggccagctcctctacggcctgatgctcccctccggctgcgacgccgcgtacgccctggccgacaagttcggctccggcaagacccgtgcggcccgcgtgaagtcgttcatcggcaagatgaacgccacggcgaagagcctcaagctgaagaacacccgcttcgactcgttcgacggcatagggggcggcaacaactactcgaccccccgtgacctgacgaagatcgccagcaaggcgatgaagaactccacgttccgctcgatcgtcaagaccaagtcgacgaagcagaaggtcaccacgaagagcggtggctaccgctacatgtcgtggagcaacaccaacaagctgctcagcagttacagcggcgccgtcggcgtcaagaccggctccggcccgaccgccaagtactgcctggtcttcgccgcgacccgcaagggcaagacggtcatcggcacggtgctgacgtcgtcctccgaggcgaaccgcaccgccgacgcgaagaagctgatggactacgggttcaagaagtagcccgcacgcacgccttgtacggcgaaggggcccggcccgcacggtgtgtgcggggcgggccccttcgcatcgcccgaggcttacggctgccggcggcgcaggtcggccgtgaaggcgtccccggcggcgggggcgagggtgaggacgggtccgccgaggcgcttggaatcgcggacggcgacggtacgggggatgttgcgggcgacctcgacgcactcctggcctgcgttgccgccgctgtagctggacttgacgaattcgtgcgcgggcacgaggcctacaactccttgagaatgccgtcgatcagtctgaccgagttccgctgcgcgaggcccagccgtgtgatgcggtcgaagagcgtgacgtgccgggcggcatcagtatcgctctccagtggggacaccccacgctcgccggtgacgcggcgctcctggtcagcgagttggccaccaacgcgttgctgcacggggccatccggggccggctcttccgggtccacctcgccctcaccgcgagctcactccgtatcgccgtcagcgatccgcgcggggaacggctgcccagcgtccggcggcccgacgccgacgactgctacgggcgcgggctcctgaatgtcgcgcggctcgccgaccactggggcgtcgagccgcgcacggtggggaagaccgtgtacgccgaactcgccgtgcgatgagggccggacatgccggtgggcccgtacggagaaacgtacgggcccaccggaaaaagcacctgaagcagctacgcccaggtgatcaggcgcttcggctgctccaggatcgccgccacgtcggccagcaccttggagcccagctcgccgtcgaccaggcggtggtcgaacgacagggccagcgtggtgacctgacgcggcttcaccttgcccttgtggacccacggctggagcttgatcgcgccgaccgccaggatcgcggactcgcccgggttgaggatcggcgtgccggtgtcgacaccgaagacgccgacgttggtgatggtcaccgtgccgcccgccatcgccgccggggacgtcttgccgtcccgggccgtggtgaccagctcgcccagggccgccgcgagctgcggcagcgtcttgtcctgcgcgtccttgatgttcggcacgatcagaccgcgcggggtggccgccgcgatgcccaggttcacatagtgcttctgcacgatctcctggttggcctcgtcccaggcggcgttgacctcggggttccgcttgatcgccacgaggagggccttggcgatgatcaggagcgggttgacccgcacccccgccatgtccttgtcctccttgagctcggccacgagcttcatcgtgcgcgtcacgtcgacggtgacgaactcggtgacgtgcggcgcggtgaacgcgctgcccaccatcgcctgagcgatggccttgcggacgcccttgaccggaatacgggtctcccggacggaggcggaggccacggcggctgccggggcctcgggggccgcctgcgagggggccgcctgcgagggggccgcctgcgagggggccggggcagccaccggagtcgtagcggccggagcagccgccgcgtggacgtcctcgcgggtgatgacgccgtccttgccggtcggcaccaccgttgcgaggtcgatgcccaggtccttggcgagcttgcggaccgggggcttggcgagcggacggcctccgtccggcgcaccggcctgcgccggcaccgagggagcaggagcggaagcggcagcagcgggtgccgcgtgcccgttcagctcggcctgcaccgccgccgcgacggcggcggcctccggagcggccggcccccccttgcgcgggcggcgcttcgtggaggactcggcgacgccgtagcccaccagaaccggcgtgcggcccttcggcacggcttccgcctcgggctcctccaccggctcctgggccggagcggcggccggagcaggcgcgtcgccgctgcccggagccacgtcgatcgcgatgatcacctggccgacatcgacggtcgtgccctcggggaagcgcagctcgtgcaccaccccgtcgaacgggatcggcagctcgacggccgccttcgcggtctcgacctcgcacacgacctgtccgtcggtgacggtgtcgccgggctggacgaaccacttgaggatctcggcctcggtcagtccttcgcccacgtcgggcatcttgaactcacggaagcgagcagacgtttcggtcatcgtcgtcacgaaccctctcctcagaacgccagcgagcggtcgacggcgtcgagcacccggtccaggccgggcagatactcgtcctccagccgcgccggcgggtaggggacgtggtagccgccgacccgcagcacgggagcttcgaggtggtagaagcagcgctcggtgatccgggcggcgatctccgcgccggagccgtagaagacgggcgcctcgtggacgaccacgacccggccggtcttctccgccgacgcctggacggcgtcgaagtcgatcggggacatcgagcgcaggtccaggacctcgatcgacttgccctcctcctgggctgccgcggccgcttccaggcaggccttcaccatcggcccgtacgcgacgagcgtgaggtctctgccctcgcggacggtcacggccttgtgcagcgggccggggatggactcggtgtcgacctcgcccttgtcccagtaacgccgcttgggctcgaagaagatgatcgggtcgtcgctctggacggcctgctgcatcatccagtaggcgtcgctcgcgttggacggcgagaccaccttcaatcccgcgacgtgcgcgaagagcgcctcgggggactcgctgtggtgctcgaccgcgccgatgccgccgccgtacgggatacggacgacgaccggcagcttgatcttgccgagcgcgcgggcgtgcatcttcgcgagctgcgtgacgatctggtcgtacgcggggaagacgaagccgtcgaactggatctcgacgatcgggcggtagccgcgcagggccaggccgatcgccgtgccgacgatgccggactcggcgagcggggtgtcgatcacccggtcctcgccgaagtccttctggagtccgtcggtgatacggaagacgccgccgagcttgccgacgtcctcacccatgatgaggaccttggggtcgttgtcgagggcgaggcggagcgactcgttgagcgctttcgcgatggacatcttttccacggccatggctacttgccctcctcggcagagtcggcgaacgatgcctggtaggcggcgaactgggcccgctcctcgtccacgagggagttgccgtcggcgtagccgtgctcgaacagggccatcggatccgggtcgggcatcgcgcgtaccgcttcccgcacccgcttgccgagggtctcgctctcctcgtccagggcggtgaagaaggcctcgtccgcgagcttctccttctccaggtacgcgcgcagccgcaggatcgggtccttggcctcccacgcggcccgctcctcgtcggcccggtacttcgtcgggtcgtcggaggtggtgtgggcgcccatccggtaggtgaacgcctcgacgagggtcgggccctcgccccggcgcgcccgctccagcgcggagcgggtgacggccaggcaggcgaggacgtcgttgccgtcgacccggacgccggggaagccgtatccctgggcgcgctggtagagcggcacccgggtctggcgctcggtgggctcggagatggcccactggttgttctggcagaagaagacgaccggcgcgttgtagaccgcggagaaggtgaacgactcggcgacgtcgccctggctggaggccccgtcaccgaagtacgcgatcacggcggagtccgcgccgtccttggcgacgcccatggcgtagccggtggcgtgcagcgtctgcgagccgatgacgatcgtgtacaggtggaagttgttgctgttcgggtcccagccgccgtggttcaccccgcggaacatcccgagcaggttggtcgggtcgacgccgcggcaccaggcgaccccgtgctcccggtaggtcgggaagacgtagtcgtcgtcgcgcagggcccggccgctgccgatctgggcggcctcctggccgagcagcgaggcccacaggcccagctcgccctggcgctggagggcggtcgcctcggcgtcgaagcggcgggtgagaaccatgtcccggtacaggccgcgcagctcgtcggcgctcaggtcgatgctgtagtccgggtgctcgacgcgctcgccctcgggcgtcagcagctgtacgagctggggctcggaactctgcggcttcttcgcggcgctggtccgcttactggcgcgtcgcggtttacgcgcggcagcagtgctctccacggtcacgtgcgtgctcctccgtcggtccggcccccggggtctgccgggaaccagtgcggctcgcctggatccggagccgtgcacggggtgggtgccggtcggccggattcaggcgtgacaggtgccccggcgagcgccctgtcataggcacgttacccagtgcgtcgcagaactgcgaaaccctatctgacctgcgattttgcttggatttccaagtaaatcgaaaaaatcgcgaagctctgctggtcagggcactggaaacagccttgcaggccgccggaacaacggcacgttatcccgcggatcagcgccagggaagagcggagcagaggcgagtgtgtgagactgcgatcgtgcgcgaagatggaaaaatcacggtatttctgctcgatgatcacgaggtcgtccggcgtggcgtccatgagctgctctccgtcgaggcggacatcgaggtggtcggcgaggccggtacggccgcggacgccttggtgcggatcccggcgacgcgtcccgacgtggcggtgctcgacgtgcggctgccggacggcagcggggtggaggtgtgccgggaagtccgttcccaggacgagaacatcaaatgcctgatgctcacctcgtacgccgatgacgaggcgcttttcgacgcgatcatggcgggcgcgtcgggatatgtgctgaaggcgatccgcggcaatgaactgctgaatgccgtacgggacgtggcggccgggaaatccctgctggacccggtggcgaccgcccgggtgctggagcggctgcgcgacggcggcggcaagggcgatgacaagctcgccggcctcaccgaacaggaacgcaggatcctggacctgatcggcgagggcctgaccaaccgggtcatcggggagcgcctgcacctcgccgagaagaccatcaagaactacgtctccagcctgctgtccaagctgggcatggagcgccgctcgcaggccgccgcgtacgtcgcgcggctccaggccgagcgccgctgagccgccgcgcgccgcagcgggactttggtcccgtgccacccggggcaggcgactcttacgctccccctacggccgggggacagtggaatccatgtccttcgacgaactccccgcggccgggacgatccggcggaccccggccggcatgatcgagcggaccgagccgatccggagagtcgagcccatcgaactgctccgccgtgtcccgtacggccgtctcgcgaccagcatgcgggccctgccgttcctggcggtggcccggcacatcgtgtgcgacggccgcatcctgctgcggatgcacagcggcttcggccaccacgaggcgtgcgacgggagcgtcgtcgcgtacggcgcggacaatggcaacgacgcggcctccggcgacggcggcgacctgtggtcggtgcagttcaccggccccgccgagatcgtgcacccctgtcccgaacaggagcgactgttcggagccgcgcccgtctccgtcaacggggagcccttcgcaccggcctatctccgggtcgatccgcacttcgtcacggaacacacgctgaacttctgaggtatcgaggaccccagagagtgtcggacggcccctagcgcacctccgggcgtgaccgcaagtccgccgaacggccacgcagagtgatctaacatctggtaagtgccgcgctcatatgtcactcgtccacctgttcccccggtcggcgaggtgctgcgccgttacccggacgtgggcgagccgctcgcctgcgagccgatcaccaaaggcctgctgaaccacggataccgcgtctccaccacgagcggctcctacttcctcaagcaccatctcgacaagaagcacctcgacgaccccagcggcgaacgcgccgcgatcgtgcgccagcaccgcgccacccagcgcctgaagtcgctcggcgtacccgtcgtcccgcccctgacggacacccggggcgacaccgtcaccgtgatcggcgaacggtgttacgccctgcacccctgggtcgacggcctccaccgggtcggctcccagctgaccctctcccagtcgcgtcggctcggagcgctcctggggaccgtgcacaccggcctggaacaggtgatggcgccgcgcgacggcccgcatccggcgagcccgcccggccggccggggcaccgcagcccggatgccgccgacaccttcgctctgatcgacgacctgttggccgccgcgcgcgggcaggacggccgggac

SEQ ID NO: 2761 - DNA, 9797 bp, Unknown
  Kingdom: Bacteria, Phylum: Actinobacteria, Class: Actinobacteria, Order: Streptomycetales, Family: Streptomycetaceae, Genus: Streptomyces
gctccgaagcccgggcccacgttcgaccgcgcccagctggagcacctggcctcccgcgagatctccaccctgttcggcccgcgcttcgcggagcaggacggctacgcggtgcagacccggatgcccggtccgcccatgctgctcgccgaccgggtcaccggcatcgacgccgtccccgcggcgctcgccctgccgggcccggtgcgcacggacggcaggatctggacggagaccgacgtcctgcccgacagctggtacctggactccacagggcgtatgccggccggtctgctgatcgaggcgggccaggccgacctgctcctgctcagctggctgggtgtcgacctcctcaaccggggcgagcgcgcctatcggctgctcggctgcgaagtgacgttccacggcagcccgccggaggcgggcgacaccctgtgcttcgagatccatctcgacgaccatgcggaagccgacggcgtccggctggccttcttccactacgactgctacgtggacggcgagctgcggctcagcgtccgcaagggccaggccgggttcttcacgcctgcggagctcgtcggcagcggtggcgttcgctgggatcccgccgagcacccgcccggcgacggactgccgctcgatccaccggccgtacgctgcgaacggtcccgcttcggtgcggaccgggtgcgggccctggaccaggggcggcctgcggactgcttcgggcccggctgggaggcggcggcggcccacgtccgttccccccggctcgacgagggccggctgcggctgctggacgaggtcacctccttcgatccggccggagggccgtggggccgcggctatctgcgcgccgagacctcgttgtccccggacgactggttcttcaccggccacttcaagaacgacccgtgcatgccgggcaccctgatgttccagggcggtctccaggcgatggcgttctacctggcggccatgggcttcacactcgaccgggacggctggcgcttcgaaccggtcagcgaccacccctccacggcgatgtgccggggccaggcgaccccggatggccggcgggtcgtctacgaggtgttcgtacgcggcgtctcggccgggccgattccgacgctccacgccgatgtcctgggctcggtggacggggcgaaggcgttcctgggccgcgacatggcgatccggctggtccccgactggccgctgtcgcactggcggcactgcggtccgcccaccgtgcagaccgacgggaacccggtgccactgccacggctggccggactgaccgggcaccgggaggagaagcccgtggcggtcgccgccgacggattccccttcgaccacgcctccctgctggcgtgtgcgtggggcaggccgagcgaggcgttcggcaccatgtacgagcccttcgacggcacccgcagggtggccaggctccccggcccgccgtaccacttcatgagccggatcgtgtcggtggacgggccgcaggccgggatgcgtgagggcagcgtcgtcgtcgccgagtacgacgtaccggcccgagcgtggtacttcgagcaggccggtggcccggccatgccgttcgccgtcctgaccgagatcgccctgcaaccgtgcggatggctcgcctcgtacgtgggcagcgcgttgaccagcgggaccgatctgctgttccgcaacctcgacgggtccgggacggtcaccggcgaggtcaccccggccacccgcacggtgcgcaccagggccgagctgacacgcgtctcgtgcagcggagacatgatcatcgagtcgttccgggtgacgtgcaccgccgacgatacgcccgtgttcgacctttccacggtcttcgggtacttccctcggtcggccttcgaggatcaacaggggctcacgacgtcggctgacgaccgggcccgcctcgacgaaccctgcggccgggtggtcgacctgacgacccgtcccgcccggtactgcgccggggaaccacgtctgccgggaccgatgctgctgatgctggaccggatcacgggctactggccggacggcgggagcgcggggctgggtcggctccggtcggagaaggacgtgcgcccggacgcctggttcttccgtgcccacttcttccaggacccggtgcagccggggtcgttgggccttgaggccatgtgtcagctgctccagttccacctgctcgaacggggcgcggccgatggtgtcgagcacccgcgcttcgaaccggtgctgcccggccgcgaggcgtcctggacctaccggggacagatcactccggccgaccggctgatccgggtggacatggacatcatggagagcggcacggacgcacgcggcccctatgcggtggcggacgcgtcgctctggggcgacgacaggtgcatctaccgggtgcggggtctggggatgcgcgtggtgtcggaggcggcacccgtggtgtgaggcggtccggcggcgcaaccgggtccgccccgcacgccggaagccacgctcggcccaccgccggccgggcgcagcggtcggggccgactccggactccacgcacttgcgggcacccaggagtcgcctggccacgggctcaacctgccatccccgaggccgggttggcgtgggggggggtgattcccggtgcctgcccgtgaccaccggctccgttacggagtgccgtgacctgcgatccactccgccagggctaccagggtggactccacgctctccgccatgtggtcccgcagggcaaggaggtcctcgggggtgtcgcccaggaccgggtcggtacgcagcagtcgccagttctgctcgacgatgctgccggtgccctgctcgtggaggcgccactcccagcgcacgatgccatgctcggctccgccgacgacgaaggcgaacgcggaacccggatcggctcgcaccacctcggaacagctgacccattcgcgcccgtcccggcggttgctgccacggaaccgtgcgccgacccaggggccgtccccctgctcgtaccgcaccgcaccggcgctcgggctccacgtcccgatcagtgagacatcgctgatcaggcggtagacggagtccggcggcaaggcgacccagcaccgcctggcgaaggcaaagggagtcaggtcgagaccggcccgcggattccgcgggccgacggtgatgctcttggacgtggcggtgctcatggttgctccgtgagttgtcaggtggcccgagagccgggcatgggctgcgatcaccctggcccgtcggcggacaagcgagtcgcgagctcatcctgggggccggtacggggagcagccagaccctgcggatcctcaccccagcagggtgaggtgcggctcaggggtgccgcgcatactcgcttccatggacaagcacaggcagctcgccgacttcctccaggcacgccggagccttctgcatcctgaggatgtcgggctgcggacctacggcgagcggcgccgggtgccgggattgcggagggaggagctggcgatgctggcgggtatcagcgcgccgtactacgcccggcttgagcagggccagtcgcgcaacgcctcccgcgaggtactcgatgccatcgcgtccgccctgcgtctggatgactcggagcgtgctcatctgcacgagctcgcccgtgcgccgaagcggggcaagaccgcccaccgtccccgtcccgagcgcatcactccggccaccagcgcattgctggcagctctgggagacacccccgccatcgtcatgggccgccgtagtgacgtcctggcctggaacgcgcagggtcacgcgttgttcgccggccacctcgaccggggcagccccgctgatccgggctgtcggccgaacatggccaagctggtgttcctcgacgcgcacacccgcgacctctatgccgattggcccgccaaggccaaggccgtcgtcggtaacctgcgcctgaccgccggccggtacccggacgatccactgctggccgggctcgtcggcgaactgatcatgagcagcccggagttcgccaccatgtgggcggatcaccgggtcctggtctgcgatgtcgccgattacgagatgcaccaccccaccgtcgggaccctgaccgtcactcagcagacgctccagaacccgcagggaagcggtccgtccctggtggtcgccacggcggctcccggctctccttccgagacggctctgaagctgctcgcccacggcaccgcgtcacgggaagcggtctccccgcgcacagacaccgacgcgagcgccgacaccacctgataccaacttcgaccaccgtcaccccggcaccgccgcaccgcggctgccgcatgcccaaaaccagtggccttcgcggcttcgccatgcatctcccctccgccgcgcggccgcacgcaccggaccccgcgacctgtcccgaatcgaccgcaaacgaaacgaaacgtcacagacacaggagcagcatcatgagcgacatcactctcggcgacgtcgagataacacgggtcgaggaactgcacggaccggtcggcatgaccccggaggccttcttccccgaatcgccgaagcacaagtgggaccagcaccgctccgtcctcgtcccggacttcctcgacgaggagaccgatatatgcagggtcgccgtgcagacgtgggtgctgcgcagcgaaggcaggaccatcctgatcgacaccggggtcggcaatcacaaggaacgtccctacgcaccggtctggggtcacctggaactggacttcctgggcaacctggcgcgtgcgggcgtgcaccccgacgacgtcgacatcgtcatcaacacccacctgcacgtcgaccacgtcggctggaacacccgcctggaagaccggtcctgggttccgaccttccgcaacgcctcgtacctgatgcccaaagcggacttcgagttctggaacccggccaacaaccccaagatcgccggcggggtcaaccagaacgtcttcgaggacagcgtcgcaccggtgtacgccgccgggcaggtcacgctctgggaatcaagcctgcgcatcgacgccagtctcactctgcaggcagcgcccggccacaccccggggtcgagcgtcgtgatgctggcctccggcaccgaacgcgcggtcttcgcgggcgacctgctgcactcccccttccagatcatgcatcccgaacacaacagctgcttctgcgaggacgcccacgcagcccgcaagacccggggcgaaatactcggccgggccgccgacaccaacgcgctcgtcctacccgcccacttcaccggccacggcgcgctggaagtggtacgcagcggcaactccttcggcatcaagcggtgggcctcgctcgaccggctctgaccaccggccggacccgctgccggccctccggccaataccgaagggccggggtttcggaccggcttcgtcccgcacaccttcagtccgaccgcccgccagggcccagagaacggaaccatcgtgagacaggacaccggccccctcgtcactaccgctcagggagcggtccgcggcctgcgtcaggacaccgccaccgtcttcctgaacatcccctacgcggctccgcccctgggagccggccgattcacgccgccgcagccgcacgaaccatgggacggcgtacgggacgccaccgtgccgggacccaacgcccctcagtccgagcgcaagctcggcgaggtggacatgtccccctacttcggtaccggctggagccgcggagcggactacctcaccgtcaacatctggaggcccgccaccacggctgaggacctgcccgtcatggtcttcgtccacggcggcgggttcgtcgccggatcaacacgggccgcgctgtacgacggctccggcttcgcccggcacggcgtcgtactcgtcaccgtcaactaccggctcggcatcccaggttttctcgacctccccggagcgcccgccaaccgtggtctgctcgacgtggtggccgcgctgcgctgggtgcggcagaacatcgccgccttcggcggtgacccccgcaacgtcacactctgcggccagtcggccggggccaccatggtcggcggcatcctcgccacgccccgggccaccggcctcctcaaccgggcgatcatccaaagtggcagtgggctgggggcgttcagccctcagcaggcccgtcgcgtcacccgggcagcggccgacgctctcggggtcgagccccacgccgacgccttcgcgggcatctccgacgagcaactggtcgagaccgccggccggctcgcgggcatcgacctgcgcactccgacgcactatgaccccctgatcggactcagccccttcagcctggtcctggacacacagcccgccgcatccgtcgccgccggccacggtgccgacgtcgacctgctcatcggcacgaccgccgaggaaggaaacctctatctcgtccccaccggcgactacacggcctcgacggcggccgacctcaacgcgttggctgcccgaacgcacccggacccggtacggctcatcgagacgtaccgcacggcacggccccaggcatccttcggtgaactgcggtccgccatcatgggcgatgccgcgttcggtgtgggcacccgggtactggccgacgcgcatgctccacacccccggtcccgcaccttcggttacgagttcgcgtggcgctcccaggccgtgggaggcgaactcggcgccacccacacgatggaacttcccttcgttttcgaccgcacgcatctcccccaactgcacggccccaacggcctgctcggcccacagcggcccccggctgacctcgcttccaggacgcacggtgcgtgggtccggttcgcccggaccggcgaccccggctggtccccgtacacccgtgagcgccgcaccaccatgcgcatcgacgcggagtggaccgaggccgacgacccccgaggccaggagcgacaagcctggagctgacccgtcccacgcgcccacaccctcctcaaagcgcacaccggctcacccccggggtcgttgtcccgccctcagtggtgtcgtcctcgcacgtctccggtgtcggggcgggcgggatcctgttccggcatcaccgcgggccgccgagaccacctcctgacccacctccgcgacgccggcctcgggccaggcaccttcgtcgggcgtcgactcagatgttcccaccgcccagtcgccggagcgcgtggaatccgcgagtaccgcccggacatactctcgtcgggacgttcgatcaatcggtgtcgtacagccctcggtttctccagctctcgtcgaatccgcctctcgtcgaatccgcaggccttcccgtactcgccctctatggacctacgcgtccacctttcgcaggcatacgaggggttcgccgtctgctgagcagcaggcagggtatgtggtgccaggtgaaaccacttcccacgactcccccggccacggactcttcagcgcctctcaagaaggctctgaccacctcgttgctctacttcttcatcctcggtgacgttctcggggcgggtgtgtacgtcctggtcggccaagtagccgccgagtccggcggtgccgtgtgggctcccctgctcgtggctgtctgtttggctctcctgacggccacttcctacgcggagctggtcaccaagtatccgcgtgcgggcggtgcttcgcactacgccaccttggcctacggcccgttcctcggcttcctcgccggtttctgcatgctggcggccggcatcgtgtcggtggccgcccttgcccgggggttcggcggcgactacctgtccgagttcatctccctccccgtgacgctggtgacgatggcctttctcaccgcgctcgcgctgctgaacgcgcggggtatccgtgagtcgacccgggccaatgtcgtcgccacgatcatcgaggtcagcggactgctcctggtgatcgggctcggcgcctggatcgtgctgcgcggcgacggagacacgggaaggcttgcggacctgggcacttcgcgagaggggcccgtcggggccgtactcagtggcgctgtgctcgcctattacgcgttcgtcgggttcgaaacgtccgtcaacgtggccgaggagacgcttgaaccccggcgctcgtatccccgagcgctcttcggcgcgctgctcaccgccggcgcggtgtacgccctggtcggcgtggcggcatcggtggccgtgccgaccgagaagctgacggaatccagcgggccgctccttgaagtggtccgcacggcgggaggagtccccacagaactcttcagcgccatcgccctggtggccgtcgcgaacggagcgctgctgacaggcatcatgtcctcgcgcctggcctacggcatggcgcgggacggccttctgccccgcttcctggcgaaggtccttcccggccggcgcaccccctgggctgccatcgccacgaccaccgcgctctcgctgctcctcgcgctgaccggcgatgtatccacgctcgcctccaccctggtgctgctgctcctggtggtcttcttcctcgtcaacaccgcactcctcgtcctgcgccgcgacacagtgtcccaggaccatttccgtgcgccgaccctcgtcccggccctcggagcactgtcctgcgtcctgctcgccacccggatcgaacacgatgtgtggttgagggggcttctggtgctggctgtcggcgcggggctcggcgtcgtcgccgcagtacggtcgcgacagtcctcttgacgggacttcagcgttcctggcgtggccgtacgtccgctccggatgacccacgccgcgacctcgcgtggattcggccctccgttcgacgtcgacacacgaagaggctggtgcaagaagtcggatcgccttcttcggggtggagctgagctgcggcgcgccgacttccctcctgccggactggctccgaccggctccagcagtccgaacaggtaccgcacgggccgtcccgattccccaccccaactgctcgcgcggcgttccggctccgacgcgccgctgcttcccggcccgcgaaccggtccgagcgcccggattgaactcgtgcgctgtctgccgatcagggcacttctggcatattttcgtgtcttatatgacttttacgacgattcatggcaacccttaggcgatcaggtgatcagtacgacaatcatctcgacttgaaggagccttcatgcgcatctccagttccgtccgctcccgcagcgtccgcgcgggcgccaaggtggccgtcgcggtcgcggtcgccggcgccaccctggccggagcacccgccgcccatgccctccccggcgacagcggtgacatcgacatccgctcggtcagctggcactcgcgcggtgaccgcgacggggtcgaggtctgcaagttcgtgctgtcggcgagcaacttcgagtcgttcccctcggtcccctggacgatcaccgagcagcctccgaccgtgccgccgggcaccaccctgatggacagacttccgctcatcaacggcagtgcccgcagtgagacgtacctgctcccggagggcacgtaccagctggtgtgggtcgtccccgcaggcccgaagcagaagagcttcaaggtcgaatgccccgaccgcggtcacgggggcggcaagcctcacaagccgcagaggcccatcggcggggtccccgcgggcggcggcggcgtccccgacatggagcccatcagctccgagagcgactcgaacgtcggaaccgccgccgcgctggccgccggggc

SEQ ID NO: 2762 - DNA, 6851 bp, Unknown
  Kingdom: Bacteria, Phylum: Actinobacteria, Class: Actinobacteria, Order: Streptomycetales, Family: Streptomycetaceae, Genus: Streptomyces
caggccacccgcagcaactaccagcgggtgcacgggggttcgggtgtgcggttcctggagttcttcaccgggtccggccgcgcccggccgctgaccgacacgctgcagtccgaacacggcgagtggttcctgcacaagtcgaaccgcaacatcgtggtggagacgaccgacgaggtcgccgaggaccccgcctccgaaccggacttccgctggctgaccctcggccagatcggcgagctcctgcggttggacaacctggtcaacatggacaccaggaccgtactggcctgtctgccgacccccggagggccagggccggcccggcacaccgacgccgaggtgtcgtcctggctcggtgccgcgcgctcccgctcccggctccgggccgagcccgtccagctcgcccgggtgcggggctggctccgggacgagcaggccatccgccgcaccgacgaccgccacttccgcgtggtcgcggtcgcggtcgaggcggacggccgggaggtggccagctggacgcagccgctgttcgaaccgtgcgcgcccggagtcagcgcgttcctgttccgccacttcgacggcgtgccgcatctgctggcccacgcccgcgcggaggcgggactgccgcagaccgtcgaggtgggcccgaccgtgtgctacacaccggacagccacggccacgacccggcgtacgcggacgtcgtacgagctgccgaaggcacccgcgtccgctacgcggtggtgcactccgaggagggagggcggttcctgcacgccgagagccgctgcctcttcgtgtcagtggacggcgtcgacgacagcgatctgctcaccccgccgccggaccatctctggatcacgccgggccagctcggcgccctgacaggccgaggccaccaggtcaccgtccaggcgcgtacgttgctcgccgtgctcaactccggtgcggcgaggctgtcatgagccggccggtacggatcgcggtgctcggcaccgcggagttcgcccgacggcgcatgctgcccgccttcagagcctccgccgacgtcgccgtggtcgccgtggcgagcagggacccggacagggccgcggagctggcccgggagtacggctgccgggccgccgacgactatgccgagccgctggccgacgacgacgtggacgcggtctatctgccgctgcccgcatcgatgcacgccgagtgggcgggtgcggcactgcgcgccggcaagcacgtgctcgtggagaagcccgccgcgatgagcggggcggacgccgccgaactgtgcgcgctggcccgctcacgaggcctggccctggtggagaacgtcctgttcgtccatcactcccagcaccgggcggtcatgcggcacgtcgccgacggggcgatcgggcggctccaggccttcgacgcggcgttcaccgtgccgcgccggcccgcctccgacatccgctaccaccccgcgctgggcggcggggccctgtgggacctcggcgtgtatccgctgcgggcggcactcagcctgctgggatcggccccctgcccgcggctggtgggtgccaccgccaggcgggacccgtcggacgcggtggacacggcaggtacggcgttgttggacggcggagacggactcgccctccagctcggctacggcctcgaccacacctaccgcagtacgtacacgctctggggcagcacgggacggctcacggtcgaccgggcgttcaccccgccggccgaccacgaaccggtcctccagctggaacggtcaggggtgttgaccctgctcccgctgcccgcggacgaccaggcgggcaacgctgtcacggccttcgcccacgcggtccgcacccgcgcgcgtccggcaccggagatccagcgccaggcggaactgctggaggcgatcagcctcagcggcccggcggttcaccgcacggcgcgacctgagggcaccggacggactcccccggcgaaccccgccgggtcgccatcccgttgacgtggccgggagttcagatgctgccgagttcttccgctatgcgcgccgcgtcgtaccgattgcgcgcctggagcttcttgatggccgacgaggtcaggttccgcaccgtcccgggggcgagatagaactcccgggcgatctccttgacggaggctccggtcgccgtggagcgcaggacgtcacgctcgcgctggctcaggaggtcggcgaccgggcgtgaaacgtccgccggtctctcgctcccccggaggtcctgttgtctcgcctgcatgctgcggatggtgccgatcagctggttcagccgcgctccgcgcgagatgacgctcaccatctcggattcctgcaccttgaccagcgccacctgcccgggctgttcggcgatgagggtgataccgcagtggggcacgtggttgcgcacttcgtgcaccgtctccagcacgtacggagtcactccgcccaggaccagggacacggcggacgccttacggatcgcgggaaccagttcgcggtgcgagcccacgacccccgccacccggaatccgggaatctggttcagcagcccagcgagcgcttcggtgtatatgacgtgctcacccgcgacgagaatacgtgtactcattgccgttcccccgttttgcgtcaatgcaagggaaattccaccggaccgaacctcgtgcgcgagcatgaggtttcacttctcgagtccccggaacgcctggtcagacctacggtgcggacgtcgagtgccaaccggcctgcctggtgaaaggccccctgtatgtcggtcagataatatgcgcgaccttgaacttacgaaagccttcggacacttctcgggcccctgccccggaagaggtcaacatcccgaaaatttcggcggacacctgccgccctcaatctcgatagggcgggatgccgcaccgaaggcgcattcttcgcccaaaatgttcatctcccgaggaaaccgctcaggagaagccctcactccggatcctccgcgtgatcgtgacgcgggacgggtggcgcgaccgtacgtggcggcggagaagggagcgacggggacgagccgtcggccggccacgtgacggccgactccgccggtcgccgaggactgtcgacggacgccggaaccctctctgccggtcgcagcgccggcggagggtccggtcggtggcgcggtagggcgggcccgcggccgcacgcacggcgactgacggcgagaggcacggtggccgggcgcgtaaccgatgtccgggacggccgggggaaggtgcgccgacctcgttcggctcgcccgcccggcacacggccggcggtccgtcgcaaccgtgcagagcgtccgtgacgtgtcctaccggtaagacgtcttcagcgtccgcgccgaagatgctcgacaccccaggcgcatcccacccgatcgagccaccggcatcagcaccctcacgcgtcgacgcggcacccccgaagcaaacggccacaagcatgtccaccctcaacactcgctccaggctctcggcttactgcccccgccagccaacacacagtgatcagatccggatcgactcacgaaagcacagaggtcctgggttgcgctcttcgatgtctcaccatgcgatcgctcccaccggaagcgtaaaggtgaatcccggccaagtgcaaggagaagcaaggagttggtctaggttgagtaaagatcccgaggtgatgcgcggcggagttggcattcccgcgggtcaggtgcctgttcgcgtgtccacgaccacccctgacacctggtcggcaccgggcgtcccgacaccgcacttctcggcctcgcgacctccagaacctcctcacccgtagacaaatcccgacaaccggtccaaccaccgcaccgcaccgtcgacttcgtcgcaacggcaatgaactcccgtatatctgcacgggattcacctcaagcacccctatgcgcattttccctccgacgtacccgaatgccggatcttcacgtcaccggcgagcccaccgaaagcgcctcgccgggtacacggtgcccgtacaccgtgcgacgcggctcctgcatgcggaggagccggccgaggccaccgacgagatcgggcgccggcacgccgaaccccgcacacgggacgaggccggaacctgatccggcagacggtcgactctccgaggctcgctccggcctcacgccgcggcggaggatctctccccctgccctgagacagtgccgaccggaaggtccgcccgaggcgacgccgccgtcgtgtccatcgaggtgctccgcaaataccaggaaggggaagagcgcgagatcacccgcctcaccgacgagcgcatggcgacccggtctgccggcatcccgatcgagaacgtcgcgaaggagacgccggcgcgaagtgagtgagtaccgcaccgtcttccacccggaagcccgagccgaactccgcaaggttccgcgcgacgcgttgctccgcatcctgagcaaaccgacggaacgggaagtcgacccctgcggctcccatacccaccgcgctcgtttcccagcccgagcgccgccgcctcacgcgccataggccacgcaactcatcaagaaggtgcccgcgagccgaaatttgtttccgcaacggccgctaagccggcaaagaacatatctcgaacgactgcgcagctgggcacgctgccgctggtgcatgcaccaacccgcttgcgtgcccgcgcgccgggccggaatccagcacgaatccagctacagagataggggggtgacgacaggtgacgagaggtcggaaaatccagcacctatccagcacggtaaaaatcaaggggcctgcccccgcagaggcagacccctttgacctgcatgtttgcaagatcagcgacgtggtgataattcagccgctacacattgaagcggaactccaccacgtccccgtcctgcatgacgtagtccttgccctccatgcgggccttgcccttggcgcgggcctcggcgaccgagccggtctccaccaggtcgtcgaaggagacgatctccgccttgatgaagcccttctggaagtcggtgtggatcacaccggccgcctccggggccgtggcacccttcttgatggtccacgcgcgggcttccttcgggcctgccgtgaggtaggtctggaggcccagggtctcgaagccgacgcggccgagggtggcgaggccgggctcttcctggcccatggactggagcagttcgagggcctcgtcgtcgtcgagctcgatcagctcggactcgatcttggcgttcaggaagatcgcctcggcgggggcgaccagggcgcgctgctcgttcttgaagtcctcgtcgaccagctcgtcctcgtcgacgttgaagacgtacaggaacggcttgacggtgagcaggtgcagctcgtggaggagccggcccttctcggtggcggccgtgatgcccgcggcgaacagcgtctggccggactccaggatcttctgggcctcctcgaccgcggcgaggaccgcgaccttctccttctggaggcgggattccttcgtcaggcgggggacggccttctcgacggactggaggtcggcgaggatcagctcggtgttgatcgtctcgatgtcgtccttcggcgagaccttgccgtcgacatggacgacgttctcgtccttgaaggcccggatgacctggcagatcgcgtcggactcgcggatgttcgcgaggaacttgttgcccagtccctctccctccgaagcaccccggacgatgccggcgatgtcgacgaagtcgactgtcgccgggaggagccgctgggagccgaagatctccgcgagcttgttcaggcgcgggtccgggacgccgaccacgccgacgttcggctcgatcgtggcgaacgggtagttggccgccagcacgtcgttcttggtcagggcgttgaacagggtcgacttgccgacattcggcagaccgacgattccgatcgtgagcgacactttggcgacttcctggagtgaggagggggtcaggggcgtccgggtccggctcggctgttcgggccgggtcagccgagtcccggagtgggaccgattctccagtttacggggctgacccgcgggtccgaacagtgcggtttacggacccctcccgccggtgcggacccttcggtacccggggccgcccggcctggccgaacagtgcggctttcggccgtgtgacatcgaacgcaacgccaaggtcggccaaagcgcgtgtccaacgcctgattccccgccccccgcgacctacgttgtgcaggtggagcagcacaggacacgtcccccgcagcgcaggcagcccccgcaggccgcgctcgccccgcccgcgccgggtggttccgccgtgtaccgggtacgggtgcgcagtgtgccgcccgtggtcctcgcgctgcggcggttccccaacccccggctcaccgggatcggggccgggctgttcgccgcccttgccatgttcgtgctcgcctgcgtggaccggctgctgttcgacagctcggagctcgtctacgggctgctcttcctgcccgtcagcgctctgaccgcgctctgggtcaggcccgccgacctggtcacggcgccgatcagcgtgccgatcgccttcgccgtcggggtcttcccgatctccggggggtccgagggactcggcgggcagatcatgggcctcgtcaccgccctcgccgtgcacgccggctggctgtacggcgggacactgatcgcgggactcatcgcctccgtacgcaaggtgcgccagatgcgggcccggcggcggtacgtgctggcccaggggcgcggtggcgcccccgagcgggcgccccgggccgccgc

SEQ ID NO: 2763 - DNA, 7332 bp, Unknown
  Kingdom: Bacteria, Phylum: Actinobacteria, Class: Actinobacteria, Order: Streptomycetales, Family: Streptomycetaceae, Genus: Streptomyces
gtcggctcgtccagcaacaggagcgggcggtcggcgagaaaagcccgggcgagggcgaggcgctggcgctggcccgcggagagtccggcgccgtcctcgcccagggccgtccgcaccccgtcgggcagcgccgcgacgaagtcgtacgcgcccgcgtcccgcagcgccgtgagaaccgcctcgtcatcggcgtcgggccgcgcgaggcccacgttctcggcgatcgtgcccgcgaagaggtgggggcgctgggggacccaggcgatacggctccgccagcgttcgaggtccaggtccctgagatcccggccgccgacccggacgtgcccctcgtcgggtacggcgaacccgaggagcacgttcagcagggtggacttgccgatgccgctcgggccgaccagggcgacggtctcccccggctccacggtgagcgacgcggcgtccaacgagggttcggtgcggcccacatggcgtacggtcacgtccgccagttccaggcgcagcgtgtccgggacgtcctcggtgcccgaggcccggggttcggtctccaggaccgtgaagatctcctcggcggccgagaggccctcggccgccgcgtggtactgcgctccgacctggcggatcggcagatacgcctccggggccaggatcaggaccaccaggccggtgtagaggtcgagttcgccgtggacgagccgcatgccgatcgtgacggcgaccagggccaccgacagggtcgccagcagttccagggcgaacgaggacaggaaggcgatccgcagggtgcgcagggtggcccggcggtagtcggaggtgatcgtgcggatcgattcggcctgggccttggcccgcccgaagaccttcagggtcggcagcccggcgacgacgtccaggaagtgcccggagagccgggacagcagctgccactgacggtccatccgggactgggtggcccagccgatcaggatcatgaagagcgggatgagcggcagcgtgacgacgatgatcgccgccgacacccagtcctcggtgacgatccgggcgagcaccgccacgggcaccacgaccgcgagtccgagctgagggagatagcgggcgaagtagtcatcgagcgcgtcgatgccccgggtcgccagcgcgacgagcgaaccggtgcgctgtccgctcagccagtcggggcccagccgcgctgcccgctccagaagtcggccgcgcagttcggacttgacggccgcgctggcgcgatgggccgacagctcggtgagccaggcgacgagcgcccgcccgagggcgaccgcgccgagcagaatcaggggggtgcgcagcgcgctgaccgtgagtccgccctcgaaaccgcccaccacgatctcggcgatgagcatcgcctgggcgatcaccaacagagcgccgaccaggccgagggccaccacggccgccaggaagaggcgggtggcccgtgcgtagtggagcagacgcggatcgatcggtttcacgtgaaacatccccccggcggggtcggtgaactctgcgggatggtgagctgccgcatgccctgcggggtccgcggcagctcaccggagtcagtgcgcgtcagcgatgtgctgggtgccgatgcgcttgcggaagacccagtaggtccagctctggtagagcagcacgatgggcgtggcgatgcccgcgcaccaggtcatgatcttgagtgtgtacgggctggacgaggcgttggtgaccgtgaggttccaggcgtcgttcagcgaggacggcatgacgttcgggaagagcgtcaggaagagcatcgcgaccgccgccgcgatcgtcacgcccgagaacgcgaacgaccagccctcgcggcccttggcgatggccccgatcgcggccaggagcgccaccaccaccacgatcatggctgccaggctccaggcgtccccgttgtcggcctgcgtccagaccaggaagcccagtgcgagcaccgcggtgaccggccccagcttcagcgccagtgcgcgggcccggacccggatgtcgcccgccgtcttgaggccggcgaacaccgccccgtggaaggtgaagagggtgagcgtgacgaggccgccgaggatcgcgtacgggttgaggaggtcccagaaattgccgacgtactccatatcggcgtcgatcttcactccccgcacgatgttcccgaacgccacgccccacaacaccgcggggatcagggaggtccagaagatcgcggtctcccagttggtctgccaccgctcctcggtccgcttggcgcggtactcgaaggcgacgccgcgcacgatcaggcagaacaggatgatcagcagcggcaggtagaagccggagaagagcgtggcgtaccactcggggaaggcggcgaaggtcgcgccgccggcgctgagcagccagacctcgttgccgtcccagacgggaccgatcgtgttgatcaggacccgacgctccttgcggtcgcgcgccagcagtttggtgaggaccccgatgccgaagtcgaatccctccaggaagaagtagccggtccagaggacggcgatgagcacgaaccagacgtcgtggagttccatctctcagctcctgtgctcagtacgagaaggccatgggccggtcggcgtcttcttcgtcgtgcccgccgatcttcgtgggcgggttcaggtcgtcctcggtgagttccggcggcccggccttgatgtacttcacgagcagcttcacctcgatcacggcgagcaccgcgtacagcagggtgaagacgatcatcgaggtgaggacctcgccctgcgagacaccgggggagacccccgcacgggtctggagcaccccgtagacgacccacggctggcggcccatctcggtgaagatccagccccaggagttggcgatcagagggaagagcagggtccagagcgcgacgacccagtagagcttggtgagtctcgggctcagcgccttgttcttgaagaggaccagatgcggcacctcgtcctcaccggtccgcagtgccggtggcagcaggaacttcttccgggtcagccagagccccaggaggccgaggccgaaggaggccataccgaagccgatcatccaccggaagctccagaacgcgaccgggatgttgggacggtagtcgccgggcccgtacttctcctcaaggctcttgttgatgtcgttgatgccggggacatgcgagttcgggtcgttgttggcgaggaaggagagcaccccggggatcgagatctcgaccgagttgtggcccttactgacgtccccgtaggcgaagatcgagaacggtgccccgtcctggccgtcccagagggcctcggcggcggccatcttcatcggctgctgccggaacatgaccttggccaggctgtcgccgctgactgcggtgagcatgcccgcgaccacaacggtgatcaggcccagccgcagcgaggtccgcatcaccgggatgtgcttctttcgcgccaggtggaacgcggcgatgccgaccatgaaggccccgccgaccaggaacgccgccgtgatcgtgtggaagaactgggtgaccgcggtgtcctgggtgagcacccgccagaagtccgtgagctcggcgcggccgcgctcctcgttgatccggtagccgaccgggtgctgcatccaggagttggccgccaggatgaagtaggcggagaggaccgtgccgatcgagaccatccacatgcaggcgaggtggatcttcttcggcagcttgtcccagccgaagatccacaggccgatgaaggtggactcgaagaagaaggcgatcagcgcctcgaaggcgaggggagcgccgaagacgtcgccgacgaagcgcgagtagtcggaccagttcatgccgaactggaactcctggacgatgcccgtgacgacgcccatggcgatgttgatcaggaacagcttgccccagaacttggtcgccctgaggtacttctcgttctccgtccgcacccaggcggtctgcaggcccgcggtgagcgcggcgagcgagatcgtcagggggacgaagaggaagtggtagacggtggtgatgccgaactgccatcgcgccagggtctccggcgccagagcgaggtccacgtcgtcagtctccttacatcgccgtggtcataccggctatgcccctttgatcccaccgattacgggagtaagcggggcacgcttgtgaacgcgttcacattcacaagcaattatggcgcacacactttcggacccttcgccgggggtaccccttttcggcccccgcccacgcaaagggccccggacctcacgatcgaggtccggggccacccggccgtacaggcgcgtgcgggggcctacagctccgcgcggaacgcctccgccgccttcaggaagaggtcgttgccctcgttctcgccgatcgagacccggactccctcgcccttgaagggccgcacgaccactccggcccgctcgcaggccccggcgaagtcgagggtccgctcgccgagccgcagccagacgaagttcgcgtgcgactccggcaccgtccagccctggcgcaccagctccgcgctcacccgggtgcgctcggcgaccagcgagcccactcggcccagcagctcgtcctccgcacggagcgaggccaccgccgcgtcctgggcgagctggctcaccccgaacgggacggcggtcttgcgcagcgccgcggccaccggctcgtgggccaccgcgaagccgacccgcagcccggccagaccgtacgccttggagaaggtccgcagcaccgccacattgggccggtcccggtagatctcgatgccgtccggcacatcggcgtcgcggatgaactccttgtacgcctcgtcgagcaccaccagcacatcgctcggcacccggtcgaggaaccgttccagctcggcacggcgcaccaccgtgccggtcgggttgttgggattgcagacgaagatcagccgggtccggtcggtgatcgcctcggccatcgcgtcgaggtcgtgcacctcaccgtcggtcagcgggaccttcaccgaggtcgcgccgctgacctgcgtgatgatcgggtacgcctcgaaggaccgccaggcgtagatgacctcgtcgccgggcccggaagtggcctggagcagctgctgggccacccccaccgacccggtgccggtggcgagatgcgtcaggggcacaccgaaacggtcggccagctcgttcatcaggccggtgcacgccatgtccgggtagcggttgaagttctccgcggcggcgagcgccgactccagtacccccggcagcggcggatagggattctcgttggaggacagcttgtacgcgaccggtccaccggccgccgccggcttccccggcacataggcgggaacgccgtccagctcggcgcgcagcttggggctcgtctcgctcaccgcaggtcctcctcgaccgtccgttcacagcaatactgcacaccttatgaggattgggccccgctgcgaatggcccgagcgggaaatcgaccgcagtgcccgggaatggggcctcgcacagggccggccagaggcctcccccggggggagcgtttccggttcgggcgcgcgccggtggctcgcgccgtggcgcgcgtcccccgaagtggtgagttgagacctcttcgagacatcgcacattcagcaggctgccgccctccagcacctgaaacacgtatgcaatagcagtcaactcccttgcattttaaggattctgatgggcagtgaccttgcagaaacgtgcctgccaccgtgtgcatatgcgaccggaccgaccacccctcggagccctactatcggctcgccatgacagcagcagggaagcaccaggtgagccggacggagaccccccggcgcagcggccggccaggacgggcggggatccgtgacgtggccgccgcggccggagtctcgatcacgaccgtctccgacgcgctcaacggcaagggcaggctcccggacgccacccgccgccatgtccgcgaggtcgccgagcgcctgggctaccgcccgtccgccgcggcccgaaccctccgtacgggcaggtcgggcctgatcggcctgaccgtgaccacgtacgggaatgaacctttcaccttcaccgaattcgcgtacttcgcggagatggcgagagccgcgacctccgcggcgctcgcccgcggctacgccctcgtcatcctccccgccacctcccggcacgacgtctggtcgaacgtcgcgctcgacgggaccgtcgtcatcgacccctccgaccaggacccggtcgtcaccgaactcgtccgccagggactgcccgtcgtctcggacggccgcccggccgggacactccccgtcaccgcctgggtcgacaacgaccaccgggccgccgtgctcgacctcctcgaccatctcgccgccgccggagcccgccgtatcggcctgctgaccggcaacaccaccgacacgtacacccggttgtccaccaccgcctacctccactggtgcgagcgggtcggccaggatcccgtctacgagtcctacccggcccacgacccctgtgcgggggcggtcgccgccgaccggctgctcgcccgcccggaccgccccgacgcggtctacgggctcttcgaccccaacgggaccgatctcctcgcggcggcacgccggtacgggctgcgcgtccccgaggacctgctgctggtctgctgcagcgagtccaccgtgtacgcggccaccgagccgcccatcacgacgctctcgctgaagccccgccgtatcggcacggccgtcgtccagctcctcatcgacgccatcgaaggggtcgaacacgacgggccggtggagcaggtcataccgacggagctcatcgtccggacctcctcgcaacgacgtccaccgcgcaccacggtcagcgcgccgcgctcccccagcggggattgatcggctcttttcggaccaatcggccggtgaaccgtacgtgcgcccggattcaccacccctggtgcgtcacacagatcgatccgcattcctatgatgggcgcacgacaccgcggaccacctctaccaggcagggcccgtcaggtgtacggcggcgcgacggtggtggaggggtcgatgactcagggggccggtcaggaacccgtggtgcggacggcgacgttgcgtgacttccgggttccgccgtatgcgcagacacccgtgccaccgcaggcacaggcggcacctccttccccggtgccgccgcgcgcgccggaaccgaaccctccggtgccgggcgcatccgtgcccccggcacccggcgcgtccgtgccgccgcgtgctcccgcac

SEQ ID NO: 2764 - DNA, 1953 bp, Unknown
  Kingdom: Bacteria, Phylum: Actinobacteria, Class: Actinobacteria, Order: Streptomycetales, Family: Streptomycetaceae, Genus: Streptomyces
cgggcggtcggcagccgatcgcccggttcgagcacgcccaggcgcagggcctgcttcgtctgctggacgatctggagataggtcgccactccactgcgccggtcgatgcggaacacgaccacggacttcaccttccgctcgattgcgacactttatgtggggggagaggacgatgctcacagcgggcggcgggtgacccgccacagggtgaacgcggtgagcaggaccgtcccggcgagcagaaggcctgccgcggtccactgcatcggcgccatctggctgtagtcgaggtactcgatcacgtcgttgacgatgccgtgctccttgatgcacgcgttctgcgccttctcggtcgcctcggcgcaggtgccccagccgtacagggtcccgtcggcgctgccgacccagcggtccacctcgtacgcctcggcgtagcgggccgggagctcggtgcccatcgggtaggtgaagatctgcgtgtcgccgaggcgtcggcggacctcgtcccagacgaacatggtggtgatcgccgtgaagaggaacgtgaccaccatggccgggagcacccggcggatcagggtgccgatggtgatgcccgcggcggtgaggaagaggaggaacgcgggcaggacgggcccggtgttgtcgaagatgacgccgtcgatccactcgctgaggaagaccgagcggtacggcttccaccaccaggtgaacagcgccgagagcaccacgccggagaccagcgcgagggtgtaggccaggcccagcttggcgatcagccactgacggcgggtcgccgactgggtggtgacgagctgcgcggtgccgttctcctggtcgcccgcgatcagcggggcgccgatgaagacggcgaggatcagggggaggccgccgaggatggaggtgatgtagttgtagccgcggtcgttctccagtggctggcccgcgtccttctccggccagcccttcgcgtcgagcagctggaccagctcgttgcgctcgtacacgatccagagcgcggccagcagcgtgaggccgaggacgcaggccagcgcgacccggtgctggcgtacgacgagccacggcattccgcgcaacaggcggcgtccggagccggtttcggcgggcttctcggtgagggtggtgctcatgcggcctgggtcccttcggcttcgacgcgggcgccctgggtgtagagcgagggcgcgtccggggagcggagatgggcgaggaggacttcctccagggagggctcggcgctctcccagtcggccgggaggggagccttcggccggatcatcgcctggaactgccgtccctggaggcgggtttcgacgacggtgtggtcggccagctccggtggcagcgagccgtcccgggccaccccggtgaccagcgcgtgggccgggaccagcgcgtctgcgtcaccggccatccggatccggccctcggagacgaccagcaggtagtcgcacatgtcctccagctcggtcagcatgtgcgaggacatcaccaccgtggtgccgcgctcgacggcctccgccatcagcagggtgctcatctcgtcgcgggccagcgggtcgaggtccgacatcggctcgtccaggagcagcaggtccggccgcttgccgaaggcgagcgcgaaggccacgcgggtgcgctggccgccggagagcgtgccgaccctcgcgtgcagcgggacgttgcccgagcggacgatgcgggtcgccgccgccgcgtcccagccggggttcagctcggcgcccatgcgcagggtgtcggccacggtgaaccgcttgaacagcggcttctcctggccgaggaacgcgaatgtgggcatcacggcggggtcgtcgaccggtacgccgaagatccgcagttcgccggtcgtcggctgcacctgccgggtcgccaggttgagcagggtgctcttgcccgccccgttcgggccga

SEQ ID NO: 2765 - DNA, 21264 bp, Unknown
  Kingdom: Bacteria, Phylum: Actinobacteria, Class: Actinobacteria, Order: Streptomycetales, Family: Streptomycetaceae, Genus: Streptomyces
gccagtgtggcagggcaggcgggggcggggtgggtaatcgctggcaagcccacggaaggcgtcaggactgctcagcattcgcgctcacgcgccgctgataccggcgcaacgcctcatcggccgacgacggtgtcatgcccaaagcgttggccgcatgggtcgtccaaccccgcccgtgggcctgcttgatctccgccagagcctcccccaggacgtccgcgtaagccgtcctgctgcggtccgccgtgtcgcgggcccggatggcggcgatagcccgcgcgatcggcggcagggcggccagctccgctacagaggagagctgttcggggccctgctcgacggactccgtcagacccagctcgggttccaggatgtccaggatcgcgttggcgtcggcaaggtgtagtgcaacgcgacctgctgcacgctcacggacctcggcagggtggtggctttcgggagacgccttgctccagttgagcagggccgccccgaaggaggttgcggcggacagcgcttggcgggcaacggcggggatggcctgctcggactcgttcgtccggacctgcgtgtcacgggtgggcttacggccgttccactgctcggggtggacgccctggagtacccagtgggggtccgcgaagccgccttggtcgtgggggcgggagctgtcgaggatgtcggcggcggacagagtctcgttgagctcgactcgggtgcccgtgggcttcccgaagccgatggtgccgctgacggcttccggcgggagggtcgcgaggagggcgttggttacgcgggcgatgcggcggtgcgtggcggcgatggtgtcacgggtggcgtccatggctccattcttcaacgcgcgcattgaaaagtcaatgcgcacgttgaaatcacgtcaggccgagaggtgcacccacctctagaccccttagactcgaacgcatgtacgacctgccgcccgacctcgaccgcctccgcaccctggaaacctggctcaccctcaccctcgacagggtccggcagcagatcaaagacgtcgaacagcggcagcagccccagccctccgtgcctccgcccgcgcccgccccgccacggcgaccacgcacccccgactggggcatcaccgaagcaggcatcggcacacccaccaccgaaatccaccgaggcgactgctgggcatccgggaaaaccctccaacccatcagcgccgaacgggcccgcaacgaactcgccagcggagccaaaccctgcgacgcatgccgcccagacaggccactcggcatgccaccaccaaggccctgacgcaccctgaccctgtggaataccccgtcaaggtcgccctcgcccaagccgtacccgtcatccctgccgggcccggctggtggtacgagcccaagttcgacgggcacaggacgatcctccggcgcaccgaggagacggtcatcctgtacgcgcgctcgggtcgcgttgtcaccagccactggatggaccttgccgtcgctgccatgcagctgccacccgggaccacgctggacggggaagccgtcatctggcgaggcgggcgcatcgacttcggggccgctcaatcccgggccgcatcctccgtcacccgggcccgtgcactcgccgcacagcaccccgccagctacgccgcctgggacgtcttggaacaccccgggcgcgggcagaccacagggctcccctacacggagaggcgccgactgctcctcgacctgctccacgacatcccgccgccgatccaagccgtgcccgccaccgacgaccggaacgtcgccgtcgcctggtacgaagggctccaggagcaggggatcgaaggggtcgtctgcaagaagggatccgcgagctaccccgccggccgccgcggatggaccaaggtcaggcacgccgacaccgaagacgcgctcgtcgtcggctacctcgggccccgccgccggccccaccggctcgcactcgcagtaggtgatgagggcggacccatcaggttgtccgcgcggctcgaccccgtgctcgccgggcggatcgccgacacgctcaccgcggccgaggtcatcggggagcggcgggccgaaggggagacgtacacgcgagtcgacagcgacctgaccgtcgaagtcctcgccggctccggcaggcacgggacactcaccgtcacccgcatgcgataacaccaggtcgggagcaccctggatgtatgtccgcgcccatcgtcatccaccgcccctcccccaccggcggccggcgcgtcaccatccaagggcaaatcgccgggctcgcccacgacgacggtgacgtcgtggagttcctgcgccgggccgggctccccgacgccgacgacctcctcgaccggggcgactgggtcgaatggcggggcggcagggtgcacgagtaccaggcagcgtgaatccgaccgaagaccccacgagcagcaccagcgcctgaaactctggctggcatgacccccaaaccgcacatcatcaccggcttcagcgccgcgcccgacgggtggcgcgcggcattcaaatggcccgacgtgaaggagatcatcgtcgtgcccatcgtcggctgggccacccgcaccgagggagtgcgcaggaccgaggtcggccactttgaggtcgagccggtcatcctcttcgacaacgtcagcgaaccagtgatcaccacagtcgcggacagcctgcacgactggaccgacggggaagaactccaccagatcatcgcccccggattcgacgtccgcgaggtgcccgacgggtggaaggtccgcgaatacccggactaagaacacccctgacctgcaacgagatagagcagggggagtgttcagccgaacccgtgcgacggtgaaggcatggacaacccgaagcagcgatacccgctatccgtagccaacaggctgcgcccccacccatgccccgactgcggacagaggagccctaggaggatcggcagagataccggcagcgagacgaacccgctcgaccccgaagtgtgcgtcacctggtactgccccatcgtgacgtgcaacaagaacgacggcttctggatcgagacccgctagccgagccggcgccgccgctcctgcggggattcaggagcggcagccgaccactgtcagacccggcagagatgatgagcctcatgccgatcaccatgcagaactacgccctcacctggaccgataccaccgggaagcgccgcacctctgcggtctcctacgacaagaacagcgccgccgggcggaaggccgagctcgaagccggcggggccaccgacgtgaccatcgtgccgatccggcccggcgaactcccccagccctgaacgcgggcagccgcgaagcctcccgtggggagccgggaggagcggcaggccccgcctggaacgggggtccagacaggcggggcctgagcagaaccacaccctcgggatgaggagctgcgagaacaacgatgcacccgaaccggccacaagggtagaggtgtgacgtgatctcgactatcggagttgcgccctctggaggggcgaacgaagagcacaatgtgccgcatgagcagcccagggctaccacccgatgtcgaagccttcatggacttcatcggccagaacatcgagctatccggcggcctcgtctggaacgagcgcgaccggctcaagtccgacatgatgctcgtgcggcatcgctggtctccttcccgcgtctcggtggatgccttccgcagtaagtgcgaggacgtgggcatgagcccggaagacctagtcgaagtcgtcgactggcttcggagggcgcaggctggtcggcagctaaggccgcagcacatcaaggacttccgctggcatcaagaccccacaccttaggtagcgcagcgcgccctgcccccgctccgcagggcgcgctgcgcagtcaggatcgacgaaacttcggcacgacgtccgcgaacacagcctcggcagcatcgacgtgcgctgcgttgcgttgccccttgttgcggcgatcccagtagccgaccgtcgtagccggattgtcgtgatcggcgaaggcctgcacctccgcaagggggacgccgtcatcgagcatgtgggtgatccgtgaggctcgaaggacatgcggagtcagcttgcggcctgggaggacgccagcgtggcggcccatgcgggtgagcatgcgggctacgtcgtggcggtccaagcggtcgccctttgagtccaagaggagcggccccttcgtgcggcccgctgtgtgcacgtcgaggagctcggcgacgctggtcggcagcgggagaaggcgctccttgttttccttgcgggtgacgtcgaggaaggagcggcggcctcgctcgatccggtccgtgacatcggctgagcacatctcggtgacccgacccgcaagcgcgtagaggagcgtgacgacgaggaggtcgaactcgtccttggcctgggcgatgacggcttggatctcgtcgacttcgagcacgggggtgctcgttgaggagttgccgctctcgacccgtggggtgtcgtcttgggtgacggggttgcggggaaggtcgatcttttgggcggcgtatacgtggagtgaggataggacccgaaggtggcgggcgatggtggtgactggcgtttcctgggcttcctttcggatgcgccaagctctgatgtggtccgccgtgaagcagccgagggtgaagcgttcgtgcccgatctcctgagcgtaggggctccagacgcggcggatgtcgtcggcgtaggaccgcttggtgttgaggctgctgcggcgcgtagacgagagccaatcgaggatcatcacaaaggcctgcgtgtcgacggcttcggcgagcagctcggcacgcggccggtagagccgctcttgacctcgccgctcgacctgcacttggcccaggtcgttgagcagcttgcgacggacttcctcaaacaggtccgagccgggcagcgcaatcggccgttcggctcgctgggcaatcgactgatccgtcacgccgcatcctcctgagttgaggctgcccatgcggtgagcgtgtcgaagtcggcggggagcaggccgaggcgcgggtcgatgtggtggagcagcgcgggcccctggtggtgaatggtgacgtactcgcggtcgaggtcggtgatgtcgtcgtcgatccacgcgaaggggcgtcgggcggcgtactcgacgatcgtggcggtcttccagaagacctggggcttggacttccagtacgggctgctcgcgggccgatcatcgggccaggtgacgacggggagcttggggaggccgagatgggggccgatccactcgttcgcctcgtgcgcccatgtggtggcccagacgagggtgtacggcagggcggtgagcaggcggccgtgatcgtggttgagccagacccgcagcggcttctggtacggctgctcccagcccgtcgggcgcatccggtgcgtggtgtacccctcggggcgccgggagggtttggccatccagggattgaggggaccgtcgacgtcgattaagagcagcgggagtgtggtcgtgtccatgctccagagtaccgaatcgctgacacataacaagacgttatgcgctacctcgctcgggctgtcgtcccgtcgcgctaccgtctcctcatgacgaccgccacgcgcacgaccgtcgacttggttcgcctcacgctccgggacgaggagatcaccctctcccctgctcccgggatcgagctgcgcctgatcatcgacgccgctccggacggtcggagcttcgacgtacttaccctgcccccgccggagctgcgggtagcggtcgatctgatcccgacaaccagcaacgcggtcgcccagtgcgagtcatgggcggcacgtgttggcgcacagcttggcgccgaagcgggccccctgggcacactggaagagttttcgctggaggccaccctcggcggcgagggacttccctacagtcgagtatcggtgccgcgtctcacccttaccccggggccgccgccccggctggacgaggacgaaccgctgcccggcgtccgcgtcttcactgcgacagcccacaccggcagcgacggcagcaagtacctgctgcaccggctctgactcgctgaccacagcgctgcgccccgccctcgaatgagagcggggcgcagtcgcgttcggtcaggcggccttgctctcccacggccaggacgcgtcacggccagcttcgaggagcggcaccatccggaacgcctgatcggtgagcccgccgaacgtgtgccggttactgcggccggacggggcgtgcccggcctggtagccggcgaggttccatgtgtacatcggagtcgacgccgggattgcttcggtgacctcgcggccgtcgtgactggcctgctcgtcggtgacgatgatgacccggtcgtggcccttgaactcctggcggagtgctgccgcggtgtcggtgccgccgccgaggaaccagccgccttccttccacttccggacgtcgccgaggagcgacccgccacgggtgagggggaacgccttcgtcttcgcgccgggctggtcggacatgtagtagcgggccgaggagaacgacaccacgtctgcctgaacgcaccgggccccgagcgcgatcccgaacagggccgcggcgtcccagcgcatcagggtgccgtcccgggagaacggggcatccatggagctggacgtgtcgacgaggatgagcgtgcgtccgccgagctgggggatgttcgcgagggacgcggtgagcgccttgtcgagggcgtgaccccagcgcagggacggggcagcgttgaacgcggagtagaaccgcatgggcagctgccgggacttggccacctgctcagggtcggcgagcttccgggcgaccgtgtcggcgatctcgtcggacaccccggcctcgtcgaagttccgcaggttccgcagcagcgccatgtagcccatggacgggatgacggcctcccacgccgcagcatccatcggcccctgcagccagccggccagggcctcccacgtcatgccagcccgctggaggatctctccgtggttggcgagcacgtccctgcgctggtcgactggcgtgcacgtgagctgttcgcgggcgaggagcgtcgacagcctggcggggatctcctcgtcgcgctttttcctgcggtcgagggcgtgcttgaacaggtcgccctgccacgccttgtcggcggccggtgaggggtggacgaggttgaggacgtcgccgaaccggtagcccttggagtcggtgtcgtacttgaggagcgaccgctcggtgtagaggcgctgtacggcgtcggcgacaccgcgcttcaccggcttcggtagcttccgcccgtacttcgacgtccagtagccgaggaactcgcccggctcgtccgcccgctggagcacggagtcgatgacctgccgggagtagccgacgacattagcttcgaggcgggctttcgtgaactcggcggcgccgacgagggatgcggtgcgcatgttggcgtccgagcggagccaccggaggaaggcggtgcaccagtcggggtcgatgacggcggcctggcggatgagctgggtgtaccggtcgtcgcgctggccgccctgctcgtagaaggtgtcggtgccgacgaagttggtgacggcgagcaggaagagctcagacttcgagtcgcggaggtagccgacgccgccctggtggttggtggtgcgctccccggtcgtggtcacgggcgagctggcagcgggtcgtgcgccgcgctggttgaagcgggacatgaaaaaacccctcgcatggaggggaggtgcagcagtggggtgcccgagatcaaattcggttcgggtgacaagacgctctaccgattgagctaccgacgctaggcgccggacgggactcgaacccgcaaccatcccattaacagtggaagtaacccgatcctgcgcaccgggcacccccgatgctgtgcctcccgagatcaaggacggcctgcggcggaacttttccaaagaagtagccgtaggcctgcgcaccgggaggtgcatgtgaagttgtgcggccactgtaacccgtatagctggtagcggtacggcatttgggcgacggcgtggcgcgccagccacccctcccccgctgtttggtcacaactccatcaccaccggaacatctggcaccacggggcgtacatggaccgttacggtcaggcctccgcgaaccgcacgtagggggacacatgtcgtaccagcagcctcagcccggccagcagccgcagcagcccggttggggtcagcagccgcccccggcaccgaagaagaagaccgggaagatcatcggcttcgggtgtctcggcatcgtcggcctgttcgtcctcatcgtgatcatcgccgcagtcgccggcggcggagacgacggcaacgattcgtccaccaccaagccggccgccagtcagggcgacaccaagaaggacgagccgaagaaggacgagaaggaagagccggcgaagaaggccccggtcacggtcaccggcaagcaggtcgacttcaagaagtcggtcctcgctcagggcgacgactacaccagcgtccaggtcaccatcacgaacaacagcaagaacgacatcgacatcaacccgctgtacgtcaccatcaccgacaccgacggcagcaagcacaccgccgaactcggcgtcgacgaagaccagctcgacaccgtcaccctggcccccggggagaacgtcaccgggaccatcaccggcaagggcaagttcgacgccaagtacgtgacgtacaccgacgggctcatcggcgacagcatccgcggcaacgtcagctgatagcttcatcacctgggtgccccgtagccgttgaggtgcggggcgcttttgcgtagacataaagaaggccccctcccgtgagggagggggcagttcactgcggctcgtcagccggcggaaggtcaggttcgaggaagagatcctcgtagggcggcttgggttgtgcctcggcgagcccgaggtcgatgagcgtgcccaggtcggcggcactcccatcgacttggcggtacgccggctgcggggtcatagccgacacggtcggtcacactccagttcggttgtactcggtgacccgatccggcggggcaggaggctcgatgccgtggctacgcatttgagctgtcagctcggagacgtaccaggcgaacgaccggaccagagacctcagcgaacgggtttcgtcacgcatctcagtgatctcaccttgcatgtcgtcccggatcgcctgaaaggctgcaaggtcggcggcccgctggttcggctcggcctgggcgagggacgcagcccgcgtcgcgtcagctgtggccctcgatgcggccctcgtcgccttggctgcaaagaaggcagctaggaccgtccccaccatgccgaacacggctacccagatgttcacgacggcgccttacctttcctggcgcgccgcggagctggggggaccgaatgctcgggcaccgtggccgcccacatgatgaccccgacgtgcgaggtgaggtaccaaattgcgacgaacccgccgcgggaatactcgccgctcaatgcggcggaggtgtaggcggttgcccatatggcgggggggatgagcgcggcgatgaagccccacttgtctcgcccgacgcggagccacgcggacccgaaggtgacagctccggcgacaatccacagccaggaccagtggcgtagcgagcacagctgggtgaggagctgcaggccttcggcgccgggcgggtcgacgagaaacgaaacgccccagcaggtcttcccgacaccggcgatcagcaggaaaatgccgcggcggcccagcctcctatgcagccagcggcctgcacggcagggcacttacccgcccagggcgaccggtttgaccgggctggtctcctccagtcgcgtcgaggtaacaggcggggtgacctcccgacgttcgaccaccgcgaggaccgcggagacgaacgccatccacccggcctgctgctcggtggtcatgtcgaggccgaagccgacgaacagggcgaggcctgcggaggcgagctggaggagcgcggcgtagacggcgccgttcttgaggacaacggcggacgcgacagcgacggcgcaggcgaggaaggcgttgatgagagtctgctgcgtctcgctgacctggatgccgtagccggcgaggagcttcaggagcacggcgaccgcggcaaggatggtgacgggttcacgtccgaagatgcgcatgtcagacctccttcagggcggcgacggctgcggtgagctcgtcgaggatggcgaggatcttcgtgtcgttggcctggagttcctcgatccggccgtgcatgtcgggcgggggcggggtgccgttctccttggcctcggcgacgagggcggcgttgcggtagccccacccgtcggtcttcgctgcgcccttcagggtttcgacgtcgcctgcgatcttcttcagcagggcttcctgggcaggggtcatctcggtctcttccttcttcggaggggtgggtgtcgtgggcttcggcgaggcggggcggggagcgcccttcttcacccacgcgtacagggggccgccggggcaggcggtggcgtagccgtcgcgatgacccttgatctcattgccggccccgttcttgcggagcaggtcgatgccgtcgcggatcgcggccagcatcgcgtccggcgggtccgtcagcccggacgagccgacgagcccgaggatcgcgaagtgctgctggttcaggtgctggttgccgttcgctccggttcgtcgccggagtccgcggccttcgaggaggtagccgtgggggcaggcggcgtagttgtatgccacgtcgctgtagttttctgcggtgttcgccaggtgcgagcggcggatgttcttccactcgtcgaggcaggcgttgtggtcggcgagcagcttcgtgctcacggccgtgccctcgtagtggatcttcacgcccttcgtgctcgactgcgacggcgcggccgacgcaggccatccgagctgggctcgggtcaccagcttcatgcgggtctccagacatggcgatgccccgggccagcgggcgcggggcataggggttggtcaggcggccgggttcgtgaccctgatgccgtccagccagatattggtaacagcgctccccgcctccgacggcgcggaaaacgtcagcttgccgtccgccgcatacgtggtgcgggtcccgtaatggctgctgttgtacgtcacgaagccccgcccgttcgcaggccggtggctcgcactgaacgtgaagccggtgaccgttgtcgccccggccagtgcgggagtcaccgcgatgcgcccttccagctcccagatctcggtgccgaacatgctgtacttccgcatgcgcggggtcggggtcgacgcggtgaaaccggacgcgtaagaccctaggatcgccagcgacgtccagtccatcagcagcttcgactgcaccacccacgccgaccccgtgtacacggtctccacgtcagcgtcccgcagccacgcccgcatcccctccaccgggctgctgatcgcagcgttcctcgcggacgcggatgcgaaggtcatattcgtctgccggacgatcttcaggaggccttcgcccatcaccttcagatccggggtctccccgtagtccagcgacgtgaagccctgcccgtaagtgtcttcgatcggcacgtgtgcctcctagccggtcatacggcgcgataccagccgttgatagtgaatgtgctggataccgagatgttgtacccgcggatctgaatatcggtcggcccccgcacctggtccagctgggccccgatctcggtcggctgcatgaggccgacacagtggccgccgatggcactgttggcgcctgctgtgatgccgccggcgtacacgccgaagaactggcgtatggacgccgtcccccggtacggggcgacgggcagggagatcgagatcccggtggttcctgagccgacagccgatgcggtgatgtacgcctcgacgtgaatgtcggtgccctgctgcttgtaccagccgtcccggatggcccacgtcgcggacccgcctccggtgatgactggtgtgtacgccgtccactcgctgtcgacggtgggggccagtcggcccaaggcgatccagttcccggcggcgttctggctgatcgcgatgaggtcgccgaccacagggttcagatagctgtcgaggcgccgcgcccggatagttccaacgccgaccagcccgtccgtctggacgctggtgaccgtcgcggtctgccagtccgcaccctgcagatacggatcctccgcgcccacggtgctgaccgatgcggcaaggccggcggccatgtcgagaggggttgcctgtacagcgttgggcattaggagtcctccctgccgccgatggtctcgaacgtcgatgaccccagtccgaggtcgatggtgaacgactgaatctggtggagttcccgttcgtcgttctcgtaggtgacgcgtaggacgtctccgggttcgaggcaagggttcggtgctgcttcgatcgtcaccgtcgccgcgggcttcaccgcgtcgcggaggagcttcgcggctgcgatggcggcctggccggggttggtaaggaggctgctggagtagaagcggggcaccctcccaaaaggcccgtacacgtaggtcgggctcgtcgggtcgtcgtccagggcggtcgccgacatgggcgggatgttgtcctcggtgttctccccggaggcgacgacgaggttgtacatgccatcgcgggagtagccgcggttcgctccgatcagcaccccgccctcgcctgcgtcgacattccaggcaatgggtgctgtggccaggtcggggagttcggcgatgatgaactggccatcggcatccgcgtatacctcggcgccgatcgcggtggcgcacgctttgaccgctgcccaccgatcaccctgcgcgtcccaggtggtggtaccgagagcggcatcgaccgccctgttcacaataacggcgtcagggatcgtggcccggatcagattcgtaatcgctgtgacagcggaggtgccgccgcgggtggtgtgcggggtcaggaacgcgtcggcggtgacgatcgcttcgagcccggacccattgatggtgaccggcccgtagtccggatccccttccacactgtcgacccggaactcgcccaggggaaccttctcggtgatgccgtcggggaacgtgatgccgcgaaggattcgcagccgggccccgtagatcaccatctggccttcggggcggatcgggatcagggacgtgtccgggacggtgacctggcaggtgcggcgtacagccgacccgcggttcgcggtgacgctccccccgatgtggtcgaggagtcgcaccgtgccgtccccggcgtgcagctgcacctccgtgtaaggggtgtgcggcaacgccagagccggcaggaaccggtcggatggggcggtgtacacggcgcccccttcagctggtccgctggtccagcgcgaggtccagcacggtggcgtaccgggagatcagcgacagcaccgattcgttctcgatcaggacgtcctgcaccgtccacgtcgccgacccggccagcccagtgatgggccggtcctgctctgtcagcggcagagtccactcccgccacgactccggagcgaacgggctcacccgcggtgccgcactgctgccgacggacacgtacacgtccggttcgcccatgcccggcgctgactgccacagcagcgtcgtccccgacgcgaggagccgccggagagcttcacgctcgttatcggtctgcgtccacaccaccagcgccccttcacggccaccccgttgcccggacaagatcagggcgttctgccggcctcggatacgcatggcgttctgctcgatcggctgagcccagtccggggcctgcttcaccaggacgcgcaggttgagctgcgggcgcgacgggtccttcagccacgcatagttccggtcgcccaccgcgatggtcaccggaccagcggagtaggaccccgtatatttcccggtcgtggcgttgtagaactcaatgcggtatgacacaggcaccccgaggggtgcttcgtagtcctccacgctcagcgtctcatcggagataggaacgttctccagcagcccggcccggccccggaccacggtgcggttgccgtccgggccgatgcggtacacggtcatggtccgggatgtgttgagctcgcgggcgataaggctgacgctcgctgtggaatccgaagactccacctcgatcacgggaagcacctgagtgagccgcaccaggtccatctgcagtgtcgacgacgccgccccagcggtgagaaccacatcgatctgggcggtgacagctgcggccggggccgttgtgtctgtgctgaacgtccaccacgcgccgtctgacggcaccgccaccgacgaactggtggtcgtggtgatgagagtgtccgtcacgtcgaaccaccggaccgagatggacgtgagcgtccacgaccctgcggtccgcttcagcgaaacagctggccgccacggcaggagctccgttaccgggtacttcccggaccgcaccgtgctcgccgtcgctgtcgacgacgtcaccgtcaggctgtacgcgttggagatcgactgggcagcccacggtgacgaccgggcgacggaggcggcaccggacgccacggtccactgcccgacgccctgctcgaactcgctgtccgcgaaggtgaccacgttgctgttcggttccgggctggtgatgatgacggtgcgggccttgatgaccgcaccttcagatcgcaggacctgcgcggctgtggcccctgtgatgccgaatgccagcgatgctgtcgctgcagcagccggggcaacatccgatgcgatctgccggtagatccccgtactcggtgccgcgagagtcgacctggttgcctgaatctgggagccgcccgtgtcgtagaaccggagctccacccagcacgtggttccggacgtcggcgggttcaggtaggcgtagcccacgtactcggtgcctggggtgaccggcgggcgttccaccgacagtgcggacgcgttgccattcgccgtgacggtcagggtggtgacctcgccgccggagtagtaccagtcggcgggccaggagaacatcgggaccgtgcgggacattgtcccgtttgattcgacagcccacccggttccgtcgatctccgcctgctccgtgttgaagctgaggagattcccggcgaaccgcagtggccacccgaagtacacattttcgaagttgctaaccaccccgccggctgcggggcttgccgagacgaggacctgggcgcgggcggcccccatcggggctactccgcccacgctgatccggtgccaggttgcggatgcggtagctgtggtcagcccccacgtcaccgacacctcagtaccggtgctggtcagccatcggataccgatccgctccggcaccgtcgtgccggaagcgtcgcagaacgcggcgtaggtcacgccgacggcgacgtcgtaggacgatgcggtgcgggcctgcatttcccccgacgccgtcgaggtgagcttcagagttccgtcaccgttacggccaccggtccccaggctgattgcacagttcagcttggcggtccacccggaggtattcgggtcgacggactccgtggttgcggacaggaagttcccgggaatcggcatgcgtcaccttcctgggcgtgctcggagtgcggtgagcacctgggcgttgttggccccgatccggtggtcggcgatcgtctcgatgtgggcgttgaaagcccgcccgtcttcgaggacgagctgcatctgctgcccgtccagggacagggtgccgccggctgccgcccccgaggagagcgcgttggcctgcgctgttgtgaacacgggctcgggccggccggtgccgttgtaggcgaggttgaggccgggctggaggtaacccccctggtcgtaggtgcccttgtaggcgtactggtgcgtgaacaggttgtccttgtaggagcgggccctgctgccgatgacgacaccgtcgccgccgcgcgattcgacgttgacgccgttaatcgtgcccgcggtgtggccgacaccggcgttcgtgatgccgatcatgtacggggacttgccgcccaactgccacccggacggggcggtcttcccggagaagctgccggtcgcccaacggcggtgcggcttctgaccgcgaatgacggactcgatggcgctgaccaggccggaacagtcccagctgggattgccgttgccgccccactggtacggcaggccgttctgggtccgcgcccacttcagacccgctttgaacccgccgccgccgatcccagccgcctccatcttcccgtcggccttgccgccgaagtccaagatgctgctgatcatcttcttcgggacaccggacatcatgtctctgtaaagcgacctcgacccggcgatcttggccaacaacggcttgacgaccttgttcagcccagcctgcgcactcgccttgatcccgtccttcagccacgacacaccagtcttcgccaggtcgacggtcttgcccgccgccttcccgacccagtcgaagatgccgcccttcgcgaacccctggtagggggtcagaggcttgccctgcatcgcggcctggttgaccgcgtgcagacgggcccgctcgtaggggttcttcatcgcttccgagacgtacacaccctcgccgcgacgcatcggcacgagctggtcgtcgccctgccggtaggttgactggccgggcaggattccgcccctggcgaagccagtgaacttgtccaatttcggggcgccgaaagctcctgcgactgtgttccagacgcctcgaatccccttgttgtagacctggtcgatgatgaacgtgaccggcttcttcgcgatcccggccagcttcgaccactgctcgtcaatgtagttcttcgtgctgcggaaggagtcgccgataaccttgagccccttcctgatcagctcaaactggggcttcagcgcgacgttccacagccacctacccctgtcgccgatccacccgaagaccgggctgatgacgttcttccatagagaccgggcatcgtcgccgacagccttcatgcccgacttgaacgcgttgaaggcgggcttgaccgcgttgttccatagccatctcgccttgtcgccgatccacccgaacacgggcgacaggacgttcttccaaagccaggtggcgtccttcgcgatctgcttgaacgacggcccgaaggcgtacttccacaaccacgccgcgatggcgccgagcaccttgatcgcggcaacgatcggcaggatcaccgacaccaccacgatagtgaacagcaccttcgccgcagtccagatgaacttgagcgccggaccaatcgcgttctcccacagccacattgcccaccggccgatggtctgcagacccatccagatcgccgagaacgtgggcttcaggatgttgttccacgcccacagtgccgcagtctgaataccagaccatgcggcgttgacgatgttcctgaacgtctcgaagttcttgtacgcgtacacgacggcggcaacgagagccacgactgcgatgatgatcagcgtgatcgggttggcggccagcacgaagttgaacgcgatcatcgctagcgtccacagcttcgtcgcgacccacaccgcgtaaatcagctggatcagccacggcagttcctcggcgatcgtcccgatcacacgggccaccgcacccagcgcgagatacacaatcgtcgcagccggcgccaacgccttcgcgacccgcagcaccgcacccagcatgtcccgcatcgcggacgccaggatcggagccatctccgccgagtacgccaggaaccgttcgaacccaggcgaccccttcaagttcgtcgcccagttcgcgaaccggcctgtgattcgctgcatcgtggacgagatcgagtccatgtgcggcaggaacgcctgcacaatgcccgccatccccttgagcagacgaccgaaagcgacaccgagcccggtgatcgcgggctcgacagagcccaccaagtcccttttgaagcccttccaccacggcgacttgaagccggcagatacccggtcctgcaatccgctgatggccttcgccgcagcgagcacgaacggggtcagcccaggcaggctgttcttcaacccgttcagcgcccgggtgaagatcggcatcacctggggctgaagactcttcgaccaggccgagaaagccgttcgcagcgacgtgaacgcgtcgaacgtatcccgggccgccggcgtcaacttcgcgagctcggcctgatacttggcctgcgcgacggcagcctgatccacacccccggccgcagactgcgcggcggaggcaacctgacgctgagcagacgccaccgaatcagcagcagactgctgggcggcggccagggattcttgggcgcgctgaaccgaccgcgcaccgtccgcctgtgttgcggcgacgttgcgctgtgactcggcgaccttctcctgggcctcggcgagatcctgctgagaccggatgttctggcgagccgcatcatcgcgggccttcgccagcgctttcccctggtctgcgacttccttctcggcggcggcaatacgctcctgggccgccttgaccgtgtccgaaccctcgacaccggccttgtcggctttccgcttctcggcggacagggccttcgtctcggcctgctgctccttgagccgctgtgtcgcctggtcgtaggccaactgggcgcgctgctgctccaccaacgtggccttcgacccggcagccgacaccgcatccagccgggcgcgcgcctcctgcacatcgaggaccgcgtcgcgttccgacaactgggcgttcgccacccggtcggcaagctcggtgagctgctgggcggcgtcccggcgggcctgcgtcagatcctgctgtgcctgccgggcggtgcgctgggcgtccgccaacgactcctcggcgcgcgccacgctctcggccgagtcccgctgccggtctgatgcctgctgaaccgtgtccgccagcgactgctgcgcctgggtcacctgctgggctgcccgccggttcgcctccgccgccgaccgggcggcgtctccgacaccctgctgcgcctgcgcgatctgccgggcagcgttccggtgcgcggacgccagggcctgttgggctccggccatctgcagagccttcgacgcgccctgaccggacgcctgggcgcccttgatcgtggcggccgacgccgcgtcctgggcggccttctgcgcctggagaacaccggcaatgctgatgatcgccgggaccgccacggcggccagagcgccgacaccgacaccagcggcgaccgcggcagaaccaatcgcgccgatgcccgcggcgagcacggggatcgcggggatgagggccaggccgccgatcgcgaccgccaggtgcagaatcgctcccacagcaccggtggtgttcacgttgaccctggccgttttgccgtcgacagcagcgatctgcgcgcgcacagcggtcagctcggcgatagcccgcgccgtgtcggcccgcacctgcacgttcgggtgcctcgccccgagccgggtcagctcggcctcgatcagcttgatctcggccttcgcggcgcccgcgtcgatatcaatcccgatgcgcttgctcgcgagggtctccatgcgaacccgcagcgcctgcagatcagcgtccgcctcggacgtgtccgcatcgatcgtgatcttcgggagggagcggaatgcggcctccagccgggtcttcaacgcccgggagaaggccccacccgtttcgtcgccctgccggaccgccgacgcacgcgccgccgcaccaccctgggtcacgccctgccgcagggacccacggatctccgcagtgatacgagaagcgatctgctggccgatctgctgcccaatacgcaggccgatatcaccgacctgcccctgcatcgccggaccgaacgaccggcccgcagcgttgcccgcatcctcgccagcacgcgtcgcggcgggtacaagtccacgctgcaactgctggtagatgccccgggtgttcgggacgacgtcaacttcgaccgagcccacgctgatcgccacgggagcctcctcccgcgcgtcaggccgcgccgccgttgatcagcttgaagagggtgtccgcctgcgcctcgttgatcttgtcgcgcttcttggggccacccacacccggccggcgcaacggctccggcctcttcggcttcggccctttaccgtcgctgttcgcacgcaccaggatgtactggacctgctgcagcgcatcagtgatcccggcaagaagctgctggtccaccgaccaacgcccctcttccggcctcccggactgcgcctgctcctcatattcctccggagacagcgcgttacggagaccggtcatcgtggctgactcaggtggcagattctggatcagcacccgcacctgccgccacgacatgcccccccggtgcacatccagcagatcccgctggtagtagcgccacaggtcggcttctaccgcctccgcgtgcgcttcgacgatccgccgggtcgccgcgattttccctgcggttccccggacaggtcgctgacgtcctcgacgaactggttgaactcgtcgaagctgggatccagctcgacgtacaggtcgtagtcgtcctcgtgaagaacggcggccatgaacccgtcgaggtcaccctcgcggagccgacgctgcgcggacaccggccacgccccgttcggcacggcccggaccggctcgccgcacagctcgacggtgatgtgccggccggttgcctccagctcctgagcctctgcggccgagacgtcgtcgtccggctcgcgaacgtctggggccagctcacgcggtgtgcgggcgggtcgtgccgtagtggtctttcgggcggtggtgcggctggtcgcggccatcggcgcgggcctcctcaaatcgtggcgcgggcagaaagggaaagggtgggcgggtcgggcccgcgccagcagaagtgacccgcccacccagctcaggagcccgtgtactcaggcgtcacgggaatcttgtcgacgtggtagacggtgttgccggccgcgtccgggtacgtgg

SEQ ID NO: 2766 - DNA, 7558 bp, Unknown
  Kingdom: Bacteria, Phylum: Actinobacteria, Class: Actinobacteria, Order: Streptomycetales, Family: Streptomycetaceae, Genus: Streptomyces
agatacagcacggccgccgcgacctcggcggtggaggagaccctccccagtggcgacgcgtccttcatccgggcggcacggtcggcttcggtctcgcccggcagcagcgacatggtggtggcggtcgcgccggggctgacggagttgatgcgtatcccgtcggcgatgtggtccagggcggcggcccgggtcagggcggagacggccgccttggtggtgatgtagccggccacgccggggatgcggctgtgcgcgccgaggttggaggcgatgttgacgatcgcgccgccggtgggctggtcgcgcatccgggcgatctcggcctggaggccgaggaagacaccggtgacgttgatgtcgagcagggtgcgccagtcctcctcggggaggtcggcgacgggagcgccgccccggaagacgcccgcgttgttgacggcgacatcgaggctcccgaagtgttcgacggtgcggcggaccaacgtcctgacgtcctcggagcgggccacgtccgcagtgaccgcgaccgcccggccgtcctccttctcgatcagcgcgaccgtctcgtcgagcgacgcggcggtacgtcccgccgcgaccaccgaggccccttcggcggcgaaggcgagtgcgacggcccggccgatgccggatcccgcgccggtgacgagaacggctttgccggtgaagcgtgcgggcatggtgatgactcctctggacagcgcggtgtgcgcggttgctcggccatggggcaacgtgcttgctcggttactcggtacggaggctgatgaacgcggcgacggcgagcaggaccgccgtcgcggcgagtgaggtgctgtcggacccgagggtgagcagggcggcgaggacgacggtcgggcccagttccatcgcggtgttcatgacgccgcccgcgagcccggtctgccggggttccaccccgtccgtcgccaggacagaggcggccgcgaagccggcggccgcgccggccggcagcaggagcaggccggggaggagcccgtacgcgtaggaggtgtgcggtgccaggcccgtgagcgcgatcagtacgaggcccgtggaggccaccgccagcccggcggtggtcacggccggcgctccgtacctggcgatgagcgggcccgccgtacggcccgagacgagcagcgccaccgcgaagggaacgaagccggtggaggtcgccagcgccgaccagtcgcggtcctgctgaagatggagcgagagaagcgtgaacgtcgtggcggtcccggcggcggtcagaccgacggcgacgagcgcgagggcccggcggcggtcgcggaggaatccgaggggcagcagcgggtcgcgccggtggcgctcgaccaccaggaaggccatgaacagcgcggccccggcgagcaggggagcgaggacggccgccgatccccaggggcgggcctcggtgaggacgaggccgtagctggccagggtgatcccggcggtggagagcagggcgcccggcaggtccagggagcggcccgcgccggccggggtcgccggcaggagccgtggcgcgaggacgagggcgagggtggccaccacgaccgggacggccagggcgagccgccaggacgcgagggccgagatgaccccggagagcaggtgccccgctgtggcgccgatgaccgacaggccaccccaggtggccatcgcctgtccgtacgccgcgggttgggggaaggccgcgcgcagtacggccatggccgcgggtgcggcgagggcggcgccggcgccctgcgcgaagcgggcggcgagcagggtccccggtcccggggcgagcagtgcggcgagggaggcggcggtgaacacgagcagcccggcggtgagggcgcgacgcccgccgaagcggtcggcgacccggccgccgaagaggaggagaccggagaaggccagcccgtaggcggagctgagaaggatcaagtcggtccggtcgagcgagaattcgtggcctatccggggcaacggcacgacgagcgaggtgagcgtgaagagcagcgacatctggacgatgccgagcagtgcgaaggcggggccgggtgcgggcccggccgaggcggcctcggtcgtgctgttccagctctgtgttccggccatgtctcccccgatatttgactgaacgttctgctatgcgggcatgaaggcacctcccgcaggaggtgtgtttcagtcgaacggactcagtcgagcggcctcagtcgagcagactcaatgcctgttcggcggcgtcccgggtccggcccggccccttcgacgccttgccgacgatccgcaggccttgcatcagtacgaggagcatccgtgcgagtgcccgcggatcgcgctccgcgggcagctcgccctgcgcctgggcgcgtgtcagcgccgagtgcagcagcgtctcgaagtggtcccagctcgcctcgacccggcgggccgccgccggatcgtgcgggcccagttcggcggccgtgttggtgacgaagcaccctttgacgcgatggtcgtcggcgttcgcctcggccgcgaaccgccgcaccgccgcacgcacggcgggcagcgcggggcccggctgggagagctcgtgcagcaggttcgagtcgcggttctcgctgtaccggtccagtgccttcaggtacagctcgtgcttgttgccgaacgtggcgtagatgctggcgcgcccgatgccgagatgctcgacgaggtccgccatcgaggtcgcctcgtagccgcgctgccagaacagctggagggctgactgcagtgctgcttccgggtcgaattccttggtcctggccacggttgaaccctaggcgatagtgaaacgatcggtcaaatatcatttccgcggtggctgccttcgacactcggcggcacggtggagatggcactgcgctggctccccgacccgggacggggcctggtggcggcgatcggactcgccctgccgctcgcggtggagcgtacggccctggcggctccggacctgcggcgacggcgcgggcacgaggtgtggcgacggccgtcaggagtcctgggcccgcaccagcgcgtcgccgacaggggtgcggtagtagagcacggaccgtcccgcacggcgtcggccgaccagtccggcatccaggagcaccttgaagtggcggcccaccgaaccgagaccctggcccgtcatcgccaccaggtgcgtcgtgctcatcgggctgtccagaagcatcagaacactcgcccgcccggcaccgagcagcttggccagcgcctccggagcggcggttcgctcctgctccgccagcgtgcccgagcaggggtacaccacggcgttgcggtggaccgcgccgcgggagtccggccggtccgtggagatccaccccctgcgcgcggtgaccggcacgaaaagcagctgtgcgcccatcagttgccggggcggaaaggcgcgggtgttgatctgcaaccggttgccgcccagccagcgcatctccggatgcatgccgtccagagccgctgcccagcccagtcggctcaactgacgtgtacgcgcgaccacatcggcctcgatgacacgccgccgtcgcgaccagtcgggcgccacggtctcccgccacacccactccagcaggtcggcgatacgctccggcagatcggcgcgcagcaacgggcccggcagcggcccccggtgagcgatctccaggtcgccgcgtgccgtgtcggccggcgtctcacggatccgcgccagctcgtcatggaactccgcaccgccctgcgcctcaccctcccggaacggcaccggtgtcacgaagtcggcgatccaccggtacctgcccagggcgacgcgtaccagcagagcggtgaccggatcggccgacagccgttcacggtaggcgggcccgtacctctccagccagcggcgctcggcggtgtgcgcgggggattccctctccagggcgatcaggctcgcggtcgtctcgcagagcggcgacacgacgaaccggctgctcgcgaccgtatccgcgttgacttcccagcaacccaatggtttcgcctccccgcgaaacattacttccgtgccggaacgcgtgccgacactccggccatgcgcacctaccaggagcttttcaggactccggagttcaccccactgctctcggccaccgccgcgcacgtggcggcacagacggtcagcaggacggccatcgggaccctcgtccacgacgcgacgggctcaccgttcctcaccgctctcagcatgttcggcccgttggtggcgcagatcatcggtgcgaccttcctgctgtcggcgacggaccgtctgccgccgcgcgccgcgaccaccggcctggcgctcttcttcgccgcggtcaccaccgtcctggccctgcccggtctgtccgtcgcggcgatcttcgcgatcctggcggtgcagggcatgctcggctcggtcggcggcggggtgcgctacggactgctcaccgagatcgtccccgccgagggctacctgctcggccgttcggtgctcaacatgtgcgcgggaaccctgcagatcttcgggtacgccctcggcgccgtgctcgtcagcgtcctgacgcctcgcggggccctgctgacaggcgccgcccttttcgtcgtggccgcgtcggtcgcccgcatcggtctcgcgagccggccgccgcgcgcacaggggcgtccgtccgtgcgggagacctggcggagcaacgcgcgcctgtgggcatcgaagccgcgacgacgcgtctacctggcgctgtgggtgcccaacggtctcgtcgtcggctgcgagtcgctcttcgtctcctacgccccacgccacgcggggctcctgttcgcctccgccgcggtgggcatgctcgcgggagacaccctgacgggtcgcttcctgtccccgcagtggcgcgacaggctcggtgcgccacccctgctgctgttgctcgccgtcccgtacctgatcttcgccctgcacccggccctgcccgtggcgctcgccgccgtgaccctggcctcggtcggcttctccgccaacctgctgctccaggaacgcctgatgaccatggtcccgggtgagttgcggggacacgccttcgggctgcaccactcaggcatgttcaccatgcagggggtcgcggcggcagtcgccggcggcatcgcgcagctctcctcacccgcgaccgccatgaccgtgatggccgccgcctccgtcgcggtcaccctcgtcctcacgcccggcctccggcgcgagggtacgtcggtcgaagacgcgccgaccgaagacgtaccgaccggagacacgccgaccggagccgacgtcggccgcaggctcaccgacacgggcaagggcctcaggccgtgaagtacggccacggcgaaggatccggctccgacggagaagggaaacccgggacaggagcagggcgggcccggccgagccgggcccgccatggagtcaggacctgacgagcgtgatgtcgtcgctccggaagtcggtgacgctcacggggtagtcacggtcgtccgcggtggccagtccccggagcacggcggcgccgggctggaaggaggcggtggggtcgatgttgctgggaaaggacgtggtccacgggaccggggagccgggctcgcagacaacgatcaggttctcgtgcgagccggtcgccgtcgtgcgcttctgcgtctggtaggcgctgacgttgatgctgatgcgggccggcttgttgcaggtggtggtgccgccgacggtgatctcaccggtacgggaggccaccgtgcccgtggtgttcagctgcacgccgatggcgagttccgcgggcggctcgggcatacgggcgtggagctcgccgcgtacgggcagggtggatccgctgcaggtccgctcgaaggtggcgtcgatctcacggatgtagccgtgaggtccgtaagcgacgtgcgagacggtgaaggaaccggtgccgctctcgcagtacctgtcggtcacgctgaactgcagctgggggtcctcgggctgggcctcgggccaactgcgcgcgttggagtaggtggtgccgggcacgagcttctggccgtaaggggctgacatggacagggcccagcgctcgccctcgggagtgacgaccgtggcgcccacagcggactccgaggtcggcccggagatgtcgaacatctcggtcgtgccgggggtgtaggcgtaggactgaccgccggagatgtactcacccggctcaccgctgaagctgagggaccccgtcaccgcttcatgggcctgcgccgtgcccgtgagcggggccatcgtcaccgccagtgcgaaggccgctgtgaggacggccgccgtacgggccgcgtgacgacccagtgtgctgcttctgatcatgatgcttcctcaaacgttcggtcgtgcgcggcgcacccgtcgcatgggcggacctgccgtacccagcgcatcccggctgcgaaacgtcacacggccacggattccggagccacccgggccgtccctcaccgcgtgcggacggtgacggcttcagtgacgtttcttcgactccgaacgcagagatggtggggcggatcgggcgaggcgtgggtacggagagggaagtgtgggggtgcacgacgcggagctcggcgctgctgtcgagcgagctcagcagggggacgacgaagggttcgcgatcgcctacaggctggtgcagcccggcctgatcggctacgtccgggggctggtcggcgaggacgccgaggacgtggcctccgaagcctggctggagatcgcgcgcgacctgggccgcttccgcggcgacggcgcgggtttccggggttggacggcgaccatcgcccgtcaccgtgccctggaccatctccgcaggcagaaacggcgaccgcgtacgtcattgctggaacaggacatgctggaaatgccgggcggacacgacacggcagccgcggtcctggagaagctctccacggagcaggctctcgaactgatcgggagcctgccgcgtgaccaggcggaggcggtactgctgcgagtggtcgtcgggctcgacgggccggcgagcgcgcgggtgctgggcaagcgtcccggcgcggttcgcaccgcggcgtaccgggggctgaaaagactggcgggacaactcacccgggccggagcacgcggtgcgacgcctggagcacggcgcatgctgaaggatgggacatgaatcccgaaccggtggatccccgtacccctgagctggagacgctgctcgacgtcgcgagccgccccggcgtcctcagtccggctgccgaggagaaggcgctccacgccttccgtacggcgcacggggaaggcgcgcacgcgtcgccgccgcgccgacggcgcagacgggacgactggcggccggtcgatgagcggcgctggtcacggtcgttcaaggcgctgctggcggctctcgtcacggcggcggcgctcggcggggtcgcggtggcggcggggtccggtgacctcccgtcgccgttcggcggtggcgcggagccgaagcccggtcggaacgcgcccacggtacccggc

SEQ ID NO: 2767 - DNA, 11077 bp, Unknown
  Kingdom: Bacteria, Phylum: Actinobacteria, Class: Actinobacteria, Order: Streptomycetales, Family: Streptomycetaceae, Genus: Streptomyces
cggcgggcccgggcccgccgccccttctcgcgtacgtcaggtccgtcagaccgccgtcgccggggtcgtctccggccgctcggcggacgggccgggcagcggcgcgggtgcgtcgtcgccgcgctcgcgcatgctcagcacgagccggatcacggcgatccacaggatggccgagccgaacatgtggacgccgacgaggatctcggggacgtcgctgaagtactggacgtacccgatcgcaccctgggcgagcagcacgaccagcaggtcgcgggcgcgggcccgggcgtcggcgggagcgtcgaccacgcgcagggccagcaacatcgcgatggccagggcgcagacgacccaggcggagatggcgtgcacatgggcggcggccgaccagtcccacggcatgcgcggtacgtcgctgctgtcgccggcgtgcttgccggaaccggtcaccgaggtgcccagcacgatcaggaccaccgtggtcgccacgatcgcccacgcgaggcgccgcaccggcagcggagtccgggggcgcggcggaccgtcgccctcaccgacccgcacccaggtgatcacggtgaccgcgaggagcgcgttggccagcaggaagtgcccggcgaccgtccaggggttgaggcccgcccagaccgtgatcccgccgagtacggcgttgcccagcacgatccagaactgcagccaggccagccgggcgagcttgcggcggcgcggcttgaccgcgctgatggcgatgatcgcccagccgaccgcggccgacaggacgtaggtcagcatccggttgccgaactcgatcgcgccgtgcagcccctgttcgggcgtcgcgaacaggctgtcgtcggtgcacttgggccaggtgtcgcagccgagccccgaaccggtgagccggacggccccgccggtgacgatgatgaagacgctcatcaggacggcggagagcgcggcgcgcttcaccaccttggtggacggcgtccagcgcttggcgatgagggagatgggggtttccacgcggaccatcgtaggacggggcttgtgcatgatttcacgagggggtgggttcgtacccggttgcccggacacgtccagccgtacggccccggtcggcctactcccagcggaagaacttcgccgccgcgccgagccccagcaccgcccacaccgcgaggatcccggccgcggcccacggcatcgacgcaccgtgctggaggacgtcccgcaggccgtcggagagcgccgacacgggcagcagccccagcaccgactgcgcggcgtccgggaactggtccagcggcacgatgaccccgccgccgaccagcagcagcaggaacaccaggttggcggcggcgagcgtcgcctccgccttgagcgtccccgccatcagcagcccgagcccggagaacgcggcggtccccaggacgagaagcagcagcacggagagcgggttgccctcgggcgaccagccgagcgcgagggcgatcgccgtcagcagcacgatctggagcacctcggtgaccagcaccgacagcgtcttcgcggtcatcagcgcccagcggggcagcggggaggccgcgagccgtttgaggaccccgtaacggcgttcgaagccggtggcgatggcctggccggtgaaggcggtcgacatcacggcgagcgccaggatgcccggggccaggaagtcgaccgacgcgcccgagccggtgtccacgatgtcgacggcgctgaacagcaccagcaacagcgtcgggatgatcaccgtcagcagcagctgctcgccgttgcgcagcagcatccgggtctccagcgcggtctgcgcggcgatcatgcgggggagcggggccgcgccggggcgcggggtgtacgtaccggcgctcatgcgtgcggctccttgccggtcagttgcttgccggtcagttcgaggaagacgtcctccagggtgtgccgctccacggcgatgccttcaggcatcacgccgtgctgggcgcaccaggaggtcaccgtggccaggagctgcgggtcgatggacccggtgatccggtacgtccccggcagcggctcggcggccccggagccgtcgggcagcgccttgacgagggagccgaggtcgagtcccgggcgtccggtgaagcgcagggtgttctccgcgccgccccggcagagccgctccgggctgtcccgggcgatgacccggccagcgtcgatgatcgcgacgtcgtcggcgagcgcctcggcctcgtccatgaagtgggtggtcagcaccacggacaccccgtcggtgcgcagttcgcgcaccaggtcccaggtggagcggcgggcctgcgggtcgagtccggcggtcggctcgtccaggaagaccagctcgggccgtccgacgaccgccatggccagcgagaggcgctgctgctggccgccggagagccgtcggtaggtggtgcggccgcagtcgccgagaccgaggcgttcgatcagggcgtccacgtcgagcgggtgggcgtgcagcttcgccatgtggcggagcatctcgtcggcgcgtgctccggagtagacgccgccggactggagcatcaccccgacccgggggcgcagccgctccgcgtcggcgaccgggtccagtccgaggacccgtacggtgccggcgtccgggctgcggtagccctcgcaggtctcgatcgtggtggtcttcccggcgccgttcgggccgaggacggcggtcaccacgccggtcgcgaccaccagatcgaggccgttcaccgcggtcttcgtgccgtaccgcttcaccaggcccttgacctgtacgacgggctcgttctccatggcgcaccagtctaggcagggtccctgtcggcacggctcccggggccagattaggtaaccctaagtgacgaacggcaccgttgatcgttccggaccgtggttgtcagagtcgaatgaattacgcaacaatggtgttgtgaaatacgacggacgggctcctcaggaggacctcgcgaccggtgagcgctccacgcgcaaccgggtcgcgcgctccatcctggaccatggcccctccaccgccgcggacctcgccaagcgcgtgggtctcacccaggccgccgtccgccgccacctggacgccctcgtctcggacgatgtcgtcgaagcccgcgaacagcgggtctacggtgcgcggacccgcggcaggcccgccaaggtgttcgccctgacggactgcggccgggacgccttcgaccagtcctacgacaagctggccgccgatgccctgcgcttcatcgccgcgtccgggggtgacgaggcggtgctcgccttcgcccgcgcccggatggccgcggtgggtgaggcgtaccgcgcggtggtcgaggccgcggagcccgcagggcgcaccgaggccctggccaaggccctgtcggccgacgggtacgctgctatggcgcgaagcgcgccgggcccgcagcagggcgagcagctgtgccagcaccactgcccggtggcgcatgtcgccgagcagttcccacagctgtgcgaggcggagacggaattcttctccagcctcctcgggacccatgtgcagcgtctggccaccctcgcccatggcgatggtgtgtgcacgacatacgtgccgcgaagtggccacgctccacccccacagaccacccattcagcatctgcaagcacggccgggaggaaccccgcatgacgctccccacggagactgcccaccctgagctcgagggtctgggcacgtacgaattcggctgggccgactccgacgcggcaggcgcggcggcgaagcgcggtctctccgaggctgtcgtccgcgacatctcggagaagaagaacgagcccgagtggatgctgaagctgcggctcaagggcctcaagctcttcggcaagaagcccatgccgaactggggctccgacctgtcgggcatcgacttcgacaacatcaagtacttcgtgcggtccacggagaagcaggcggcttcctgggaggagctgcccgaggacatcaagaacacgtacgacaagctcggcatccccgaggcggagaagcagcgcctcgtcgccggcgtcgccgcgcagtacgagtccgaggtcgtctaccaccagatcaacgaggagctggaggcgcagggtgtcatcttcatggacaccgacaccgcgctgaaggagcacccggagctcttcaaggagtacttcggcaccgtcatccccgtcggtgacaacaagttcgcctcgctgaactcggccgtgtggtccggcggctcgttcatctacgtccccaagggcgtccacgtcgagatcccgctccaggcctacttccgtatcaacacggagaacatgggccagttcgagcggacgctgatcatcgtcgacgaggacgcctacgtccactacgtcgagggctgcaccgccccgatctactcctcggactcgctgcacagcgccgtggtcgagatcatcgtgaagaagggcggccgctgccgctacacgaccatccagaactggtcgaacaacgtctacaacctggtcaccaagcgggccgtggcctacgagggcgcgaccatggagtgggtcgacggcaacatcggctccaaggtgaccatgaagtacccggccgtctacctgatgggtgagcacgccaagggcgagaccctgtccatcgccttcgcgggcgagggccagcaccaggacgccggcgccaagatggtccacatggccccgaacacctcctccaacatcgtctccaagtcggtggcgcgaggcggcgggcgcacgtcctaccgcggtctgatcgagatcggcgagggcgcgccgggcgcgaagtccaacgtgctctgcgacgctctgctcgtcgacacgatctcccgctcggacacctacccctacgtcgacgtccgcgaggacgacgtgtcgatgggccacgaggcgaccgtctccaaggtctccgaggaccagctcttctacctcatgagccgcggactcaccgagttcgaggccatggcgatgatcgtgcgcggcttcgtcgagccgatcgcgaaggagctgcccatggagtacgccctggagctcaaccggctgatcgagctgcagatggagggttcggtcggctaggtccctcacccgaggaccaccgggacggccgtccgcggccgtccccgccccaccgaatcccccgagttcttgacttaagaaagcgagcactacgacagccatggctgaggctcagaacactccggcgggctccaccaccgccggctccatcgcggtggccgccgagtcgaccgtcgccacccgcatgagcgcacccccgtccttcgacgtcgcggacttccccgtcccgcacggccgtgaggaggagtggcgcttcacgccgctggagcgactgcgcgggctgcacaacggcaccgccgtcgccaccggcagcggggtgaaggtcgccatcgacgcccccgagggcgtcacggtcgagaccgtcggccgcgacgactcccggctcggcaaggccggcatcccggtggaccgggtcgccgcccaggcgtacagctccttcgagcaggcctcggtcgtcacggtcgccaaggaagccgtgctcaccgagccgatccggatcgccgtgcacggcgagggcggcgtcgcctacggtcaccagctcatccagctgggcgccttcgccgaggccgtcgtcgtcatcgaccacaccggtgacgcggtgctcgcggccaacgtcgactacgtcctcggcgacggcgcgaagctgaccgtcgtctccgtccaggactgggacgacacggccgtccacgtcggccagcacaacgcgctggtcggccgggacgcctccttcaagtcgatcgtcgtcaccttcggcggcgacgtcgtgcgcctgcacccccgggtggcctacgcggccaccggcggcgaggcggagctcttcggcctgtacttcaccgacaagggccagcaccaggagcaccgcctcctggtcgaccacaacaccccgcactgcaagtccaacgcggtgtacaagggcgcactccagggcgacggcgcgcacgccgtctggatcggcgacgtcctcatccaggccgcggccgagggcaccgacacctacgagatgaaccggaacctcgtcctcaccgacggcgcccgggtcgactccgtacccaacctggagatcgagaccggcgagatcgtcggcgccggccacgcctcggcgaccggccgcttcgacgacgagcagctcttctacctccagtcccgcggcatcccggccgaggaggcccgccgtctcgtcgtgcgcggcttcttcgccgagctggtccagcagatcggtctgccggacgtcgaagcgcgcctcatcgagaagatcgagaccgagctgaaggcgtccgtctgatgtccttcgtcaaggtctgtgcgctgagtgagctggaggacgacaccccgaaacgggtggagctcgacggcacacccgtctccgtcgtccgcaccgagggcgaggtgttcgcgatcaacgacatctgctcgcacgcgaacgtgtccctctcggagggcgaggtggaggactgcgcgatcgagtgctggctgcacggatcgtcgttcgacctccgcaccggcaagccgtccggccttcccgcgacgcgccccgtccccgtataccccgtaaagatcgaaggggacgatgtgctcgtctccgtcacccaggagtcctgagtcacccatggcaacgcttgaaatccgcgacctgcacgtcaccgtcgaggccgacaacgccacgaaggagatcctcaagggcgtcgacctgaccgtgaagcagggcgagacccacgccatcatgggccccaacgggtccggcaagtccaccctcgcgtactcgctcgcgggtcaccccaagtacacgatcaccagtggcacggtcaccctggacggcgaggacgtcctggagatgtccgtcgacgagcgggcccgcgccggcctgttcctcgccatgcagtacccggtcgagatccccggtgtctcggtctccaacttcctgcgcacctccgccaccgccatccgcggcgaggcccccaagctccgtacgtgggtcaaggaggtcaaggagacgatggccgggctccagatggaccccgccttcgccgagcgcaacgtcaacgagggcttctccggcggtgagaagaagcgccacgagatcctccagctggagctcctcaagccgaagatcgccgtcctggacgagaccgactccggcctggacgtcgacgcgctcaagaccgtctccgagggcgtcaaccgggtccgcgagaccggcgaggtcggcaccctgctgatcacgcactacacccgcatcctgaagtacatcaagcccgacttcgtgcacgtcttcgccaacggccgtatcgcggcctccggtggcgccgagctggccgaccagctggagaacgagggctacgaggcctacacgaagggtggcgcttccgcgtgactgacgcccgacaggggctcaccggcctcctcgacaccgaggcgatccgcaaggacttcccgatcctggaccgcacggtccacgacggcaagaagatcgtttacctggactccgcggcgacctcgcagaagccgcgtcaggtcctcgacgcgctcaacgagtactacgagcggcacaacgcgaacgtgcaccgcggcgtctacacgatcgccgaggaggccaccgcgctgtacgagggcgcccgcgacaaggtcgccgccttcatcaacgcacccagccgcaacgaggtgatcttcacgaagaacgcctcggaatcgctgaacctcgtggcgaacatgctcggctgggcggacgagccctatcgggtggaccgtgagaccgagatcgtcaccacggagatggagcaccactccaacatcgtgccgtggcagctgctctcgcagcgcaccggcgcgaagctgaagtggttcggcatcaccgacgacggccggctcgacctctcgaacatcgacgagatcatcaccgagaagacgaagatcgtctccttcacgctggtctcgaacatcctgggtaccgtcaacccggtcgagcagatcatccgccgcgcccagcaggtcggcgcgctggtctgcatcgacgcctcgcaggcggccccgcacatggtgctcgacgtacaggcgctccaggccgacttcgtggccttcaccggccacaagatggtcggcccgacgggtatcggcgtgctgtggggacggcaggagctcctggaggacctgccccccttcctcggcggcggcgagatgatcgagaccgtgtcgatgcactcctcgacgtacgcccccgcgccgcacaagttcgaggccggtacgcccccgatcgcccaggccgtcggcctcggcgcggccgtggactacctctcggcgatcggcatggagaagatccaccagcacgagaaggcgatcaccgagtacgcggtgaagcgcctcctggaggtcccggacctgcggatcatcggcccggcgacggccgaggaccgcggggccacgatctccttcacgctcggcgacatccacccgcacgacgtgggccaggttctcgacgagctgggcatcgccgtccgggtcggccaccactgcgcccgcccggtctgcctgcggtacggaattcccgcgacgacgcgagcgtcgttctatctgtactccacgcccgccgaggtcgacgccctggtggacggtctggagcacgtccggaacttcttcggctgagggctgacaggtgaagctggaatccatgtaccaggaagtgatcctggaccactacaagcacccccacgggcgcggcctgcgggacggcgatgccgaggtgcaccacaccaatccgacgtgcggcgacgagatcacgctccgggtgaagtacgacggcgagaccatcgccgacgtgagctacgagggccagggctgctccatcagccaggccagcgcctccgtgctgaacgagctgctcgtcggcaaggagctgtcccaggcgcagaagatccaggacgccttcctggagctgatgcagtccaagggtcagctggagccggacgacgcgatggaggaggtgctggaggacgccgtcgcgttcgccggcgtctccaagtaccccgcccgggtcaagtgcgcgctgctgagctggatggcgtggaaggacgcgacggccaaggcgctgtccgaagggaagaccgcatgagcgacaacgagaccgtgaccatgaagccggcctccgaggaggaggtccgcgaggcgctgtacgacgtcgtcgaccccgagctgggcatcgacgtcgtcaacctgggcctgatctacggcatccacgtcgacgacgccaacatcgccactctcgacatgaccctgacgtccgcggcctgtccgctgaccgatgtcatcgaggaccaggcgaagtccgccacggacggcatcgtcaacgagctccggatcaactgggtctggatgccgccgtggggcccggacaagatcaccgacgacgggcgcgagcagcttcgtgcgctgggattcaacgtctgacccgtccccccggacggcttcgacgtctgacccgtccccggacggttccgacttctgacacgtcccccggacagtggtgaacggccatgcccgccaggcacactggcgggcatggccgttcgcatgtaccacatcgccgtcgacgctcacgacctgccgctcgtcgcccgtttctggagcgcggtgctggactggcaggtgctcttcgaggacgaggaggagatcgtcatcggcgcccacgagaccgcgctgccgggcatgtgcttcctcgccgtgccggaggggaagaccgtcaagaaccggctgcacatcgatctgacccccgacgaccgggacgccgaggtcgagcggattctcgcgctcggcgcccggcgggtggacgtcgggcaggggccggacgccaccttcgtggtgatggccgatccggagggcaacgaattctgtgtgctgcgccccaagcggaccctgaccgactgagcccggtccggccactgcggagtcaggagtgtgcgggcggcgggccgtactgctcgggcagggtcgctgccgccgcctcggccaggacagggcccaggttctccttgcgcatccggaggtcgacgtacagcaggccgaccatcagcggcgggaagatcgccgtgaacagctgggcgatcatctggctgatgaacgacagcaggatcaggccgccgaacagggcgatgagctccccgccgctcgggtcggcgtccacgtccgtggtgtcgaacacgccggggagcatgccgaccatctggaacggcatctggatcatgtagccgatcacggaggcgagtccggaggcgagcagtccgacgccgaagacccgccaccagctgccgcgtaccagttgggccgagcggcgcagggccgcgaccgggcgctggtcctcgaagaccacgaccgtcggggccagggagaagcgcacccagagccagatcgccacgggggcgacgaccagggtgccgagggagccggccacgatcagcggcacgacgccgtcctcgtcgcccagcgtgacggcgtagacgatcagcccggcgaaggcggccaggaagagcgccaccgggatgaccatgatcagcccggtcaggaaaacggtgccgatgatggaccaggcgcgcgaccacgctcggcgccacacggcgccgaagcggatcgggcggcccagtacggcttcctggaggacgaccgggaccgccgcctgcaccacggccgacgccagcaggtagacgatcatgccgacgagcatcagcacaccgaacgcgatacccagcgggaccagttccgaggagtccggggatcccggggagctggaggtgagctcgtcccagtgggtcgcgacggcggcgccggcgaccaccagtgcggcgatcatcacgagcgtcgccgcgccgaacagcgtcagggccatcccgatcagcggcttccagtaccgcccgagcgtcgagaaggcgccgctgagcatgtccgagaccctcagcggcgccttctcgac

SEQ ID NO: 2768 - DNA, 7374 bp, Unknown
  Kingdom: Bacteria, Phylum: Actinobacteria, Class: Actinobacteria, Order: Streptomycetales, Family: Streptomycetaceae, Genus: Streptomyces
gccaccggaccgcacggcgccggagtcatcgtcgcgatcgacaccgaccacctgcgcacgctcctggacgccggacggaccgtggtgatcgccggtttccagggcgtcaccgccgacggcgacatcatcacgctcggccgcggcggctcggacaccacggctgtcgcggtcgcggccgaactgcggtccggccactgcgagatctacagcgacgtacccggcgtgttcaccgcggacccgcgggtcgtcaccgacgcccggctcatggccgacatcgacatcgacgtgatgaccgagatggccttcgccggagcccgggtcatgcactcgcgggccgtcgagcttgcagccctctacgacgtcgacattctcgtgggccggtcgacggccacgcggaccggcacccgtatccatcgacgagacggaaccgacatgctcgaggacaggaccgcggtgatggccgtcgtccacgacaccgacatcgcccggatcaccctgcgcacccacgacaccccggacccctctcccgccgtcttccggttcctggcgaaggagtccattcccgccgacatgaccacggtctcctccgcgcccggcggcggcttctcgctcggcctcacggtgcaccgctcgcacgcggcggacgtcagcaggtcgttcagcgatctcatggctccgaggcggcacggagtcgaggtcgaggacgaggtcgccaaggtctcgatcgtcggtcagggcctgctcagccggcccgagtacgcgtcccggatgctcgcctcgctcgtcggctccggcatcagcgcccggtcgctgtccgcgtcccagctgcgggtctcggtgacggtgccacgctccgacgcggtccgcgcggtgggcctgctgcacagcgagttcggtctcggcgccgagaccggcgcggtccccgcaagcctctctcctcggccttgatcccggtccgagacggcgtacgcgacacccgacgcgccgacacccgacaggagcaccgatggccccgaacgcgcccttcgccaggagtctgcgactccaacggctccatcaccacgaccccgagcggctgttcatcgtcccgctcgaccactccatcaccgacggcccgctgacccgcacccaccgcctggactcgctcgtcggcgagctggcgtcgcaccacgtcgacgggatcgtcctgcacaagggctcgctgcgccacgtggacccggagtggttcacgcggacctccctgatcgtgcacctgagcgccagcaccgtgcacgcccccgacccgaacgccaagtacctggtgtcgagcgtcgaggagagcctgcgcatgggcgcggacgcggtgagcgtccacgtcaatctcggctccgacgaggaacgccaccagatcgcggacatggcggcggtcgcggaggcctgcgaccgctggaacgtaccgctgctggcgatgatgtacccgcgcggccccaggatcgacaatcctcgcgatccggcgctcgtcgcccacgccgtccaggtggccgtcgatctcggcgccgacctggtcaagacgctgtacgtcggatcggtcgcggcgatggccgagatcaccgcgtcctcgccggttccggtcgtcgtggtcggcgggccgcgcgacagcgacgagagccgggtcctcgcctacgtcgaggacgcgctgcgcggcggcgcggccggtgtcgccatgggccgcaacgtcttccaggccaacgatcccggcgcgatggcggacaagctctccgacctcatccacaacagcggcaacaggtccgcgtctccggctccggccggctcggcggccgggcccgcttgatccgcctccccccgttcaccgtcccatcgctactgaggagttcttccatgtcttcgtcttcgtcttcgaaactgacctggctcgatatccgctccgtgggtgaggcccgtgccgccatcgtccaggaggctctgcaccaccgggtggacgcactcgtcgccgatgatcccgccgacctcgcgggcctgccgccgaccgtgaccaaggtcctgctcgtgcagggcaagcagattccggaggagttcggcgaggcgacggtcgtcgtcgtcgacccgtcgaaacacggcgtgacaccggccgaactggccatcaagcacccggagatcgagttcggacggttcgtggagatcatcgacgcgccgacgctggaggacgcctgcgagtcctcgcggaccgagaagtggtccgtcctgctgttccgcgacccgaccaagatcccgctggagatcgtgatcgccgccgccgcgcgggccaccggttcgatggtgaccatcgcgcaggacctggaggaggcggagatcctcttcggggtgctggaacacggctcggacggcgtgatgatggctccgaggaccgtcggcgacgccgccgaactgaagcggatcgccgaggccggcattcccgacctcgacctcaccgagctgcgcatcgtggggaccagccacatcggcatgggcgagcgggcctgcgtggacaccaccacgcacttcggcgaggacgagggcatcctggtcggctcgcactccaagggcatgatcctctgcgtcagcgagacccatccgctgccgtacatgccgacccgtccgttccgcgtcaacgccggcgccatccactcctacacgttgtccaagaactcccgcacccactacctcagcgaactcacggccggcagcaaggtgctcgccgtcgacgtcaagggccagacccgggtcgtggccgtcggccgcgtcaagatcgagagccgcccgctgctctcggtcgacgcggtggcggccgacgggaccacggtcaacctgatcctccaggacgactggcacgtccgggtgctgggtcccggcggcgtcgtgcacaacagcaccgagctgaagcccggcgacgtcgtcctcggctacctgcccaccgccgaccggcacgtcggctacccgatcgacgagttctgcctggagaagtagtcccggccggccgaagaaggcccggtgcccggggaaccgatcggttccccgggcaccgggccttcgcgtggcggacgcgtccgctacatgggcacggccacgatcacgctcgtgggcgcccgggtcggccgggtctccttgtgccggaaaccggaccgctcgaacaggtcgacgtactccgcctcggtccgcacgtgcccggtcagcagcgtcagcatcacgatgtcctcgaacttgccgaagtggggggtgtcgccctccggcggcacctcgtcgatgatgatcagctgacccgaatcgcccatcgcccggcggatgttgcgcaggatgcggacggcgtcgtcgtcgtcccagtcgtggatcgtccaggacagcacataggtgtcgccgccctccgggaccgactccaggaagttcccgccgacgcactccgcccggtccgagaccccgagccccgccaggaccgcctccgcgtccggcaccaccctcggcaggtcgtggaccaccgccgtcatctccgggtagcgctggagcagcgagcccaccagccgcccgtgcccgccgccgacgtccaccagccggcgcacgtccgacaggtcgtaggcgtccagcgtgctggagttgaccatcaccgacatgctgctcatcgcgctgttgaacagcgaggccagctccgggtgctgggagaagtacgtccaccagtccatgccgtgcaggtggttgaaggcgggcttgccggtgcgcaggctgtgccccagcgcgccgaaggagttctgccgcatcggcagtcccacgtaccgggccaggtcccgcatcgagcccggtacgtcgctgcgcagggtggccgccagcggggtgagggcgaaggagcgcggctccgcctccgtgaagaccccgacactcgccagcgcccgcagaccccggtagagcgcgcccgggtgggcgccggtccgctccgcgatgtcgtccacatggcgcacctcgtcaccgatggcgtcggcgacccccagatccgccacggcgatgatcagctggctcaccagggagctgtagagcatctcgtacatgcggaccggcggcgggacgtctccggcgggctccgggctgaactcgtaaagggtcatgtgctgctctcctcggcgcccggcgcgggccggacgagtacgtcggcgaagtgttcgcgcaggctgcgcttgaggaccttgcccgtggcgccggtcgggaagtgctccggctcggtggcgacgaccgccgcgctcagggcagtgagcccccgggcgcgcaggacgtcgttgagcgagcccaggaggtcggccggagccttcgccccgggcttcagcaggaccgtggcgaacgggacctgcttgccgagcggcgggggagcgtcgaccgcgacgaccgcgcagtcggccacctcggggcggcccagcaggatcgcttcctcgatcggcaggctgtagaccggcccctcggcggtgtcgatgacgtcgggcacccggtccagatggaagaaccggccgcgccggtcccggtagacgacgtccccggtcagccagaagcccgagacggacgactttcccgtcagctcggtgttgccccagtaacccggcgtgcgggtcggcgagatgacgccgagccggcccgcacggccggggccgagctggcggccgtcggggtcgagcacggtggcgcgctccaccaccttgaccggcctgccgacgcaccggtcgtagtcctgccgctccggctcactgaccttgcggaacagggccatgcccatctcggaggagccgagcccgtcgatgaaccgggagccggcgcgcgaggtaccccgccggccgggccgtcggccgtgccggatcagggccttgatgtgcgcctcgtgcgcggagtcgcccgtgttgatccaggtgtggacgttcccgaccgccgacggcgacaggtcgagcccggccagttccgcgtacgtctgggggaaggcgaccaccagggtcggccggaaccacccggccgcgtcgtgcaccgcctcacccgaggagtccgccatgaccagggtcggcagccccagcagggtggccgtcatcagatagctgatgcccgccgagtgggtctgcggcagggcggacagcatcctgttggcacccgcgtccgggaagctcaccagacggtgccgcttgccccggaagaactgccggtggccgaaggtgacggccttcggcggcccggtcgtgccggaggtgtggcacagcatcacgaggtcgtcctcgccgtgccggtaggggaagacgccgggcagcgagggccgggcggtccggttgcgggggaaggagcggaggtccttctcgaaggccaggttcttcggcagtccgcccgactcgcggagccggtcgatccccccggccgtgccgaccaggccgtacaccccgacccggcccaggtactcggcggccacggccggcttcatccggccgttgaccagtgcggcgatggcgcccagcgagctcagcgccagaaagtgcagaaaggcgtcgacgccctcgccggcgtagacgccgaccgggtcgcccttgcgcacgcccgcctcgtggtaccaggaggcgtacgcatcacgtatctccgtcagccggtcgaggctcagacgctccagaccgtcctcctccgttccctccgcgtgctgcgcgaggaggaagggggccgacgggtcggggctgacggcacgggcatgatcgaggaagctgcccaccccgagggtgggttcggccaggagccggagcctggcacgcagcggcatccgtgccgccggcgcgaggcccatgctgatgacgccggtattctggcgcatgcgttccttcctgggagaaggtgcgatggagcctggaagaggtgcggggggtcccggagcagtgccgggaagcccgggaaccgtgcgggggattccgggggggccaggaacctccgcccgccgccgcccgcgcggaggcgcgcgacggcgggcggagcggccggatcagccctcgtagaccgtcagctcgtaaccgtcggggtccttgaactggaactcccggccgcagaatccgtcgcacggcggcttcgtgatggtcacaccgtggtccgccaccgtcttggccagaccgtccgggtccttcgccttgatccacaggacgacgccccagccgagctccgtcacggagtccaggtccacggtggcctggcgcagggcgatcttgatgggctccgtctccagcacggcggcggtggggaccttggactccgtctccttgaagccgatcacctccgtgtagaagcgccgggcccgttcgacgtcacggacctgaagggtgaggaagttgggtccgatcgcgttcgtcatgaagtgcctctctgccgttgcttcaccaacccttggacggctcaagtgtgttggggcacgggatacgcggcatcacgtgttctcgtgaactccgcggaggccatcggctcagccggatccggccggcgggatctcctcgtgggtcagcacctgccgggtcagctcgacccggctggtcacgccgagcttggtgaagctgtgccgcagatggctgtccacggtgtgcggcgagaggaacagcttctccgccacctcccggttggtcagcccctgcgccaccagtcgcacgacacgcagttcggacggggtcagctggtcccaccgggcccggggaccctcgaccgggtccaggtcccggtcccgcccccgggtccggcgccgcaccgccagggagcgcagggtcttgcgtacgcgcagggcgtcgccgcgggcgccgtggctcttgtagcgcgccagcgcctcgtcgagcagaccgatcgccgtgctccgggcgcccgcgtcgttctccgccagcgccaggtcctcggtggccgcggcgagcgagagcggccggggcccggaccggtacgccgacacggcggcccgcagccggtccacgtcgttgcacaggacgccttcggcgtgcgcggcggcggcgaccgccgaggtcaccgtgggattgcgggtggcgaccaggcgcgccgcctcggcgacggccgtggcgcgttccgagtcgccggcgctcatcgccgtacggaccaggcaggcgcccgcgtgcggttcgcgggtcagcagcaggggccgcttcgggacaccggagtagacgcgggagagggtgtcgagcgcggattcccggtcgttctccgcgctgtgcagcagagccgtcacccaggagagctcctccagcgccgcaccgctcgcggccgccgacagccgggacgcgtggtcgacatggcggttggcctccgtcagctcgttgcggtggaccgccacccggatgcgcagcgcgagcggtccgacgg

SEQ ID NO: 2769 - DNA, 22917 bp, Unknown
  Kingdom: Bacteria, Phylum: Actinobacteria, Class: Actinobacteria, Order: Streptomycetales, Family: Streptomycetaceae, Genus: Streptomyces
caagggccggatgcgcgccgagctcgacgtccgctacctgggagcccaccgcgcgggcaggctccccgtcgtcctcgggcgctccgccgacttcctcgggcccggggtcctcaactccacgctcggcggagccgtcttccccgccgcgctcaccgggcaacccgtgcccgcactcggcgacatcgacctgccgcacagctacacgtacatcgaggacgtcgcggccggcctcgccaccctcggcgaacacccggacgcctacggccgcgtctggcacctgccgaccgcggcggcccgcaccacccgcgagatcctgacgctcgtcgaggagcgcaccggccggccgatcgacctcgccgtcgtcgccgaaccccgccccttcggtcccttcgacgagaccttcatggcggagtacgccgagatgttctaccagcacaccgaaccgcagatcctcgactccgccgccatcgagaaggcctacggactcgcccccacccccctggagacggcgctggacgccaccctcgcctggtacggggaactcctcgccgcccagcgctgaacgcggtccggccccgggcgccgtacgtaccgcgcacccggggccggaccgccgacaccctcgctcagtagcgcagccgggacagataccggtagctggcccgcgccgaggcgaacggatcggccggagcatcgtgctccaccagccactgcttcaccccgccctgccgcgcggtgtcgaacatggccgggaagtccaggacccccgacccgacgtccgcgaactccccgttcggcgccatgtccttcacatggagcgcggggaagcggccccggtgccggacgaacagttcgcccgggtcggacgagccgccctcggccgcccagtacacgtccagctcgaaaccgaccagctccggatccgtctcgttcagcaggatgtcgtacaggctgacgccgtccaccacttcgtggtcgccgccgtgattgtggtagagcagcttcagtccggactcccgggcggccagccccgcccggttgaactgccgtgccacctcccggtatccgtccggcgagtgcagcgaacccggcaggctcggcaccacgatccacttgccgcccagcgtatggacgtcctccagcgcctgcggcagcccggagcccgtcacgatgttgtagccgacgtgctccagcaccgccttgagccgggtccggtccagcatctgccggatcgcggcgggggagttgccgtgccgaccgctgacgccgaccgtcgcgtacccgatctccgcgagctgttccagcgtccccgcgaagtccgccgcgagcggcgtccgcatggtgtacaggtgcatcccgatccccgaaggggggatgcgccgacgacccggccggccggccgccgcggccggggccgagccgatcccgacggcggccaccgcccccaacgccgtaccgagaaaggctcttcgggctccgttcacgtgctgcgtacccatggggctcctcacttcacgtcgatgcggacggcgccggtgctcgtgtcgcccttgtcgtcggtgaccgtcagacgcgcggtgtaggcgcccttccggtcataggtgtgcgtcgccgtcgcgccctcgggtccggacggcttcacgttgtcgccgaagtcccagtggtacgaggcgatcgtgcggccctgcgcgggcttgaccgtgctgctcagcgacacggcgaggggagcggtgccggacgcgggaccggccttcaccgtcaccttggtcccgcccttcttctccacgcccggaccgttgaagtgcagccagtcgaccgagagcagatcggccttgtcgggactccagtccgggttggtgaagaccgcgtacagcgtggtcgtgccgcctgggttcttgagcttggtcgtcggagagatcagcttctcgtagccgccggtgtgcgggatcctggccgagcccagcagtgcgccggtgggagagccggcccggaattccaccgtgccaccgagcccgccggaggacgcgccgaccgtcaccgattcgacgcccttgagattcaccgggtcgaaggcgatccagtcgccgtcctcgatctcgatcagccgcttcccgccggacgcgtcggcccgactgccgatgtccgcaccgccgttcgcgccgcccgtcgccgtgcggtgttcggcctcgcggaaggaggtgcgcagggtcagcgaggtggagccggtcagcgccggggcgtcgggagcgcccttgtcctcgtactgtgcggtgatcccgtagtagaggttctgtcccggaccgtgactgtccccggcgtccgtgacgatctcacccgcgcagccggtgtagttgtccagaggatgcaggtgggtgtcatggccgagctgtgactgcaccacgacccgcgagcagtcgatcggaccgctccgaccgtcctcctcgtcggtcacctccaccgtgaacgggatcgtgtccccgaagctgaacatccctccgttcggcggctgttggatggtcacctcgggcctggtgttgcccaccgtgatgtcccgcaccgcgagagccgtcagctcgtcggggccggtcacggtcagccgcgcggtgtgcagtcccttggcggtgtacgtgtgcgtggggtccgcctgcgtcgagtccgtggtgccgtctccgtcgaagtcccaggcgtagctgcccggttgatcgccgggcaggccggagccctcgctggagaacttcacggtcagcgggtccgtgccgctgtcccggtcgacggagatcttggcgtcgggcagccggccgtcgccgacgtagtcgatccggtagatgcccgcaccctcgttgctgcctccgcggccggtgccgctgccgagaccgaagtcgatgacgtacatcgctccgtcaggaccgaagtccgcgtcgaagggctggttccactccatgtcctcgaagatgccgttgaccgactggaggtcccccgccttcacggggtcgaaccgggggtcggtgaacgtctggtcctcgctctggaaggagaacgtcttgaaccagcgccgggtcagctcgtagttgaacgccttcccctcgaagtactccgggaacttggtgcgataggtgttgtcggggtcgtagtcgtagaccgggccgcccatcgggccgcctccgccggtgcccacctccgggaactcggccgaggcggagtaggcgtaccagaccgtggcgggctgggccgggggcagctcccgcaggccggtgttgttcggcgagtcgttgaccagcgccgagcagtcgaacttcggtccggatttcttcgtcgcgaagtcgtagtcgttgaaaggggtgttgttcccgacgcagtacggccagccgaagttccccgcctccgtgatacgggtgtactcgaccgttccctccgggccccggtccgccttcgccgcgcgggcgtcggggccgtagtccgcgaccatcagggctccgctcagcggatcggtggtgatccggaacgggttgcgcatgcccatcgcgtagatctcggaccgggtcttctccgtacccggggcgaagaggttcccctcggggaccgagtacgtcccgtcgtcctcgggagtgatgcgcaggatcttgccgcgcagatcattggtgttgcccgcggtcatctgcgcgtcccaggcgcggcggccctcgccctcgtcgatcggggtgaagccgtccgaggcgaacgggtcggtgttgtcgccggtcgccgcgtacaggttgccgtccttgtcgaaggcgagcgaaccggccatgtgcgagttggcccggccctcgccgcgcagcgtcggcacggtcagcagccgcttctcggacgccgggtcgacggtgttgccgtccgcggtgaaacgggacaggttcaggcgcttctcgaccttgtcggagtacaggagatagagccagttgttctccgcgaagccggggtcgagcgtcagccccagcagcccgtccgactggctggtcatctccggggtgtacgcgaagtccagtgcggtggagaccttcatcgtctcctggtcgatcaccttgagcttcccggtccgctgggcgaagaacacccggcggtcgggagcgacggccagctcgaacgggtcggccagatcactcgtggcgagcggggtccgttggaacgatcccgtgcgggtcgcggtgcagtcgccctccgccgcgccggccgcccactggatgccgccgaggaggtgtctgacgaacccctcctcctggaaggacgccttgtcgtgcccgcccgcagtgaaccaggagcggccgccgtcgtagttctggcaccaggagaacgggtggtccacgccctcgtcgagcccgtcgatcccgtcgcgcaccttgatctgggcgagggtgtgcaccttggacgtggggttggtgcgccagttgtaccactcctcctggcgctcccagaggtcgggaaggtgccgggtcgaggggtgcgtgtggtcgaggaccttgacccggccggtctggggggtggggtgcttgtcgaagatcgcgccgaccaggccttcgtaccactcccagtcgcgttcgctggcggacgcggagtgcagccccacccagccgccgcccgcccggatgtaccgctggagagcggcccgctcctcggcgttgagcaagtcgcccgtctccggggtggagttggtgttgttgaagacgatcgcctggaaccggccgaggtcggcgtcgttgaagaccgaggagtcggcggtggcctccacctcgaagtcgtgctctgctccgagtttccgcaccgcctcgatcccggccgggatcgaggggtggttggagttggtgacctcggagtagacgagcacccggtacgaggcggccgcctgcgcgctgggcggcgacgccaccagcagggcgaggaccagcgccaggagcgaggtgagggcgatgaggggggacgggccgccgggggatcggctgacgcggccggcccggcgtaacgaacggcgtctcatggggcgctccctgtgcggtagatgccgactgcaggatgagtagaaagcgctttctggagtacgccgttcagattaggttcagcccttcgacggggtcaatgggtctgcagggcccagcgcgccgggcggggcgcgaggcccggtcgtgcgtggatgtcggtgccgggcgttacggtcggatcccggcgagaagccgccgggacccctcgaaacggaggcccgggatgaccgccgacgccgcgatcaccgccgctgatgtccgctcggccgcactgtccctgcccgacaccacggagaagctcgcctggggacagcccaccttccgggtggcgggcaagatcttcgcctcgctcggcgacgacgggacggcgatgggcgtgaagtgcccccgggaggaccgcgccgagctgatcgccgccgagccggagaagttcttcgtccgtgaggggcacgacgaccactacgcctggatgcgcgtccggctgtccgccctggaggacgagggtgagctggccgccatcctcgccgactcctggcgccaggtcgccccgcgccggctggcggcggcgcacccggagctggacgtggtgggggaggacgaggggtgagcataggcggggcgaccggtgctggtggcggccgggagtgtgcggcccgcgcgggcggccggctcgatgggtgcggcggtgcgcgggccgggctgacggttcgggcgtgcggatggtgctgacgggccgggctgaccggtgtggcgagcggttcgggcgagaggtcggggcggacgggccggggtgtgcgggcccgcggatcagggccgcaggaatccggtgatccgctcccgcagaccccgcgggtccaggccgtgcgccgtgaggtgctcctccagctgtccgtaccggcgcagctcggcgcgtcccacccccagcccgagcacccggtggggcaggtcgatcagcgcttcacccgccgcggcggcggaggtgcccgccagatacggctccacgatcaccacgtccgcggtcgcggacgcgccggcggcccggcgcacccccgccgcgtcgaacggccgcacggtcgccgcgtacagcacggtgacgtccagtccctcggtggcggcgaggacgttgtcgagcatggggccgaccgcgatcacggtcccgcgccgcccttcgcgcaccgcggtgaacccggccgtgccgctcaccggcagaggctcccggttcgcctggagcgagaggcgtacgtacacgcggtcgtcgccggtgaccgactcccgcagcagggtctcggcctcgtccggatggcccggtacgtgcacggtccagccgtcgagggtgtccatgagggcgacgtcaccgggggccatgtgcgtgaatcccccggccggccagtcgtacgagccgccggcgctcaccaggatcccgccgaccccctggtgcccgaagtccagcttgacctgctcgaacggtcgctcgaccaggaagctggcgaaggtgtgcacgatcggccgcattcccgtcagcgccatccccgcgccgaccccgaccagcagttgctcccggatgccgacgttgatcacccggtccgggtgggcgcgccgggccgggtcgaagccgtcggcgctgatgtcggcgaggacgacggccagtcgcggctcctcgtccaggagccgcgatgcggtgctgatgaatcggtcacgcatggtgtccatgaaggggtccttcccggcggctccggtatgcgaagcggcggtcgcgcggtgggggtacgggggcgatggggtcagttcttgggctcgacgcgggcgacgacggccagcggtttgtccgggtggggtgtggtgaaggccgcgtacagggcctcgtggtcgcgaccgtccgcggtcaccgccgcccatccggcggacgcgaagcgggaggcgatcccgccgggccagccgtgggtggcggacgcgttgtcgatcaccagcgtgtggagctgttcgagcccggcggggcccgcgtgggcgatggcttcgtgattgctgccctcgtccagctcggcgtcaccgatcaggacccatacccgggggtcggtgaggccctgggcgcgcagccccagtacggttccgacggcgagcggcaggccgtgtcccagggacccgctgccgatctccgcccccggcaccagcagccggtccgggtggtggccgagcggtgagtcgtacgctccgaagccgggcagcagttcctcaccgaagaagccgtgcgcggcgaggacggcgtagtacgccatcggcccgtgccccttggacaacaggaagcggtcccggccgggatcgtcgaccgtgtccggtgtgacgcggagcaccctgtcgtagaggacccacagggcgtcgagcgtggaatgggcggcgggggcgtgcttctctgcaccggtcatcagggcgatcagccggccgaggtcatggaattcggggaggccgcgtaccggcgcggcggtcgtgttcgtcatgacaccgagcgttcaacatcaaccgtggttgaggtcaagcccggaatggtgttggtgaccacctgctggagtgcggtattgttctcatgcgcgttcagccaggggaaacccccaggtcagacgggcagcgggacgtggcgcagcttggtagcgcacttgactgggggtcaaggggtcgcaggttcaaatcctgtcgtcccgactggagacagtcgcagatcagggccggtttcggagcaatccgaaaccggcccttgatcatttttggggaccagttggggaccagctggaggtccggcgtccttgaccgtcagcgagtcagcgagtcaggtcgatggggttcggctcccgctgcccgcaggccacccaccatctcctgcaccggcctctctggcagaccgcggcggacaacggcaccgtcctgctggccggcccgcgcatcccggctggcacggcacaccgggtccgggcccggaaccgtatgccgtcgatcagctgccgccgaggccggactggcggcctccccgccttcgtccccttcggcaacaatagcttcagtggtgctcgctgctcgtccgtgagatctccccggccccatagagcatgatcgaggagctgcggggggaggccgggctcgactatccgagtagcgggccctactcggcgtgtatgccggcacaagggtctcaagctgatgtcggacgtctccttctgcaccgtcgttgagacatcaccgatgtacgacaacggccggttggtcaggcatgtgctcccgtccgatgccgagacctctggaaacacgctcggcccacagcggcaagactgtgggccgaggaggagctgagggcatggcagcggagtgccgccgtgccctccgtacgtgcggtcgggtcagtcggtcatgttgcccatcttccagacggtcatggacgtgatgacgctgccgtcaccgaacagtcgcaggccgagggagtcctgacggaaggggtaggcgcgggtggtgatggacttgtgggagttcgcgtatgcctcgatcatcgagcggtcgaggaacacgtcgagggtcaggttgccgcccgagagggtgagcggccccttgtggatgccgaagttaagctcggcgctggagttgttcccggatcgggatcggtcgacgcccagctgtcctgcgggggcgtcgtagaacaggcgggttcgttcttcgtctcctgggctgcggagtacgtcgaggccgaaggtgccggcggtgcctcgttccatggtcagcttgatatggagcatgttgcccttgacggctgccaggcgtgtgttggcatcgttgatggaggtcggtgcggtgatgttgaggagcggttcgccggtgtggaggcgggagacctcctccacgggtcggaagccgaggtctccgtcgggccgcatgttcagttcgatggggaggccggcgttgtgggcccagccggcgtcgtagtgggcgcgttcggtgcggcggtcctgggcgatgctgaagacgagggagcgtcccttgtcgtcgacggttccgctggggccggtgaagtggtcgccgtagtccatcagcttgggctcggtcgtgtcgggtgtccaccggcgggcgccggcgtcccaggtaccgacccagtagtagacgaacttgctgctgtactcgccggggccggcggggaaggccgggttgatgagcagcgcccggcgctcgcggccctgtgcgtccttgccgatgggcaggaaggtggggagttcccagacctggccggtcttggggtgggctgccacgtcgccgaccatcagggggcccgagtaggtccagtcggtgaggttcttggaggtgtagaggagagcggtgccaccgacgtcggcgcccgaggtgttctggacgccggagcccatcagctggaaccaggtgtccccctccttccagacgaacgggtcacggaagtcgccgaagcggaccttgcgtccggcgccgacgttgagatcggcggtctggctggtgaccagggtggggtgcatcttccactcgaccaggtcggggtcgctggggtcgacggggcgggcgagaccggtcgcctggttggggcgctgggagtcgttcccggccgtgaacagcaggacgggcacgccgttctcgtcgagggtggagtcgccggaccagacgccgtcgggtgccacgctgtcggcggtggggaccagggcgtcgggcaggtccttccaatggaccaggtcctcgctgaccgcgtggccccacccgatgttgtgccagtaggggccgtgggagttgtgctggtagaagaggtggtacttgccgttgacctggatcggggcgtggggttcgttcatccagtggttgggggcggtgaagtggtagccgggacggtagcggtcgccgtcgtagcgtgcgcggtccatggccatgcgggccttggggatgctgccgccgctgaacgtctgcaggtccttggcgtggctcgccgtgacggctgcgggggtgagcgggttggtgtggaccttcacttcgtcgatcaggccgttgaacatgttgacggcgaaggtgccgttgatgatggcgggctggttgtggcgtccgatgatcagagggacgtcggccttggcgagccgtgcgttggtggggatggttgtccgggcgacctgtgtgccgttcaggtacagcctgatggcgccttcacccggtgcgaacacggcggcgaggtgggcccacttgccggcgtccagggccgcggacttgggtaccttcgtctcgtaccagctgtcgccggtgccgacgccgaactcccacaccccgtgccgtccgacgccgagggagaagccgcgcttggctcccttgtcctgctggttgacgatggcggagggtttgccttcgtcgccccattcgaaggcgcgcggggcgacccatccttcgatcgtcatgccgtcggtggggatctgtgtcggggatgcggcgcgtgtgacccaggtggagtagccgtcgaacaggagggcgccggagaggatgccttcctcttcgcgttcggtacgccacagtggtgcgctgtccggcttgtccaccgcgtcgttgaagacgtagctgatggggtcggctgcctggctgatcttctcggtggtcgtggtgccctggccttcggagaagtcccagtgggcggccagaccttccaggccggggttgggtgctttgtcgatgccgacgcggacgtcgtcgaggttgatgtggccccagccgccggtggcctggtcgaccgcggtgacgcgcagttgttcgccgaggtgggcgcgggcatcccaggtgacgcggcggtacgcctcgtcgtcggtgccggtggccttgtgcaggacggtgccgtccagggtggtcagggcgacgtacagctgggcttcgttgcggccgccggataccaaagcgctgaccatgccggtgccgttcacggtgaacggctcggaggtgatggtgccggtggcggcgtcgccgccaccggcgaatccccagaggtggtgggtgcctgcctggttgaagcagcacccccacccccatcccgggtcgtcggtgaccgcgccgttgaaggcggcgccggtcgtggtccagccgctgaggttaccggtctcgaagccggggttggacaggctggtctcactcgcgatggcggtcttggccatcatgggtgaggtcaggccgaggcatatcgtgagcgcgagcagcaggcgcagcagagtgcgcctggttgctgctggtatgtgttgcgctggggagcgcgttcgcatgcggacctccggtgtgggggttgtgggttggggtgggcggcacgctgccccgggtgttcgtgcggttcgccggggacggcgtcgtagggggtgtggcctctcaggggcgcttgacggggacgttgacgtcgtcgacgttgatgtggccccagccgcccgaggcgcggtcgacgatctcgatgcagatccggtcgccgatgtgagcggcgaggtcgaagacgacgcggcggtactgttcggtgccgcagccggtggccttggccaggaccttgccgtcgtcggcacggacgacggccgcgtagagctggtcggggttgtcgccgccggagacgagcaggtcgatcactccgtctccgccgaggaccacggtggccgagcgcaggacgccggtggcgtcgtctccgcccgcgtcggggttgaagccccacaggtggtggccggtcgggtcgtcgtcggtctcggcctggtagaaggggccgccccaaccccagtcggggcgggtggtcacgttggcgtcgctgaaggtcgtgcccgagacgacagtccatccggtgaggtcgccggtggcgaagtcgtggttgggcagggcgtcgacgtccgtgggacgcggcgggtcgtaaacagcgggtgcgacggacctgtcgtaggcgccgttcatgcgccagacgtccagggacaccacgtgcgcggatccgccctcactggtcaggcgcaggccggtggcgtcctggcgggtggggtagagacggctggtgaggctgttgctgccgttcacgtacgcctcgaacatcgagcggtcgagcaggaccctcaacctgagctgcccgccgtcgagttccacgctgccgccgtgcaagcccttgcgtacgtccgggtcgaggctggagcggctgcggtcgatctggaagcggtgggtggccgtgtcgtaggacagcagcgattcctcggtgccgtcggcgcaggcccggaccgccagggtgatggtctgcgcgccgcgcggctcgatgacggcgctgatgtccagcaggtcgccggagacaccggtcaggcgccggttggcttccctgaccgaggtgttgcggatgtgggcgagtttctcgccgcggagggtggccgcctcggcgatcggttcgacgcccagcgtgttgtccctgcgcagcgagagcgtcacgggcatgccggcgttgtgtgcccagccggactgggcgtgctgctgttcggtgcggcggtcctgggcgatgctgaagatcacggacctgccgtcgggggtgacgaagccggaggggccggtgaagtgctcgccgaaatcgaactcgcggggcttttcgtggtcgggtacgaagcggtggcgccgcttgtcgaaggtgccgatccagtagtaggtgtgcttgacggcgttcgggttgaagccttcccaccacggacagatcagcaggacgtgcttgccggtgcgccggccccggggaccggggaggggaaggagtacgggcagttcccacacctcgccgggctccggcagtgtggcgaggtcgttgtggtgcagcgggccccggtaggtccacgggccttcgggccggcgggcggtgtggaggagtgcggttccgccgtgtttgtgggtgacctgggtgccgtcgtagtcgacgatgccgctgccgaccaactggtaccaggtgccgtcctcttcccagacgaacgggtcgcggaagttttcggcccatgcggttccggggccggcaggcagggctgccggggcttcggtgaccggctcgggtttcatcgtccaggtgggcaggtcggtgtcgcggtcggcctggtaggtggacacggcgagtccggtgcgctggcggtaggggagccggtcgtcgccgccggtgaagaagagcaccggtccccggtcgccgtcgacgtaggcggagcccgaccagcagccgtccgggccgacggagtccgcggccggggcgagggcgatcgggaggtcgcgccagtggaccatgtcggtgctgaccgcgtggccccagtggatctggccccagaaggggccgagcggatcgtgctggtagaagatgtggtatttgcccttgaagtagacgggcgcgtgcggctcgttcatccagtgccagggcggcagcatgtggaactgggggcggtgccggtcgccgtcgaagcgggcccggtcgggggccaggtccgggcggggtacacggcggccgggcagcgcggcgacgctcgcggcgtgctcccggtgtgctgtcgcgtcgtccagggtgcccgggcggatggcgaggctgtccatcaggcccatgtacgtgttggcgtggaactcgccgttgagcagggtgggccggttgtgcttcccgatgagcaggggcaccccggaagcctgcacgggagcctggccgggcgtggttgccgttccgatcagccgtccgtcgcggtagaggcgcagttgatgggcagaggggtcgtaggtagccgcgacatgcgtccatctgttcttggcggccggctggtccggggcccctttgacctccaccaggtgagtctcgaacccgagctggaagacgatctggccgaagcggcgcaggccgagcatgaacccggtcccggcgtcggggtcgtgctggttgaccagggcctggggcttgccgtcgatgccgtgctcgtaggcgtagggggcgatccacacgtcgatggtcatgcctctggcgaagtcgagcctgccgggcccttcggcggtgatcacggtggagtagccgtcgaagtagagcgcccggccgtgtacgccgcggcggcgtacgggatcgctgtcgggcttgaagcgggcgtcgtcgaagacgtagccgacggggttcgcggagccggacaccgcctcgcgggcgacggaaccggtgcgctcgtcgaagtcccagcgcgctacggggcttcccagggcggtccgttcggcggcagcggcgtgggcgggagcgaacgagagcggcagggtggcgccgccgacggcagcggacacgaccctgagggctgttcttctcctcatgcaagctcctggagtgcgcggcagtctgacgccctgccaatacgatttaggtgatgggtcggcatggttcgcgcggcggcgccgctaaagcaagagctaacgcacacagatttcgactttgtgacccccacagatgcctaaaacggcgcaaaagatcatcgttacgcaggcgagatgtccggggtgttgacagtgcatgtcgggtggcgcaatctcgtcacaccttgctaatccgatttagccgaacggggctgatcctctgatgtccgagcgtcgcgtgaccatggccgacgtcgcccgcaaagcgggtgtatcgccgacgaccgcttcgttcgccctgtccggccggaccgacatgcgtatctccgaagcctcgcgcgaacgcgttctggaagccgcccgggagctgggctaccgcccgaacgtcacggcgcgcagcctgcggacgaagtccacgcagacgatcgggttcgtctcggaccggatcaccacgacaccgttcgcgggcgacgtgatccgcggcgccatggaggccgcccgggagaaggaccacctgctgttcatcaccgaggccggcggcgaccgcgcggccgagtcgtccctggtccacgctctgctggaccgccaggtcgacgcggtcgtctacgcgtccatgttcacccggtacgtgaccccgcccaaggagctgttcggtcgccgggtggtcctgctgaactgcctggctcccggcttcgacgcgccctcggtcgtccccgacgagttcgaggccggccgggacgcggcccgtgctctgctcgcggccggtcacaccgagggaatctgggcgatcggcgggcaccaggccgttccggccacccctgagggaatcgtcgccggaaacgagcgcatgcgaggtctggaggaggtcctccgcgagggcggagcgcgcctggagggcgtcgtcgagtgcgactgggacacactcgacggccaccgtgaggtgtccgccctgctggcggcgggccaccggccgcgcgccctggtgtgtctggccgaccgggtgtccttcggcgcctaccaggcgctcggtgaggcgggactgtcggtgcccggcgatgtgtcggtcatctcgttcgacgaccaggacatcgcctccgtgctgcgcccggcgctcaccacgctacggctgccgcactaccggctggggcacctcgcgatggaactgatcctccgcccggggccgctcgaagccgccgtgcaccgcgtgcccatgcccctgcagagccgtgcctcgctcgccgcacccgccggcggctgacacaggcaccccaacagtcgtcccgccacccgcaccggtcatcgggcgggtggcgggacgaccaccaagaacagcgaccgtcgcaaccggtcgccagggcgggtcctgcaagacccgcctcagtgagatggaggaacctcatgctgttcagaacacgacgcctcgctgctgcgagtgtagccgtcacggcggcgaccgcgctggtcgccggatgcacctcgggaggcgcaagcacgtccggtgccagcggcgacacgctgaccctgtggacgcacaacgccggcaactcggtggaactcgacgtcgtcaagaagatcatcaaggacttcaacgggtcccaggacaagtacaaggtcaagctccaggcgttcccgcagagcgactacaacaactcggtcgtggccgcggcctccgccaagaagctgccctgcctcctcgacgtcgacggccccaacgtggcgaactgggcatggggcggctacctggacccgatcgacgtcaccggcagcgaagtgcccgtgctcagccagctggaaagcaccgtcgggcggtacgacgacaagctctacgcgttcggtttctacgacgtctcgctggccttcttcgcccgcaagtccgtactggaagagcacggcatccgtgtggccaccatggacaagccctggacgaaggccgagttcgacagcgcactggccaagctgaagaaaagcggcacgttcgagtacccgctggagatgggcaccggcggcaccggcgagtggtggtcctacgggtactccccgcagctgcagagcttcggcggggacctggtcgaccgcggcgactacaagagcgcctcgggcaccctcgacagcgaggcggccgtggactgggctacctggttccagtcgctggtggccaaggactacatggcgaagaagtccggagccgaccccaacaaggacttcctcgccggcaagagcgccatccagtgggacggcagctggaacgcggccaagaacgccgagaagctcggcgacgacctggcgatcatcccgccggtcgacttcggtgaagggcccaagatcggcggcgcctcctggcagtgggcgatgagctccacctgctccaacaaggccggcgcgcaggagtggctgaagttctcccggcagacgaagtacttcaccgagtacgccaaggccaccagcaccatcccggccaccgaggccgccgccgagcagatcgccgactaccagccgggcggcaagttcgacgtgctcgtcgagttcgcgcgcaagtacgcgacggtgcgccccgccacgccggcctacccctacatctccaccgagttcgagaaggcggccaaggacatcctggccggtgccgacccgcagaaggctctcggccaggcggcgaaggacatcgacagcaacctgaagtcgaacaactactactccaactgacccgcccggcccggctcgggcgcgaccctgccggccgagccggaccgatcctctggagataccgtgcccaccaagaccgcagcccccgagcggctgcgtccggtccggcgaacccgaacgaccaacgcccgtcgccgtgaaagcctcaacgccttcggcatggccactccggccgtcgtgctgctgatcgtctttctcgttgtaccggtcgctctggccttcgccctggcgttcaccgacgccaggctcgtctcgcccaccccagcccgcttcgtggggctgaggaatttcaccctgctcttccaggacccgaccttctacaagtccctgcgcaacacggcctacttcgccgccgtcgtcgtcccgctccaggccgggctcgccctggtactggccctgctggtcaacgccaaggtccgtggcatcaacttcttccgcaccgtctacttcctgccggtcgtcacttcgatggtcgtggtgtccctcctgtggaccttcctctaccgcaaggacggactggtcaaccacgtcctctccacgctcaccttcggccacgtcgaggggccggactggctgggcgactcggcaaccgcgatgcccgccatcatcctgatgtcggtgtggcagggtgtcggcttccacatgatcatctggctggccgggctgcagaccatccccgcagagctgtacgaggccgccgacctcgacggagcagaccgctggcaccgcttccgccacgtcacctggccgggactgcgcgccacccgcacgttcgtgctcgtcaccatcacgatcgcggccttcagcctcttcacccagatcagggtgatgacacagggcgggcccctcgactccaccaccaccgtcgtgtaccaggcggtgcacaccggctacgaccagcagcagaccgcctacgcggcggccatctcgctgatcttcttcgtgctcgtgctgagcgtgtccctcgtgcagcgcttcctgacccgggagaaggactgacatgactgccttcctcaagcacctcggcggtcacaccggccgcatcgccctcgccctggtcttcgcgctcccgctcgtcttcatgctcgtctcgtcgttcaagccggacgaccagatcttcggcgacctggactccccgcgtgccttcctgcccatcggagccctgtcgctcgacaactacaccgccgtcttcgagcgggtccccgcggcacggttcctgctgaactccgttctgatctccgccagcacggtggtgctcggcatcgtgatcaacagcatggccgccttcgccctgtcccgcatgcggtggcccggccgcaagctcgtcctgaccgccgtcatcgccaccctcatcgtgccgttcgagacgttcgccctgccgctggtgtggtgggtcaaccagcttccgctgctgagcgtcaacggcttccacctgcagtggagcaccggctggatggacacctaccaggtgcagatcctgccgttcgtcgccaacgccttctcggtcttcttcttccaccagtactttcagagcatccccaaggagttggacgaggcagccatcgtggacggcgccggctggttcaccatctaccgccgcatcgtcatgccgctgtccgggccggccgtcgccaccgtcgcgatcctgaccttcctgccggcctggaactcctacctgtggccgctgatggtcgtgcagagcgaggaactgcggccggtgatggtgggcatctcctacttcttccaactgaacgtgggatggggccagatcatggcgtactcctccatgatcacggttccgatcctggcgctcttcgtcgcgttccagcgctccttcgtcaacagcatcgcctccagcggcgtcaagggctgacccgcacagcggcaccacaccgctcgttgccctcgccctcgtgatgcccctgtgctccgcgcaccctgagaaaggccccgcgtgcccacgtcacctgccgacccacacctcccggccatccatctgcggccgccccacaactggatcaacgaccccaacgggctggtcttccacgacggccactaccacgtgttcttccagtacaacccgcacggaccccagcactcgaacgtgcactggggccacttccgcagcccggacctgatcaactgggagcccttccccgtcgccctcacccccaccccgggcggctacgacgccgacggctgctactcgggcaacgccgtctccgtcgacggcagcatcgtggccttctactccgcacaccgcaacgaccgctggtggcagcccatcactaccgccgcatcgcgcgacgacggccgcacctgggccaagcgcccggaactgctcatcgccgacccgcccgccggcaccaccatgtaccgggacccctacgtctggcagcaggacgcgcgctggcggatgctcgtcggcgcggccctcgacgacgggcgcgcagcggcgctgctgtacgagtccgacgatctggaaacctgggcatacctgggccccttccacacaagcgacgccgcgccaggcaccgacccgatcggctgggaatgcccccagtacgcaacgttcggcgaccggagcgtcctgatcgtcagcgactggaccccgcagaacggccccagccacaccaccgtccacaccggccgcgaacacaacggccgcttcacaccggccgcctcccccgtgcccctggaccacggccccgacatctacgcgcccgccctgctgaaggtgcccgggacgaaccgctggcttctgtggggctgggcctgggaagcgcgcgacgaggactgggcgcacgaagcgggctgggcaggcgtcctcaccctcccccgcgaggtgagcatcaccaccgacggcaccgttgtccagcgccccgcccgcgaactcctggccctgcgcagcgcacgtgtactgcaccgcaccggaagcgtggtacgaaccgagccggccgaactcggacaggtcagccgcaccttcgacctcaccgcctccctggtccccgaccccaccggcacgagcgggctgcgcctggtcacctctgcggacggctccgagtatctcgacatcagcctcaaccccacgttcgggcagctcatcgtcgaccgcacccacgcctccctggaccagcgggcgcgaaagggctcgtacaccgccccctgtcccgctgcgacccgcgggggtagccccgtcgaactccgcgtgatcgtggaccgctcgatcgcggaggttcacctcggcgacggacaggtcctcacgctgaggttctatcccctcgccgacgggccgtggcgactgcaggcccgtacaacaggcgccggacgcagcgacttcaccgtcgaagcatggaacctggccaccggcggtgtgcggcaagaaccgatcccggcaggccaggcgcagaatcccgcactcatgcgttcctgaccagccggtggggcggtggccgccccaccgcccctccacgtgaacgacaggtgccgtctgcgcccatgcaggccccgcacgccgtcagctacatcccgcgcagcacgccgcgagcgcctcgccccggctgtccccccggcgccgggcggcgaccctgcgcctcccagaaaggcagaccgtcaccatgacccgatccgggtcccccggcagcatcaccgttctcggcgagtgcgtcgccgacatcttcacagacgcccagtccggacccgacgggctgtcattgcgggccctgccgggtggcggccccgccaacaccgccgtcgcactcgcccggctcggcaccccgacccgcttcctcggacgcctctccaccgacatcttcggaaccctcttccgcgcacgcctcaacgcctccggcgtcgacctgaccgccagcgtgaacacctccgaacccagcactctcgccgtcgccgacctcgacgcgaccggccaggccgcctacaccttctacgccgacggagccgccgactggcaatggaccgaccgggaactcgcagaagccacgaaggacgacgccgtctgcctccacacaggctccctcgccctggtccgacagcccggcggcaggcgcatcgaggaccatctcgcccaggcacgcgagcagaccaccgtgtccatcgaccccaacgtccgctccctgctcgtaccgccgtccctctaccgagaacgcctgccccgctggtgcgccgccgccgatatcctccgcctgagcgaagaggactgcggcatcctcgcccccggagccggcttcgacgaggcttgcgacacctggcatgccgcaggaacacgcctcatcgtcatcacactcggcggacgcggagcactcgtatcactggacggcaggcgcgtcaccgtcccggcaccacctgtcgtgatcgttgacaccgtcggcgccggcgactccttcaccgcgggtcttctccaccgccttgccgccctaggacaactcggcagccgacttgacgagctgacccttgaagatgtcaccgacgcctgctccttcgccgcccacgtcgcagccttgacgtgctcggtttccggcgcgaatccaccctgggcagacgaatcaacgctgcgaatcggtgccccaccacctctgccccagctccggggctgaagaccttcagcctcggcgacggcccccaacgatgtgtacgcgggccacacgaccgtccggccctccagcaccggacgattgagcgctgtacttggcctcactggccaagtacagcgctaagtcacaccagaccggctcccacttatcactgcgtcgccgcttcgagagccgacacccgaagggagacaagcgtggactgctgagcaacaaggggtgcgtgaaccccgagacggtggagtgggtgacgaccacgcggtcgggacgggtacggatcagcgacgaggccatcgtcgcgccctgtggtgaccacttcccgctcacctggaaacggggcagccggctccgcatggccggtgccgcgcaacatctggtgcgcacaggctgggcggagtggaacctcggcgaccacggtgtcgagccctcccgaggcttccatcagctccttggcctgacggccgaagccacgccggacagcttgcccggtgcgcatcgctcccgcggcctggggtgggcggtgcgagccgtcttcatcgacgtcaccgcggaccggtggagacgagaggcggcacagcactccgaaatcgagcacgccgtgaacacgagcgcgtcgaaaccgtcgtggagatcgccgacgtcctgcgcgaggcggtcctgacccagttccaggacgagttggacgcctacggcctcgaagcggcggccgtccacggcctcgacgcccgcgaggccggagtcggcggcgactggtacaaggcgcgcgaactgcccgacggccgcctcctgatcgcgctggacgaggccagcggacacggtctggaagcggcgaccctgatggccaaactgaggtacgcgctcggcggtctcgcctacaccgaggaacccgtcgagcggctgacgccgtggctcaatgaagtggcgtgcgccgacggcgacgagtccaccgacaccgccttcatcgcccgctaccaccccgagcgctccctgctccgctggacctgagccgggcatccgcgccactcaactcccggctcccgacggcggacccgggatctcgctgggcgtcctgcccgacgtgacctgccggccgggccctgcatgaggaattttgcccgccgacaccgaaggggcacagtggcgcatggtttcgtgtggagctgacgatagggggctgaatggtgggcacagtcgatgaggtgctgcggagcgcaggcgatgcttgcgagaggcagctgcgggggtgggtgggg

SEQ ID NO: 2770 - DNA, 4417 bp, Unknown
  Kingdom: Bacteria, Phylum: Actinobacteria, Class: Actinobacteria, Order: Streptomycetales, Family: Streptomycetaceae, Genus: Streptomyces
gtacgccgacagcggcgccgaactgctcaccggggtccgggtcgaccacgtcgagaagggggcggtcgtcctcgcggacggccgggtcctgcatgccggggccgtggtcgtcggcatcggcgcgcgccccgccacaagctggctggccggctccggggtcgcgctcggcccggacgggtcggtcaccgccgacagcgcgctgcgcacctcgctgcccgatgtgtacgcggtcggggactgcgcctccttcccctcggcccgttacgggacacgcctgctggtccatcactgggacaacgccctccaggggccgcgcaccgccgccgccgcgatcatggccgcccaggacgggggaccgctccccgtctacgaccccgtcccgtacttctggtccgagcagttcggccgcttcgtgcagtacgccggccaccacgcgggtgccgacaccctggtgtggcgcggcgacgggacggacgccgcctggtcggtgtgctggctgcacgacggcgctctggtggccgtgctcgccgtgggccgcccgcgcgacctcgcccagggccgcaggctcatcgagtcgggggccgtcctcgacccggagaaggtggccgaccccgccgtgccgctgaagtccgcagccctgtgacggacccggaacccgtcggcccgacccccgtacggtcgggcccggctaccggctgtcagtcctggatggcacgcttgtccctgtgaccgagattgacgcaaagaccgatgctctcgtccccgcctggctccaccttcccgacatcgcggaaatgctcgatgtccaggtgacgcgcgtacggcagctggtcagggatggccagctcatcgccgtacgccgtggtgagaaccgggcgctccaggtgcccgccgccttcatcgacggcgacaaggtggtcaagggcctctccggcaccctgaccctcctgagggacgacggctattccgacgaagagatgctggagtggctcttcactcccgacccgaccctgcccggcacccccgcgcaggcgctgagcgagaatcgcggtacggaggtgaagcgccgcgcccaggcgctcgccgtctgaccgaaacgacagcaagcggagcacgggccgccggcgcggcccgtgcaccgtcacgaccacgggggagtccgcccatgtccacgcctcgcgagcagctggccgacgcccggctctatctgtgcacggacgcccgcaagcggcagggtgacctccccgccttcctggacgccgtgctcgccgccggcgtcgacatcgtccagctccgggacaagggcatggaggccgccgaggagctggagcatctcgccgtcctcgccgacgcctgccgccggcacggcaagctcctcgcggtgaacgaccgcgccgacgtcgcccacgccgccggcgccgaggtactccatctcggacagggtgacctgccggtccccgccgcccgggcgatcatcggctccgaccggctgatcggccgctccacgcacgccgaggccgaggtcgacgcggccgtcgcccaggacggtgtggactacttctgcaccggcccctgctggcccacacccaccaagcccggccgccacgcccccggcctcgacctcgtgcgctacgccgcctccctcggcggggtgcggccctggttcgcgatcggcgggatcgacgcgggcaacctggaccaggtgctggatgccggagcccgccgcgtcgtcgtcgtccgggccatcaccgaggccgatgatcccaccgccgccaccgccgagctggcccgacgcgtccgggcgcgcgcgctctgatttcccgcgcgccgccccgcgtatcgcctcacgtgtcgactcgcgtgctcgcgtgtcgatgtgggacatatcgggtacgtgtccgagggatggacaacagtccggcaaaacgagacaaattcagccgctctggttgggggagcgtccaccccctggttaacctccccttatggcccttggcacaccctccaccaggacggatcacgcgcgtaccgtgcgtgacctgctagcgaccggcaagacgtcgtactccttcgagttctgggcgcccaagacggaaaaaggtgagcggaacctctggaacgcgctccgtcgcgtcgaggcggtccgtccgagtttcgtctccgtgacgtacggtgccggcggttccacccgtgccgggacggtccgggccacccagcagatcgccgccgactccaccctcaccccggtcgcccacctcaccgcggtgaaccactccgtcgccgagctccgcaacatggtcgggcagtacgccgacgcgggcatcaggaacatcctcgcggtccgcggcgacccgccgggcgacccgatgggtgagtgggtggagcacccgcggggggtgaagtacgccgccgacctcgtccggctcatcaaggagtcgggcgacttctgcgtcggtgtggcggcatttcccgaaatgcacccccggtcgtccgactgggagaccgacatcggtcatttcgtggacaagtgccgggcgggggcggattacgcgatcacccagatgttcttccgcccggaggactatctccggatgcgtgaccgagtggtcgccgcgggttgcgaaacgccggtgatccccgaggtcatgccccttaccagcgtcaagcaactggaaaagttctcccagctcagcaacgcgaccgtgcccgcgtcgttgaaagagcgcatcctcgcggccaaggacgatccagccgctgtacgctccattggcatcgagttcgcaacggagttctgcgcgaagctgctgtccgagggtgtgcccggactgcacttcatcacgctcaacaactcgacggctacgctcgaaatctacgaaaaactcggactgcacaagcagtcgtgaccggtcgtacccgccgccgacgcggctacggccgaaggagggggcgggcgtgggctggacggtcctctacatcgctttcggtctggtggccctgtggctgctcggcgaggtgctgctgcagtacaaggcacgactgcgctggcggctcctcgccttcgccggcttcctcggcgtggtggtcggggtgctgctggcctccgttccggtcatcgtcgtcgggacgctggccttcgccaccggccagaccttcgtgacgctgtccttccggcgcggcttctccaccggctgggccataggcggcagcccgggggagagccgccgccgcaggggaggcggcgagggcgccgccgtgaaggaacccacactggaggtctcggacctggaggtcgccgaccccgggtacgaccagcccccggccgccccgcccgcgcagtcggtctacgaaccgcagcccctccccgacgacaccggccagtacggcgtgtacgggaacacgggctacgacgcgaacggcaacgcccgccaggaccacggccacgaggccgatccctcggcacagccgcagtacgccgcgtacgacccgtacaccggctacgaacagcccgcggcccaggacccctacgccggaacgtacgactacggcaccgaccggcagagctacgccgcctactccgacccgtacatcggcaccaccaacggagccccctcctacggcggttacgacgcctacggccagggcggcggcgacggctacgacagccagggcgggcagcagagctaccccgacccctacgcccagggctatgtcgcggacaccccgcccggcggcgtctgggtcccgcagcagcgcgacaccgagcagtaccccccgatggagccggagcagcccgcgacgcccgcgacgcccgctccgtacggcaacggcaacggctacgacaccggccagaacgagcagtaccgctactgaggccgcgccgctgccgggggaagggcccgtcggcagcggcacacgctcaggcacctcccgctcaacgggagccgcggaagtcgtcgccctccacgacgagcccggccaccagcgtccccgacatcccggcgtgcgccagcccgccgcccgggtgggaccagccgcccgcgagatacagcccgggcagccgtgtgaggttgcccgggtgcagatacgctccgtcggccccggccagcgcgggcggcggcaccgcaccgccctcggcccccgtttcggcctcggtctccgcgggcgtgcggacctcggtgtgcaggatccgctcccgcagcccgggtacggccgccgccgcccgctccaccatgacgtcggcgaaccgctgccgcaccccggcgtcccgccagtcgaccggaccctgcggagccaccgtcgcggtgagcgtcaccgcctcgtgctccgcgtccggccgggtcgccggatcgtcggggcgcagcaccgtgaccgtggggcctgaggcgacccggcccccgaacaccgcctcctgctccgc

SEQ ID NO: 2771 - DNA, 22147 bp, Unknown
  Kingdom: Bacteria, Phylum: Actinobacteria, Class: Actinobacteria, Order: Streptomycetales, Family: Streptomycetaceae, Genus: Streptomyces
  misc_feature (214)..(245): n is a, c, g, or t
acttcacctggtacttcagcccgcgcgcggatgtgcggcgcggcgacgaactgcgggagcccggcggtgcggtgcacaaggtgttcgccaccttcgagccgtccgtggacggcacctatctccgggcggactgcaccaccgaccagcccctcaccacctaaggaggcgcgccgcccatggccgcactcactgctcagcccgtacccaccgccgnnnnnnnnnnnnnnnnnnnnnnnnnnnnnnnntacgcggccgcggcggtgggcggcgacaccgcgccgatcggcacgaacctgctgctgcacgtcatcaacggcggcggggccccggtcacgctgacgatcgtcaccccgggcacctccgacggcctggccatcgcggacacagcgcgcacgatcgcggccggcgcggccgcgttcgtgccgctgcgcgccgtctaccgcaacccggtcaccggccgggccgcgctcacctacagcggcaccaccagcgtcaccgtcgccgtcctgcagatgccctgagaggaggtggccaccatggcccgacgtaaccgggtggacggcctggcgggcgccctggccgcgatcggccgcatccccgaggcggcccgcgaagcgcgcaaggacacgctgaacgactgggcggaccgtgtcctggacacctccgaggagcgtgtcccgcaggacaagggcgacctgtgggaggccctggaccagaaggtcaccgagcagtacgggcgggccgaggtcggtgtctgggacccggaggagctcgagtacgcgtactacgtggagaagggcaccagcagcatgcccgatcagccctacctcgtccccgcgttcgaggagcaccgggccgcggtgccccgtacgtaccgggccgcgttccgccggcacatgggcggggcggccggaccgtgacgacgtcccagtggcccctgcaggaggccgtgtacgccaagctcaccgccgacacggcgttcatggccctggtgaaggggctgttcgacgaggtccccgagaccgtcgcccacccctacgtcagcttcggcgcggctaccgaggtcgtggacgacgcgcacaaccagcggggcctgacggtcaacctcgtcctgcacatctggtcgaagtaccgcggcatcaaggaagcggccgggatcctcgccgccctggacgcggtcctggaccggcgccccctggcggtggccggcttccgcgacgtgtccatcgctcatcagcaacacacccacgtacgtgaccccgaccccgacatcaggcacatcaacgtcgcctaccgggtctggctgaccaaggaataggagaagcccatggctggtctggatgccttcggcacacagctgcagcgcggcgacggggcggggccggaggtcttcacggccatcgcgaacgtcaccgacatcacgcccccggcgatcgagcgggagaccctcgacgtcaccacccacggatcgcccgaccagtggcgcgagcacatcgggggtctcaaggacggcggcgaggtgtccatcgacatcaactacgacccgcgcatccacgacgtcctggccgccgacctggatgaccccaacccccgcagctaccgggtcgtctggcccgggaccctcggggactgggcgttcaaggcgatcctcaagggcttcgagcccgaggccccgcacgatgacaagctggccgcttccctcaccttcaaggtgtcggggaagcccgtgatgaacccgggaatctgaatatgacgaccaactacctgtccgcagagcagatcctcgacgccgatgacctcgccatcgaggacgtcgccgtaccggagtggggcggcaccgtccgcgtgaagggcatgtccggcaccgaacgcgaccggttcgaggccgggttcgtcggcaacgacatgaagcagttgcccaaggacaaggccctggagtactaccgggcgcggatcgccgctgcgtgcctcgtcgaccaggccggaaacaagatgttccggtccgtcggcgagatcaagcgcctgtccgacaagaacgccgaggcactgcagcgcgttgtcgacgtcgccaaccgcctctccggcctcacccaggaggacgtggaggagctgacgggaaactccgacgccgccccgagcggctcttctacttccggctcgccggacacctcggatacaccgtcgccgagctcctcggccggatcagctcgcgcgagctctcggagtggcaagcagtagagcagctgacagggccgctcggcggtcaccgcggcgacgtccagatggcgatcctcgccgccgtgatcgccaactcccagcgggccaagggccgcatgctcacccctgctgacttcatgccctcctgggagggcaagcgcaccctcacccccgaagagctcttcgccaaggccatgcaggcgaacgtcgcactgggcggccgggtgcgcgccgacaactgaacatctgagcagcgagaggggggccggtccccgtggcgactctcgcgtccatgacggtgcgtctcggcatcgacaccgaccagctccgtgccggtgccgaccgcgccaagaagatgctcaccggtctcgccaaggccgccgcaggcctcggcgtcggtatccccgtcgcggcggccgtcgcgaccggtgtgctgggcatcgccgcggcggccgtcgcggccggcctcgcctacaaggcgttccaggcggcggccggaccgcagatggaggcggtcaagaacgtcgccgagctcgccgcggccgcccaggaggcggctgcggagggcggggagaaggccgccgaggcgcagaaggcctacaacgccgcccttgccgacctgccaccggcgacccgggcgaccgcgaaggcgtacatcgggctgcagaaggaccaccagaagtggtccgacagcatggccagcacgaccatgcccgtctacgccaagggtattgagctgctgcggcgcctgctgccgatgctcaccccgttcgtgaaggcggccgccggcgctctctcggggttcttcgacgacatcgccaagggcgtgaagtcggcccggttcaaggactgggccgacgacatgtcgaaggccgccggccccgcgctgcgtgacttcctcaccgtcatcaagaacctcgcgatcgggttcgccgggctgctgcaggcgttcctccccgcctccgacgggatgacgggcggcctcgtctcgatgaccggtgcgttcgccgcgtggggcagcggcctcaagggaagcgacggcctggccgacttcctggcgctcgcagaacagggccgcgaaaccctcggtgcggtcgcaggagcgctcctcaagcttctggtggcgctctccccggtgctcggggccaccgcgacgctggccctgtacctggccaacatcatcaacagcacgcccgcgccggtgctgaaggtgctggccgcggtcctggtcgccgtcaaggtcgggatgatcggctacaaggtgggggccgccggcgtcgccgtcgccaaccggctcatggcctcgtccagctacctggccgtcaccgcctggacgcggatgatggccgtcggcctcatggcctacatccggctcggtgccgcagccgtcgtatcggcggccaggaccgccgccgcgtggatgggtagcgccctcctgtcgatcggcacgtggatcgccgccgtcgtacgggctgcggtcaccgccacggtgcagttcgccctcatggccgcccgcgccatcgcgtgggccgtcatcatggccgctcagtggctgattgcgatgggcccgatcggctgggtcatcgccgcagtgatcggcctcgccgtcctgatcatcgcgaactgggacaagatcaagaagtggaccgcggccgcctggacgtgggtctggtcgaagatcaagagcacgctgatgacgatcctgtcgttcgtcaccggctggttcatcgtcaagttcttcctgaaccactgggaccgcatcaagtccggcaccgtctccaaggtcaccgcgctgatcgcgtacgtgcggggcatgcccggccggatcctcgccgccctgtccagcctgaacaacctgctctactccaaagggatcgccgtggtgcagggcctgtggcggggcatccagtccatgggcggctggctcaagggccagctgatgagtttcgcgaagtcggcggtgcccgggccgatcgcgaaggccctcggcatcgcgtcgccgtcgaaggtcaccaaggcgcagggccagtggatcggcaagggcctcggcgtcggcctcctcggcaccgcgaagcaggtgaaggccgccgccgagaagctcgccggtatcgtccgcggcagcctcgccccgggcaagaagcgcaccagggccctgggcaggatcggcgacggatctcgggcgctggtggccctggccaagcgggacgcgaacgtcgcgtcccggctgcaggacgcccgcaagaggctggccgcgcaggtcaaggcccgcgacaagctgatggcggacgtccgcaagggcgtcatggacagcgcgaacatcacccagctcgtccaggacgtccccgtcaccgccacctccctgatcgccggtctcaccgcgaaggtcacccaggccctgcagttcaccgccaaccttgccaagctccgcaagaagggggtggccgccgacctcatcgcccagatcgggcaggccggagtggagcaggggtcggccacggccgccgctctcgcgaacgcctcgtccgcccaggtccagcagctcaacgcgcagcagaaggcgctcggaaaggctgcgaccgccgcaggggcgaccgccggaacagccatgtacggcactggcattcaggccgcacaaggcctcatcaagggcctcgcctcgcagcagaagctgatcgagaagcagatggtcaccatcgccaagggcatgaccaaagcgatcaagaaggcgctcggcatcaactccccgtcgcgggtgatggcgcgcgaggtcggccggcacgtgccgaccggcgtggaggtcggggccgaggacgcccgcggctcgctggaccggacgatgcgccacctcgtcgacgtccccggcatcaagaagatgcagccccgcaccagcggcgccgctgccggggcgacggaccacctcatcatcgagctcgccggagctcccgagttcaaggcgctgatccgcggcattgtccgcaaggacggcaccggtgacgtgcagaagaccttcggctacggaaagaagaggaccacctgatgccgttccccctggacatccgtaccgagctgcagatcggagggatgtggacggacgtcagcacggacgtccgggtcagcacgccgatgaccatcacccgtggggcaggcgatgaggcgtcgtccctcgagcactccacgtgcgagttccagctcaacaaccggcacggccgctacagcccccgcaaccccatgtcgccgtactacgggctgatcggccgcaacaccccggtgagggtcagcgtgcccggcccggagtcgtacctccaggtggacgggtcggccgcgtcctacgccagcaccccggacgcggccgccctcgacatcaccggggatctcgacctgcggatcgaggcaacgtgcgactggaacgcagcacagggccaggccctcgtcggcaagtggaacagcgcgacgaaccagcggtcgtacctgctgcgggtccaggccggggtcgtcttcctgaactggtcggtcgccgggacggcgtcggtgttcgggcagcgtcccctgcccgagctcccccggcgggccgcactccgggccacgatggacgtgaacaacggggccggcggtttcaccatccagttctactggggggccacgatctccggaccgtggacgcaggtgggggacccgatcaccagcaccccgcccacgagtatctacgcggggaccgcgccgctggagatcgccccgcaggctgtcgccggagtgccgcccatgcgcggcatcgtgcaccgggccgaggtccgcaacggcatcaacggccccctggtcgccgacctcgacgtgcgggccctgcccgccgggacgaccgggtggagcgacagcgccggccgcgcctggacgctcggccccgctgcggcgatcggcgaccgcgcgtaccggttccacggtgagatcagctcgtggccggcccgatgggacgtctctggcgaggacgtctgggtgccggtcgaggcagcgggcacgacccgccgtctgggccaggggcagaaggccttggcatcgactctccgcaggcgtatcccgtcggctccgtcgctgctggcgtactggccgatggaggagtccgccaccgcgggcacacaggcatacagtccggtgcccggggctcagcccctagcactgaccggcgcaaactgggcggccgaggacaccctcggcggatcggctccgctccccaccgtgaaggccggcacgacgctgctcgcgcgcgtcccggcagccgccgtcaccggctggcaggtcgaatgggtgtacaacctgcccaccttgccagccgtacagacggaggtcctgcgcctcacgatcgccggggcaacgatgcgatcggtggttctctacgcgtcctcctctgccatccgcctcgagacgctgagcggggacggtacggtcatcggggcgttctccctcagcaccaccggggcgctggcgaccttcgccgggaaatggaaccgcttgtcgatctacagcggcaactacggcggcggagccagcctcatcactgcgacctggcgggacgtcaccaccgggcagcggtactacctgggcaccgcccccaccaccgggcaggggcgcatcgcgagcgtgtccggcgcctgggacgcgaccatggaaggcatgtccctcgggcacatggccatcttcaccacgcccggtaccggtgttctcgacgcgccgcccaccaccacgatcttcgagggagccgacgacggtttcctcggcgaaagcagcctcgcccgcatcgcccggctcggtgccgaggaggccgccaccgtcgacctggtcggccgcggctcggactacccggaccggtccacccggctcggcccccagcgcccggacaccctcctgagcctgctggaggaaatccagaacgcggacggcgggatcctctacgagcggcgcgaccgcaccgggctggtgtaccgggaccgccggacgctctacaaccagcccgcctccctcgccctcgactacaccgcgcccggggaggtcccgccgccgctggaccccgtggaggacgaccagaggctccgcaacgacatcacggtcacccgcgacggcgggacatcggcacgctcggtggtggcgaccgggccgctgtccgtgcagccgccacccgacggtgtcggcccgtacgacgaggcgctgaccctgtcgctgtacgacgacaaccagcccgagccgatcgcccagtggcgcacacacctcggcacctgggacgaggcccggtacccgacgatcagcgtgtggctccacgccgcaccccacctggtcggcgacgtcctcgcgatggacatcggcgaccgggtccaggtccgaaacccgccgccgtggctgccgccggacacgatcgatcagcacgtgctcggctacaccgaggtcctcgaccagttccagtggacgctcgagatgaactgcgtccccgcccgaccgtggacggtcggtgtcgtggaggacccggtgctgggccgggcggacacggacggatcggagctggccggggcggtggcggctacggacaccgtgctccccgtcacggtgacagcaggccctccctgggtcacggccgcaccgaacgtcctggccgaccccgggttcgagtccgggaccgggtcctgggcgtgcacccgcggggccagcatcggcgtcgtctcccacgagacgggcatcgtccactccgggacaggcgctctgcgggtcacccgcgtgcaccccaccgacaccggcaccatgaacctctgggaccccacctcggcccaggccgcagcccccgggcagacgtgggcgggcggcgcctgggtgcgctccggcggcgcgggcgcgaacaacatgcgggtcgccatcgtctggaaagacgcgggcggtgtcgagacgttcgtctacggggcggcaccgtcggtgtcggccggcacgtggacatacctcagcgtgtccgcgacgctcccggccggggcggttggggtccggctcggcgtggagggccgctcgacctggaccgtcggcgagtggtggatcgccgacgacgtgcgcctcgcccgcaccgacacgttcgcgggcacggacatgggcaaccagttcccgttcgacgtcaccgtcggcggagaggtcgtgacggtccacagcatcggcccctccacgtcgcccaccgtcagcgacacgttcacccggaccgccctaccgcccaccgtcaccgacgcgttcgaccgcacggtgacgggcggctggggcaccgccacgaccgggcaggcgtggaccaactccgggggcaccagcgcggactacgcggtgggcagcggcgtcggcaccgtcagcgcgggcgtcgtcaacagcagccggttcacacagctcgcgacattggccctggccgacgtcgacatgcaggccgacgtcaccgtcccggtcgtggcgacgggcgcctccatctccgccggcctgcgcctgcgcgccgccagcactgcggactactactacgtcgaggtcgtacgggcgaccgccggaacgatcagcgtgctcctcgtatcgcgcgtggctggcgtctccaccacgattgccgcagcggtgtccaagggcgcctatgcggcggggcagacgtggacggtgcgcgcccgcctggtcggctccgtcctccaggccaagctgtgggcgaccgcgggcaccgagccgaccggctgggacgtccaggcgtacaccacctcaatcccagcggccggccccgtcgggacccgcaccatcctgtccggcgggaacaccaacgcgctgccggtcgtcgccacgtgggacaacgtccgtgtcaccgccgtcgagtcggggtggggcaccagctcctccgggcacgcctggacccggtccggcggcgcggccaccgagtacacggtcgacggcgggcggggcctgatcgcgctcacgtcggtggactcgtcgcgccggatcatcaccggcccgacgctggccgacacggacatccgtgcggcgatgacggtgccggtggtggccgccaccgactccatcgacatggccgtcatgagccggtaccaggacagcgggacgtactaccacgcagtactccactgccacgccgacgcgacgatcgacgtccggatccgcaaggtcgtgtccggcacgtacaccaccctgtcgatcagctcgctcctcgccgggacgtacgcggccggggacacctactggctccgcttccagaccaccggcacgagcctccaggcccgcggctggcgcgacggtacggccgagccggggacatggcaggcgaccgccacggacggcggcatcacggcggccgggcagaccggtgtccggatgaacttgcaggtcaacaacacgaacacgctgcccgtgatcgtcggtgtcgaccagtacgaggtatcggggccggtgcccttctacgtcacccggtccgtcaacggcatcggcaagggcctccccgccggggccaacctgtcactcacacacccgatgcgcgccgcgctctgagaaggggaacaccatgccgatcctcgcaggacagagggtgaccgccgatcaactcaaccggcttcagccgaagacgtaccgagctggcagccagaccgccgccctcaccggaccgctgaccaacgcggacgtgcccggcatcgagatcgcgttcacaaccctggccccaggggcgacggtcaccgcccagatcgtctgcgacttcgacccgaccaccaccgtcggcggcctgtcctccggacgcctgttcattgacgggtccggggtcggcgagttcgccgtctaccaacaggggccagggaccctcggcgaccgcggctcgaccccgcagacctaccgcgaggtcatccctgcggccggcgcgcacacggcgaagctcgtcgtgaccctcgcctccggcatgaacctgaacgtgtacagctcggtgctgctcaccgtctatgaagccgtctgatccacccgctcacccatcccgccccgagccaccaggccggggcatcgtcatgtctggagggcctgtcacatggccacattcctctccgccgacacgctcctgaaagccctccgcgacgaaggcctggaggtcgtcgaacaccggagctggcgcgccaacaaccgcaaccacaagggtccgtccgggccgatgcgcggggtgatgatccaccacaccgtgacgtccgggaccgcgtcgtcggtggagctctgctacaacggccactccgccctgcccgggccgctctgccacggggtcatcgccaaggacggcaccgtgtacctcgtcggccacgggcgcgcgaaccatgcgggcctgggcgacgacaacgtcctccaagcggtcatcgccgagaaggaactcccgccggacaacgaggccaacaccgacgggaaccggcacttctacggcttcgaagcggtgaacctcggcgacggcaaggacccgtggccggcggcccagctgctcgcgatcgagcgcgcggccgccgccgtctgccgggcgcacggctgggggcctcggtccgtgctcggccacctggagtggcagcccggcaagatcgacccgcgcgggttcacgatggactcgatgcgcggccggatcggcaagcgcctcggtgccgagccgacgccgccggcgaccgcgaagcccaagccgaagccgaagccgaagccgaccaaaccgcggtacgagccgttccccggagcgccgttcttcaaggccggtcgcaacagcgccgtcatcaccgcgatgggcaagcgcctggtggccgagggctgcggacggtacgccgtcggtccgggccctcgctggtcggaagcagaccggaagtcgtacgccgcctggcagcgcaagtgcggctacaccggccaggccgccgacggcatccccggcaagagcagctgggaccggctcaaggtccccaacgtctaggaggcctcgtgtccgtagtgctgaccgttgacccgtcgctcgcccaccgcctggccgagccgacggcctgggccgtgatcgccgactggctcgcctcccaaacgaaacccctccccgtcccggaaacgttccggggcccgaactggaagcaggacgaatcatgatcagagtcagcagcgccgccaaggcgatcgtggccggtctcgccgccggtgcaactgcggccgccaccgccgtgcaggacggcgtcttcaccaccggggagaccgtcaccacggtgctcgccgtcctcggcgcgctgggcatcacgtacgccgttcccaaccgcgcgaccggggccgaccgggtcacgcctggccggggcctctgaccaaccctcgcaccaggaggtatgtacgtggacgctgcgacgctcggcgcaatcggtgtcatcgtcgtcgggctcgcaacggccataggcgcatgggttggaaaacgcggagagaacctgctcggcggatactccacgctcgtcgacaacctgcaagaagaacgcgacaaggcgcagcagaagctcgccgagaacgaggtgctcctcgcagctgcgcacgccgaactcacaggcgagcgctccgggaaagccgagttgctcagacagattaccgagctgaccactgagaacgcccgactgcacgcgcgcatagccgagctgggaggaaccccgtcgtgacgcacagcagaccgaacgtcctcctcgcccgccggtggcggtcgctggccctggccgctgtcctgcttgtgctgtccggggccgtgctcctggtctggctgcgcatcgacgccgaagcccagcgcaccgcgaacgtggcagctgaggctgacaagcgcggcgacgcggtcagcaccctggccggggacgtccgtacgttgcgcgcccagatccaggccgagggcggcactcccgccgccccggatccggcggccgcggtcgatgacctgccggaccgggtcgaggtgccggtgccgatccccggcgcaacgggcccgcgcgggcagaagggcgaggccggcactcccggcaaggacggccaggacggtgagcccggggcggacggatcgcccggccctgccgtcacgggcatccccggccgcgacggcgcgaacggggctgacggcgtccagggcgagcgcggcgagaagggcgagaagggcgacgtcggcgcgaccggtgaacggggccctgcaggaccacccggcccggcctgccccggcggatacaccctgcagcccccacccggagatccggacgccctcgtctgccgacggacaggcgcaccacccgcgccggacgaccccgccagcacaccgaacccgctcgccctcgcgctcgaccccacccgccgccagtacccgtgaccgcgcccccaccgcttcggcggtgggggcatttctgcgtttcggagtaccgtggatccaaccttctggcgggggtccaacatgaatacgtccattggcgaccgcatccgcgcgttgcgagagttccgcgacatcacccaggaaacgctggccgaccggtccggagtgtccatcgacaccatccggaagcttgagcagaaccgacggcagtccgcgcggatcaacactctgcgcagtatcgcgcgggcgctggacgtccagctcgagcgtctcgtaggacagcccaccgtgaccagcgaacttccccctgacggcggcctcctggccatgcgcgacgcgatccaggaccccgggtcgctgcccggcattctgggcgacgaggacatcgaggacccgccgagccctgccgagtgggcgcggcaggtgacggccgccaccgacacgtactggaccggtggctactccgagctcgctggcgtactgccgggcctgctccgggacggccgcgccaccgcgcgccagcacgacaccgagagcgtgtggcggagtctcgctctcgcctaccagctggccgcgtccctctctacccaggccggtcatcccgactgggcgtacaccgcggtggagaagcaactttctgccgccgcgcgggcgtctgatccgctgctcgagggcatgggcgtatcgacgctgtcctgggtcctcctgcgtcagggccggtgggagcaggcgcgggacatcgcggaacggaaggccgaccagctcgagccgcggcggcgcggtgcgacagcggaccagctcgctgtctacgggaatctcttgatcgcggcggcgacgccgtacgcacgtgccgaccagcacgaggaggcgctctacctgctcgggctggccgagggcgctgccgtgcagtccggcccggtccgcgcgtacgggaccgcgttcagcgtgactgacgtgctgactcagaaggtgaatgcagccctggctggtaccgacggcatgcccaacattgccctggacgccgccgccgatgtccacctcggcaacatcagccgtccggtgcactcggcgtcgtaccgggtggacgtggcgcaggcgaagtaccagaccggcgacaacgagggtgcgctgacgctgctcctggaggtggagaccgatcagccggagtggatccggttccaggccggggctgcggcgacggtgcgggagatgctcgaggccgagcgccggcggaacagtacattgcgcggcctcgcatcgcggctgggcgtcgacccggccctgtgaggtaggacgtagcgccctacctcgggagggcgcggccgcctagagtggtggggttcgcccctggggcgtgatcgcgcgaacacctagcgtgattcacgtaatagcggcaccggtccccccgccaggatcgaccggtgccgcaacccatcccgtagggggcgagcatgagctccgagaccttacagaccgcaccgggcgacgccgcgtacaggaagtggctgggccacaccaggacctgcgccggatgccgagcaggcgcggcgtgcgccaccgcctcggcgctcggccggcggtggcgtgaggcccggcagcgcatcgcccctgcggaccacgcgaccgccgcacccggcggtcctggacgaagggcagaccgatgacgaatccccagacgccccagcaggccgacgacggcaagcacggcgggcagccgtccgacacgccgtggaagcccgacccggccccggcgccgtcccccgacggcagccgcccgcagaagcgcgcccagtgagcacggcgcaggagaccggcacgtacccggccctcgtccaggacctcgccgaccgcaggctgctcgatgcccgctggcggcaggtctgggaggccgtgccccgcagccagttcatcccgccggacatctggcgccagctccccgaccggtgcgagccggtggtagggacggacgactggctggccctggtgaacagcgacgagccggtagtcacccagctcgacgacggggccgagggcgggcccggcatcgcgacgtcgtcgaactcgcagccgtcgatggtggcccagatgctcgggctcctcggagtcgaggacggccaccgggtcctcgagatcggcaccggcaccgggtacgtcgccgcgctgctcagcgagcggctcggcgacgagcaggtctacagcgtcgaggtggaccccgtgctggcgcagcaggctgccgacgccatcgccggatccggataccggccgcacctccacgtcggcgacggtgcggagccgatccccggcatggggccagtcgaccggctgatcgccacgtgcgcgctgcggtacatcccgtacgcgctggtcgggcaggtccggcccggcggggtcatcgtggccccgctcgcccgggacttctggtcgggcgccctggtccagctccacgtccagggcgacgggaccgcggtcggtccgttctgcgggtcggcgatgtacatgccgatgcgctcgcaccgcccggtccaccatgagatcacgggcagcggtcgggcccgggccgcaggcctggaccccgcgcggattctcgacctcgggttcgcgctgtacgccggggcgaggctgcccggtgtccgggtctccggccacgagaccgccgacggtgcccgggtctgggtgagcagcgtggacggggcgggggtcatggccgccacgggcgaggaggtgctgcagtacgggcccggcttcctgtgggaggagatcgagcaggcctggcgggagtacgaggaggccggccgacccgacgtcgaccagttcggtctgaccgtgacaccccgaggccaccaggtgtggctgcgcgatccacacctggtcgtccagcccagcagggcgtaggcacaggcaggcccccggccgagcagtggccgggggcctacctgcgtacgaaatcctcaagctccacgccgatcccgtccgcgaccctgatcagggtgtccagctgcggcgagctatgcccctgctcaatctcgctcagggtcgcggttcgaatgcccgtccggtgcgagacggcctccagtgtgaggcccgcggcgatgcgggccgcgcggatcgcgtcggcgatctgcaggcgccgggcccggacccgctcggggggcatcggctcgtggtacaccccggcaacgctcaccgaggccatgatcatttgtcattacggttgaccgtaaaacggttgatcaagcacgctgcagaacccagcacggaggtacggcgcagtgtccagcgagcacggatggcgagcacgcaccagccagcgcgtggtggtggacaccagatccgggcgggtcggtcggcttgtcgggagagacgccgacggcgtggtccttgagccgctcacgctggggccggagtggtccgtgccatcgcgatacgcgagagccgccacccccgaagaggtgacggccgcgctggaggagtagttacccctccgcctgccggcgaccccaccaggccatcagctggtacgcagtctgcgccccgacggccgcgcgggcggccgccagctccttcgttacggttcgctcagacaggttgagccgcggcccgacgcggtgctgcgactcgccctcctcgagtgcccgcaggatggccttctgtcgctcggtcagcatcccgctggaggcgtccccttcctgccaccgagtgccgcgcgcccagagctgctggtacagcgtgtgcgcccaggcaacggtggcccggtccgtgacatgccatcctgcgtccttatcgccgggcatcaggcagttgtcgatgaacaggtgaacgccatcgatgatgactaaacgggggaaggcctcttccagggtggccacctcggccccggcctccaccgccgccgccaggtacccgctggtcgccgcgtgatcgcgcgccgccacgttgtagagggacctgaccgagacaccgcggtgccgcagctccaggacccggtccattccggcgcgctgcacctccgggtcgcggtcgacgggggcgccgggctgggccgtccacatctcctcggaggctgttcgcagcgcctgctgtatgcgccggttcatctcgtcgcgcgactgcagcagctcggagacggggccgctgtaccagcggtgctggtcgtacgccggggcaaggccctccacggacggcaggtcggccatgcaggcggccgcctgggtgatagcggcctgcacctgcgccaggactcgctgggcggccgcccgagggtcgtgcgcgatgaagtggccgtcctggtcgggattgggggtgaccagccccaggctcaccaggcgcgcgaggtcatgacctgcgacgggcgctccgtcagacgcgaccgcccggtaggtttcccggtcctccggggagagcgggaggtctggcaggtccggcatttcgttgccctttcaaggttgtactagataccgcacgtgctgtttctggcacaccgtaacccctttcgttaacaggatcaccatgcgaacctacgttcagtgacgttcgcctcgtacgggcgttcgaatcgtagagctttcatggaggggatccacatgtccatcacgcgaagactccgccggacagcagctgtggcgctgctcgccgttcttccggccctggcggtcgctgccgtcagcgccaccgcggagacgccggaccgcacggctgttgtcgcagatccgggctggggcgtcgtgaaggtcgcggagccgccggtggagtccccactgacggacccgggctggggctgagctgaatcggttctccgtcgagtgacggagggataggccggccttggacgtgaggtcggatcggcccggcggacgatggagtccgccgggccgttgcaccaagtcaacggggaaaggcgctacaaatgatcacgctggttctcgggctcctcatcgtcgcggggctcgccgcgctcgccctgctcgtgcgaggtctgcggcggcaggtggaatcgttgcgggcggagattgcagcggcgcgtatcgcgggtgttctcgacagggacgacccggtgccgtgactgttcgccacccgccttcgtcagggcgcccccggtcgggacgccctcacgatttctcacactcgtctcacagactgcggaggagcaccgggaatcggggctccctgcctggtccgagcggcgcgttcctggactgtgtggacaccatggacgggccgcatacaactacggatcagaaggttgcaggttcgaatcctgccgagtgcacaagaaacaccaggtcaaggccctgattctcctccggaggatcggggccttcctcgtttcgtctcactttttctcacacgccctgttgatcttggtcgcccgttcagccgagcagctcgttcaacttctcggacccggcccggagtgactgcgggtcagggtgcacgtagatccgcttcgtgaagctgaggtccgcgtggccggcccatgccgacaccacggtgtccggcacgccgttgttcgccatccacgacaggatcgcgtgacgggccatgtagagcgtgacgcgccgcacctcgagctggtccatcagcttgtacgcttcgcgccgcagcttgtccgtcttccacggacgcccgagcctgtccaccatcacgtagccgctgttctcgtaggcctccccggctgcgagccgttcggctacctggatcttgcggaacgcgcgcagcccgttccatgtggggacggggagggggagcgcgcgttccccagcctcggacttggcgtccttctcgatcaccacggaacgctccccgcgcggccgctccggatcgtaggccagggtccgggtgttgccgatcgtggtggtgcccttctccaggtcgatgtcctgtgcccagcgcgccccgcagacctcggccggtcgctcggcaatgaaggtcagcatccacccgccgtactcccggacgccgcggatgcctgtgaggaactgacgcacctcgtcctcgtcccacggcgtacgctcgcgcttcttcgcacgggctgccttccgggccgccttcgggacggtgacgaactcggcgacgttccgcgtgaggatgttgcgccgcatcccgaggatgagcacggctcgtagacgtccgagtgtgaggtccaccgtccgaacgctgaggccggtgcccggccggcccccgatccggcgggcgctggtgagcatccacgtgaccatctcggtcacgtcctcctcggtgagctgctgcaccaacttgtcgcccagccaggtcttcacatacgccatcgcgtccacgtacgacctcgctgttttgacctccacgtccggcgtcaccatcgcgagccaggtgtcgaccagctcctccaccgtcatcttcgacggcgcgacgaactggccagtcgcctgctggtgctggatgcgcgccaactcgttcttggcctcggtcgaggtgtccttggtcaccgtgagctgacgccgcttcttggtgacggggtctaccccgatgtcgacgacgaaccggtagcgcgtcttccctctcgccgtcaccttcttgatctccggcatgccttcccctcctgttgaccgggcgcctatcgccgcggtgttccgtatacgccgaagcccccgcggccgcggatagttcgcgtggccacggggacttcgggtggccgtcagccttcgtcgatccgcttcctgagctccgggccgagttggcgcagagcctcgtcccggacacgtggcggcaggtccatgaggatgtccaccgccatttgcacgcgggggtcagtggtcccctgcgtcggctgcgcttcggcagcctcctggcgcttgatctcccggaggatctccgccgcgtccgcccgtccggcatcatccagctgctcgggctggacgcccaccacgttcgccatgtgggcgagcgtcttggccggcgcagtggttggcgtgaacggcgagcgcctggtgtagccctgctcgatgtgacgccatcgaccgccgcccagacgtacgggcgcacggtctgccgctgtctccgggctaagacccctggccagccgggccactcggatcaactcggcctcgggcggtggggcgggtgggggcgcgctcaccacgggggtcctctcacggtcggatcgatcaggagccgatcgaacttcgctgaactttaggacaccagcacgtcagatggtagggaacgccggttcaggacgacttctggctagttctttcttgtactttcttgaacttatggctactgtgccgctcatgaaagagcgctaccaggaccccgcgcagatccgtcggcgtcggatcgaggccggtctgacgcaggaagggctcgcgaagcgagccaagtcctccaaggcccacatatccatggtcgagcgcggcactgccggtgcatccgccccgctcctttcccggctggccgaggcgctcgggtgcgaggttgccgacctgatgcccccgccccccgtcccggcaccggtcccggcatgagccgcgaccccgggcccacgctcgacgaggtgagggcgtggccagcaaccgttgacgttcccgccgctgccaaggcgctcggagtcagcagggctcacctctacgcccttgtgaagtgcggcgatgcgccggtgcgcactctcagcttcggcaagagccaccgcgtcgtgaccgcgtcgctggtccgcctcctcgaggccgcctgaccacacgcaaacggggccgccgggaccgggcctggtccctggacggcccctcaaccggcacacctcaaccatgaatcgaggcaaccgtgtccaccgagactatcggcaccatcccccagcccgcaccggctcccacgtggcagtccggcctgcagctggcaatgaacgcgacctggaaggccatcggcgtcccgtcggccgctgctgaaccgttccacgctggccagacgacctggggccgcaccggcgactacgtcggtgaggtccactacctccttctcgctccgctcctggagatcgccgccgcgtacgacgtcccggtcaccgaggtccccgccgccggcggcggcaccacctacaaaatcgtcgtcccggtcgacggcatcgacatccacatctggacgaccgacccggccgatgccaccacggcggtgacggcatgagtgcccgcgacgtggtccgcagcgacatggatgcggtcatcaccgacgcgaccgcagaacggcacctggacgcctaccgcgccgaggtgttggccgaggccgccgaggggaaggacacccagccgggcgagtccaccccggccatgtccattcgtgacgtccgtacgaccgtcctggtagcggtcgcccgcgccctgcgcgagcagcccaccggagcgcagctcctcgacggcctgggcgagctcggcgaggccgtcgtctgtgcggacctcggcgagatcgcggcgtgggcggatgcactcgccagcctgatgcacatcgacgacgccctcggcgctgccgccgagcagccgctggtgatgtaccgggccgagcacgaggggatcccgctcaacacgtacaccaccgagggcgccgcccgggcgcacgccgagcacgtgctgtcctccgagtacgggcccgagcgcacgctgctgcgcgactggaccggcgacgaggacgaccccgaggagctgcgcgagctcgtcgcccaggtcgacggcggcgacgcgcagtacacggggtacatcgtcgtcccggtccccgtcgccacctcgttcgacccggacgccgagtgatggccgccgccggtttcaccgtgccgaagaagcgggcgaccaaggcgcagcaggactggaacgccgggatgcgcggcatgccggagcccggccggtcggtcgagatccccgggtcgtgcacgacgccccggtgcggcacgaaggcagacacgctggacgagtccgatccggcgctgtccggctggactcgcgccggtgtgtacggatcgcgtgagcctgaccgggtgtggtgctcgggtctgtgcgccgcgtacggcgtcgccctcgccgagctccgtctgacggccacggcccgccgcaaggcggacgccgcgcgcaaggcccgggaggcggccgatgcctgagccgctgcccttcgtgctcctggccgcgctcttggccgccgccgttcactgcctgaccgccgcacttcacaccggccggaggcccacgcccccgccgccggccgctgagcgcgcggacgagttcgggatctggcacgcgtgccacaacccgggctgcggaggccacgggcagaccgtccaccgctacacgacggccgggctgatctgcaccggctgcggcagccccgccgaatgagcgggttcacctacccgtgcggcgacctcgggttcccgcacggcacggcctacccccgccggtacgtcatcggctaccggtgcgacctccacaccccctcggctgtgcgcggcctgcccgagcccccgccggggccgggctggccgcccggcaactacctcaaccaccccgaccgcaacccgcacacgaacctgcccgtagaggagccgccgtcatgacgaccgcc

SEQ ID NO: 2772 - DNA, 7766 bp, Unknown
  Kingdom: Bacteria, Phylum: Actinobacteria, Class: Actinobacteria, Order: Streptomycetales, Family: Streptomycetaceae, Genus: Streptomyces
  misc_feature (651)..(652): n is a, c, g, or t
gctcgggcaagtccaccctggctcggctgatcgcgggcctgggcgaacccacggacggccggatcaccgtggggtcctccgccgaggcgcccgcggtccggtatctggtgacgcaggaggtccaccggttcggcggcaccctcgcggacaatctccggctggcccgccccgccgcgtccgacgaggaactgcgcgaggcgctacgcgcggtgggcgccgactgggcggaggacctggagtccggccccgacaccgtcctcggcccgggcggggcgcctctcgacgacggctcggtccagcaccttgcactggcccgcgtcctgctggccgacccgcccgtggccgtgctcgacgaggccaccgccgagtccggggcgggcgatctgctgcggacggcgctcgcgcgggtgacccggggccggaccagtgtgatcgtcgctcaccgtctggaccaggcgcgcgacgcggaccgtatcgtcctgctctccggcgggcgggtcaccgaagagggcacccatgacgaactgctcgcgcgcggcggcgagtacgcggcgctgtggcgggcgtacagccggggcgctcctgcgtgagggtgcggaccggactgcggaccaggcggcgcggatggacgggacgcggttggaggggacnngggacgcggttggaggggacgcggttggaggggacgcgttactgggaggagccgatcccgatgacgtcgcgctctgcctcggactcgaccggttctccttcgccatggtcgcggccctggaggactcgctgatggtgctccgcccgtgcgccgtgccctaagccgcagcctccggtgcgatctcggcgatcaggccctcgacaagagtcttgatctcgtcgcggatcgggcggacggcggccacgccctggccggcggggtcctccagcttccagtcgaggtagcgcttgccggggaagacggggcaggtgtcgccgcagcccatcgtgacgcagacgtcggactcacggaccgcgtcgacggtcaggatcttcggcgtctcggcggagatgtcgatgccgacctcggccatggcctcgacggcggcggggttgacggcgtcgccggggctggagccggcggagcggacctcgacgcggtccccggccaggtgggtcagccaggcggcggccatctgggagcggccggcgttgtggacgcagacgaacaggacggacggcttgccggaggactctgccatggtgatcgttctctcccgtcgcacggcggaactcggccgccgatgactccgatgacttcagcgcccgctggtatcagcaagcaatgatgtgacagtatcagcgcatgctgacttcagtcgatcctgacgtgatccgggcgctgggcgatccgctccgccttcagatcgtgaccctgctcgcccgtgagacgctctgcacgacgcacctggtggaagagaccggagccaagcagaccaacctgtccaaccacctgaaggtgctgcgtgaggcaggactggtggagaccgagccgtgcggccgcttcacctactacaggctcaggcccgaggtcctggccggactgtccgaacagttcgccgcgctggccgagtccgctcgtaccgccggcgagaacaagagggcctgcccgtgacctccaccgagccgaccatcgcctccgcccgggccgccggccaggacggggacgactcgatcgtcaggaagctctccaccctcgaccgctacctcgcggtgtggatcctgctcgccatggccgtaggtctgggcctgggccgtctcgtccccgggatgaacgacgctctcgcgaagatcgagatcggcgggatctcgctgccgatcgcgctcggcctgctggtcatgatgtacccggtgctggccaaggtccgctacgaccggctcgaccgcgtgaccggcgaccgcaagctcctggtctcctccctggtcgtcaactggatcgtcggccccgcggtcatgttcgccctggcctggatcttcctgccggacctgcccgaataccgcaccggcctgatcatcgtgggcctcgcccgctgcatcgccatggtcatcatctggaacgacctcgcctgcggcgaccgggaggccgcagccgtcctcgtcgctctgaactcggtgttccaggtgttcgcgttcggcctgctgggctggttctacctcgacctgctgccccggtggatgaacctgggagacggccagggcctggacgtctccgtgtggcacatcgcgctgaacgtcgtcatcttcctcggcgtcccgctgctggccggattcctcacccgccggctcggagagaagaagatggggcgcgagcactacgagcagcggttcctgccgaagatcgggccctgggcgctgtacggactgctgttcacgatcgtcgtcctcttcgccctccagggaaagacgatcacctcgcagccgctcgacgtggcacggatcgccctgccgctgctggtctacttcgcgatcatgttcttcgggaccttcctcctcggaaagagcctcggcctggcgtacgaccgcaccaccacgctcgcgttcaccgcggcgggcaacaacttcgagctcgccatcgcggtggccatcgccaccttcggcgtcacctccggacaggccctgtccggtgtcgtcggcccgctcatcgaagtgccggttctgatcgggctggtgtacgtcgcgctcgcctggcggcgcaggttcacccccggtgcggtgacgacggcaccgtgacgcggcggggccggccagcgtctccgtaaggaagacagcgcggccgacccggccgtcacgtgatggcggggctgcggcgttcgacgaggacgacgtcgcgccagacgccgcgcctgcgcccgatccgctcccggatgccgatgacccggaaacccgcccgctcgtgaacggcgaggctggcggtgttctccgggaagatcccggcctgaatggtccagatcccggcctgctcggtggagtcgaccagcgccttcagcaaggcggaagcgaccccgcggccccgcgcggcggggtcgacgtagacggagtgctcgacgacgcccgcgtacgcgcaccggtccgaaaccctgccggccgccacccagcccaggaccgcgccgtccgcgccgagggcgacgaagcggtggccggggagcttcgcggcgtcgaagctcccccagtcgggcgggccggtctcgaaggtggcgtcgccctcgtcgatacccgcccgatagatcgccagcacccgctctgcgtggtccgcggtcatcggcgcgaccacgacccccgacaccccgctcaccacgccgcccgtcccgtcatcccggcgctcaggcggcggcgtgctgcgtcagcagccggcccatcccggccagcaccgacggctcgacccggtagtagacccaggtgccgcgccgctcggacgtcagaagcccggcctccttcaacttcttcaagtgatgggacacggtgggctgggagacgccgacatcggagatgtcgcacacgcacgcctcccctccctcgtgcgaggccacggcggagaacagccgcagccgcaccgggtcgccgagcgccttgaacatccgcgcggccgtctgcgcctcatcggcggtcatcgggcgctcggtcaggggcgggcagcacggcaccacgccctggccgtcggcgggctcgatcagcggcagcaccttcgcattcgacatatatctatgttgacacacgtcgaaccagggtgcccagaggtcgaccgtgcgcgagcaggacggaggcgggaccaggaaggccgaccggggcgaaccggggccaccccgcccggcaaccgcgcgcgggggccgcgaagctccgccgagcccccccgacttcgacatacgtctatgttgacgttcatcgatacaggtgtcattcttggcagcacaagccatcgacagatgtcgaaacacgcgaggagccgccgccgtgaacgcgcccgccaccaacgaactgcccgtcgtcgtgatcggagccggacccaccggtctggccgccgcagtccacctgatcgaccggggcgtcgagcctctggtcctggaagccgggccggccgccgccaccgcggtacgcgactgggcgcatgtgcgcctcttctccacctggggcgaggtcgtcgacccggccgccgagaagctgctggcacccaccggctggacccggcccgacccggagacgtatccctccggcggagactgggccgagcagtatctgcagccgctcgccgacgcactcggcgaccggatccgcctcgacgcccgggtcaccggcgtctcccgcacaggccgcgaccggatcgtggacgccgaccgcgaccggcagccgttcgtcgtccacatcgcccacaccgacggccgcgaggagcgggtcctcgcccgcgccgtcatcgacgcctccggcacctggtccacaccgtccccggcgggcgccagcggcctgccggccctcggcgagaaggccgcggccgaccgcatcgcctaccgcgtccccgacctcaagaacccggccgtccgcgcccgttacgcagggcgccgcaccgccgtcatcggctccggggcctccgccttcaccgccctcgcctccctcgccgacctcgccacgtccggcgacggcacgggtaccaagggcgtgtgggtcctgcgccggggtctctccgactccaccttcggcggcggcgacgccgaccagctgcccgcccgcggggcgctcggactcgcggcgaaggccgccgtcgaagaggggcacatggacgccgtcaccggcttccgcaccgaagcgatcgaacgcgacaccgccggccgcctcgtgctggtgggcgaggacggacgccgcctggacgcggtcgacgaggtcatcgtgctgaccggcctccgccccgacctcggtttcctggacgaactgcgcctcggcctggacgagcggctccaggctccgaccgagctggccccgctgatcgatcccaaccagcactcctgcggcaccgtctacccgcacggccaccgcgagctgtcccacccggaaccgggggtctacctggtcggcatgaagtcctacggccgcgccccgaccttcctcgccatgaccggctacgagcaggtccgctccgtggccgccgctctcgccggcgacctggaagcggccgaccgcgtcgaactcaccctccccgaaaccggcgtctgcggcggggccggcctcttcgacgacccggccgccgcacagtccgacgccggaggctgctgcgcggcgccggaacccgccctggtgcagctcggcgtcgggaccccggccgctgccgcggtcgcggacgaagcggcggcgggcggctgctgctccccctcgtgaccggcctgtcgcgccatcaggtcacatcgcgcctgacgcaccgacggttcgccctcccaggaaactgcccgtaccccccgacccgtcgcgactgacgcggcccggggggtcagtggtaggcgtggacgacggcgtggcccttgccgcggccgatcatccacttgttgaccggcgtcgtgatcacgaaggcaacggcgaagccgcccagcagagccgtccagaacagcgcgtccgacaggtgggcgtccatcgccccgggcgtcagggcgatgatgccgttgtcgacgagctccatcaccgcgatcgagacggtgtcggcggccagcgccaccttcagcgcggtcctgaagtccagccctgccctgaggaccgcgaacagtgtgaacgagtagccgaacacgaacgccaaggcgatcgccagaatcatcgtctggacattgccccacatcagggcggtaccgatgaccatgccgaggatctcaccgatcgcacagccgatgaggcagtgcagcgtcgccttcgcggccgtcccccacgtcgccccgcctttccgttgtccggcgggacccgcgtgcgtctgccggccgtcatggtcgtggtcggcgccggcgcggtgcgtgccgtggtccatggtcatcgcctcccgtcccgtccggtgggatatcgctgccccacgcgagacacacgttatacccggcaggggtataacgccgcgcggtacggttcagctcccccgggggatacagccgacgggccaaactcgctccgtcgccgaacaaggagcctgcgggcatgggcgtcctcagccctcctcactcgtcactcgtcgtgtccggagtcagcggcgcccccgcagggccgcaagagtggcgtcgaggtcggccgcgtcggtgcgattgtggggcagttttgccagcatggcggccataccgcaggtgttggtaagggcggagaagaccagtcctgcggcgatgcctgccgcgaggagctggaacgcggggtgcacgaggaggccgaggagcaggccgaggaggacgacggttccggcggtgaggcggacctgccgttccatgccccaggtcgcacggggggttccttgggggcggtgcaggtcgtggccttcggctacccaggcgctggtgccaccgccgagcgtggcggtcgcgatgccgttcgcggcgaggaggcggcaggcgctctccgagcgggcgccggacgcgcagacgatcaggacctcaccacggtccgcggactgccggatatccgtgagcgctcgctggatccggtccatggggatattgagggcgccgggcaggtgaccgccggcgtactcgccgggggtacggacgtcgatgacggtcaactcgtggaggcggttgcgggcctcgtgggtggagagggtggagggcgtggtcatggcgggtgtcgtccttttctgtctgccgggtccccaccaagggggagtacattacccctgggggtatctcagaaggagtgatgatggagcttgatctggcgggagcggagctcaaggcggtcctgaaccggctgcgccgggcgcaggggcagatctccggggtgatccggatgatcgaggaggggcgggactgcgaggaagtcgtgacacagctcgcggcggcgtcgcgagcgctggaccgggccggattcgcgatcatcgccaccgggctccagcagtgtctgaccgaggtggaggacggccggcgttccggtgagtcccgggacgagatgcgcgcccggctggagaagctcttcctctcgctcgcctgacccccggacggcccgcgtgctcagacgaccacgtcgatgaccatgaaggccgccaccgcgaacagtgcgtacgcgaacactctctgcagagtggcgccggcgaccttcgccgccagccgtttgccgtcccaggctccgaggatcgccgctccggcgaacggggcgatcacctcccatcggaggtggtcgccggttcccgatcgggccgcgagggcggtgagggaattgacggtgatgaccaggaggctggtgcccacggcctgcttcatccgcaggccgaggacgccgacgagggcggggacggcgaggaacccgccccccactccgaggaatcccgtcacggcgccgagcccggcgccggttccggccgccttcgcgagccgcgccccctccttcggctcggtggccgagggccggagcatccgcagcgccgccagggcggcgatcagcgcgaacgccgtcgtgagaaccgcctcgggcagatgatcggcggcagctccggcgaggtacgccgggaggactcccgccgccgcgagcaacgccccggctttccaggcgacatggccgtctctggcgtacgcgtagag

SEQ ID NO: 2773 - DNA, 1623 bp, Unknown
  Kingdom: Bacteria, Phylum: Actinobacteria, Class: Actinobacteria, Order: Streptomycetales, Family: Streptomycetaceae, Genus: Streptomyces
cccgcttcgacgaccgcgtcggccaggatcgtcgagccgtctattctcgcgcccgcgccgaccaccgcgccggcgccgaccaccgtgccgccggtgagcttggcgtccggggccacggaggcggtcggcaggaccagacggtcgccgcagcggccggggaccgccggggacggggcgcggccgaggacgaggtcggcggagccgcggacgaaggcgcccggggtgccgaggtccagccagtacgtggagtcgaccatgccctggaggtgggcgccggaggcgagcagtccggggaaggtttcgcgttcgacggagaccgggcggccggacgggatggagtcgatgaccgagcgccggaagatgtacgccccggcgttgatctggtcggtgacgatctcttccggcgtctgcggcttctccaggaacgccgtgacccggcccgtcgcgtcggtcggcacgaggccgaaggcccgcgggtcctcgacccgggtcagatggagggagacatccgccccggagacggtgtgcgaggtgaccagggcccggatgtcgagcccggtcaggatgtcgccgttgaagatcaggaccggttcgtccggccccgaggacagcttcggcgcgacgttgcggatggctccgccggtgccgagcggctcctgctcggtgacgtactcgatgtgcaggccgagcgaggaaccgtcgccgaagtacggctcgaagacctccgccaggtaggacgtggcgagcacgatgtgctccaccccggccgccctggcgcgcgccagctggtgggtgaggaaggggacccccgccgccggaaccatcggcttcggggtgtgcaccgtgagcgggcgcagtcgggtgcctttgccaccgaccaggagaatcgcttcttttgcctctgtcacagcaccgtctctgcttcctgctggggcctggcccggatatggctggccagtctaagcagaccggtcggtagcgccccggtcagcggccctgcagtttggcggagctggtccgggccttgccgagcttcttgtagagacgcgctccgggacattcggttgcgaagccgtcccgatggcccgagatgacgttcattttgacccttttgcccttgctgtacttgccgctgccgccggagacgagggtgaccttgcccttggggttggctccgaacagtccgagcttccaggcggtgagcttggagacggcggtcaccgcggcggcgggggggttggtggaggagtacgagccgagcaccgcgacccccatggtgttggtgttgaagcccagcgtgtgcgccccgagcaccgccttcgcgacgcctccggcccggccctcgtagatgtttccgcacttgtcgacggcgaagttgtagccgaagtcgcgccagccgctgctcttgacgtggtagcggtagatgccgcggagcaccgaaggagcctgcttgcaggtgtagttgttcccggtcgcactgtggtgcacgaaggccgccttgacggacttggtgtacgcgaagttgcgctcacggagcttctcgtcagcaccccagcccttgcgggtgacgatcttcggccggggtccgaagtacgtacatcggccccggccgaagatcgtcac

SEQ ID NO: 2774 - DNA, 6919 bp, Unknown
  Kingdom: Bacteria, Phylum: Actinobacteria, Class: Actinobacteria, Order: Streptomycetales, Family: Streptomycetaceae, Genus: Streptomyces
gacccgggccgcctccaggagctcgcgcggcagaccggccaggcccgccgcgatcagcaccatggcgaacccggcccacatccagacgtagctgcagatgatcccgggcgtcacgagggacggcccgagccagtcgacgccgttgtacggctcgcggaagttgtcggcgggcaggcttccgacatgccctgacatgacgtcacgaggcgatcacgatcactctgttgggacctccggcggtattgcggggcccgtgtgccgggcgtaggactgtgcgcacggacgacgtggtccgggcatgggacatggccggacgcgtaaagaagagacggggcaggaatgcgcacaacccttcggatacgcagggccgcagtggtgttcgcggcggccggcgctctggcgctcaccggctgcggaggcgacggcaagaagaagtcggacgacgactccggcaagggcacggacagcgcggccacggtcgagctgccgaagctcgacggggagaacatctccgtcgccgcggtctggaccgggcccgagcaggagaacttcaccaaggttctggacgagttcgagaagcgcacgggcgcgagcgtcaccttcgtcccggcgcaggacccgatcatcaacttcctgggcaccaagatcgcgggcaagcagccgccggacgtggcgatgatcccgcaggtcggcgccatccagcaggcagccgcgaagaagtgggccaagccggtcggcgccgaggcgaaggctcagctcgacaagaactacgcgaaggtctggcaggacctcggcgcggtggacggcacccagtacggcgtgtatttcaaggccgccaacaagtccctgatctggtacaacgccgccgcgttcgacaacgcgggggcgagcgagccgaagacctggaaggacttcctgacgaccgcggagaccatctccgcctccggcgtcacgccggtctcggtgggcggcgcggacggctggaccctgaccgactggttcgagaacgtctacctctcccaggcggggccggagaagtacgaccagctggcgaagcacgagatcccgtggaccgacccgtcggtcaaggacgcgctgacctcgctggccgggctgttcgggaagccggagctgatcgcgggcggcgcggacggggcgctccagacggagttcccggcctcggtgacccagacgttcaccgggggcgaccagcccaagggcgcgatggtcttcgagggcgacttcgtctccatcaacatcgcgcagaccgaggcgaagatcggcacggacgccaaggtcttcccgttcccggcggtcggcgcggactcgcccgtggtgaccggcggcgacgctgcggtggcgctgaaggacaccaagggcgcgcaggcgctgctgacctggctggcgtcctccgacgcggcgaagatctgggccgaggcgggcggcttcatctccccgaacaagggcctggacctgaaggcgtacccgaacgacgtgcagcgcacgatggcccaggctctgatcgacgccggtgacgacgtccggttcgacatgtccgaccaggccccgcagtcgttcggcgggacgcccgggaagggcgagtggaagatcctccaggacttcctgaagaacccgaaggacgtcgcggggacccagaaacagctggagtccgaagcggtcaaggcgtacaagagctgacgccgtgacgacaacgaccgcggggggcgccgggtcggcgccccccgccgacgacaccaatccccgtccgtccccgcccccggatccgaagaagtcccgccggagcgtgaccggcacccgcagggtcatcgcggcggcgttcctgctgcccgcgctggtgctgctcggcgcgctggtgctctacccgatcgggtattcggtctaccggtcgttcttcgaccaggccggtacgggcttcgccgggatcgacaactacaaggcgctgttcaccgacgccaccatcgtcacggcggtgaagaacaacgcgatctgggtggtcttcgccccgacggtcgccaccgcgctcggactgatcttcgcggtgctgaccgagcggatccgctggggcaccgcgttcaagctgatcgtcttcatgccgatggcgatctcgatgctggccgcgggcatcatcttccggctggtgtacgaccaggctcccgagcggggcgtggccaacgccgtggcggtgggcgtgcacgacacgttcaaccagtcctccggcttcccgaaggcgcgcccgctgcccgtgcacccgctggagaagggtgacggcggtgcgttcgtgtccaaggagccggtccgggcgggccagccgcttcgggtgccgctgatcggcgtggctccggcgaagatgccgggcgacgcacggccggcggagggcaccccggcggcctccggggacaagatctccgggaccgcctggctggacttcacccggggtggcggcggaaagccgaatgtcgtcgacccgaaggagctgggcctgaagggcctgaaggtcgaggcggtgaaggacgggaaggtcgtcgccaccgccacggccggagcggacggcgtgttcaccctgcccgcctcggcggacggggcccaactgcgcctgcccgccgacaacttccgcgagccgtacaacggcgtcgactggctcgggccgtccctcgtgacgcccgggatcatcggcagctacgtctggatgtgggccgggttcgccatggtgctgatcgcggcgggcctggccggtctgccgcgcgagctcctggaggcggcccgggtcgacggcgccaacgagtggcaggtgttccgccggatcacggtgccgatgctggcgccggtgctcgcggtggtcctggtgacgctgatgatcaacgtgctgaaggtcttcgacctggtgttcatcatcgcgccgggctcctcgcaggacgacgcgaacgtgctggcgctccagctgtacaggtcctcgttcggcacggacgcggacctggggatcgggagcgcgatcgcggtgcttctgctgctgctggtgatcccggtgatgctgttcaatatccgccggatccggaaggagggacggcgatgagcagcgctccggaagtgaacactgcgcgcatcggccgccagaaggcggtttcccggcagtcgagcgcccccgaagcgccgagggccgagcagtccctcggtgcgcggatcgccgcccgtgcgggcggcggggtgatgcgggtcttcctgatcctggtcgccctgttctggctgatgcccacgatcggcctgctgctgtcctcgctgcgcgggccgcaggacatcgcggcgaccggctggtggaaggtcttcaccgccccgtcggagatgaccttcgacaactaccagcggctgctggacaattcgacgatcaccggctcgctcgtcagcacggtcatgatcaccgtcccctccacggtgctggtggtggtgatcggctcgctggccggatacgccttcgcgtggatggagttccccggccgcgactggtggttcctgctggtcgtcgggttgctggtggtgccggtgcaggtggcgctgatcccggtgtccgaactgttcggcaccatcgggatcttcgagacgacgctcggggtggtgctgttccacacggcgttcggcctgccgttcgcgatcttcctgctgcggaacttcttcgcggagatcccccgcgaactgctggaggccgcccggctcgacggcgcgggcgagatccggctcttcgtccgggtcgtgatgccgctgggcggtccggcgatcgcctcgctcgggatcttccagttcctgtgggtgtggaacgacatgctggtcgcgctgatcttcgcggactccgagtcgccgccgatcaccgtggcgctccagcagcaggtacgccagttcggcaacaacatcgacgtactggcgcccggcgcgttcgtgtcgatggtgatcccgctggtggtgttcttcgccttccagcggcagttcgtgaccggcgtgatggcgggctcggtcaagtagccctcgccacaaggccgtacaccctcgaagacgtacggctgtacgtcaacccggagcggcccggttccccggaaccgggccgcttcgccgtccgcgtcccccgattgccacgtccggcgtaaccctgtcattccatccgacgtttgcggtctgcctgcttcccgcgaacgatcgacccatggatgtgtagtgccccggttctccgtcatcgtgcccgcattccgggtccaggcgtatctgcacgcgtgtctggattccgtgctggcccagtccttcaaggactacgagatcgtcgtggtcgacgactgctcccccgacgcctgtgggacgatcgccgacgagtacgcccgccgggaccctcgcgtcaccgcactgcacctcccccgcaacaccggcctcggaccggcccgcaacgccgggatggaccgggcgggcggcgactacctgatcttcctcgacggcgacgacactctgctgccggacgcgctccagaccatcgccgaccggatcgacgcgaccggcgagcccgacgtcctgatgtacgactacgcccgtacgtactggacgggccgcagcgtgcgcaacgttctggccgcccacctcgacgagggcgggcccgcccgcttccggctcaccgaccgccccgagctgctgcaactcctcatggtcgtctggaacaaggcgtaccgacgcgcgttcatcgaggccgaggggttcaccttcccgcccggctactacgaggacaccccctggacctacccggtgctgatgtcggccgggtcgatcgcggtgctggacgcggtctgcgtctcctaccggcagcggcggcgcggcaacatcctctcgaccaccagcgagaagcacttcgacgtcttcgaccagtacgaccgggtgttcgcgttcatcgactcgcgccccgaactcgccctgtggcggccggtgatgttccgccggatgctggaccactactcggcgctgttcgcctcccgcgaccggcttccgcaccgcagccgcgcggcgttcttccgccgggcggccgcgtcctgccgccgctaccgcacccccggtgccccggtcccccgccgtgcgctgctgcggcacggcctgctgcggctcggcgcgcggcgcacctaccaagccctgtcgggggcccagcgcctcggcggccggctgcgccggggttcggctgcggtgcgccgggcggtgcggggcgctgcgctgcgggcgcactaccggatccagttgaggctgccgctgcgctcccgggacgcggtgttcgccgcccggggtggtggcgggtacacgggcagcccggcggcgatcgaggcgaaggtccgcgagctggtcccgggggtgcggacggcctggatctgccggaccgtcgacgcccacaccgtgccgaccggcacccggcatctcgcgcccggcaccttcgcccactggacggcgctggcccgctccacgtacctggtgaacgacgccgccttcgaccggggactggtcaagcgccggggccaggtcctgctgcagacgcacgagggcacgcccctgcggaccgtgggcaccgacctgctggaccggcccgccgccgcccggggcaccgacttcgagcagctgctgcgctccgtggacacctgggacttctccctctcggccaacccgcactccaccctcgtacgggaacgggcctacccgtccgcgtacacgacgctggagtacggctcgccgcgcaacgacgtgtaccaccgcaccggtccggccgatgtggcgcggctgcgcgagacgctggggatcccggcgggcagcacggccctgctgtacgccccgacgcaccgcgactaccggcgagtccagcggcccgccctggacctggagcggctggtcagggtcctgggaccgcagttcgtggtcctggcccgggcgccgcagctcgcgggccccggcggccaccgggcgccgcatccccggatcatcgacgtcagcgggcaccggtccgtggagacgctggctctcgcgtcggacgcgctgatcacggactacgcgtcgctgatgttcgactacgtcaacctggaccgcccggtggtgctgcacctggccgacatcgaggcgtacgaggcggcccggggcacgtacttcgacatcacgacgttcccgcccggcatcgtggcccggagccaggacgagttgttcgacatcttcgccacggaccactggcggggctcccgctcggcgcagctgcgggccgcgttccgggcccggttctgtccgtacgacgacgggtacgccgccgagcgggtggtgcggcgggtctttctcggggagacggacggactgccgctgccggtgccgtccgccacccgccggacaccctcggcccttccggcgcaggacggggccggggcaggcgtcaaaagctgaccccggtctgtcgtccacgcacctgctcggcgcgtgctcagcgttccaggaacgcgaacagctcctcccagcggcgcagggtctccggctcggagaaccgctggacgccggacctggcccgcgcgcccatcgcgtcacgcagccgggggttgccggtgagccgcagcagccggtcggcgagcgcggcgacgtcaccggcaggggccagcagcccgtcctcgccgtcgcggacgatctcccgcactcccggcgcgcagtcgaaggcggcgcagggcacgccgctcgccatcgcctccagcagggccagcgggaagccctcgccccgggaggactgaacgaagacggaggcctcggcgagggcccgctccacgtcgtcggtacgacccatccactccacggatccgtcgaggccgaggccggtgcattggtccttcagcgcggcctcgtcctcgcccgccccgactggcggctg

SEQ ID NO: 2775 - DNA, 6474 bp, Unknown
  Kingdom: Bacteria, Phylum: Actinobacteria, Class: Actinobacteria, Order: Streptomycetales, Family: Streptomycetaceae, Genus: Streptomyces
tgccgaggcggcgcaggctcgcctccaccgccgatacgatgtgcttgcggctcagccctcccgcgttcggggactcacccatcgtcccgaacaccttggtggcgatgacgagatcgtcgcgtctgcggcccttcagccaccggccgacgatctcctcggagacaccctggttgtacacgtcggcggtgtcgacgaacgtgccgcccgcctccgtgaacgtgtcgaggatccgatgggcggccgtctcgtcggtgtcctggccgaaggtcatcgtgcccaggcacagttcactgacgcgcagtcccgaacgccccaggaatcgctgcttcatggtgttcctctcgtggtttcgtgcgctgtcccgaacgctacgagttgaagtgcacgcgaaggcaaggaagctgacgagccatcactggcgttcagccgtcggccagcaccacgcacgactccggcggcaggtgcagaatcccgtccgaccccggggcctccaccagcacccaggccgccaacacccgagcgccggcccgccggtggcggccggagcccagcgggacggcggcaggcttgtccgcgaggttcaccgcgatccgcagatcgcccctgcggtacgccaaccagcgcgcgtcctcgtcgaacgccgtcttcaccgaggccaggtcggggtcgtgcagatcggacaacgtgcgccgcagcgcgatcagttcgcggtaccaggcgagcagccgtgcgtgcggttcgcgctccggctcggaccagtcgagacaggaccggtcccgggtcgccgggtcctgcgggtcggggatctcctcctccgcccagccgtgcgcgccgaactcccgccgcctgccgttgcgcacggcctcggccagctccgggtccgtgtggtcggtgaagaactgccagggggtgcgcgccccccactcctcgcccatgaacagcatcggggtgaagggaccggtcagcacgagggcggcggcgcacgcctggaggccgggggtcagggacgcggccagccggtcgccgagcgcccggttgccgatctggtcgtgcgtctgcgcgtagccgacgaagcggtgggccggggtgcgcgtcacgtcgaccgggcggccgtgggtgcggccccggaaactggagaaggtcccgttgtggaagaacccggacgtcaccgtcttggcgagagcggcgagcggagcgcgggcgaagtcggcgtagtagccctgcgactcaccggtgagcgcggtgtgcagggcgtggtggaagtcgtcgttccactgggcgtgcagtccgaggccgccggcctgacggggggtcgtggtgcgcgggtcgcagaggtcggactcggcgatcagcgcgagcggcctgcccacctcgacggccagcgcgtcgaccgccgccgacagctcctccaggaaggtgagcgcccgggtgtcggccagcgcgtgcaccgcgtcgagccgcagcccgtcgagccggtagacgcgcagccaggccagggcgctgccgagcaggaacgcccgcacctcgtcggagccgggcgcgtccaggttgaccgccgcgccccacggggtgtggtgggtgtcggtgaagtacgggccgaaggcgggcaggtggttcccggacgggcccaggtggttgtggacgacgtccaggaccaccccgagccccagcccgtgcgccgtgtcgacaaagcgcttcagtccctcgggtccgccgtacggctcgtgcaccgcccacagcgagacgccctcgtacccccagccgttgacgccagggaacgggcagacgggcatcagcgacacatgggtgacgcccagctcggccagatggcccagccgtgccgccgccgcgtcgaaggtgccctcgggggtgtacgtccccacatgcagctcatacagcaccgcccggttcagccgccgccccgcccacgcgtcgcgccaggcgtacgcctcctggtcgacgaccgcgctcgggccgtcgggcccgtccggctgacgccgcgaacgggggtccggcagcagagggccgtcgtccacccggaacccgtaccggtccccgtccgaggcctccgcctcggccgtccaccacccctcgcgccccgcgtcgcgctccatcgcgctccggacgtccgccgcctccagcacgaccgagtccgcctcgggggcccacacctcgaactgcatccaccactcctcgtccctgggcggggcgcggccgcccgcgggcgggctccacgatccacgcgacaggctctgttgccgcccgtcaccggcgattaaggtctggtcctgatcattgcccggcgaggttccgctcatacaggttctgctcacacgtactggttctgctcatacgtacggctgctggaggccgcgatgaccctgccgatgttccctcccggcttcctctggggagcctccgcctccgccttccagaccgagggggcggtggacgcggacggcaagggcccctccggctgggacgccttcgccgcgctgcccggccggatcaaggacggcaccgacaccacccggggcaccggcttccacgcccgctaccgcgaggacgtcgccctgctggccggactcggcgccgacgccttccggttctccgtcagctggccccgcgtggtgcccggcggcagcggagccgtcaacgccgacgggctcgacttctacgaccggctcgtcgacgagctctgcgcccacggcatcacccccgccccgaccctctaccactgggacaccccactcccgctggaggaggcgggcggctggctcgaccgggacaccgcctaccgcttcgccgagtacgcgggcatcgtcgtcctgtgcgcgctgaccaccgtcctgttcctcggcggctggcacggcccgttcggcgccgacgggctcggctggctgtggaccgtcctcaagaccgccctcctcgcgttcgtcgtcatctggctgcgcgtcagctacccgcgcctgcgtgaggaccagttgcagaagctcgcctggaccaccctcgtcccgctcgccctcgcgcagatcgcgctcaccggcatcgtgaaggtggcgatcaactgatgcccccgatccccggatcaggcctggccaaaggccttgccgtcaccctgcgcacgatgacgaggaagaccgtcaccgcgcagtacccggacacccagcccgaacttccgccccgctcccgcggcgtcatcgggctgttcgaggagaactgcacggtctgcatgctctgcgcccgtgagtgccccgactggtgcatctacatcgactcccacaaggagacgtcgccgcccgccgctcccggcggccgtgagcgcagccggaacgtcctcgaccgcttcgccatcgacttctccctctgcatgtactgcggtatctgcatcgaggtgtgccccttcgacgcgctgttctggtcccccgagttcgagtacgcggagacggacatccacgaactcacccacgagcgcgacaagctccgcgagtggatgtggaccgtgccggagccgcccgccctcgaccccggggccgaggagccgaaggagatcgccgccgcccgcaaggccgcggacaagctcgccgcgcaacgcgcacaggcccagcaggaccggacggacgagcagaaccaggacgagaagaaccaggacgagaagaaccaggacgagaagaaccaggacgggaagaaccaggcccacgggaagacccaggccgacgggaagaaccaggccgacgagaagggaggaaccccgtgatgctgctcaacgccaccgccaccgtgggcaccaccgccaccacggccgcaggcgaccaccccggcttcctctccccgtccggcgtcgagatcgccttcctcctcgtcggcctcgccaccctcggcgccgccgtcatcaccgtcacgaccaggcagctggtgcacgccgcgctctggctcgtcgtggcgctcggcggactggccgtggagtacctgctgctcaccgcggagttcatcgcctgggtccaggtactgatctacgtcggttccgtcgtggtcctcctcctcttcggcctgatgctcacccgggcccccattggccgctccccggacgccgattcggacaatcggtgggtcgccctcggggtggccgccgccgcggcggcggccctcgtctgggtcgtggtcgacgccttccgcaccacctggatcgacctcgacgggccggcccagggatccaccgaggtcaccggctccttcctgttccggaactgggtgctgcccttcgaggcgctctccgtcctgctgctcgccgccctcgtcggcgcgatcgtcctgtcccgcaaacgcgacaccgacaccacggtccgccccggcccgaaccgcacggccaagcccgggacggtgaacccggacccgcccgcctcgccctcctctcccggtacacccggcacacccggccaggaggagcagagctgatgcacctcgcctatcccgctgtgctcgcggccctcctcttctgcatcggcctctacggcgtcctcgcccgccgcaacgcgatcctggtcctgatgtccgtcgagctgatgctcaacgccgtcaacctcaacctcgtcgccttcgacgtctggctccgcgacaccctccactccggccaggcactcacgctcttcaccatcgccatcgccgccgccgagatcggcatcggcctcgcgatcgtcctggccgtctaccgcaaccggggcacctccgacatcgaccggctccgcgacaccgccgagaccgacgacgccgagacgctccccgacaccgccgggaccgacaccgccgacatcgacggcacggagccgacccccggccgggcggacgagaaaacagggaagacgaagaaggcagaggccaccacgtgaccaccacgaccctcgccgccctcgtccccctcctccccttcctcggtgccctcgccgggctcgccgtcggccgcgtcgcccccggcttcgtccgcccgctggcgatcctcccgaccctcaccgcggccgtactcgccgtgatcgtcgccgtccgccagggcggcggccgggccatcgacgccgcgacccagctcacgcccaccggctcggtcccgatcgacctggccctgcacctcgacggcttcgccgttctggtcgccgttctcgtcaccgtcgtcgccacctgcgtacagctctactccaccgcctacctccgcgacgacgcccgctacccctcctacgccgccctcgtctccctcttcacttccgcgatgctcctggtcgtctactccggcgacctgatggtgctcctggtcggctgggagatcatgggcatctgctcgtacttcctcgtcggccactactgggagacgcccgaggcccgagccgcctccctcaaggccttcctggtcaccaagctcggcgacgtaccgttcctgatcggtctgttcgcgctcgccgccgacaccggcagcttccggatcaccaagatcctcgccgccgtcggcaccggcggactcgaccaccccaccgtcatcgccctgctgctcctcgcgggcgtcgcgggcaagtcggcccaattccccctgcacacctggctgcccgacgccatggccggccccacccccgtctccgcgctcatccacgccgcgacgatggtcgccgccggcatctacttcgtggcccgtctgctgcccgtcttcgcggcctccggcgcggcgctcgtcgtcctcgccgtgatggccgccgtgacgatgatcgggtccgggctcgccgccctcgcccaggacgacatcaaacgcgtcctcgcctactcgaccatcggccagctcggctacatgtcgggcgccctggcagtcggcgaccggggcgcggcggtcttccacctgatctcgcacggtgcgttcaaagcggtcctcttcctcgccgcgggcgtcgtcatccacgccgcgggcaccaactcgctcgccgccatgtcccggatgaggggcctcgcccgccgtatcccggacgccttctggacgatgaccgtcgcgctcctcgcgctggccgccatcccgccgttcgccggcttcttctccaaggaagccgtcctcgtcgccgccgagcacaccgccctcggggaccggagcgtcgccccggccgccgcgggatggacgatcctgatcgccgggctcctcgccgccgtcctgaccgccgcctacgccgtacgcctctggctcctcgccttccgcgggcgcggcgcggaggcccccgaccacggcaggcagcccgccgccatgacctccgtcctgtggatcctggccgtccccaccatcggcttcggcgtcaccgtcggcatgatcggcgactggttcgacgggcacgacctcacgccgtccctcaccaccgccgtcctctccaccggcgtcacactcgtcggcggtctcgtcacctacggcgcgtggcggcacaccaccgccctcgccgcccgcacccccatcggcgc

SEQ ID NO: 2776 - DNA, 6308 bp, Unknown
  Kingdom: Bacteria, Phylum: Actinobacteria, Class: Actinobacteria, Order: Streptomycetales, Family: Streptomycetaceae, Genus: Streptomyces
cgacgcactggccgcctcggcagcccgtcaggatccggccacccccgaggcggccagtgcgtcgagcgctgcccgggccaggagcagccggtccagggtggtgcggtcggcggtcggagccggggcgggtccgaggtgtccgcgtaccggagggctgttcagccagacggccaggccggccgcggagtccagcaggtcgtgcgggccgctcccgtcgatccaccgggtgttgagcaggtcgagggcaagcggctcgccggtcagcggccggggatccgtcctggggtgatgggacacgactgggctccttccgtcctgcgggagggggtggctgacccttcgatcttaaccagccaaacgaagatcaccggttgacccggtctgctctaacctgcaaaatcactgtcaatggttacgagatcgcctcgcgaccctgacaagaagagtgggatcgatcatgggtaaggccaagaaccttcagacgggccacgtcggcctcaacgtcaccgacctggggcgttcggccgccttctaccgcgaggtcttcgacttcgaggtgctggccgaaggcaaggacgccgatcggcgctgggccttcctggggcgcgactcccggctcgtggtgaccctgtggcagcagagcgacggcacgttcgcgacggccctccccggtctccaccacctctcgttccaggtggactccgtcgaggaggtccgggccaccgaggaggtcctgcgcgggctgggcgctgagttcgtccacgacggcgtcgtgccgcacggcgagagcggcgcctcgggcggcatcttcttcaccgaccccgacggcatccgcctggaggtctacgcgccgaccggggccgacccggcggacgcccctaccgccggtgctcccacctgcggcttcttctaggcgttcaggcatccaggcaacggcagaagggcaggtgcggggcgatgagcggatatcaccggggtgagctcgccgtgcaggagcgggcgggtctcgcctcgcgggcggcgagtgcggggcgggccatccgctccgacatccccgaggtggcggcggacttcctcgtccggcagcccttcctggtggtgggcggcgcggacgagcgggggcggatctgggcgacccagctcacgggagaaccgggattcctgagcgttcccgcgccggacaccctgatcatcgaggcactgccgctccccgacgacccgctggccggtctgctgtccggtgccggcacgggtgacgcccctcccgcccggatcggcatgatcggcatcgaaccggcgacccgacgccggatgcggatgaacggccgggcggtccgtgacggggacgcactccgcgtcgacctcgaccaggcggtcgccaactgccccaagtacatccaggtgcgccacccccgcggaccgtctccggacgacgacggcggaggagagggcgccggagcgcgggcccgggccgtggacggtgacgccctgagtcccgcgcagcaggaggcgctgcggaccgccgacaccttcttcgtcgccaccgcgtccgaccggggcgacgccgacgcctcgcaccggggtggcaacccgggcttcgtccaggtgctcacacctcgcctgctgcgctggcccgactatgcgggcaacggcatgttcctgaccctgggcaacctcgaactcaacccggccgccggtcttctcgtgcccgactggcgcaccgggtcctccctccacctgaccggcctcgcccgcacggtctgggacggggacgcggtggcgcggatcccgggcgcgcagcgcctcgtggagttcgaggtcaccgcagtacgggagatcgccgccgcctccccgctgcgctggtcggaacccgccttccaccgcttcaaccccccggtggccgaacagctccagggggtgttgcgacagtagcgccgtccgcccggagggccgccgagcaggcgggactttcggaacacgccttagcgcccccggtactccggcgaccggcgctcgacgaaggacgccacgccctcgttggcatcgcgcgaggtcatgttgatctcctgggcggcggcctccgccgcgaacgccgtggcccggtcgccgtccagcgaggcgttcaccagctgcttggccagggcgagggcccgggtgggaccggccgccagccggcccgcccactccttggccagggcctccagctcctcgtccgtgatggcgggcgagatctccaggcgggcccggaccttgcccttgatctggacgacgcaggtgacggtctcgtccacgacgtacgccggatccgccaccgggaagtcctggtgcacgaccgactcggtgtgacccagacgccgccacagctcctccgcgatgtgcggggccaggggagcgatcagcaggaccagacgctcggcgacggagcgcgacagcgggccgccggccttcgtcaggtggttgttcagctcggtgaccttggcgatggcggtgttgaaccgcatccccgccatgtcctggccgaccccgtcgatggccttgtgcagggcgcgcagcgtgtcctcgccgggctccgtgtccacgacggtgatctcaccggtctcctcgtcgaccacattgcgccacaggcgctgcagcagccggtactggccgaccacggcccgggtgtcccaggggcgcgatacgtccagggggcccatcgccatctcgtacaggcgcagggtgtccgcaccgtactcggcgcagatctcgtccggcgtgaccgcgttcttcagggacttgcccatcttgcccaggacgcggctgaccttctcgccctcgtagtagaacgcgccgtcgcgctcctccacctctgcggcggggacggcgatgccccggctgtcgcggtagacgaaggcctggatcatgccctggttgtacagcttgtggaacggctcggcggaggagatgtggcccaggtcgtgcagcaccttggaccagaagcgcgcgtacagcaggtgcagcacggcgtgctcggcgccgccgacgtacaggtcgacaccgccggtgggccggccctcgctcgggcccatccagtactgctcgatcgccgggtcgaccagctgccggccgttgttcgggtccaggtagcgcagctcgtaccagcaggagccggcccagttgggcatggtgttggtctcgcggcggtacttccggggaccggcgccgtcgcccaggtccagcgtgacgttgacccagtcggcgttgcgcgacagcggggtctcgggctgggcggtcgcgtcctccgggtcgaaggtgcgcggggagtagtcctcgacttcgggcagctccagcggcagcatcgactcgggcagcgggtgggcgatgccgtcctcgtcgtacacgatcgggaacggctcaccccagtagcgctgccggctgaacagccagtcgcgcagtcggaagttgacggtgccctcgccgacgccgtgctccttcagccagtcggtgatcctcgccttggcctcgacgacgcccaggccgtccagcgagatctcctcgttcgcggagttgaccagcttcgcgtcgtacgaactgaaggcgtcgtcccacgtggaggggtcggttccgcggtcgtccgacggctggacgacacagcgcatcggcagctcgaaggcgcgcgcgaacgcgaagtcgcgtgcgtcgtgcgccggtacggccatgatcgcgccggtgccgtagcccatcaggacgtagtcggcgatgaagacggggaccttctcaccgctgaccgggttggtcgcgtacgcgccggtgaagacgccggtcttgtccttggcctcggcctgccgctcgacgtcggacttggcggcggcctgcttgcggtacgcggtgacggcctcggccgggctcgcgtggccgccggtccacaccgggtgggtgccctcgggccaggcagccgggatgatccgctcgaccatgtcgtgctcgggcgccagcaccatgtacgtcgcgccgaacagggtgtcctggcgggtggtgaagacggtgatgccgccggcggtgtccaccgggaactcgacccgggcgccctcggagcgtccgatccagttgcgctgctgcagcttgatggcctcgggccagtccagcccgtccaggtcgttcagcagccggtcggcgtaggaggtgatgcgcatgttccactggcgcagcttggccttgaagacggggaagttgccgcgctcggagcgaccgtcggcggtgacctcctcgttggccaggacggtgcccaggccgggcgaccagttcaccggggcgtcggaggcgtacgccaggcggtactcgctcagcaggtcggcgcgctcggtggcgctcagcgcgctccactcacggccgtcgggggtcgcccgcgcgccgctctcgaactgctcgaccagctcggcgatcgggcgggcccggtcggcctcggtgtcgtaccaggagttgaagatctgcaggaagatccactgcgtccacttgtagtactcggcctcgatcgtcgcgaaggagcggcggttgtcgtggcccagacccagccggcgcagctgggccttcatgttcaccatgttggcctcggtggagacccgggggtgggtgcccgtctggacggcgtactgctcggcgggcaggccgaaggcgtcgaaacccagggtgtgcagcacgttgtggccgctcatccgctggtggcgggcgtagacatcggtggcgatgtagcccagcgggtgtccgacgtgcaggcccgcacccgaggggtacgggaacatgtccatgatgaacttcttcggcttggcggccagctccgggtcgcccgccaggtcaccggtggggttcggcgcctcgtaggtcccctcggcgtcccagaagtcctgccagcgtgcctcgatgtcggcggccatcgccgccgtgtagcggtgcggcgcggccgtctcggctgcggaattcgtctcgctcatgatcctcaaagctccatcgatcgtcatctgccgggaaacgaaaaatcccctcgcacaggaggggacgccgcgctgactgcgaccaggcgttctcaccggtcgggactgttcagcgcggctcgctaagcagaaggcgtacggcacgcatggcgtcagggtaccgcacgggcccggaagggagcagggagtaaccagagagcggacatcccgcgcgcgagccggaaccctgccgaccactcgtcgctctccgtagccggaacgcgacgcttccgtgggtgcgcggtgtgcgttcggcgaccttccggtgcgctttccatgaagttccgaggcggatcctggggcgtctcccgaggcggagggaacgcccgggaagcggggttactccgcgtaccgacctctttcggggcaaccgagcaaagcccgtactggttggtatggggcgtcctagcatgcggcaacgggaccgctttgccgaactattcggagtcgccccccatgaaccctcatcgcaagatccgcgtatccaccggcatgagccccggaatgagtcggccggtacagggcggcctgactgtcgccgcgttggttttcgtccctctgctcgccgtcgcggggagcgacgggctgcgcgccaccctcgatttcaccaccggcgtcctgtcgctggtggcgctcagcgccgccgtcgcctggggcctgctggccaccgaccggttgttcctctccacccgtcagcgcatcgtctgccagggcgtccaccgggccaccgccgtggcctcgctcggcttcctgctgctgcacggaaccgtgaaggtggctctcgggcatgtgtccctgatcggcgccctcatacccttcggcctcggcgtcgcgggaacagccggactgatcgggttcggctcgttggccgggctgctgatggttctcaccgccgcgaccggcgccctgcgcagcgccttcgcgcagccctcccccgcggccacccggctcgggcagtcgctggggtccccccgggacacgggcggaatcgcgggtcggtggcgctccctgcacgcgctggcgtatccggcctggtgcgccgcgctgatccacggcctgtacgccggacgcgcgcccgccacctgggtgatcgtgatgtacggcctctgcctcgccggtgtcgccggcgcgctgtgcctgcggctgctgccgcgcccgacgaagcggcggatcgccgaccggatcgccgaactgctgggccaagggcccccggccacccccgatccggtcctgcggaagtcctccgcttccggcgggaagccctggtccgacccggccgccgggagcgaaccggaccgcgac

SEQ ID NO: 2777 - DNA, 1597 bp, Unknown
  Kingdom: Bacteria, Phylum: Actinobacteria, Class: Actinobacteria, Order: Streptomycetales, Family: Streptomycetaceae, Genus: Streptomyces
cgttcacacgggggtccggcggcgcgccgcttccgctgccggacgcgttcccggggccgccgcgtcccgatgacctcgcagggcgcggacaccggtccgccgcaccggtgaccgtggcccgatccctgcgaaccatgccctccgggccactcgtcacgaagtgcgcgggccgggaagctggtccacgtgacagaaaccgtcgaaaacgccgcgcgggtcgaccggcgcccgccccgtgagaagcgccgacgtccccgcgtccaccgggcgtggatcgtcgccgccgtcaccttcgtgacgatcatcggcggtgcggcgttcaactccctgcccggactgctcatcgacccgctccacaccgagttcggctggtcccggggcgagatcgggctcgcggtctccatcgacatggcgctgtacgggctgaccgcgccgttcgccgccgcgctgatggaccgcttcggcatccggcgggtcgtggcgatcgcgctcaccatggtggcggccggggcgatcgccagtgtctggatgaccgcctcctggcagctgatgatctactgggggctgctcgtcggcctcggcaccggatccatggcgatggccttcgcggcgaccgtcaccaaccgctggttcgtggcccgtcggggcctggtcaccggcatcctcaccgcggcgggggcctccggacagctcgtcttcctgccgctctgcgcctggatcgtcgacgaacacggctggcggcccgcgtcggtcaccgtcgccctggcgtccctcgtcgtcgtcccgttcgtctggctcctgatgcgcgaccacccggccgacgtggggctcgctccgtacggcggcacgtatctggcgaagcccgcgccggagcggggtgccgcgcgccggacggtgcgcgtgctgttcgacgcggcccgcaccggcccgttctggctgctggcgggcgcgttcgcgatctgcggggcctccaccaacggtctgatccgcacccacttcgtcccgttcgcccacgacaaccacatgcccatcaccgtggcggcctcgctgctcgcggtgatcggggtgttcgacgtcatcggcacgatcttctccggctggctcaccgaccgtttcgacgcccgcaggctgctcgccgtctactacgcgctgcgcgggatctccctgctgttcctgccgatgctgatcggccccgatgtgcagccgccgatgatcttcttcatcgtgttctacgggctggactgggtcgccacggtcccgccgacgctggcgctctgccgcgagcagtacggcgaggacagcgcgatcgtcttcggctgggtgctggcctcgcaccaggtgggcgcggcggtggtggcgttcctcggcggggtcgcgcgggatgtgttcggcacctacgacgtggtctggtacgcggcgggggcgctgtgcgcgatggcggcgctgatgtccctggtgatccgccggcgtcgcactccggaggaggtcgcggaccaggtgccggacggggtgcggccggtggaggcgggcgggctcagcggctgaaccggccgaacgcaccccggtggaacagcagcggctccccctcgtccgccgc

SEQ ID NO: 2778 - DNA, 22401 bp, Unknown
  Kingdom: Bacteria, Phylum: Actinobacteria, Class: Actinobacteria, Order: Streptomycetales, Family: Streptomycetaceae, Genus: Streptomyces
cggcgcgagctggaggtgctggggtgcctgggcgagggtctgtcgaacgcggagatcgcgctgcgcctctcgatggccgaggccacggtgaagacccacgtcagcagggtgctgggcaagctggagctgcgcagccgggttcaggcggccgtcctggcgcaggagttggggattcgagctacctcctgatctttggtccagacctcttgacgattggtccagaccttcctactgtcaccgtcacacactgcggtgagtacaagagcacccgtactcagggcggcgcagggtttgcagtccacgaatcacccccgtttgttggacctcacccgaggagcaccgttgagcactgataccccccaacgccgatccagattcagatggatccccgtccggagcggccggtccaaggtcgtcgcgggcctgacggcgctggtcgtgccgctggccgcgatggtggggctcgccacccccgcctcggcagccgcgtcggccaccgccacctacaccaagaagtcggactggggcagcggcttcgagggccagtggacggtgaagaacaccggcaccaccgcgctgtcctcctggaccatcgagtgggacttcccctcgggcacctcggccggctccgcctgggacgccaccctcaccagcagcggcggccactacaccgccaagaacctctcctggaacgggtccgtggcgcccggcgccagcgtcagcttcggcttcaacggcaccggctccggctcccccacgggctgcaagctgaacggtgcctcctgtgacggcggccccaccgtccccggcgacaacccgcccacggcccccggagccccggcgaccagcgacgtcaccgacacctcggtcaagctcagctggagcgcggcgaccgacgacaagggcgtcaagaactacgacgtcctgcgggacggcgcgaaggtcgccacggtcaccggcaccacgtacaccaacaccggcctgaccgcgggcaccgactactcctacgccgtgcaggcccgggacaccgccgaccagaccggcccggtctccggcgccgtctccgtgcgcaccacgggcggcggtggcgagcagcccggcggcgacaaggtcaacctgggctacttcaccaactggggcgtctacgggcgcaactaccacgtcaagaacctggtgacgtccggttccgccgcgaagatcacgcacatcaactacgccttcggcaacgtgcagaacggcaagtgcaccatcggcgactcgtacgccgactacgacaaggcgtacaccgccgaccagtccgtcgacggcgtcgccgacacctgggaccagcccctgcgcggcaacttcaaccagctgcgcaagctgaaggccaagtacccgcacatcaaggtcctctggtcgttcggcggctggacctggtccggcggcttcccccaggccgtgcagaaccccgccgccttcgcccagtcctgctacgacctggtcgaggacccccgctgggccgatgtcttcgacggcatcgacctcgactgggagtaccccaacgcctgtggtctgacctgcgacaccagcggccccgccgcgctgaagaacatggccgacgccatgcgggcgaagttcggcccgaagaacctggtcaccgccgccatcaccgcggacggctccaacggcggcaagatcgacgcggccgactacggcggcgcctcccagtccttcgactggtacaacgtgatgacgtacgacttcttcggcgcctgggcggccaagggcccgacggccccgcactcgccgctgaccccgtacaccggcatcccgcaggcgggcttctcctcctccgaggccatcgccaagctgaaggccaagggcgtcccggccaagaagctccttctcggcatcggcttctacggccgcggctggaccggcgtcacccagtccgcgcccggcggcacggcgaccggcgcggccccgggcacgtacgagacgggcatcgaggactacaaggtcctgaagaacacctgcccggccaccggcaccatcgccggtacggcctacgcgcactgcggcaccaactggtggagctacgacaccccggcgaccatcggaaccaagatgacctgggcgaagaaccagggcctgggtggcgccttcttctgggagttctccggtgacaccagcaacggtgaactggtgaacgcgatcaagaccggcctccagtaagcaccacggtgctccccacgccgtaacggcaagcaccaccccggaaaagcaccggggagacgggtccgccccccgtctccccggtttttcgctgtgtgcgcatacgttctccgcgcatacgcgctccgctgcgcgacgtacgcgttgggcgccgtcctcaggctctacgcgacgttcacccgctggccgggcggcgccgcctccagccaggcgaggaagccggtcagggcgtcctcgctcatcgccagctccaggcgcgtcccgcggtggagacagccgagcacgacggagtcggacaggagcgcgagctcctcctcgccttccggcagccggcgggcgatcacctcgatcgcagaacgctccaggccccggcgggggcgaggagcgtaggagaagacccggaaccagtcgacgcggtcaccgctgtagcgggcgaccccgtacacccagcccttgccgagggcgtccggttcctcggacacgtcccagcgcaggctgcagtcgaaggtccctccggaccgctggatcagcctccggcgcaggccgaagacgaacagtcccaacaggaccgtgacgacgacggacgcgcccacccacaacgcgaggaccatctccaccgacctcctcgcatcgtcgagtaacgaacaccgaaaccgtattgcacctgcatcgcctcagccgcgacacggctggatcgctccagctcgggccgcggctgagtaaagacatctgtcagtgggggtgctagcgcaccgccaccgcacgcagtcgtacgtcggcgcgccgctgggcagcggcgtccgcgtccgacttcgcgagttccagcgcccgctcggcgcgctcgacatcgatctcgtcggccagctcggcgatctcggccagcagcgacagcttgtcgtccgcgaacgagatgaatccaccgtgcacggcggcgatgacggtgccgccctcactcgtgcggatcgtcaccgggcccgattccagcacaccgagaagcggctggtgaccgggcatgacgccgatgtcgccggacgtggtgcgcgcgacgaccagggtggcctcgccggaccagacacttcggtcggcggcgaccagctcgacatgcagctcagcagccaagggtggctcctcgggtcaccacccggccgcccggccgggtgtcggttcaattctacggggcgtggtgaggggggcgggacacacccacccccctcggtgagccggaggctcaggagacgccgagctccttggccttggccttgaggtcgtcgaggccaccgcacatgaagaacgcctgctcggggaagtggtcgtagtccccgtcgcagatcgcgttgaacgcggagatcgactcgtcgagcggaacgtccgaaccgtccaggccggtgaactgcttggcggcgtgggtgttctgcgacaggaagcgctcgacgcgacgggcacggtggacaacgagcttgtcctcctcgcccagctcgtcgataccgaggatcgcgatgatgtcctggaggtccttgtacttctgcaggatccccttgacgcggctggccgcggcgtagtggtcctgcgagatgtaacgcgggtccagaatgcgggacgtggagtccagcgggtccacggccgggtagatgcccttctcggagatcggacgggagagaaccgtcgtcgcgtcgaggtgggcgaacgtggtggccggggccgggtcggtcaggtcgtccgcggggacgtagatcgcctgcatcgaggtgatcgagtgaccacgcgtcgaggtgatgcgctcctggagcacacccatctcgtcggccagggtcggctggtaacccactgcggacggcatgcggccgagcagcgtggagacctcggagccggcctgcgtgaagcggaagatgttgtcgatgaagagcagcacgtcctgcttctgcacatcgcggaagtactccgccatggtcagggcggacagggccacgcgcagacgcgtccccggcggctcgtccatctggccgaagacgagcgcggtcttctccagaacgcccgactcggtcatctcgtcgatgaggtcgttgccctcacgggtgcgctcaccgacaccggcgaacaccgacacaccgtcgtgcagcttcgccacacgcatgatcatttcctggatgaggaccgtcttgccgacgcccgcaccaccgaacagaccgatcttgccgcccttgacgtacggggtcagcaggtcgacgaccttcaggccggtctcgaacatctcggtcttcgactcgagctggtcgaaggccggggccttgcggtggatcggccagcgctcggtgatctgcgcctcggcctccggctcgttcaggatctgaccgagggtgttgaacaccttgcccttggtgatgtcaccgacggggacggtgatgcccgcacccgtgttggtcaccgcggcctggcggaccaggccgtcggtgggctgcatcgagatcgcgcggaccacgccgtcacccaggtgctgggcgacctcgagggtcagcgtcttgcgggcgccgtcctcggccgggtcggcgacctcgacgtggagggcgttgtagatctccggcatcgcgtcgacggggaactccacgtcgacgaccgggccgatgacccgggcgacgcggcccgtggcagcggccgtctcaactgtcgtcgtcattacttgtcactccccgcggtcgcgtcggccagagcactggcaccgccgacgatctcgctgatttcctgggtgatttcggcctgtcgggccgcgttggcaagccgggacaggctcttgatgaggtctccggcgttgtcggtggccgacttcatcgcccggcggcgggcggcgtgctcggaagctgccgcctgcagcagtgcgttgtagatacggctctcgacgtagcgcggcagaagggcgtcgaggacgtcctcggccgacggctcgaactcgaacagcggaaggatctcacccttgcgggtgctctcctcggccacctcgtcgagcgaaagcggcagcatccggtcgtcgaccgcgttctgcgtcatcatcgacacgaattccgtgaagacgatgtgcagctcgtcgacgccgccctcggccgtttccttccggatggcctcgatcaacggggccgcgatgcgcttggcatcgccgtacgccgggttgtcggtgaagccggtccaggagtcctcgaccttgcgctcgcggaagccgtagtacgcgacacccttacggccgacgatgtacgtgtcgacctccttgccctcggaggcaaggcgctcccgcagtcgctccgcggccttgatggcgttggaggagtagccgccggccagaccgcggtcgctcgtgacgagcaggaccgcggcccgggtcggggcttcgacctcggtggtgagcgggtgcttggcgttggagccggtcgccaccgcggtcaccgcacgggtgagctcggtcgcgtacggcttggacgccgccaccttgcgctgtgccttgacgatgcgcgaggcggcgatcatctccatcgccttggtgatcttcttggtcgcggtgacggcttggatgcggcgcttgtaaacgcgaagctgagcgcccatcgatcagccctcgcccaggagcttgccgtccgaggtctcgaactgctgcttgaaggcggcgatcgcgtcggcgatcgactgcagcgtgtcgtcggacatcttgccgccctcggcgatgctggtcaggaggtccttgcgctcacggcgcaggtactccagcagctcggcctcgaagcgacggatgtcctcgaccgggacgtcgtccatcttgcccgtggtgccggcccagaccgagacgacctgctcctccatcgggaacggggcgtactgcggctgcttcagcagctcgaccatgcgcttaccgcgctccagcgaggccttcgaggccgcgtccaggtcggaaccgaaggcggcgaaggcctccagctcgcggtactgggcgaggtccacgcgaagccggccggagacctgcttcatggccttgtgctgggcggagccaccgactcgggagaccgagataccgacgttgagcgccggacgctgacccgcgttgaacaggtcggactccaggaagcactggccgtcggtgatggagatgacgttggtcgggatgaacgccgacacgtcgttcgccttggtctcgacgatcgggagacccgtcatcgaaccggcgcccatctcgtcggagagcttggcgcagcgctccagcagacgcgagtgcaggtagaagacgtcacccgggtaggcctcgcggcccggcgggcggcgcagcagcagggacacggcgcggtaggcgtcggcctgcttcgagaggtcgtcgaagatgatcaggacgtgcttgccgtcgtacatccagtgctggccgatggccgaaccggtgtacggcgccaggtacttgaagccggccgggtcggacgccggggcggcgacgatggtcgtgtactccagcgcaccggcctcttcgagcgcaccacgcacggaggcgatggtggaacccttctgaccgatggcgacgtagatgcagcgcacctgcttgttcacgtcgcccgagcgccagttgtcgcgctggttgatgatcgtgtcgacggccagagcggtcttacccgtctgacggtcgccgatgatcagctgacgctggccgcggccgatcggcaccatggcgtcgacggccttgtagccggtctgcatcggctcgtgaaccgacttgcggaccatgacgccaggggcctgcagctcgagggcgcggcggctgtcggtcgcgatctcgccgagaccgtcgatcgggttgccgagcgggtcgacgacgcggccgaggtaaccctcgccgacgcctacggagagcacctcaccggtgcgctgcaccggctggccctcctcgatgccgctgaactcgccgaggacgatcgcaccgatctcgcgctcctcgaggttgagggcgagaccgagggtgccgtcctcgaacttcagcagctcgttcgccatggcggagggaagaccctccaccttcgcgatgccgtcgccggcaacgctgaccgtaccgacctcctcgcgcgaggccgcgtccggctggtacgactggacaaagttatccagtgcgtcccggatctcctccggccggatcgtgagctccgccatctgggttccctgctctccttgttgggcccgaagtttcttaagggggtctgggggccgacccccaggaatcttctgcaatttctgcacggcccaaccgggccgctggtcttgcttgttcttgctctgtgtcagccggccatgcgtcgggtcgcctcttcgaggcgctccgcgacggtgccgttgatgatctcgtcaccgacgcgcaccgagatcccgccgaggaccgcggggtccacgtccaggttcaggtgcatctgccggccgtagagcttcgccagggcgtcgccgaggcgccgcttctgccggtcgctgagcggcaccgccgaggtgacgacggcgaccatgcggtcccggcgctccgcggcgagcttggacagcgactccagtcctgcttccaggctacgtccacggggctgggtgaccaggcggacgatgatccgctcggtgaccggctgcgccttgccgccgagcaggctgcgcagcagctcgcccttggcggacgccgtggccgtacggctggtgagcgcggagcgcagctccttgtcggagccgacgatccggccgaaccggaacagctcgtcctcgacgtcgtcgaggttgccgccgcgctgggccgcggtgagatctgcggtgttcgccagctcctcgaccgagtccaccaggtcacgggactgcgaccaacgggaccggaccaggccggagaccaggtcgacggtctcgccgcccacctgcccgccgagcaggcgcgcaacgagctcggccttgctctcgccgctctgggccgggtcggtgaggacccggcgcagggatacttcgcggtcgagcagcgcggtgaccgatgccaggtcctcggcgagcttcgccgcgtcgaccgtcgtgttgtcggtcagcgcgtcgagacgctcgcgtgcggcagccagtgcttcgcggctcgcgccgttcatcgggctgcctcggccttcgcctcgagctcgtcgaggaaacggtcgacggtgccgctctgccgggcgtgatcctggagggactcgccgacgagcttgccggccaggtcggtggcgagcttgcccacgtcctgacgcagcgccgaggcagcggccttgcggtcggcctcgatctgggtgtggccggcggcgatgatctcttcgcgctgccgctgaccttccgccttcatctcctggatgatgacggcaccctgctcctgcgcctcctggcgcaggcgagcggcctcgtggcgggcttcggcgagctgagccttgtactgctcaagaacgctctgggcctcggtctgagccgcttcggccttctcgatgccaccttcgatcgcctcgcgacgctcgtccaaggccgtgttgatggccgggaggagcttcttgtagaagacgaagaagacaatgctgaagcagatcaggccgatgacaatctcgggccagaccggaaacagcggtgactgcggctcctcagctgccagatgcaacatggtggacctttcgtcgaaaacgtatcgtcaggtcgccaggactacttcgggtagatgaagggcgcgacgaagccgatcagggccagggcctcgatgaccgcgaagccgagcagcatgttctggcggatgaggccggccgcctcgggctggcgggcgatggcctgcacgccgttaccgaagatgatgccgatgccgacgccggggccgatcgccgcgaggccgtaaccgatggtgccgatgttgcccgtgacggctgcgagagtctcagacattgatctgtgattccttctcttgattggccggtggagattgcatccaccggacgtctagggggtgtccgggtggtggcccgggtgtcctcagtgcgcttcttcgagcgcctgggacaagtacgtggcggtcagcacggtgaacacgtacgcctggagcgcctggatgaacatctcgaagacggtcagggcgagcgtcacggcgaacgacgcggtggcgtacaccgtgccgagcacggtgccgagcatgtaccacgtcgcgatcgtgaagaccagaatgaggatgtgacccgcgaacatgttcgcgaagagtcggaccgccagcgtgaagggtcgcacgaagatgttcgagacgaactcgatcggcgtcaggatcacgtagatcggcttgggcaggccgctcggcacgcacaggttgcggataccgcccacgaagccgttgttccggaacgtcaccgacatgtagacgacccagaccagcagcgccagtccgaccgggtaggcgatgagcgagctcacggggaactgcgcgagcgggatgatcgcccagaggttcatcatccagacgaagaagaacagcgacaccagcagcgggacgaaaggctcgcccttcttgccgatgatctccttggcgatgccccggtgcacgaagtcataaagcgtttcggcgaccatctgcagcttgcccggaacgaccttgggcttggagaagcccatccagaacagggtcaggatcgcaatcgttccgatgatcgccagcagcatcggcttgttgaactcgaccggaccgatcgtgaagatcgggtcgaagatgaacgaccacgcgctcggggctgggaatccgcacgagccctggaacaggtggcagtcaacctcgaaggcgagcgtctgggcgtcagcagtcaccaggagctccttctgcatggcgcatggatacggctacctcgttgtatcggagcggctggcagccgcaggtcggcaccggactggttcttacggtgaggaggcggcggccgggcccgaagcctcgcgatgaatcaggcgacagccgtgttgtccgcgcccgcgataccgcaaccgagaccggacgatagcagcatgtcgaacagggctttatcccggccctactggtcatgcttcccctcggttccgcccggggtcttccggctctccgcctccggatcgacgtacagggtcttgctcctggcgtgcagcacggtctgcgtgatgatccacgcgatcaccgaagcgaccagcgtgagggcgaagacctgaagatcgaagagcgacgtgttcctgatgcccatgatgagcacgagcaggagcacgagctggaccgagtagaccagcagccccattccctggaagaggtggggcatggccctggccacccactggagcgccagctgtccgagggccatgaagagaatgaccaccacgcagcccaccacggcaccgatcgccccctcgccgccggcgagcagaccgccgacaagcgtggcgatggctcccactgcggcggtgggggtggcgatgcgcagtagttcgcgcatgtcggactgcatggcggcagctccactggtctgaggggaggaatggggcgtcgtcatggacgagcgtaggcccggtccgcgaggcggattttcgggccaatggaccgtcctgcaagggtccttcggctccgtcaccgggtctcgtgaacggtatcacaaactatttgatgaggtctttacctcaaaggtgtgccaactgtcacacatgagagtcaatccgcgcgtgtgtgcacgacaagacggcgtaatgtctggtaatgcaccgctggttccgaatcgtcagcgcgaggagtcgatcgagcgacgatccgggaaccgagaacgagcgccgatcgcggtagcgccgttgacgccggacaccccgaccgccacgggagcccgttcgacggccccctcgcccatcgacgcgtccgacgggccctgttgggccccggagaccccgggcgccggcttctcgccgcaggaggacgagggaacggactccgcctccgctccacggtggcggtagcgcggcggcacgaagcggttggcccagtgcggggcgcgcggggtgaagcgcggcatcagcagcaggacgagtcccaccgcgctcgccgcgatgatgacgaacacgatccacgaggacgccgagtgcaccgagtagccgacggcgccgaaggcgatgagggccgaccagaagtacatgatcagcacggcccggctgtgcgagtggccgatctccagcagccggtggtgcaggtgcccccggtcggcggcgaacggcgactggccgttccaggtgcgccggacgatggcgaggaccaggtcggcggccgggatcgcgatgatcgtcagcggcagcaccagcgggatgaagaccgggagcagcgcgtgggtggcctcgcgctcgctgccctcgaagatcttcatgaggtccgggtccacctggccggtgatcgagatcgcgcccgccgccagcaccaggccgatcagcatcgagcccgagtcgcccatgaagatccgcgccggatgcatgttgtgcggcaggaagccgaggcacatgcccatcaggatcgccgcgaacagcgtcgcgggggccgccgcctcgatcccgtaccccatccagaggcggtacgcgtacaggaagaacgccgccgacgcgatgcacaccatgcccgccgcgagcccgtccagaccgtcgacgaagttgacggcgttgatcgtgatgacgaccagcgccaccgtgagcagcgtgccctgccactgggtgagggcgaccgtgccgacaccggggatcggcagccacaggatcgtgagcccctggatgaccatgacggcggcggcgatcatctgaccgccgagcttgatcagggcatcgatctcgaacttgtcgtcgagcacgccgatcagccagatcagagcggcgccggagagcaacgccctcggctcgttggagagttcgaagacactcttcagattgaagaggtggtcggcgacgatcagtcccgcacacagtccgccgaacatggcgatcccaccgagccggggtgtcggctcacggtggacgtcgcgcgcacggatcgcgggcatcgccccgaccgcgatggcgaacttacgcaccggtccggtcagcagataggtcaccgctgccgtaacacagagcgtcagcaggtaatcacgcacgggctgccccacagaactcgccggccatccaaaaaccacaccctagtctctgaaacaaggactccacggtacgggtgatggttgcacagggttcgtgtgccccggacagggtggagtccactaccccggatacggcggattgcgcgcggccagttcacggacctccgccgcgatcgggctcacatctcccggctcccgtacggccgcaccgaacagggccgcgatccgggccatgtccccctcgtccatcccctgggtggtgacggcggcggtgcccagccggatgccccgggcgtccccgtgcggcagtgcgcaggtgtccaggaccacaccggccgccgccagccgctcccgggcggtccggccgtcgacgccgagcggggccgggtccgcgacgacgagatgggtgtccgtgccgcccgtggtcacctcgaagccctccgcctccaggccggcggcgagcacccgggcgtgggcgacgacctggtgggcgtagagggtgtacgcgggggtggccgcctccccgaacgccacggccttcgccgccaccgtgtgcatctgcgcgccgccctgggtgaacgggaacaccgcccggtcgatccgctcggccagctccgcgccgcagaggatcatgccgccgcgcggcccgcgcagcaccttgtgcgtggtggcgcagaccacgtcggcgtacgggaccgggttcggcgccgctcccccggcgatcagccccatcgggtgggcggcgtccacgatcagatacgccccggcctcgtcggcgatctcccggaacagctcgtagtcggggtggcgggggtaggagatcgagccgcagacgatcgccttggggcggcgggcgcgggccagggcgcggagccgggtgtagtcgatcagaccggtgtccgggtccaccccgtagccgacgaagtcgaaccagcggccggagaagttgcccggcgccccgtgggtgaggtgtcccccgtacgggagccccatcgcgagcaccgtgtcgcccgggcgcagcagcgcggcgtaggcggcgaggacggccgaggagccggagtgcggctggacgttggcgtgttcggcgccgaagagggcggtggcccggcggaccgcgatgcgttcggcggcgtccgcgtgctcgcagccgccgtggtggcgggcgcccgggtatccctcggcgtacttgttggcgagcggggagccgagggccgcgaggaccgcgggcgaggtgaagttctcggcggcgatcagctggagggtggccgcctgccgttcgctctccgcgaggaggaccccggcgatctcggggtcctcgcggagcagggcgccgaagtcctggggcagggcgtcgggcgcgggcgacacggctgcgggtgcggcgggagaggtgaccggcatgggacggctccgggcctggaggtgggtgcgccggcgaggggtgccggtgtcagctccaatgtaggccggggccgggcgctgtgcccgctgtcgcggggcgccgtacgccggtcggcgcacccggccccggtacggcgcggacacgtcccgtcagtgcggggcgcgtacgccggtgagcgcggtgacgacggggtcgagcgcctggttgatctcgtcgccgatggagcggaagaaggtgatgggggcgccgtaggggtcgtagacctcgtccgcctcggcggtcggggccagcagccagccgcgcagcgcggcggcggcgcgcaccagggcgcgggcgcgctcgacgacgccctcgtcgcgcgcgtcgggcagggtggccgggtctatggcccgcaccagccgggtgaactccttgagcgtgaaggtgcgcaggcccgcggagtggcccatggagatgacctgcgcgcggtggtcgcgggtggcggtgaggaccaggtcggcgcggatcacgtgctcgtccagcagttcccggccgacgaagccgctggcgtccgcgccgaagtcggcgaggacgacctcggcgttggcctccatgggcgcgccctcgtggccccaggtacccgcgctctccacgatgaggccgccgctgagcgggtcgccgagccggtccaccagggcatggcgggtcagccgctcggtgatcggtgagcggcagacgttgccggtgctgacgtggaggatgcggaaggtgtcggtccgccccgctatgccacgcccctcgggggcggtcaattggccacctcgaggtcggggaccaccttgcgcagctcctccgcggagagggcgccggcgcgcagcaggaccggggtggcgccggtgacgtcgacgatcgaggacggcacgatgccgggcgtcgggccgccgtcgaggtagacggagacggagtcgccgagcatgccctgggcggcgtcgcagtcctccggcgcggggtgtccggtgaggttggcgctggagacggccatcgggccgacctcggtcagcagctcgatggcgacggggtgcaggggcatccggatggcgacggtgccccgggtgtcgccgaggtcccactggagggagggctggtgccgggcgacgagggtgagggcgccgggccagaaggcgtcgacgagctcccaggcctcctcggagaagtcggtgaccaggccgtgcagcgtgttcggcgagccgatgaggacgggggtgggcatgttgcggccccggcccttggcgtccagcaggtccgcgacggcctccgaggtgaaggcgtccgcaccgatcccgtacacggtgtcggtgggcagcacgaccagttcgccccggcggacggccgatgcggcctcgcgcaggcccgtggtccggtcggtggcgtcgttgcagtcgtatcgccgagccatcagccggcctcctggagcgggtacgggtacgggtacgggtggtggtgccgggggccggtcacggcatggccttgcgggcggtggcgaaccggggccgcttgttcaggtcggggtggtcggcggcatccgcccagccccgctcctcggtgaagatccacggcacctggccgccctgggtgtcggcgtgctcgatgacgacgaggccgccggggcgcagcagccggtgggcggtgcgttcgatgccgcggatggtgtcgaggccgtcctcgccggagaacagggccatctccgggtcgtggtcgcgggcctcgggggcgacgtactcccactcggtgagcgggatgtacggcgggttggagatgaccaggtcgacctggccgtcgagctccggaagggcgctcagggcgtctcccttgtgcacggtgaccctggacccctcggcgttcttccgggtccacctgagggcgtcctcggacagctccacggcgtgcacccgggagcgggggacctcctgcgccatggcgagcgcgatggcgcccgacccggtgcacaggtcgacgacgacgggctcgacgacgtccatcgcgcgcaccgcgtctatggcccagccgacgacggactcggtctccgggcggggcacgaagacgccgggtccgacctggagctccaggtagcggaagaaggcgcggccggtgatgtgctggagcggttcgcgggcctcgcggcgggcgatcgtctcccagtaccgggcgtcgaagtccgtgtcgggcaccgtgtgcagcgcaccccgcttcaccccgtggacgaaggccgcgagttcctcggcgtcgaatcgcggtgaggggacaccggcgtcggccagccgctgggtggcctgggccacctcggcgagcagcaggttcatcgcggttctccgtacgggttacgggtgtgcgggacgggcgggtcgcttacgcgttggcgagcttggcggcggagtcggcgtcgacgcatgcctggatgacggcgtccagctctccgtcgagcacctggtccaagttgtacgccttgaagccgacgcggtggtccgagatgcggttttccgggaagttgtacgtccggatcttctcggagcggtcgacggtgcggacctggctgcggcgcacgtcggaggcctcctgctcggcggcctcctgggcggctgccagcagccgggagcgcaggatgcgcatggcctgctccttgttctggagctggctcttctcgttctggcaggaggcgacgacgccggtgggcaggtgcgtgatccggacggcggagtcggtcgtgttgacggactggcctccaggacccgaggagcggtagacgtcgatgcgcaggtcgttggcgtggatctcgacgtcgacctcctcggcctcgggggtgacgagcacgcccgcggcggaggtgtggatgcggccctgggactcggtggagggcacgcgctgcacgcggtgcacgccgccctcgtacttcatccgggcccagacgccctggccgggctcggtggcgccgttgccgcccttggtcttcacggcgacctggacgtccttgtagccgccgagctcggactcggtggagtcgatgatctcggtcttccagccgacgcgctcggcgtagcgcaggtacatgcgcagcaggtcgcccgcgaacagggcggactcgtcgccgccggcgcccgccttgatctccaggagcacgtccttgtcgtcgctggggtcgcgcgggacgaggaggaggcggagcttctcggtgagctcgtcgcgctgcttctccaggtccttgacctcggcggcgaagtcggggtcgtccgcggcgtactcgcgcgcggtctcgatgtcctcgccggtctgcttccagttccggtacgtggagacgatcggggtcagctccgcgtagcgcttgttcagcttgcgcgcgttggcctggtcggcgtggaccgacgggtcggcgagcttcttctcaagaccggcgtgttcaccgatcagttcctcgaccgcctcgaacattcgggggctcctggttggttgtgcgtctgcgggcctgcttgggggcgtactgcccggcggggtgtacgccgggggttcccccgtacacccgaccggaaaaaacgccggttccgacgcccccgggaagagggcgccgagaaccggcgcagtggctcgctacttgctggcggagccggcagccttgccgaagcgggcctcgaagcgggccacgcggccgccggtgtcgaggatcttctgcttgcccgtgtagaacgggtggcactcggagcagacgtcggcacggatgttgccgctgtcgatggtgctccgggtggtgaacgacgcaccgcaggtgcagctgacctgcgtctcgacgtactcggggtgaatgtcgcgcttcaaggtgtctcctagtttcgggagggcgccgggtcgtccgcgcggatttgcgcggccgtgaaccggggccgacgtaccagtctgccaggaccggccgtatctcccaaaaccgggggcggagcgcaggtattcccccggtggccgcgcacggagcgtgacggctcgggttactcgacgacctccgcggcgtcgcccttgtcgccggccgacttctcggtggcggaggcggggatcggccggtcgtgtctgagggcggcccagacctgccggccggccttctcctgcggcaggacccggttcgggtcggccgggtcgtactccacgggcagggtcaccatgtggacgttcttcgcgctcagccctttgagaccgcccgcgaaaccggtgagcttcttgacggagccgagcccggagtcggtggtgacggccttggtggcggcgtccgcgaggccgtagagcttggcgggactggtgaacaccccgacgctcttcgtctggtccatcagcgccttgatgaacgcctgctggagctggatgcgcccgaggtcgctgccgtcgccgacgctcttgcgggtacggacgagaccgagggactgctcgccgttcagcgtgtgggtgcccggctccaggtcgaggtggctcttggagtcgtcgatcgcggtcttcgtggtgatctcgacgccgccgagctcgtcgatgagcttcgtgaagccggtgaagtcgacttccagatagtggtccatgcggatgccggacatcgactcgacggtcttcaccgcgcaggcgggcccgccgacctcgtaggcggtgttgaacatcgcccggtgctcggcggggacctggtcgccggtggtgtcgctctcgcaggcggggcgctctatcagggtgtcgcggggtatcgagacgacgctcgcggacttgtggcccttgtcgacgtgcatgaccatcgccgtgtcggagcgggccgcgccctcgtcctcgccgtacttcccgttgtctccggagcgcgagtcggagcccagcaccaggatgtcctgcgagccgtcgtccacgtcgtcgggacggtcggagccgagcttggcgtcgatgtcgatgctggagaggttgccgtcgagcgccaggtacgcgtatccgagtccggccccgccgacgaccacgacaccggccaccgtccaggccgcgacgaccttggcacggtgcctgcgggacggcttcctccgtcggctgccggtgccgcgtatgcggccggtgctcctgttctgctcgctcacgcgtctcctcgtcgctcctgttgcccgtgtgcccccctgccgtggtgttccacgcgcggtcggcctctcctggagggacggccgaagcagcaagaagggttgcatacgcgtctgtggcccccgtcggaggacgggggccacggggcgttcgggcgaacaggccgtgagacggcgttcacctggggtttcgcgctcggtacagcgaggtggcggacggctcgaaagccggggccggtgtggccaaggtctcgggccgggcgggggcggccggggtcagccgaagaggttgtagttgttggctccggtgcccagcagcttgcgggcgccgaagatgccgctgtcggccttgccggtgcccgggtagaggtacagctctccgctcttcacccggacgacgatgtccgcgtggccgtcgccggtgaagtcaccggtggtgaccagggccgtggccacgtcccaggtccggacgaggaccttggccgcgaacggggcgctcgccttgccggtgcccttgaagaggtacagcttgccgccgctgccccgggcgacgatgtcggccttgccgtcgttggtgaagtcgccgctgccccggaccatgctgaagctgaggccgccgccaccgatcctggtccgggcggcgaaggtgccgtctcccttgcccgggtacagccagaagccgccggaggagtcggtcgagagaatgtcggggtggccgtcgctcgtcaggtcgccgggggccaggatctgcttgcgggtaccccagccggtggccaggcgcttggtctgccacgcctcggcagccgagctgtaccactgccagtacaggttgccgtccgtgcctcggacgagcaggtcctggttgtcgtcccggttcagatccgtctgcaggaggacgttgatgtcgccccagccgctgctgtacgtggccttcgacatgccggtgccggtcgaattgaactggtacatcgtcttgttggacgcgttgcgggccatcaggtccgcgcggtggtcccagttcatgttggtgtcgtaggcccgcgccttgatggcgggcacataggtgctcaccttggcgaagacgctgtacgcgccctctccgacacagtccaggacaccccacgacacgatgccggccagcttgccgccgatcaccagcgggccgccggagtcaccgttgcaggcaccgacggtctccgcgtcgctcacgccggtcttacccgcgcagaccatgtggcccgccacgaaggagcttccgtacgaaccccggcacgtcgcgtcggagacgatcgggagcgtcgccgaacgcagggtcgtggagatgtcgtcgttggtggacgtggtgcgaccccagccgtagaccttggcctgggtgcctggcgcgtagaggcccgtgtccgtgttcgccatcaccgggaggggtttggccgcgaccgggtcgaagagggtgagcaccgcgacgtcgttgtcggccgctccctgcacgtccttgtagagcggggtgttccactggcggtagggccaggagacggtgccggtgctgttcggctcggtggaggtgctgccggtgacgacaaccccgttcgcgttccagtcgaagcccttgacgcagtgcgcggccgtggcgatcttcgtgggcgcgatgacgacgccgccgcagaagaagccggtgtcgtcggtctcgtcgcccggggttccttggtcgtcgtggtaccagagctgcgccatccacggggcgctgctgatggaggtctgcgtgccgccgatgaccatcggggcggctgtgcccgggtcgcccgcggcgaacttggcgggcggcagtgccttgcggtccgccacggccgagtcggccacgcgttcgcgcagctccgactccggcggggcgaccggccgttcgggtgcggccgtcggcaaggcgggtgccggttcgccggcctgagacgtggacatcgtcagcgcggtgccgacgagggcgaggacggtgacggccgccgccggaacggcgagtctgagccggcgcgcgtgccggccccccgtggtgcgtatgtgcacgcgtgatccttcggattgggaaccggtggggcacgagagccccgccggtcgggaaacggcgggggtgcccgaactgcccgcagcgcagggcggatcgccgcagggctcacgcctctgccgttccgcctcgatggccccccacctcaactggcccagatattacgtgagcgacaacggaagaggaatgtgcggagaaggaaaaggagaggaaaagggaaccacgaacacggaaaaggactccaccccctcaccgaagtgagggggtggagtccttggagacggcctgtgccggtgtccggtcggtcagtcgttgccgtttccgctgcccggcgtcgtcttctggatctggagcaggaactccgcgttggactgggtcttcttcatccggtccaggaggagctcgatcgcctgctgctggtcgagcgcgtgcagcacccggcgcagcttccagacgaccgccagctcgtcggtgccgagcaggatctcttccttacgggtggaggacgcgtcgacgtccaccgccgggaagatgcgcttgtccgagagcttccggtcgagcttgagctccatgttgccggtgcccttgaactcctcgaagatcacctcgtccatgcgcgagccggtctcgacgagcgcggtggccaggatggtcagcgagccgccgtcctcgatgttgcgcgcggcgccgaagaagcgcttcggggggtagagcgcggtcgagtcgacaccaccggacaggatgcggccggaggccggcgccgcgaggttgtacgcgcggcccaggcgggtgatcgagtcgagcaggacgaccacgtcgtgacccagctcgacgaggcgcttggcgcgctcgatggccagctcggcgacggtggtgtggtcctcggcgggacggtcgaaggtcgaggagatgacctcgcccttcaccgaccgctgcatgtcggtgacctcttccggacgctcgtcgaccaggacgaccatcaggtggcactcggggctgttgaccgtgatcgcgttggcgatggcctgcaggatcatggtcttgccggtcttcggcggggccacgatgagcccgcgctgacccttgccgatcggggccaccaggtcgatgatccgcgtcgtcaggatgttggagtcggtctccagacggagccggtcctgcgggtagagcggggtcagcttctggaactcggggcggccgcggcccgactccggggccatgccgttgaccgagtcgaggcggaccagcgcgttgaacttctcgcgccgctcgccgtccttgggctggcgcaccgcgccggtgacgtggtcgcccttgcgcaggccgttcttgcggacctgggcgagcgagacgtacacgtcgttcgggcccggcaggtagccggaggtccggatgaacgcgtagttgtcgaggatgtccaggatgcccgcgacggggatcaggacgtcgtcgtcggccacctgcacatcgctggcgaagtcgtcgcggccacgacggcca

SEQ ID NO: 2779 - DNA, 4925 bp, Unknown
  Kingdom: Bacteria, Phylum: Actinobacteria, Class: Actinobacteria, Order: Streptomycetales, Family: Streptomycetaceae, Genus: Streptomyces
tcccgggctcatccgcgtacgggtggcggcaggcaggggttcacacctgccggtactcgtccgcccaggcctccaccgcgtccgtggcccgctcgaacgcctcctcgcgcccgaggaagtccgcgttgtggtcggtggtcagcggcggcagcgcctcaccgctctgccggaccacgacgagcgcctggccctggaccgtacgaggcaggcccatccacttcacgggctgctggaccgtccgcaccgcggacgtgccgctccaggccaccgtggtggtccggaagaacgcgacgcgccgcacaccgtgacggctgacccacgcgccgacccgcagcagtcgcagggcggcggcgatcaacgcaccggccagggccagacacacggtcgcgccggaaggcgctccggccacaccgatgatcatggccgcgagcagaacgaacgaggccagcaacaacagggtggccgccgccgcgacccgccacgggccggggcggtagggccgccgccagctgtcgtggtcgtcgaacggcagcgcgacgtcctccgcgctcgcgtcgaatgcgcggtcggccgtcagaaagggcaggggcacgactcatcctcactcacaagcacgctcgattgctgtgcccggtgaggctaccgagggtgccaccggcccgaccaccccagggggtccgtacgagtcagcggccctgcgacgcttcggactgcttgccgtgcgcgggggactgttcggagtcgagagcagggagccccagcagcagtgagcccacgagacctgcgaccacggtaagcccgacgagggaccgccccagcagttcgggaacggtggcacgggccgagggagggggagtgacattactgcggaaccggtcggaatcggcgacgaacgagaacgggacggcttcacgccggcggaacatgaggaaactctccttgatctcagtgacgggtgctgctaatgagtcagacgtacgagagaccggatcggtgcccgaatcgccgtacttgttgggggaactccacgaacggcggccctgaggtcggcgcaggcacgcatgccggtgccccgtaaagtggtcgccgccagagcgacgccattggaaggacccctgtcggtgaccgacactcccgaacccgcaaagccccacttccgcagcgacgtcaccgtcgagctggtgaagagcgacgcgcgcgacgcggacgtgctgttcgccgcccgggtctccaccgccggcgagcagtcgctcgaagaggtcaccaaggaccccgagcgctccaaggggctcatcaactacctcatgcgggaccggcacggcagcccgttcgagcacaactcgatgacgttcttcatcagcgccccgatcttcgtcttccgcgagttcatgcggcaccgcgtcggctggtcgtacaacgaggaatcgggccgctacagggagctggacccggtcttctacgttcccgggacctcccgcaaactggtccagcagggccgtcccggcaagtacgagttcgtcgagggcaccgaggagcagtacgtcctgacgacccgcgccatggaggagtcctaccgggcctcctacgaggcgtaccaggacatgctggccgccggcgtggcccgcgaggtcgcccgcgcggtcctgccggtcggtctcttctccacgatgtacgccacctgcaacgcacgctccctgatgcacttcctcggcctgcgcacccagcacgaactggcgaaggttccgtccttcccgcagcgcgagatcgagatggtcggcgagcagatggaagcccactgggagcagctcatgccgctcactcatgcggccttcaacaaaaatggacgggtagccccgtaggcggtgtccgtattgcggcgtttcgagaagttcatctaggctgatcaaacggacccggcactgcttgaacccccgagcaggcagtgccgggctcctcttccccgtccccccgaggggaccccgcgcgctgagcagcgagtagcgtgttacccatggctccgatctccactccgcagacccccttcgggcgggtcctcaccgctatggtcacgcccttcacggcggacggcgctctcgacctcgacggcgcccagcggctcgccgcccacctggtggacgcaggcaatgacggcctgatcgtcaacggcaccaccggtgagtccccgaccaccagtgacacggagaaggaccagctcgtacgagcggtgctcgaagcggtcggcgaccgagcacatgtcgtcgccggcatcggcaccaacgacacccggcacagcgtcgagctcgcccggacggccgagcgcaccggcgcccacggcctgctcgcggtgacgccgtactacaacaagccgccgcaggagggcctgctccggcacttcacggccatcgccgactccaccggtctgcccgtgatgctgtacgacatccccggccgcagtggggtgccgatcgacacggagaccctcgtccggctggccgaccacccgcggatcgtcgcgaacaaggacgccaagggcgacctcggccgcgccagctgggccatcgccgaatcgggactcgcctggtactccggcgacgacatgctcaacctgccgctcctctcggtcggcgcggtcggtttcgtctccgtggtcggccacatggtcacccccgacctgcgggccctgatcgacgcccacctgagcggtgacgtccagaaggccaccgagatccaccagaagctgctcccggtcttcaccggcatgttccgcacccagggtgtcatcaccacgaaggccgccctgacgctccagggcctcccggccggaccgctgcgcctgccgctggtggagctcagcgcccaggagacggcccagctcaagatcgatctcgctgccggcggggtacatctctagtcaagacttgttgaacacaggtttcaccacagacttcacaactgaacaggcgaggcgactcgcatcgagcaccaccccaagacaacagcaagtgcacgaatgacatgcgcgccacgtgcctcagcggtacgtggcgtgcgtggtaaggagagtcttttgagtcatccgcatcctgaactcggtaccccgccgaagctcccgaagggcgccctgcgggtcaccccgctcggcggcctgggcgagatcggccgcaacatgacggtcttcgagtacggcggccgcctgctcatcgtcgactgcggcgtcctcttccccgaggaggagcagccgggcatcgacctgatcctgccggacttcaccacgatccgggaccgcctggacgacatcgagggcatcgtcctcacgcacggccacgaggaccacatcggtggtgtcccgtatctgctgcgcctgaagccggacatccccctcatcggctccaagctgaccctcgcgctcatcgaggcgaagctccaggagcaccggatccggccgtacaccctcgaggtcaccgagggccagcgcgagcgcatcggtgtcttcgactgcgagttcatcgcggtcaaccactcgatcccggacgctctcgccgtcgccatccgcacccccgcgggcatggccgtggccaccggtgacttcaagatggaccagcttccgctggacggccgtctcaccgacctgcacgcgttcgcccggctgagcgaggaaggcatcgaccttcttctctccgactccacgaacgccgaggttcccggcttcgtgccgccggagcgggacatctccaacgtcctgcgcacggtcttcgcgaacgcccagaagcgcatcatcgtggcgagcttcgccagccatgtgcaccgcatccagcagatcctggacgccgcccacgagtacggccgcagggtcgccttcgtcggccgctcgatggtccgcaacatgggcatcgcccgtgacctgggctacctgaaggttcccgccggactggtcgtcgacgtcaagaccctcgacgacctcccggacgacgaggtcgtgctggtctgcacgggttcgcagggcgagccgatggccgccctctcccggatggccaaccgcgaccaccagatccggatcgtcccgggcgacacggtgatcctcgcgtcctccctgatcccgggcaacgagaacgcggtctaccgcgtgatcaacggcctgacccgctggggcgccaacgtcgtccacaagggcaacgccaaggtccacgtctcgggccacgcctcggccggcgagctgctgtacttctacaacatctgcaagccgaagaacctgatgccggtccacggcgaatggcgccacctgcgcgccaacgccgagctgggcgccctcaccggcgtaccgaaggaccacatcgtcatcgccgaggacggcgtggtcgtcgacctcatcgacggcaaggcgaagatcgtcggcaaggtccaggccggttacgtctacgtcgacggcctgtccgtcggagacgtcaccgagacctctctcaaggaccgccgcatcctcggtgacgagggcatcatctcggtgttcatcgtggtcgacagctcctcaggcaagatcgtgggcggcccccacatccaggcccggggctccggcatcgacgacagcgccttcgtggccgtcacgccgaaggtccaggaagccctggacaagtcggcgcaggacggcgtgatggagccccaccagctccagcagatggtccgccgcgtcgtcggcaagtgggtgtccgacacctaccgccggcgcccgatgatccttccggtcgtcgtcgaggtctgacccctcacgaccgcctgacctggagcggggcccccgatttgcatcggggagccccgctccagtacgtttacgtctccgcctgaacgggaagcaccgcgcgcactcgtgcgcctggaggaccccgaacggggcgggaattccgactcagaatctctgataaagtcggatccgc

SEQ ID NO: 2780 - DNA, 6931 bp, Unknown
  Kingdom: Bacteria, Phylum: Actinobacteria, Class: Actinobacteria, Order: Streptomycetales, Family: Streptomycetaceae, Genus: Streptomyces
ggccttgctgtcgccggtgacgtccgcgaagtagagccgtcccatgtccgtgccggtgacgaagcggccccagccggaagacatcacggttcccggcccgaagctggtcccgagattccggtggacgacgacggagccgtcgatgcgctgcaggacgagatcgtccttgccgtcgccgtcgatgtccgccggcgtgaccttctcacgcgccacgacctccttcacccagcccgccaggtcgtcgacgcgggtgtccacggcgccggtgcgggtttcggcggggtcgaccccgaggcagccgccctgccaggaacgggaggtgacgctcacgagctgcgggctgccgtcgacggtccggagggccggccctccggcgtccccctggcacaccgtcgccgtatcggagccgttgaggttcaccgtcgtgtcggtgcgggacgcgacggtgaacgtgcccgcgtgcagcttggtgggcacccactcggtccgtgtccgtccgaacccggccttcgtcagctgctcgccgtccgcggcgggggtggaagccagcggtacgggagtgatggccggacccgtgatccgctcgctgagccggaccaggacgagatcgcgctccgcgtggggaacgagggcgagcgcggactggacgctgccgcctgtctgcgtcaggtcgctccggccgatcgtgaccttcgtggggagggcgggcttgcccgtggtggatatgccggctccggtgaagcacgacgccgcggtgagcacccattgctcggccacgagcgagccggtgcaggaggtcttgtccccgacgttgatcttcgcgacgaagttcagcccggtcgtcgtgggggtgccgacgagagcgttcgcgggtgctgtggtcagcaccgcggcgaacgccgccaccgcactggtggcccacaggaaatgcgagcgtttggtcatggaaggttccttaacgttgtgggtgtgcgctgcgaagagggcagcgtcgcccgatggagcgagtggcgggtgatgaacgggccgcacggacacccctggaggcatccgcggaagagcgggccggcgcccgaaaccgcgaccccgcgcgaggacgtcgtcagagggacgcggctcgcacgagcggggtgtacggcggtgccggtcgtggtgccgggaaccgacgccgggaggatgtcctcaccgacggcgtccggtcgggtgtcgcggcgcgcgggtccggcggtgcggccatgcgaccgaaggtgacggaacatcgccgaggcgatccgcatcagtgcgtcgggctgatctccccgagggcgtgagcacgtccccctgggtcggacgacccgcctgcggacgccgacacgttcgcggccacgacgggccggtcgaacgtcatggcttcgcgtccctcgaccggcgacacatcccgaagggcctgcgtggtcatcggcaacatgaatactccccccgacgggctgtcgcgaaagtcaccgctcgcaccccctgtgcggcgaacgggttccgaaaaattcggaacacgcacatcggcccggcaccggattcaaacccatgagtgcctggtcacgcaaccttcacgcggtgcgcacgagctccgacggttcgtcaggcgccgcacccccgccagacgttcaccaggccgacgagaagccggaaacgtgcgcgggcgacgggaaaccctccggccgcggtggagggatccgccacggcgggagggtggccggccggagccgggggagcagggtcaggcggccgcccggccgttccgctccgcgtgttcccggaccagctccgcgtaccggaggccgctgctcttgaccgtacggcgctgggtcgcgtagtccacgtggaccaggccgaaccgcttgtcgtagccgtacgcccactcgaagttgtccatcagcgaccaggcgaagtacccggccagcggtgcacccttgccgaccgcgcgggcgcaggcggcgaggtgctcctccagatagcggacacgctccgggtcgtgcaccgaaccgtccgccgcgacgacgtcctcgtacgccgagccgttctcggtgacgtagatccgctggacgccgtactccccggtcaggcgcagcaacagctgctccaggccctccgcgtggacctcccagtccatgtgcgtgagccgcgcgccggggacggagacctgcttcgcgtgcggtgcggtgccgtcggggtcggcggtgacgatctgccggaagtagtagttgagccccagccagtcgagcggtgcggcgatcgtctccaggtcgcccggccggaccgggagttcgaccccgtactcctccaccatgtcctgcgggtagccgcggcccaggaccgggtccagccaccagcggttgatgtggccgtctgcgcggcgggcggcggcgaggtcggcctcgcccgcgctcgccggctcgatcgggctgaggttgttgacgatgccgacccgggcgtccgacgaggccgcccggatcgcccgtacggccaggccatggcccaggtgcaggtggcaggaggcccgcacggcggcggtcaggtcggtgaggcccggcgccatccggccctccaggtgcccgatccaggccgagcacagcggctcgttcagcgtcgcccagtgcttgacccggtcgccgaggcgctccaccacgtgggaggcgtacgcggcgaagtgctccgaggtctcccgtacggtccagccgccccggtcctggagcgcctgcggcaggtcccagtggtagagcgtggcgaacggggtgacgccggcctccaggaggccgtccacgagccggtcgtagaagtccagacccgccgtgttgaccggtccgtcgccgccgggcacgaccctcggccaggcgaccgagaagcggtaggcacccgcgccgagctgcttgatcaggccgatgtcctcggggacccggtggtagtggtcgcaggccacgtcacccgtgtcacccccgtcgatcgtgccgggggtgtgcgagaacgtgtcccagatcgagggagagcggccgtcctcggccacggctccctcgatctggtacgcggcggtggcgacgccccaggtgaagtccgccgggagggcgttgaggtcggacacgtgctgcctttccgtgggggacgcggggcggcgttcgccgatggggctcacttcacggctcccgcggtgagaccggcgaccaggtagcgctggaggagcaggaacccgacgacgatcgggacgctgacgacgagggacgcggccatgacctggttccagtacacgtcgttctgcgtggcatagccctggaggccgacggagagggtccgggtggcgtcgttcgtcatgacggaggcgaagagcacttcgccccaggccgtcatgaaggagtagacggacacggcgacgatcccgggcacggcggccggcacgacgacctggaagagcgcgcggacgggtccgcagccgtcgaccagagcggcctcgtcgaggtcccgggggatggagtcgaagtacccgatcagcatccagatggagaacggcagcgagaacgtgaggtacgtgaggatgagcccgccgcgcgagccgtacagggcgacgccggtgctgttgccgatgttgacgaagatgaggaacagcgggagcaggaagaggatccccgggaacatctgcgtggacagcaccgtcacggtgaagacccgcttgccccggaaccggtagcggctcaccgcgtaggcggagaacaccgcgatcgtcaccgacagcaccgtcgccgagcccgccacgatcagcgagttgacgaagtactcggcgagcggaacggtctcccagatgtcgaagtacggccggatcgtcagcgtcgacggaatccactggaacctccccgacacgtcctggagcggcttcagcgagctgctgaccatcacgtagacgggcagcaggacgaagccggcgagcagggtcaggacgatgcggcgggtccagaggaaggactgcggtgcggccatcggcgagcgggcccgcgaccgggtggtgcgggccggccgcgtggggctagacatcggagcccttccttccgcgcgaggtgagaaacaggtagacggctgtcacgaccagcaggaagagcagcagcaggaccgacatcgcggatccggtgccgaagttccaggtgacgaacgacgactggtagatgtggatcgagatcaggtccgcgctctccggggccgatttcccgaacaggacgtacggggtgttgaagtcgttgaacgtccacaggaagagcaccaggaccaggacctggttgaccgggcgcaacgagggcagggtgatccggcggatctgctgccagatacccgcgccgtcgatcgaggcggcctcgtacagctcgcgcgggatgttctggagcccggccatcagcatgagaaaggcgaacggccagcccttccacaccgagacgatgatcagggcgtagatgctgttgtcgccgatcagccagaacgacggctcgtcggtgatgccgagctggtcgtgcagcacgtggttgatcagtccgttgtcccgctggaacatgaacgcccaggtgatgacggccgcgtagaccggcagggcgtacgggacgaggaagacggcgcggaggaagccccggccgcggaagttctcctggagcaggatcgccgcggtgacgccgaacagccaggcgaggccgaccgagaagaacgtgaagacgcaggtgacgaggaacgagtgcagcaaggcctcaccgatcggcgcgtcgaagtcgacggcgatgctgtagttgtcgaggccggtccagggcgccgcgccccagttgttgatgaagaactgcgtgagctgccggaagctcatcacgatcccgatgaccatcgggatgatgtggatgaggagttcgagcaggacggcgggcaggagcaggagatagggcagtccgcctcggcggatccggtcggggatgcgcggcagtctcctgcgcgcacccccggtgccccggctcgtacccgtgccggtcgacttgtcgacctcggggtccgtggtgacggtggcggtcatgggtcagggcctcactgctgcatcgtctgctgggccttttcgaggcgcgccttgacggattcctcggtcacgggacgtccccccgcggcgtccgcccacagctccttgacggccgttcccacggccgtctcgaactgcgactcgttcgggacctgggggagcggtgcggcgctggtggcgagggtgtcgcgcagcaccttgaggtcgggggctccgaacgcggcatccgcctgtgcggccttgaccggcgggatcgatccgtaggtcttgttgagcagcttctgctcggcgtcgctcgtcatgaacttcacgaacttcttcgcgccgtcgatgttcttggtgttcttgaagacggccatgttgatgcccgcgaccatggagttggtctgcttgcccgcacccgggacgcccgaggggaccggcaccggggccgcgccccagtcctcgggcttcatgccctgggcggcgaaggtggaggcggcggcctgccacagcaccatcgccgtcctgcccttggcgaagtcggtgagcgactggttctgggcgtactccgcgttgcccggagcgatgatcttgtcctcggccatgaagtcgatgtactgcttcaccgccgcgaccgcaccggcggaggtgaaggtcgccctgccgtccttgtcgaagaagtcggcaccgtgctgccggcccaggacgaaggtctggtggatgttgttggagaggttgccgccctcggcgcccagaccccacttgccgtccctggatatcttcttgccggccgcgaccagctcgtcccaggtggccgggggcttctcgacgcccgcctcggcgaacatcttcttgttgtagtagagggcgtacgccagtgagtacagcggcaccgcggcgggaggctcgccctccttgcccgccgaggcgaccgccgagtcgacgaagcggtcccggccgccgatcgcttcgaagttcttctcgtcccacggcaggagcgcgccggtcgcctggagcgaggccgaccaggtgttgccgatgttcagcacgtccgggccctggccggagctggtggcggcgaggatccggttcagcaggtcggcccacggcacgacctccagcttcaccttgatcccggtctccttctcgaacttcttcagctcgggggtgaggatctccttgtcggcctcgatgctggggccctggttggacgcccagtaggtgagggtcttcggcgactcgttgctgccgcccgcggcggtcccgccgccacagccggtggcggctgcggcgatggcgagggcgagggtggcggcgcttgcggctctgacatgacgcatgtgaggtggcccctttccggggatggctgcgttcgggaagcgaacggcctccatgacttaatttatgccgtgatttaagaggtgagagaaggtcgcgtcaaggcctggcaccggggtatgttcctcgacgggaaggagcaacatggccgagcgcaacagacggaccgtgcgtgacctgcgccggggcaaccgggcgagggtattgcaacggttgtatttcgacggccccctgagtcgtcaggagctcggaccggtcacgggcctgagttcgggatccatcagcaacgtcgtcgcggaactgtcagccgaaggcctgctggaggaggccggcatcgtcgactcggacggaggccgcccccgtacgctgctgcgcgtcgccccggacggcgggttgctcgtcggcatcgacatcggcgagacccgggtccgggtcgagctgttcgacctctccctgaccgaactggcccgcaccgaacggctgctggcccagcacggctacgacgtcgaccgcatcgtcgcccacgtccgcaccggcgtcgcggacgtgggc

SEQ ID NO: 2781 - DNA, 2712 bp, Unknown
  Kingdom: Bacteria, Phylum: Actinobacteria, Class: Actinobacteria, Order: Streptomycetales, Family: Streptomycetaceae, Genus: Streptomyces
gtagccgtacgcccactcgaagttgtccagcagcgaccacaggaagtaaccgcgtacgtccaccccgtccgcgatcgcccggtgcacggccgtcagatgggcgtccaggtatgccacccgctccgggtcgtggacctcgccctccgggtcggcgtagtcgtcgtacgccgctccgttctccgtcaccagcaggggtacggaggggagttcgtcccggagccgggccagcagctcgtacaggccgttcgcgtcgaccggccagtccatcgcggtgcgcgggccggccgccggggtgaacgccacatgctgttccgcgcctgcccacggtgacggtgactccgatgcgcccgccgaaaccacgctgggggagtagtagttgatgcccagcgagtcgatcggggtcgacgccacctccaggtcgccgtcccggacgaacgaccagtccgtcacctccgccgtgtcctcgaccaggtcctgcggcagccggccgtggaagaccgggtccaggaagatccggttcgccaccgcgtcgatccggcgcaccgcgtcccggtccgcctccgtgtccgtcagcgggcgcagcgcgtggaggttcagggtgagggagatctcggcggtgtccggcaggaggtcgcgcaggacacgggcgcccgcgccgtgggccaggttcaggtggtgggcggcgcgcagggccgcgaggtcgctggtccggccgggggcgtggaccccgttcccgtatccgaggaacgccgcgcaccagggctcgttgagcgtcgtccaggtcggcacccggtcgcccagggctccggccaccagacccgcgtactccgcgaaccggtgcgccgtctcccgctccggccagccgcccgcgtcctccagctcctgcggcaggtcccagtggtagagcgtggcgaccggtctgatcccggccgccagcagctcgtcgaccaggcggcggtagaagtccaggccgcgctcgacggccgggccccggccggtcggctggacccggggccaggagacggagaaccggtagtcggtgacgcccagttccttcatcaggcgtacgtcgtccggcatccggtgcagatggtcggcggcgatgtcaccggtgtcgccgttgcgcaccttgccgggcgtccggctgaaggtgtcccagatggacggcgtacggccgtcctcggtggcgccgccctcgatctgataggcggcggtggcggtcccccagcggaacgcggtggggaaacggagttccgtcacggtctcgggacggggacccgcggagctcgccggacgggcatcgacagcggtcatgggactgacactccagaggtgagggaggggcggaggaggggccgcagggcggggcggcgtacggtgtcagcccttgaccgcgccctgcatgatgccgccgacgatctgccggcccagcaggccgaagaccagcagcacgggcagtgtgccgagcagcgtgccggccatgatcaccgactggtcgttgacgtagccgccaccgagctgccgcagtgcgacctgcacggtcggttcctgcgaggacagcgcgatgatcggccagaagaagtcgttccacgccgtcatgaacgtgagcatcccgagcaccgccatccccggccgcgcgatcgggatcacgatcgaccagaagatgcgcgcggtggaggctccgtcgacccgggccgcctcgatcagctcgtccggcagcgactgcaccaggtactggcgcatgaagaacaccccgaacgccgagaccagacccggcaggatcaccgcctggagctggttcacccactggagttcggcgatcagcatgaagagcgggatcacgccgagttgcggcgggatcatcatcgtcccgatcgtcagcgtcagcagcgcaccccggccacggaacttcagcttggcgaaggcgaatccggccagcgtgcagcacaggaccgtgccgagcgtgatcgaaccggacacgatcagcgagttcagcagggccttgccgatgtcggcctcttcgaggaccgcgtcgaagttcttgatcaggttcggtcccggcagcagactcggcggcacccgcgccaggtccgcgttggaccggctggccgcgacgatcgtccagtagaacgggaacgcggagatcagcagcgcgaagccgaggatgaggtaggagagccagccgcccttcatcgtccggcccgccccgccgcccttgcggaaccgggagcgcctttcgggcgggtcctgcgacgggcggccctttccgggcgcggtcggcggtgcggcgagcgcggtcatcggccggcctccttgcgtgcgcggcggcgcacgagcagggcgttgaccccgacgagcaccacgatcaggacgaacatcacccatgcgatggccgcggcccggcccaggtggaagaagccccagccctgctcgtacatgtacaggccgagggtctggtactggtgcgagatgccgccggagatcgacccctcgaacagcagcggctcaccgaagagctgcgtcgcgccgatcgtcgagatgatcaccgtgaagacgatcgtcggccgcaggccgggaagggtgacgtggacgaactggcgccagcgcgacgctccgtccatctccgccgcctcgtacagctcgtgcgggatcgactgcatccccgccaggtagatcagcgcgttgtagccggtccagcgccagatcacgatg

SEQ ID NO: 2782 - DNA, 1429 bp, Unknown
  Kingdom: Bacteria, Phylum: Actinobacteria, Class: Actinobacteria, Order: Streptomycetales, Family: Streptomycetaceae, Genus: Streptomyces
ggccagcacggccgcggcggcgagggcggcggtcgcgggtctgcttctcccccggcgggggcggaggtgtggggtgcgagtcatctgggagcgctctcacttccgggtcggagttgccgaacatacggcgggtcagaggtgttggcctgctacgcggtggcgtcgcgggtgaggcggatcgtgtcgcggtaccacttggcgctgtccttgagcgtgcggacctgggtgtcgtagtcgacgcggacgatgccgaaccgcttgtcgtagccgtacgcccactcgaagttgtccatcagcgaccaggcgaagtagccccggacatcggccccttgggcacgggcggcgacgacggcgtcgatgtggtcggcgaggtaggcggtgcggtcggcgtcggggacggagccgtcggcggcgacggtgtcgtcgaaggccgcgccgttctcggtgatgacggtcggcagcccgtagtcccgctgcaaccgcaccagcaggccggtcagttcggtcggggtgatctcccagtccatcgcggtacggggcaggtcgcgctccaccacgcgggtgacgggcaggccgtcggtcccggtgggcgagccgtcctcggcgacgccggagaacaacatgccccggtagaagttgacgccgaggacgtcgagcggagcggcgatggcggccaggtcgccttcctcgacggggagttcgttgcgctgggcggccaggtccgcgacgacgtcctcggggtagcggccgtggacgagcgggtcgaggtagagccgggtgcccatgccgtcggcgcggcggcacgcctcgcggtcggcctcgctgcccgtctcgggggtggcggtgcccaggttgagggtgatgcccagctccagggggttgctcccggccgcgtcgcgcagcgcgccgaccgcgaggccgtggcccatgagaaggtggtggacggcgtgcaccgcgtcgccgaggtcccggcggccgggggcgtgcaccccgtgggcgtaaccgagcatcgccgagcaccagggctcgttcagcgtggtccagtgctcgacccggtcgccgagggcctcgtacgcgagggaggcgtactccgcgaagcgcagggcggtgtcgcgtgcgggccagccgcccgcgtcctccagctcctgcggcaggtcccagtggtacagggtgatccagggggtgacgccgcgcccgtggagctcgtcgaccagacgcttgtagaagtcgaggcccttggcgttcgccgcgccccggccgcccggctggatgcggggccaggcgagcgagaagcggtacgtgtcgacgccgaggcccgcgatcagctccacgtcctcgggcatccggtgatagtggtcgcaggccacatcaccgtgctcgccgccctcgacggccccgggcacccggcagaaggtgtcccagatggacg

SEQ ID NO: 2783 - DNA, 12100 bp, Unknown
  Kingdom: Bacteria, Phylum: Actinobacteria, Class: Actinobacteria, Order: Streptomycetales, Family: Streptomycetaceae, Genus: Streptomyces
ttcggcttcggtgtcggcgcgttcccggccgcggtccgctttcggtcgctcgccggtgagcgcggcccagtcccgttccgtggttgccagctcgatgaggttctgcgagtgccgtggatcggtgaccgaggtgtgggccaccagcgtctgccggatccggagcagttcggccagatcatcccgcgctccgcggtcccggtagtggtcgtcgagcaggtacgcgaaattcttcaaccggtcgagcacgtcggacgacccggcaggcgtgagctgtaccgctcgccgcgcggcgtcgacggcttcctccaggacgacaccggtctcccccgtctcacgggaccagtcgcgcaggacgacggcgaggaagtgcaggctcgtggcggtggacgcgtcatcgggggaacacgcgacggctgcccgcgcgtgctcgacggcttccgccaggggggcgaggtcttccgtcacggtgaacgccgtccgcagcgcgacgacgaggttgcccaggtagaacgccttgttcgtggacggttcctcgtcgacggccgtccggctccagtccagcgcgtcggcaagggttccgcggtcctggttctgctggaacgcggtgtgcagcagcatgccgatgttgttggcgtagcccgccgaatcctccgggctttcgtacgccaggaggtaggcctccgtgacggcccggaccgcttcctgcaggaacgcgaagtcgccggtctggtggtagcgggtctgcagcaggcccccgagattcgacaggaccgagcggcgctcgtccccgtcctcggcggccagcagggcatggccgaggtcgatcgccttctcgatcgacgcggggtccgcgctgtgccgagccacgcgaaaggcctcccagaaccgctcggccaggccgtcggcgggtccgccacccacgcgtcagtcctcgttgccgtgcgaggtgccggccggtccgccgggtgcctcgtccggctcggcgaccttgcgtttcggggtgtaaccccgtccctcggcctcctgcagcagctccgcctcttcgggcgagagctcaggttcgtgcgccatcaccactccttccctcctcctcacccggcacggccgccggttctccggcttcgacgaactccaggacgtcgaagtcctccgcccgcagccgcagacccgccgtcccgcgcacgcgcgcgccgaacgccccgtcggcacccatcacgcgcgccgattcgagatacagctcggccgggtaggggtacgaggaggcgtacgaccggtcgccgtaccagccgccggcccagttgccgtccttgagccgcacgcgcacgaagcacggttcgcggtcgcggaacgcgtggtcccaggcgctgggtgtgctcaggtagcgagccttgcgtcgctgccgatccatcagggatacggcgaccgccgccacggccggcacgacgaggaacagcatcacggcgacgaagccgaccgcccgcggcctctccacgaagccgtcccagccgccgccggcaccccgcgccaggcgaaccagcgccggccccgccaccacgacgtacagcgcgtccagcgcgatcgacgcgacgatcgcccgcaacacccgctcacccaggtcacgctcaccgggcaccggtccgcggcggcgttcccggacgaactggtaggtgaccccggggagcaccagaagaacgagcagagccagctgcacgacggtcgcgggcgcctgcacgtcaccacccccatgtcgcacggactccgttccatcacgctactggttggtgtgctccgcgaccggcagaacgcttctttacgcggctccggggaggtcagcggcaaggacgccacccccacgacagctaccgaggtggtgacgacgaacagcacggactcgtatgagagttcccggctggtgttccggagctctccagagggccgggccgatgtcaccgcgggccgacgccggtcggctcctgcgagtgaacacgcccctgctagcgtggcgaagcgtggatgacagcgtgtatgtgggcaacgcgggcaaggacgcggcgctggaccggggatggcttctcgggcacttcaaggacatggacgatccgcgtcacagccaggctgtggagatcaagtggggcgtccaccctcgcggcgacgagcgagcacagtgggtcgaggacgagaggcggacagccctcctggtcctcatcggcgggcgcttccgggtcgacttccccggccacagcgttctcctggagaagcaaggcgactacgtcgtgtggggaccggatgtcggccactcgtggttcgccgaggaggagtcggtgcttctgaccgttcgctggccgtcagtacccggttacgcggtgccgggaaacaagcgggacagcccttaggtcgtgtccgcggcagccggccccgctcgcttcccggctccgcccggcccgataccgcgaccgggcggagccggggtgtccctctccgggcagcccttgcgggcgacgcatgccatcaagcactgcccgcgagaaccggacgacggtagctaccggtcgccgatcctcaggaacgtgatcgagttggcggggaacgtgtacgtgaagctgtccgagatcccggtcagggtcgacctcacgggggtgacgggagtggccttctcgctgttcacggcggacgggtcggccgccagggtcgtcacccgcgcccgggaggccacccgcgctccgccgaggtcgaccctggtgcgcgcctcggccggctgggcgttcacgaccttgacgatcaggtcaccggtcgcccggtcccgggtgacgacctgacggaagggttcggccaccttgtcgtcggtgaaggccccccactcctcgccgtccaggtacagggtcacctggcgtccgcggaccttgacctcgatgtcgtaggcacgtccggactcgatggtgccggccttgctgatcagtgtcgtcttgtcaccgtcgtcggagcgctcgactccgtgcgcggtgttgccccaccccccgaggttccaccagtagtagttgccggtgtccttgacgccgaaggcgaccaggaacccttccgcgcccgcctgcttggtggccttcacgtgcaggtcgtagtcgcgccatgcccggtcgcccgcggtgaccgtggtgttctcggctgcgacgtccgtctgggcgtactggccgtcctgtacggcccaggtgccgccaccggtgtgggtccaggccgagtccgggcctgagaagtcgtccgtcaggagggtcctgccgtccgcggcggtcacccgtacgtcgtcgtacgaggcggccgtcgcccacgtcgacaggccgacggccccggagatgggtcctccgacggagggggtggaggtggccccggagggaacgacctggtcaccggcgttgttcatgaacagcttctggacctcgtagttggccgatccccaggacgcgcggttgttgaaccacaccaggttggggcgccactgcacatagtcctcgttggccaggacgggagcgtaggaggcgagcttgacgatgtccgcgttgcgctccagaccggtcatgaacgcggcctcggcgagaccgttgccgaaggtgttgccccgggaggcgtactcaccgaggaagacctggggaccggagcggtcgtaggagtcgtagcgctggttgttctccatgaaccaccgcgggctgttgtagtagtgctcgtcgaccatggcgacgcccgcgtcccggttgagttgccagagagtgtcgaaggtcgcgccggatgcggccggtccggagttggagaccaccgtgatcccggggtgttccgcctcgacggccttacggaacttcgtgaagcgctcgaagaactcccggggcaggttctcctcgttgccgacctggacgtgggtgaggccgaacggtgcggggtgtcccatttcggcacgcttacgtccccaggtggacgtcgccggtccgttggcgaactcgatgaggtccagagtgtcctggatgtgccgcttcagcagggcgtcatcgacgacggcccggttctggccacaaccggtgaccagggcgggcacgaccggcagcggcatcgctcccacgtcctcggcgaagcggaagtactcgtagtatccgagaccatagctctggttgtaaccccagaagttggcgttggtggcacgctgctcgaccgggcctatggtgtccttccactggtaggaacgggcccgctgccagccggacgcctcgctgtagtcctccatggagccggtgttgaccaggcagccgccggggaagcggaggaagccggggttcagcgcggcgagcttctccgcgaggtccttgcgcagacctcccggctgcttcttgtacgtatcacgggggaagagggacacctcgtccagtgcggcggcgccggacgaggcgacggcgagccggccggtggtggtggtgcgcgtcgcggtgaacgtggcgcggtactgcttccagccgcccttcgcggccttctgccggaccgcggccagtgcgccgtccgcgtccccgagcgtgagtgtgagcgtggttccggtctcggctcgggcccacacggagaagtcgtacttcgccccgctcctcagcgacagtccgctgttgtagctggagttggtcagggtcgtgcccgcggccacccgcgcgtagttgcggttgttcgcgtggagacggccgtcgtcgttcacgaccgtggcggagccgtcgacgtcccaggaggtcaacgaggtgtaggcccggttgtcgacggcggagtactcgaaggacctgttctgtacgagttcggcgtacagacctccgtcggccgcccggttgatgtcctccaggaacagcccgtacatggtgtcgtcgatcgcggcgcccggcttgtcagggtccacggtgatggcgtagtcggtggtgggcgtctcgccgttcgcgggggccggcacgaggcctgccgcgacgaggaccgcggcggccgtcagaccgaacctgaggcttggacgggtacttctgcgggacatggagcctccgagtcgtggcgccgagaggcgccggtccgggtggacgaaggtgtcgtgatacgcccgcgccgtcgggccgtcccgccgccacgttggcctcacccacttcccgccgggagcagttcagcaccatgggaagtggatgaccggacgggcccggcgcagcccaaagggacttcgggcttcgatcatcgttccgggcggctcacccagattgtgagcgctaactacccttgatctcaaggctcttgcaccacacgaggagaaagccgcgaaaccgttcggcccacgtgttgacgcaaacgcctccacttacccccaaaccccttcccaccgcgaccacccgacctcgcgtgaacgtccactcactcccccaacggccgagtcggccgcagtccagcacaactcttccgccacaccgacagacaggcgcgacagaggcgatcagggcggcggcgaggcgcgggtccaaccccgcacgcctggcaccacggtgggcactggtgagccgacacctggcttgttatcgttaacacacagagcgtcgggtgcggagtcgacgtggtccgtcgtcgccgcttcgcgcccgtacggaggctccgctgtcccctgaccctgtccgcgagcggccgcggtggcgaccgccggcacacccccgaacgcgtcgtcgttcagcaggagcaggagcgacacggaccggtcgcttctcgtggacgatgcgctcgtcgagcgaaaccagtgcgtcggcccccgcacgcccgggctctcgacagacctctgatccctaccgccgtcggagcgcgcacaccggcacgccctcgccctccggctgtctcccgttgtgatgaaggagccccatgaatctgtccccgccccctttcaccggaggccctccggtctgtcaccccgacccggcaggcgggcagcgctggaccttcggcttcgccgggggtctcgcggcggaagtgcacacccacggcgcccgcatccacggactgtgggtgccggaccggcacggccgtacggccgatgtcgtcctcgcaccccgcgaaccgggcgagtcgaccgccgccgcccggtacttcggcgccacggtgggccgctacgccaaccgcatagcccacggccggttcaccctgaacggcacgccctaccagctgaccacgcaggagaacggccactgcctgcacggcggaaccgacgggttcgacacccggatctgggaagccgaaagcgtgcacaccccggagcggaccggagtgctcctgcacctccgcagccctgacggcgatcagggctttccgggaaacctggacgtcaccgtcagctgtctcctgagccgcgacgaactcaccctcacctacgccgcggtcaccgacgccgccacgccggtcaacctgaccaaccacgcctacgtcaacctcgaaggcgagggcgccggtgacattctcgatcacgagctgaccgtcgacgcctcccactacacaccggtcgacggagatcttcttccgcacggggagcatctccccgtctgcggcaccccgttcgaccttcgccggccgctcaagctctccgaggcgctggcccgcgccgagcgaggacccttggcatcgggcgaggggtacgaccacaacttcgtactgaccccggaaggcaacggcacgctgcgccgggcagccgtcctccacgcaccggccacgggccggtgcatggaggtgttcaccaccgagcccgggttgcaggtctacacggccggacagttcgacggaagcgttgtcggcaagagcggagcgccctaccgggcgggtgccggtatcgcgttggagacccagcatttccccgactcgccgaaccgccccgacgacccttccacggtgctccggcccggcgacacctatcggtcgatgaccgttctgcgtttcgggatccgcggctgaccgcgcggggacatggtgaggcgtctgtgccccgccggtggtcgaccggcggggcacagacgcccccaggtggagtcagatgcccgctctgcgcctgttccacacgtcgaaaccgaccgccgcgagcagcacgaggcccttgatgacctgctgccagtcggtgcccaccccgaccaggttcatgccgttgttgagcacgccgaggaccaggccgccgatgatggcaccggccacggtccccacgccgccgctcatcgaagccccgccgatgaacgcggcggcgatggcctccagttcgaagttcacgcccgccttgggcgaggccgcgttgaagcgggccgcgaacacgagtccggcgagcgccgcgagcattcccatgttgaggaacaccgcgaaggtcaccttcttgtccttgaccccggacagcttcgcggcggggaggttgccccccaccgcgtacacatggcggccgatcaccgcgttgcgcatcacgtaaccgaagccgaccagcagcacggccaggatcaggagcacgacgggagcgcccttgtaactggcgagcagcagggtcgtgaccagcacggcggcgaccaatgccgtcaccttgagcgcgaagagactcgtggggagcgactccagtacgaactcccgctggcgtcgacggtcccgcacttcctggaacacgacgaaggtgatcagtcccaagccgaggaggagggtcagattgtggtaattggtctgcggccccgcttccggcaggaaaccgttggcgatcttctgcagaccctccgggaacgggccgagcgtctggccctggaggaagatctccgtgagcccccggaacagcagcatgccggcgagagtcacgatgaacgacggtatgcccacgtacgcgatgaagaacccctggagcgcgccggcgacggcacccagcaggagggcgaggatcaccgcgacgggccacgagaggtggtgctcgaccatgagcacggcccccacgccaccgaccagggccatcagcgagccgaccgacaggtcgatgtgcccggagatgatgaccatcatcatgccgatggccaggatgaggatgtagctgttctgcagcaccaggttggacacgttgcgcggcagcagcaggtctcctcccgtccagatctggaacaggaggacgatcagcccgagcgcgagaagcatcccgtactggcgcatgttccgccggacgccgtccaggagcgcacgcgcgacctgtgccccggcgggcggggcggcgccgtcccccggcggcgccggagcggtcgttttcgtggtggcgggggtgctcattcctgatgtccttcgttgagggtggcggtgcctgcgccgaccgccgacagtgcggaagtgtcccgcgtcatgtaccgcatcagcacttcctgggtggcatcctcgcgggtgacctcgccggtcagccgaccggcggccatggtgtacacccggtcgcacatgccgagcagttcgggcagctcggaggagatgaggaggatcgccttgccctcggcggcgagccggtcgatcacggtgtagatctcgaacttcgcccccacgtcgacgccgcgggtgggctcgtcgaggatgagaacatccggcccggcgaggatccacttactgagaacgaccttctgctggttgccgccggacagtcggccgaccgcttcgaggacgttcggagtcttgatgcccatggtccgccggtaccgttcggcgactctgcgctcctcgtgctcgtcgacgacgccccgccgggcgagcgtgcccagggacgcgagcgagatgttccggctcacggagtcttccagattgaggccgtagcgcttgcggtcctcggtgacgtacgcgatgccgtgggcaaccgcctcgggaaccgtccgcgtgcgcaccgcccggccgtccttcagaacggttccctgctcgtagcgaccgtaggagcggccgaagacgctcatcgcgagttccgtccggcccgctcccatgagtcccgcgacgccgacgacctcaccgcggcggacctggagcgagacccggtcgacgaccttgcggctgtggtccaggggatggcgtacggtccagtccctgatctccaggaccgggtgggtgtcggccgggccctcgtaccgggtgcggtcggggaaacggctgtccaggctccgtcccaccatgcctcggatgatgcggtcctcagtggtggccggatccctgacgtcaagggtctcgatggagcgcccgtcgcgcaggatggtgacggagtcggcgatctgcgcgatctcgttgagcttgtgcgaaatgatgatggacgtgatgccctggtctttcagttcccgcatcagccccaacagcttcgcgctgtcctcgtcgttgagggcggcggtgggttcgtcgaggatcagcagccggacgtccttcgccagcgccttcgcgatctccaccagttgctgcttgccgacgccgatgtcggccaccctggtcccggggtgctcgtcgagaccgacgcgccgcagcaacgcggcggcacgcctcagcgcttcgtgccaatcgatgattcctcgccgcgacggctcgttgccgaggaagatgttctcggcgatggacaggtaggggacgagtgcgagttcctgatggatgatgacaatgccgcgccgctcactggcccggatgtctttgaagcggcacggttcgccgtcgaagaggacttcgccctcgtaggtgccgtgcggatgcacgccggacaggaccttcatcagcgtcgacttgccggcgccgttctccccgcacagggcgtgaacctcgccgcgccgcacggacagggtcacctccgacagagccctgacgccgggaaaggtcttgacgatggcccgcatctccagcacgggacccgccggaggctggtgcgaggaggcggcggagctcaacggagctcctcggccttgatgtagccggagtcgaccagaaccttccggtagttcgccttgtcgacgctgatcgggtcgagcaggtaggccgggaccaccttcttgccgttgtcataggtgctgtggtcattgatctcgggcttcttgtcctcgaggacagcggtcaccatgttcgcggcgaccttcgcaagggcgcgggtgtccttgtagacggtctgggtctgctgattcgcgatgatcgacttcacggaggcgacctccgcgtcctggccggtgacgatcggcagcggcttggccggacttccgtagtcatcagatttcagggcggacaggataccgatcgagataccgtcataaggggacagcacagcgtcgacccgggccgtggaataggaggaggtcagcaggtcgtccatgcgcttctgcgctgttcctccgtcccagcgcaacgtggtgacctgggcgagccgggtctgctgggagcgtacgagcagctgcttcttgtcgaggtacggcttcagcacctccatggcgccgctgaagaagtacttggtgttgttgtcgtcgttggagccggcgaacagctcgatgttgaaggggcccttcttcgagccgtccttcaggcccagcttctcgacgatgtaggtggcttggagcttgccgaccttctcgttgtcgaaggaggcgtagtaggcgacatgcggggatcccaggatgagccggtcgtaggagatcaccgggatgtgggcgtccgccgcctgctggagaacgttggacagcgcctcaccgttgatggccgccacgaccagggcgtcgacaccttgggtaatcatgttctcgatctgtgccacctgctggtcggggtcgtcctcgccgtactgcaggttggtcaggtagccgctcttcttcaggcccgcggtcatgttggcgccgtccgcgatccacctttcggaggacttggtgggcatggagatcccgatggtgaggtccttcttgctcttcgactcctgacttcctccctcgctgttctgcccgcaggccgtgaggagcagggcgcagctggtggtcgcggcgaggagtgtggatgcggctcggaagttcgtcatgggcattacctggcaatctcgtcgttgaggtgcttctgtcccgaaggtcatctgcggtagcggtgtcctcctcgcaccacgggggcttcgtcgcggaggcggtcgggttcggcagctaggtcgagcttgattgttagcgctcgcatcaccgcagtacaagaggtgcccggcattttctcgcggcgatgcacagcccacggtcgcggagaacggggcaaaagggagggcatcccgcaaagcccgcccacgccgcggcctaccgtcggaccgcgcctccggcacagcacagtcgaccgatgcgcccgcgccgtacgcgcgggcggtgacgcgtcgcgcgtgggcgccgcgcggcaccggccgcatcaccggaccactccggccggaccgcgccgtgactatccgtcgcctcccataaacgtcccccgggatcggaccgcgatgccgggcgtcaacgcgcaccggcgacgcgaacccgctaaccctcccaaaaggtcctgttcgcggcccccggacgcacaagcgctcgacgacggctccgcggcagctcccctccagctacctggacctgctccccggaagccgggcgccgctcccccgccccgccgttctcgtgggtcgggggcgaccgccggcctctggacccggcatcccggctgcccaccagccggattccccccttccacggcggcaagggcgagcgccgcaccaccgtcgcatcgagccaagaatccggacttcggccgacgcgtgtccgggcggatcggagccgcgacccgtcaagccgttcgcgaagccgccgacaagcacgtgagtcacacagaacggccgccgaccggccggtgcccggccaaagcacggtgtcgcatcgtgcgaggatcgacatgacccaaagaccgtgggactcttgccccatgagcttgtgagcgttaacaattcacctggccgtcggggcgcgtgagcagctccaggcggccggggtgccgacgcgggtcgtctcgatgccgtcggtcgagtggttcgaggagcaggaccaggcgtacaaggacagtgtgctgccgcctcggggcctcggccgacgcg

SEQ ID NO: 2784 - DNA, 5429 bp, Unknown
  Kingdom: Bacteria, Phylum: Actinobacteria, Class: Actinobacteria, Order: Streptomycetales, Family: Streptomycetaceae, Genus: Streptomyces
cccccacacccgactggaacccgcggcccgggtcggtcgcggcggtcggggactcgatcacccggggcttcgacgcgtgttcggtgctggccgactgtcccgaggtgtcgtgggcgaccggttcggacgacgcggtgcgcagtctcgcggtccggctgctcggcccgtccggggcggcggaccgcagctggaaccacgcggtgtcggggtcccggatggtgcagttgcccgagcagatggcgctggcggcgaaggagcggccggagctggtgacggtgatgacgggcgcgaacgacgcgtgccgggactcggtgcggctgatgacgccggtggcggacttccgggcgtcgttcgaggcgtcgatgcggcaactgcgcgccggtgcaccgaaggcgcaggtgtacgtctccagcgtgccggacctgaagcggctctggtcgacggggcgggtgaacgagctgggcaagaagatctggcagctcgggatctgtcagtcgatgctggccgacgcggacgatctgggtccggcggccgtggaccggcgggacgcggtgcgggagcgggtcgtcgcgtacaacggggtgctgcgggacgtgtgcgcgaaggaccggtactgccggtacgacggcggggcggtgttcgacttccgcttcaccgggacgcagctcagccggtgggactggttccatccgagccgtgacggccaggcccggctggcggagatcgcctaccgcaacgtcacggccacggagccgcccgcgtagggtcggtgaccatgaccaccagcacgggcacggcgacgcacacggaagatttcggcgctctcgcggacgggtcgccggtccgccggtggacgctggagcgggacggggtccgggtgcgggtcctgacctacggcgcgatcgtgcagtcggtccaggcgccgggccgggacggctcccgggcaccggtggcgctcgggctgccggacgtcgcgggctacgagaagttcccggccccctacttcggtgcggtggtcgggcggtacgcgaaccggatcgggggtgcgtcgttcgtcctggacgggcgcacacaccgcctcacgcccaacgagggcggcaaccatgtgcacggcggggccagaggcttcgacaagcgggtgtgggacgcggtggcggtcccggacggggtgcggctgtccctggtctcggcggacggggacgaggggtatccggtgcggctggacttctcggtgacgtacaccctggagcccggcgggacgctgcggctcgactaccgggccgtgaccgacgccccgaccgtgctgaacccgaccagccatctgtactggaacctggcgggcgccgacagcgggagcgcgctcgggcagcagctgcggatcgcggcgcgcgaggtgaccccggtggacgcggagtcggtgccgaccggtgagctgctgccggtggccgggacccggttcgacttccgggggatgcgggcggtgggcgcggggtacgaccacaacttcgtgctggaggaggggacggaggccgcggacgccgtggccgccgagctgtacgacgcggcgtccgggcgggtgctgacggtgcggacgaccgagccgggtctccagctgtacacggccgaccacttcgacgggcggccgttcgggccgtgtgccgggatcgcgctggagacccagcacttccccgactcgccgaaccggccggatttcccgtccacggtgctccggccgggcgaggagttcgtctcgcgcaccgagtacgcgttctcggtgcgctgagacctcctccttcggcgctccgctcagcgggccaggcccagggtgacgccgaggccgaccaggaccgagccgatcgagcggttcagggccttctggcggcgcagcatcgcaccgcgcagccgggagtgcgagaagaacagcgcgacgagggcgaaccagccgaggtgggcggccgacatgaacaggccgtaacccgcctgctgccagagggcggtgtcgggccccacgacctgggtgaaggtggcgacgacgaacagcgtggtcttcgggttgagggcgttggtgaggaagccgctgcgcagcgctccgaacggggagaggcccggccggtccgtcaggtcgacgtcgaggtcggcacgggccaggaaggtgcgcaccccgatgtagatcagataggcggcgcccgccagcttgaccgcggtgaacagggcggtcgaggaggcgatgagcagcccgacgccgagcatcgtgtacgtgacgtggaccaggacgccggccgcgacgccggtggccgcgaggacgccggtggtgcgtccgtacagatagctgttgcgcaccaccatcgcgaagtcggcgcccggcgagatgaccgcgaggacggtgatggcggcgaccgccagcagttcggtcacgcggaccacgcccggggggccggtgcgtcaccgctgtcggcggtgccgggacccgggcccgggtccgacgccgcgtccgggtccaccaggtcgcgggcgaggagggtggccccggcgacggctcccggcatcaggaacaccgcgacgaccgggacgaggaaggccagggtcagcgggacgccgaagccgagcaccagcatccggcgtccgcgcagcaggacgaggcggtccttgaggaccatgccccggcgctggagggcgacggcggtcagctcctcggccaggaagtagccggatacgcagaagccgatcgcggggacgacggtctgcccgatgacggggatgaaaccgcaggcgaagaggatgatcccgtagaaagcgacgcgcagcaggatgcgcagcgagtcgcgggcggagatccacagttcccgccagagcggcagtccggactcggggacgtcgccgccttcgctgcggtcgacctcttcggagagggactcgtagaagggctggccgaccaggagggtgacggcggtgaaggtgatgacggcgagaaacaggccgaagacgaagacgagagcggtcagcccggtgcgcaggattccctgccagggtgaggaccagtcgtcggcgaacggggtcgcccagccgacgaagtcgtcggctccgtagccgagtccgatcagcgctccggcgtagacgacgagggtgacgagtccgggcagcagcccgaatccgaaccatcgtccgtgttgggcaacccagcgttgccccttcatcaagtagccgaaacccgccccgagatcactcatgggcgtcagcgtactggcgtacggaaagcggtaaggaacccccctgggaccgcaccccggggcggggtgcggtcctcgtacggcgctgtggtcggcggcgctgcggtcaggcgacggagagcgtgacgtcgatgttgccgcgggtggcgttcgagtacgggcagacctggtgggccttctcgatgagcgcctgcgcggtggcggcgtcgacgttcgggatggacgcgctgatcgcgacctccaggccgaagccgccggcctccgtcttgccgatcgagaccgaggcggtcacggtcgagccggagatgtcggccttctcctggcgggcgacgacaccgagcgcaccctggaagcaggcgctgtagcccgccgcgaagagctgctcggggttggtgcccgcaccgctgccgcccatggccttcggcgggttgacgacgacgtcgagctgaccgtcgtcggaggagacccgtccgtcgcggccgttctcggcggtggcgacggcggtgtaggcgacgtcgatcttctgaatggtcatgatgtgaggattcctcctgttggtgcgccgcgactcgcgcccacggatcgcgacggcctgcggacgagcctaacgcgtgaccgtgaccggcagggagcgggtcagaccagggaaacgatcatcttcccggtgttctcaccgcgcagcagtcccacgaaggcgtcgtagccgttctcgatgccttcgaccgtcgtctcccggtacttcagctcgcccgaggccagccagccggcgacctcctggacgaactgcggctggaggtcggagtggtcgccgacgagcatgccggtcaggcgcagccgcttgccgatgatcagcgccatgttgctcgggccgggggtcggctcggtcgcgttgtactgggcgatcattccgcagatggtggcgcggccgtgcacgttgaacgaggagatcgcggcttcgaggtgctcgccgccgacgttgtcgaagtagacgtcgatgccgtcgggggccgcttccctgagctggtcgcggacgggcccgttcttgtagttgaacgcggcgtcgaagccgtactcctcgacgaggagcttgaccttctcgtcggagccggccgagccgatgacccgggaggcgcccttgagcttcgccatctggccgacctggctgccgacggcgccggccgcgccggagacgaagaccgcgtcgccctccttgaaggaagcgacgtcgaacaggcccgcgtaggcggtgagtccggtcatgccgagcacgccgaggtaggcggagagcggggcgagttcggggtcgaccttgaccgcgagctgcgcgggaacggcggcgatctcgcgccagccgaggccgtgcaggacatggtcgccgacggcgaagccctcggcgttcgaggcgatgacctcgccgaccgcgccaccgtccatggggcggtcgagcttgaacggcggggtgtaggacttcacgtcgttcatccggccgcgcatgtacgggtcgaccgagaagtacttgttgcggacgaggacgcggccctcggccggagcggcgacctcggcctcacgcagcgcgaagtcctcggccttgggccagccgtgcgggcgggcgaccaggtgccattcgcggctggacgtgggaagtgctgcagacatgggctcgggttctcctcaatgtcatacgagggggtgtgcttccgcgccggtggcacgaaaagcttcatgacatgaaacaaccatgctcctgaatatttcatgatgtcaagtaaatcggtacgctgggacccatgaccactcgcacagaccccctgacccttgaggtcgtcgagctcatcggctccgtcgtggcgcgctaccacgaggagtacgaccgggccgccgccgagcactccctcaccggggcgcaggcacgggtgctcgggctgctctcgctggagcccctgccgatgcggaagatcgccctcaggctgaagtgcgagccgtccaacgtcaccgggatcatcgaccggctggagacccgcgagctggtcgagcgcaggcccgatccgtccgaccggcggatcaagctggccgccgcgacggagaagggcaggcgcacggcccgtgagctgcgggacgcgctggacttcgcccgggagccgctggccggactctccgacgccgagcgcacggccctgcgtgacctgctgcgccggatgctgg

SEQ ID NO: 2785 - DNA, 9922 bp, Unknown
  Kingdom: Bacteria, Phylum: Actinobacteria, Class: Actinobacteria, Order: Streptomycetales, Family: Streptomycetaceae, Genus: Streptomyces
cgacccgcggcgggtcggcatggcgggccactccatcgggggcaacgcggcctcctccacgatggccgcggaccgccgggtggacgcgggggtcaatatggacggcaccttcttcgacccggctcccgtccagggactggacgggcggccgttcctgatgctgggcaccgaccccgggcacggccccggcggcgacacgtcctgggacgacgcctgggaccggctggacggctggaagcggtggctgacggtgcgggactccgggcacttcaccttcactgacaccccggagatcggtgagcagctcggcatcgaggacccggacgcgccgctgtccgccgcgcgctcgaccacgatcaccaggagctatgtgacggccttcttcgaccggagcctgcgcggccggccggcccggctgctgaacggcccgaccccggccaaccccgaggtcctcttccagcgtccctgaccgtgcggacagcacgacagcgccctcggaccaccacgttccgtacgtggtccgagggcgctgtcaggacggccgagtggtgccgagtggtgctaggcggtgacgggcaccgcgctcttgggctccgcgtcgcggacctcgtcccggtcggtgtcatcgaaggagtcgatcggggaggccgaggccgagttgtacgcgtcgtggtcgaggatcttctcccgggccgcgacgatcaccgggaccagcgcctggccggccacgttggtggcggtgcgcatcatgtccaggatcgggtcgatggccatcagcaggccgacgccctccagcgggaggcccagcgtggacagggtgagggtcagcatgaccgtcgcgccggtgagaccggcggtggccgccgagccgatcaccgagacgaaggcgatcaggaggtagtcgccgatgcccagctgcacgtcgaagatctgcgcgatgaagatcgccgccagcgccgggtagatcgcggcgcagccgtccatcttcgtggtcgcgccgaacgggacggcgaaggaggcgtactccttcggaacgccgaggcgctcggtgaccttctgggtgaccggcatggtgccgaccgaggagcgggagacgaaggcgagctggatcgccggccaggcgcccttgaagaactggagcgggctgaccttggcgacggtggccaggagcagcgggtagacgccgaacatcaccagggcgcagccgatgtagacgtcggcggtgaacgtcgcgtacttgccgatgaggtcccagccgtagtcggcgatggcgtagccgatgaggccgacggtgccgatcggagcgaggcggatgacccaccacagggccttctggagcagctccaggatcgactggctgagggtgaggatcggcttggccctgtcgccgagcttgagggcggcgataccggcgacggcggccatgaacacgatctggagcacgttcagctcggtgaacggcgtgatcacgttgtccgggacgatgccggtcaggaagtcgatccagctgcccttggtctcggagagcgcgccgtccttcggcgtgaggccggtgccggagcccgggttggtgatcaggccgatcgcgaggcctatggcgaccgcgatcagggaggtgatcatgaaccagagcagggtgcgggtcgcgagccgggcggcgttgttgacctggcgcaggttggtgatcgacacgaggatcgcgaagaagaccagcggggcgacggccagcttcagcagctggacgaagagcgagccgatctcgtcgagggtggtgacgagccagccgaggtcctggctgcgggccagccagccgagcagcacgccgaggaccagaccggcgacgatctggacccagaacgggacgctgggtatgcggaaaccggagccggagccggtgggctgctcggcctcgggggtggcggacgcgggattcgcggacacggacacactccaactggggacgcatcgggacgcacggaggcaaccgtgcggtcgtgcggtggaacggggacggggtcgcggcgcccgcgtcgggggcggcaccgctgcatgatgccgtatcagacctcgcggcaacagaccgcggacatacagcggcagagatcgacatgcaggcgcgccacgagcgggatgctcgcggcatgacggaggcgcacagctgtcttcatgtcgaatacgttaacacttgaactttgggaacctcaaagcctttctttggctcccgggcatggttccgccgggcaggaaaggctgaaaagcaccggaaaacagcggagaacgccgcggaccccggtgctggagcctgtcggctccggcccggggtccggcggagaagaggtgcgcgcggtgtgcgcgtgtgaggaagcttacgcggcgcctacaggtgtcgcaggtgctactggaccgcgtcctcgcgggtgcggttggcgtcgaggcgcgccttggtgcggtcgacggtggaaacgatctgctcggacatctcgtcgcgctgcctgcgcagcagcacgtagctgagcggggcggacaggaggaggccgaggaggatcacccagacgacgttggagcccccgagccctgcgggcaccagcccgaagtggacggcgacaccggcggcgaggaagcagccgacgaagatcagcaggcgcaacgccgtgtaacggatcaacgcgctcggcttggcagcggacacggctggccctctctcttcccatggactctcgacacgcttctgcccgtccagtgaagcatggcccgaattctctcggttcagggggttgccgggcggcgggagttcttggctcaaagggctgccgggcggcgggagttcccgggtcagggggtcgccggccccagcgggagcagcatgatgacgtcgtcccggtcgtcgccgggagcgacccggatcgcgtccggcacccggccgacctccttgtatccgcaggcggcgtagaaacggtcggcgccggtgccgccccggcaggtgaggcggatcgcctcgatgccctcgacggagcgggcggcgtcggcggcggcggccatgaggtcgcggccgtaccccttgccctggtggcgggggtgaaccatgacggtgtagagccacagccagtgcttcatcagccggtgggtgttcagggcgaggaaggcggtggcggcgacggtcccgtcctcgtcccggccgaccaccagccgggtgcgaccgtcctcgatggcgaccaggtgcttcagcagctcgggccggatctcctcggccgtgacgggcggaacgaagccgacggcgccgcccgcgttgctgacgtcggcccacagcgcggtgatgccgtcgcgcagggcgggggtgaacgagggatccagctcgaaggtaagcgccataagcgcagactaaccattacgccccgctcggctcaaccctgtccgaaacgcgagaaagccccggccggggacggcggccggggctttcgttcggtgtggggtcggacagggcggccgtcagacgcgcatcggctgcggggactcgcggcggtccgcctccggacccgggtactcgcgcaggatctcgtaccgggtgttccgctcgaccggccggaaaccggcgtcgcggatcagctccagcagatcctcgcggccgagcttgttcggcgtgccgaagtcgtcggcgtcgtgcgtgatcttgtactcgacgaccgagccgtccatgtcgtccgcaccgtgctgcagcgcgagctgggcggtctgcacgccgtgcatcacccagaacaccttgacgtgcggcacgttgtcgaagagcagccgggagaccgcgaaggtcttcagcgcctcggcgccggtcgccatcgtggtgcgcgcctggagcttgttgcggaccttgccgtccttcatgtccacgaagtcgtgctggtagcgcagcgggatgaagacctggaaaccgccggtctcgtcctgcatctcccgcagccgcagcacgtggtcgacgcggtgacggggctcctcgatgtgcccgtacagcatcgtcgcgggggtcttgagccccttttcgtgcgcgaggcggtggatgcgcgaccagtcctcccagtgggtgcggtggtcgacgatgtgctggcggacctcccagtcgaagatctccgcgccgccgccggtcagcgattcgagaccggcctcgatcagctcgtcgaggatctcggaggccgagaggccggagatcgtctcgaagtggtggatctccgtcgccgtgaacgccttcagcgcgacgtccgggagggcttccttcagcgcgctgagcgagcgcgggtagtagcgccacggcagggtcgggtggagtccgttgacgatgtgcagctcggtgaggttctcgccctccatcgccttggcgaggcggacggcctcctcgatgcgcatcgtgtacgcgtccttctcgcccggcttgcgctggaacgagcagtacgcgcacgaggcggtgcacacgttggtcatgttgaggtgacggttgacgttgaagtgcaccacgtcgccgttcttgcgcgtgcgcacctcgtgcgccagcccgcccagccacgccaggtcgtcggacgcgtagagggcgatcccgtcctcgcgggtcagccgctcgccggcccggaccttctcctccagctcgcgcttgagtcccgcgtccactaggccgcctcccatatctccgtgtatcagactccgaccaaccgtacgcctacgcctcttcggggagttctccgacccggttctcccacttggtggagagcacgatcgtcgtacgcgtccgggagacgcccttcgtaccgctgaggcggcggatcgtcttctccaggccgtccacgtcgccgaccctgaccttgagcatgtacgagtcgtcgcccgcgatgaaccagcagtcctcgatctccgcgagatccttcagccggcgcgccacgtcctcgtggtcggccgcgtccgagagcgagatcccgatcagcgcggtcacgccgagcccgagcgacgcggagtcgacggtggcgcggtagccggtgatgaccccggcggtttccagccggttgatgcggtcggtgacgctgggcccggagagccccacgagccgtcccagctcggcgtacgaggccctgccgttctccctgagggcctggatgagctgcctgtccaccgcgtccatatgactgaagccttccattgttcagcagtaccgcgactttacgtgtagaatctaaggcatgcagggctgacgccctgcaaatcttctagaacatccaagaaacgctttcgaatcttcaggagtgaacttcaccgtgtacacgatcgagatggcctacgcccggatgcgcgagctgcaggacctggccaaccgctcgcgtgcccaccagcccgccgccgcgcaccgcgtcgacaagacccgcaccccgcgcgcgcacaagaagcgctgaccaggacctatcggtcctgagggcctcgggaaccgccaccgagctctccttcccaacggcggtacagccggtgcggcacgcctcccgcgtccagcacccgccccgcgacgaaatccaccagatcctggatgtgcgtcgcacccgcgtagaacgccggggaggcgggcagcacgatcgcgcccgcctcgtccagggccaccatctgcttcagcgtctggccgctcagcggagtctcgcggaccgcgacgacgagcgggcggcgctccttgagcgtcacgctcgcggcccgctggagcagatccttcgacagaccgagcgccactccggccacacaggccgtcgaggccggcacgatgagcatccccttcgcggggtacgacccggaggacggcccggcggccagatcaccggcgggccagtggcgtacacgctccagctccgcctcccccaccgcgaacgcgtccggcttcccgtcggccccccgctccagccaggtccgcaggtcctcgcgccagtgcccgtcccggaacgcgatgccggtctcgtccagcagcgtgagccgcgaggcccggctcaccaccaggtccacactctcgcccgccgccagcagcccgcgcagaacggcggccgcgaacggggtccccgaagcgccggacaccccgacaatccaaggccgccgctgctgatgagtcactgaagtcctggattccacacctgcgagcctatccggcacgccctcgcgcccggcacccggaaccgggcgggcgccgcagacgttcaccgggtgacgggcaacccgggggcaggggcagaccatgggcgactactggaccaccgaccgcaccacgagcaacggcaccaccggcggtgcgcgggccctgaccgccgggctcctgatggcgggctgggtggccctgctgtggatcctcgaaggaatcgacacggccacgggaaacgccctggacacctacggcatcagcccgcgcgagacggcggagctgcgggacgtggtgcccgccgcgttcctgcacagcggctgggagcacctggcctccaacaccgtcccgctgctggtcctcggcttcatcgccgccctcgcgggactgcgccggttcgccgccgtcgtcgtgacgatcatcctggtcagcggcctcggcgtctggctgaccgccccgtcggacacggtgacactcggcgcgtccggcgtggtcttcggactgctcggctatctgctggtccgcggcttcgtggaccgccggccctgggacgtcctcataggcgtcggcgtcgccgtggtctacggctcgctgctgtggggtgtcctgccgaccgactcgggcgtcagctggcagggccacctgttcggcctggccggcggggtggcggcggccttcttcttccgccgcccgcgccgcgcaccggaccacctggtcacggtctgaaccccggccggcccgaagcctcggtgccgcacgggtcttacgagccttacggcgtgaggccgcggaccagcaggtcgagcagcgcgcaggcgaacagcgcgatgccgatgaagccgttcaccgagaagaacgcccggttcagccgggacaggtcgtgcggccgcaccacccggtgctcgtagacgaacgccaccgcgacgatcaccatgccgatccagtagaagacctcggcgtccgtggccagcccgaaccacaccagcagtccggtcgtgaccgcgtggcacacccgcgcgccccacagcgcggccgggatcccgaagcgcgccgggaaggagtgcaccccgtgggcccggtcggcagccacgtcctgacaggcgaagatcaggtcgaagccgccgatccagatccccacggcgagcccgaggatcaccgcgtcccacgaccagctcccggtcaccgcgagccaggcgccgaccggcccgatggcctgcgcgaggcccagaatggcgtgcgggaagttcgtgaaccgcttgccgtacgggtagaccaccatcggcacgacggccagcggcgcgagcgccaggcacagcgggttgagcagggccgccgcacccaggaagaccgccagcgcgacgagcgcacccgtccacgcggacttcaccgacaccgcgccggtcaccagctcacggccggcggtgcgcgggttccgggcgtcgatctcccggtcgatgatccggttggcggccatcgcgaacgtccgcagacccaccatcgccagcgtgacgagcagcagcgtgctccagtggatggtgccgtccagccggaacatcgcggtcagcgcggcgatgtacgcgaagggcagcgcgaagaccgagtgctcgatcatcacgagccgcaggaaggccttcaccttgctgtccgatggcgcgggcccgggaacggacgccgcttctgccgtactgctcacagcccgtattccttccagcgccggtcgaccttcgccgccgtctccgggtcggagacgaccatctccggccatccaccgtcccgggtgtagccctccgtgggcagcttcctggtggcgtcgatgccggccttgccgccccagaactgctggtacgaggcgtggtccagatggtcgaccggcccttcggtgaccgtgaggtcgcgggcgtagtcggtgttgccgagtgcccgccaggcgacctcgtgcaggtcgtggacgtcgcagtcggagtccaccaccacgatcagcttggtcagcgacatcatgtgtgcgccccagatcgcgctcatgaccttctgcgcgtgcttcgggtacttcttgtcgatcgagacgatcgcgcagttgtggaaaccgcccgactccggcaggtggtagtccacgatgtccggcacgatgatcttcagcagcggcaggaagaaacgttccgtggcccggcccagcggcccgtcctcggtcggcgggcggcccaccacgatggactggagcagcggccgcttccgcatggtgacgcagtcgatggtcagtgcggggaacggttcctgcggggtgtagaagccggtgtggtccccgaacggaccctcggggagcatctcgcccggctccagccagccctcgatgacgacctccgcctgcgcggggacctggagcggcacggtcttgcagtcgaccatctcgatccgcttgccctggatgaacccggcgaagaggtactcgtcgatgtccccgggcagcggcgcggtggaggcgtacgtcacggccggcggcgcgccgaaggcgatggcgacgggcagccgctcaccgcgccgggcggcgacctggtagtggttggcgctgtccttgtggatctgccagtgcatcccgatggtgcgcttgtcgtgccgctggagccggtagaggcccaggttccggacgccgttctcggggtgcttggtgtgggtgagacccaggttgaagaacgagccgccgtcctcgggccaggtgaacagcgcgggcagcttgtccaggtcgacgtcgtcgccggtcagcaccacttcctggacgggcgcgtcggcggacttcaccttcttcggcggcacgtgcaccatcgagccgagcttcccgaaggcctcccgcaccccgacgaagccctgcggcagctccggcttgaggagtccgccgatcttgtcgctgatgtcgctgtacgacttcagtcccagggctttcaggaggcgccggtcggtgccgaagacgttcatggccaggggcatcgaggcccccttgacgttctcgaacagcagggcgggcccgcccgccttgttgacccggtcgacgatctcgccgacctccaggtgggggtcgacctcgaccttgacgcgcttgagatcaccatcgcgctcaagagcccggagcagggagcgaagatcgtcgtaagccatgcggtccagtttgtcatccccgcgcccgcggccccgccggggctcccccggcgccgcgcaccgaaagcccgccgatcgtccgcgcacgcgcccggcaggaccggctccgggccccggatccttcatgtcgagccggtaccctggccgcgacaccgggcgccatcccgcccgccgccgcttcctgggggacgcaccatgagagccctgatgttcatcgtcccgctggctctgacgatctacgcgttcatcgactgcctgaacacctcggaggaggacaccaagcatctgccgaagatcgcctgggtcttcatcatcctgctgttctggatcgtcggccccgtcgtgtggctcgccgccggcaggacccgccacaacagggccgggggcgcgggacccggctcgtggcagcggaacaggcggcagcagtgggtggccccggacgacaacccggacttcctcaagtcgctcaaggacgacaaggacgccgaggccgaagccgaggaggagcggggccgccgcgacggcggtacgggccccgacgacaagaccccgcctgcctcctgaccgcgcaccgccgccccgtcacgcaccacggctccccggatgagaatccgtccggggagccgtggtgcgtga

SEQ ID NO: 2786 - DNA, 4733 bp, Unknown
  Kingdom: Bacteria, Phylum: Actinobacteria, Class: Actinobacteria, Order: Streptomycetales, Family: Streptomycetaceae, Genus: Streptomyces
ccgtccggcgattgaggacatctttcaaacccgcgcccgggaacggcgaccgcacaagaaggaggcgcacccggtcacccggatgcgcctcctggagcgacgcgtacgcacgcgcgaaccgcagcacgcacgcgtcacacctcagtgaccgtcaacggtcaaaacgctcgcgcgcctggtccttcgcgtcccgggcacggtccttcatgcccgaggaggagtccgactcctggtcacggccctgggaggcccggtcctgggcctcgtccttgccctgaccggccttctgcttggcctggtcggcgagctcctgcgccttgtccttgaactggtctgcgatacccatgctgttcactcctgtgggatgcgtggggtacgtgggggatggccccctgcggggcctcgcccagcgttgcacgacccgacatcccacgcatttcgtaccgttacggtcggtcagcacgctccgcacgcgcgtcctggtccgccgctcccccggcccccacgagccccttcgacaccgtgtggagccgcggctcgaagcgccgcatctcgcgctgtccgccgatcgcgatgacggagggcagacagccacgcacggactgcatcccgcgcagccaccactgggcgtacacgtgcggggagcgccgcgcgatcccgtccacgatccggtcgacggccgggccgagcggatacgtgcggttcatcggccacggcagccgttgacgcagctcgcgcatcacgtcgtcctggtccgcgccgcgcaccatgtcggtgtcggtccaggagaggtagccgacgccgaccttgacgcccttgtagccgacctcggcgcgcaggctgtgcgcgaaggcctcgacacccgacttggacgcgcagtacgcggtcatcatcggggccggggtgatcgcggccagcgacgctatctggaggaagtagccgcggctctccatcagcaccggcaggaaggcccgcccggtgaccgcgccgccgatcaggttcacctcgatgacccgccgccaggcgtccgggtcggagtcggcgaacggaccgcccgaggcgacacccgcgttggcgacgaccacgtcgaccttgccgaagcgctccttgacctcgcgcgccacctgggccatcgcctcgtggtcggtgacgtcggcgaaccagtggtcgctctcgccgtgcagccgctcggagacgtgtttcagctcgtccggctccaggccgaccagcgcgagggtcgccccgcgtgccgacagcttccgggccagcagctcgcccacgccccgggccgcgccggtgacgacgacgacctggccctccagactccgcctgctgctcatgcgacatcctccttctccgccgtggcggccttccccgtggcggccgtccccgtggcgacgtaccgggcgaccagttccctgatcttcgccgtgacggcctcgggggcctccaccggcgtcatgtgtcccatgcccgccagctcggtcagcccgaggccgaccggcagcgcggccgcgatggcccgcgcgtggaccggcggggtcagccggtcgtcggtgccggtgatcaccgcggtcggcacccgcagctcacgtacgcccgccgcgaggtccagctcggcgagcacatggccccattccaccctcgcgcggcgcgggcaggcgtgcacgatgcgggcgcaggcgtcgacccggtccggagccgaaccgggtcccatcgtcgcgtacttgaggatcttcctggagacggggttgaccggaccgagcggcgccttcgcccccagtacggcggtggtgatccgggtccgcagcgcacccgcgcgcagcggcaggacgcgggcctcggcggccagccgcgtactgccggtggaacagagcagcacggcggcggcatgctcgcgcagtccggggcgcgcggcggcggccatcaccgtcatcccgcccatggagtgcccggcgagcaccgccctgcggcccggggcgagcgtcgcggcgaggaccgcttcgaggtcgtcggccagcgcgttcgtgctgtagccgccgggtcccggttcggaggtgagcccgtggccgcgctggtcgtaggcgatgacccggtggtcggcggccaggtcgcggatctgggcgtcccagaaacgggtgttgcaggtccagccgtgggccaggaccaccgccggggcgtcctcggggccgtgcagttcgacgtggatccgcgagccgtcggcggagcgggcggtcaactcggcggcgggcaccggcggtacggtgtcgcggtgcaggaggcggctcatcgcgcggcctcctcggcgacggaaccggcgtccgtaacggcggtcacggtctcgcgatcggtgcggccgggctgtcccggtacgcgaccgctcccggcggcccgccgtgtcccgcccgccgcgccgacccggacgacgtcgtattccgcgaggtccaccgaccgcgtctgccgccggaactcactggtggtgcctggccagacggtggtgttgcggcccgcctcgtccaggtaccagctggtgcagccgccggtgttccacacggtgcgcttcatccgctgctggacccggtcgttccacgcggtgacggcggcggagcgggcaccgagtgcggcgcgtccgcccagcacgttcaactgccgcaggtagtcggccatgtagttcagctgggactcgatcatcaggatcatggaggagttgccgagcccggtgttgggtccgatgatcgtcatccagttggggaacccggcggcggtcgcgccgcgcagcgagttcatcccgtccttccaggactcggcgagcgtgatgccctcctcgccgacgacccgctccgcgatcggcatgtccgtcacatggaagccggtgccgaagatgatcgcgtcgacctccgcctcgctcccgtcggcggcgaccaccgtgttgccgcgtatctcgctgagcccggaggcgacgacctccacattgggctgggcgagggccggatagtaggtgctggagagcaggatccgcttgcagccgatgcggtagtcgggggtcagcttggcccgcagggccgggtccttgatcgcccgcgccatgttggacttggctatcttctccaccaggcccagctggtcggggtgcttggtgaaggcgctgacctgcaactccctgatgccccagagaagtccgcggcgtgccgtgccggtgacggggacggcccggtgcagtgcgcgttcggccttgctgatcgtgcggtccatgcgcggcatgacccagggcggggtgcgctggaagagcgtgagcttcgcggtcctcggctgaatcgccgggacgatctggatcgcggacgcgcccgttccgaccatcgcgacgcgcttgccggccaggtcgtagtcgtggtcccagcgcgcggagtggaagaccttgccggggaaggagtcgagcccgggtatgtccggcatcttggggtccgagagcggcccggtggcggagacgacgacatccgcgtggagcacggacccgccggcggactcgatcacccagtacaggttctccttgtcccaggtcatcagcttcacctcgtggttcagcctgatgtgcgggcggagcccgaagttgtcggcgacgcgctccaggtaggcccggatgtgctcctgcccggagaaggtgcgcggccagtcggggttgggtgcgaacgagaaggaatagaggtgggacggtacgtcgcaggcgcagcccggatagctgttgtcgcgccaggtgccgcccaccgagtcggcccgctccaggacgacgaaatcggtgatgccttcgcggcgcagccgtacggcggcccccaggcccccgaatccggttccgatcaccgccacacgtacgtgctcctgctgggccatgctgccgcctcccgcggtacgtcacacgactctgccagcaatcactggcattgttcggagagtagagcaggaccgtactgatgggtagggggcggacggaggaaagttaccggcggtacaacatagggtgcccctgtggccgaaggacgcgagcaccgcgaataccgcatggaggagctggccgaggaggccggcatcaccgtgcggaccctgcgcttctaccgggagcgcggcctgatcccgccgcctcgccgcgagggccgcatcgcctggtacgacgaccaccacctggcccggctgcggaccatcacgggcctcctggagcgcggccacaccctcaacggcatcgccgatctggcggccaccttcgagagcggccgcgatgtcgccgaggtgctgggcctgggcgaaccgaccgaggagaccccggtccgcctcaccccggagcagctcgcggactacttcgagggcgaggtcacgcccgagaacctcgccaccgcactggacctgggctatctcgccaccgacggggacgagatcgtgcacatcagccgccgcctcctggaggtgtcggccgagctcgtacgggaaggggtgccgctgtccacggtgctctcctcgggccgccgcgtccgcgagcacgcggacgcgctcgccgagatcttcgtacgcgtactgcatgcccacaccaaggagaccgaaccggcgcaactccgcccactggcccgcgcggtggtggacgccgagctgtccatggccctcgaccggaggctgcgccgcgaggacggcacacagcccccgaaggcggagtgacctcgtgagccgctgaagccaccgggccggcccgg

SEQ ID NO: 2787 - DNA, 6209 bp, Unknown
  Kingdom: Bacteria, Phylum: Actinobacteria, Class: Actinobacteria, Order: Streptomycetales, Family: Streptomycetaceae, Genus: Streptomyces
cgctgcccgccctggtgccgctcggaccggccccgagtgcggcggccgcactggaccgggtcccgctggtgccggaccggaatggcggcgtccgggaccggttcgcgcagctgaccgggttcccggtctggccggggcccgaacaggacaccgacccggggcaggggcccgtcggccccgagtcggcccggtccgcgctccgggagctggtgcgggcctcgacgcaccggtacgcgacccatgcgcacggcgagccgatcatgctggtccacgcggcgaccgcccccaacgcggtcctgcgcaccctgccggccctgcccggtgagctgtgggagccgagtctgcgggccgcctgggcggcgagcgcggtggtcaccgccgcctacgcaccccgtgaggcggccccggttccggcgtcggcctccggcgtcccggacgccggggagctgttcgcccgggctgcggcgcacggcgacgaccacaccatcaagttcaccgacacggcactggacgtgggcgacgcgctcgcgttctccgccgcccggcgcgcgatcgagctgaatccgccggtcctctaggcgttccggaggtgcttcggagcgccctgatcccctcagccgaactgcaccgagcgcttcgccaaccccatccagaagccgtcgatgacgctccgcccccggtccagctcgtccgcggccgctcccagcgtcacgaacagcggcgcgaagtgctcggtgcgcgggtgggccagcctcccggccggggacgtgtgctcgaagtcgatcagtgcgtcgatgtcctgggcccgcagcgcgcggtcaccccagtcgtcgaactccgccgaccagccgggaacgccgccgccctggtggcgcagagcggccaggttgtgggtgaagaagccgctgccgacgatgagcacgccctcgtcgcgcaagggggcgagtttgcgcccgatgtccatcagcttccgcgggtcgagggtcggcagggagatctggagtacgggaacgtcggcgtccgggaacatctccaccagcggtacgtacgccccgtggtcgaggccgcggtccgggatgtcctggaccggcgtaccggcgccgcgcagcagcttgcggacgctgtcggcgagctcgggcgcgcccggagctccgtaacgcaccccgtagtagtgctcgggaaaaccccagaagtcgtacacgagcggcacggtctcggtggcgcccagcgcgagcggggcctcttcccagtgggcggagaccatcaggatcgcgcgggggcggggcagccccgcggaccaggcggcgagctccccgggccagacgggatcgtcggccagcggcggtgcgccgtgcgagaggtagagggcgggcatccgctccgcggtggctgtcatggcactcccatccactggacgcggccccagggcgacaggcgccgcgctgggcgcacaggacactggatccggtcacgaactcgtccgagcaggagttccccgaggtcatccgggggatcgttgttcaggggccctgcgaaactccttcggatcccctgcggggatctctcggggcaggcttcttgaaatttcaagttcctacctccggagaccttagccctatctagttaaactttcaagaaaaggtcgtacagtggagtacatgaccacggcatccaccagcgcgccgcgctggctcaccgacgaggagcagcacgcctggcgcgcttatctgcatgccaccacgctgctggaggatcacctcgaccgccagttgcagcgcgatgccggcatgccgcacatctattacggactgctcgtccagctctcgcaggccccccgccgccggatgcggatgacggagctggcccggaacgcgaagatcacccgttcccggctctcgcacgccatcgcccggctggagaagaacggctgggtgcgccgcgaggagtgtccctccgacaagcgcggccagaacgcggtgctcaccgacgacggccacgcgatgctccgccgctcggcgccgggccatgtcgaggccgtacggcaggcgatgttcgaccggctcacgcccgagcaggtgagcagcctcggggagatcatgcgggtgctcgcgaccggtctggagccggagggcacggacgcggatctgccctggctccgctgagcggaaccagggcagaggacctacctgggcggagaaggaaccgccgtcgtcagtgggcgacgaccggaatcttgaactcctcctcggcccccgcgtcggacgcgccgtccgtcccaccggaacccattcccgggcggccggtgttgatgagggcgatcgcgatggcggcggcggcgacgaggatgccgacagcccaccagatcgcggcggcgaaaccgctgaccatggcctggagctccaggagctgcgggtccgtggcgcgggccgcgtggtcggcgacgtacgcggtggtggcgctcgcggcgatggtgttcagcagggcggtgccgatggcgccgccgacctgctgcgaggtgttgaccatcgcggaggccactcccgcgtcacgcggctcgatgccgtgggtggccagggacatcgccggcatgaacgccgtacccatgccgaggccgagcagcagcatgccgggcaggatgacggccgcgtagctggtgttcaggtccagctgggtcaggagcagcatgccgaccgcggcgaccaggaagccggggcccatcagcaggcgcggcgggacccgggtcatcaggcgggtgccgatctgggtggaaccggtgatcatgcccacgatcatgggcatgaacgcgaagccggtcttgaccggggagtagcccttcacgacctggaggtagtaggtcaggaagaggaacagcccgaacatcgcgatgatggcgagacccagcgagaggtagaccccgccccggttgcgctcggtgaggacgcgcaacggcagcagcggcgacttcacccgcgcctcggtcacgacgaaggccagcagcagcacggcggcggcgacgaacatggagacggtcgtcgcgtccgaccagccggcggactcggcgcgggtgaagccgtacaccagggcgaccaggccgagcgtggagagcacgacgccggggatgtccagcggtgcgcggttgcgggtgccggacggctcacggatgacgaagtacgcgcccgcggcggcgacgatggcgaacgggatgttgacgaagaacgtccagcgccagttcaggtactcggtgaggaagccgccgaggatcagcccgacggcgccaccgccaccggcgatggccccgtagatgccgaacgccttggcgcgctccttggcgtcggtgaacatcacggcgagcagggagagcgcggccggggcgagcagggcgccgaagacaccctggagggcccgggagccgaacatcatcgcctcgttctgggccgcaccgccgagcgcggaggccagcgcgaagccgatcagaccgacgacgaaggtgcgcttgcgcccccagaggtcggcgatccggccgccgaagaggagaagcccgccgaaggccagggcgtaggcggtgatgacccactgcttgttgccgtcggatatgccgaggtcggtctgggcggagggcagcgcgatgttcacgatggtcgcgtcgaggacgaccatcagctgcgcgagcgcgatgaaggccagggctttccagcgactcggatcgggaagggcggtgtcagccgtttttgacatgggtgtagccacctaaggacgtgcgaggacgccgaggcgtcgcgtaatgggcgccggagtacgtgctggtgtacgcgcgacgggatgacgtgggttcgtgggatgcgtaaggccgcgtaaggacccgcggtgggacacggcggtccacgtacacgggatgggcgtacgcgggagcgcgtttcccggtgacggacaagcgtcgggcggacacccgcgggcgttaccggtaagggcgggacagggccggaaggttcaggtcggcgcgggggtcaggggcgccgcaggtcctccaaggtcgccgccgatccgggcagttcggaacgggccggagtctccagcccgtccaggaacagctgcagatgacggtgggtgaaccggtcgatgccctggcaggcgataccggggagcggccgggtgagctgggagagggcgacgagtacgtcaccgacggcgatgtcggtacgcagccgccccgcggacatggcgcgcgccacgagcccttcgacggcctcttcgaggcgccggcgctcggcgagcagttcgggatggtccctgtcgaagacgccggagagcatcgggcacagggcaccgatccgttcgtcggccgccgcgtgcacgaaacggctgagcgcggcgaacgggtcggactccgtggcggcggcctcttcggcccggagggtggtgcgggaggtgaccgcgaggacgacctcgtgggtgagggcggcgcggtcggggaagttccggtagagcgtggcgttgccgacgcccgctcgccgtgcgacgtcgtccagtgccacgtccggcccgaactcgacgaacagctcgcgtgcggccgcgacgatccgctcacggttccgcagcgcgtcggcccgcgggcgcggcgctcggcacggtgccgccggtgcggtgctcttcgcggcggtctcggcgacggtctccacgacgctcctccccttccctctctgtagccggtcggcccctttcggtaaccggggaccgtttccccgtttagcggggacacgtatgcaaacggggaggggatccccgcttatttcccacccgaacgtgacctggctcacatcacccctggaggcaaatcctcctcgcgcccggaggaaaaccctccgatcggcgcacccagcgagcggccccggaccacccggcacaggctgatcgccagagcgcagtcaggggtcggccgactgccgcggaccccgaaggcgcctctatgcagcagccccgccaccggatacgcagacaccgccgcccgatcgccctggccggagcgaccgcgctggtcatagcggccatggcctcggccagcaccacccttccgaccgccggccgcgcctcggcgggcccggcggccaccagccaggactccgcgctcgccccgtgccggatccccgccaccatgggcgtacagatgtccgagggcctgccgaccccgcccggctacgcccggtcgaccggcgagataaaggcgctcaacctgatgatcgacttcccggacgcggagggcaccgaacccgcggcggaccggtacgcggagttcttcccgcagacctccgagtggttcagggccagctcctacggccggctcgtctaccggcccgaggcccccgtccaggactggctgcggatgccgatgcccttcacggagtacgggatagagcgcggctcacccttcgagccgggttaccgccaactggtgaaggacatcgtcgcggccgccgacccccgggtcgacttctccgcgtacgacctggtcaacgtcctggtcagcccgaacgccggcccctccgcgctggacaccgtgctctcggtgaccttctccggcaacgacgaggccccgacggcggacggtgtcccgctctccaacacgtcgttcgtctacagccgccaggacgacggatcggggtcgtacgcggagaccggctaccgcgtcctgccgcacgagaacggccatgtcttcggactgcccgacctctatacgatggagggcggcggctcggtcgggcactgggacatcatgtccgaggactggggcgccaacaacgacttcctggcctggcacaagtggaagctcggctggctcgacgacgagcagatcagctgcgcctcggggcccggtgtcagcgagcacacgctcggcccgctggccaccgagggcggcaccaagctggccttcgtcccgctgagcgcccagtccggctatgccgtggaggtccgtacggcggcgggcaacgacgaggcggtgtgccggcccggggtgctggtctacaaggtcagctccgacgtggacaccggccagggcccggtctccgtcgccgacgccaccgaggacagcggcggctgcacccgacgccccaacgtgcacgcggaactgtccgacgccccgttccgccccggccagaccttcaccgaccgggccaacggcgtacggatatccgtgctggacgaggacggcgacg

SEQ ID NO: 2788 - DNA, 2729 bp, Unknown
  Kingdom: Bacteria, Phylum: Actinobacteria, Class: Actinobacteria, Order: Streptomycetales, Family: Streptomycetaceae, Genus: Streptomyces
ggaccgccgcctggcggcggccggcgggggagcggcggcttcggtgcggcgcgcggacgtcgtcgtcaccgcgacgtccgcgcgcgaacccgtggtcgacgggcgggtggtgcgcgacggcgcggtggtgctggcggtcggctcgcacgaaccggacgcgcgggagctcgacagcgtgctgatggggcgtgccaccgttctggtggagagccgcgcgaccgcactccgcgaggcgggtgacgtcgtcatggcgatccacgagggctcgctcaccccggacggcctcgtcaccctggcggacctgaccggttcacggggagacatcccggccgaccgcccgctggtcgtgaagacgtgcgggatgggctggcaggacctggtggtcgccgtcgcggcctaccggaggaaggaggggacgccgggggagcggagctgaccgtccgccggagcgggtcccgactccgcgcccgcagggcggtccgtttacgtcaacacgcgccgccgcgccctgacttcgacgcgagtggcgcagagcctgcgcggcctcggcgcgtccgcacgcaccgccctgaacggacgtcggcgtcagcgtgcgccgagcttgcgggacggggccgcgcgttcggcttcgcgcttccgggccgcccacagggtccgcacatgcgcgagatggcggcgcatgtgctcctcggccccctccgcgtcccccgcgatcatgatgtccaggagcgcggtgtgctcgcgcgccgaacccaccagcgatccctcctgggacaggtcggtgaggccgtagagccgggagcgtttgcgcaggtcggccacggtctccacgaggcgggcgttcccggcgagggcgagcaggtcgaggtggaagcggcggtccgactccaggtagccgatcaggtcgccgccctgcgcggcggtcacgatctcctcggccaccggacgcaccgcctccaactgctcgcgggaggcggtgcgggtcacacggccgatggtggggatctcgatgagggcgcggatctcggtgtactcgtccaggtcgcgctcggagagttcggtgacgcggaaccccttgttgcgcaccgcctcgaccagtccctcgcgggccagatccagcatggcctcgcgcacgggtgtggcggagacgccgtactcggcggcgagcgtgggcgcggagtagatcacgccgggctggagttcccccgctatcagtgcggcacgcagggcgttggccacctggtcgcgcagatgctcctgcaccgagatgagtttgcgggacttcaactcactcatgcattccccttcaatgatgtggcaccgcactatacaatgtcacgttgcgcggtgcctcatccctcgaaggtcagtgctgtcagctgtccaggaggcgggccatccactcctcgacaccctcgaccgtacggggcagtgcgccggagagcagcttcgccccgtccgcggtgatcaccaggtcgtcctcgatgcgcacgcccatgccgcgcagctcgggcggcagcgtctcgtcgtccggctggaggtagagcccgggttcgacggtgaggacatggccctcctccagtacgccgtcgagataggtctccgcgcgggctcgcgcgcagtcgtgcacgtcgatgccgagcatgtgcccgctgctgcacagggtgtagcggcggtgcaggccgctgtcgtcggcgagcgcctcctcgggcgggaccggcaggatgccccacgcgtgcagtccctcggcgatgacgcgcatggcctcgcggtggaagtcccggaaccgggctcccggtcgcaggacgccgatggcggcctcctgtgcggccagcaccagttcgtagacgtcccgttgggccggcgagaagcggcccgacaggggcagggtgcgggtgatgtccgcggtgtagagggtgtcggtctccacccccgcgtcgagcaggagcagttgggacgggtcgagcggtccgtcgttgcggatccagtgcaggacgcaggcgtgcgcgcccgccgccgcgatggtctcgtaccccgtgccgttgccctcgctccgggcgcgcagctggaacacgccctcgatccagcgttcgccccgggggtggcgcagcgcgtcgggcagggcgcgcgcgacgtcctcgaagcccgccgtggtgtggtcgacggccagttggagctggccgacctcccaggcgtccttccgcagccggagttcggcgagcgcggcgtgcaactcggcgtcccccgccggggtgtgggaccgcgtggccagcaggtcgtccacccgggcgtcgacgccggcgagcagacgggtcggcggctgcgggccggtgaggagtttcgccaggtcgtcgaggtgggtgcagcgcagcccggtcagcgccgccgtctcgtccaggtcggggcggcggccgacccagaactcgccgtagcggcggtcgcggtagaagtcgctggtgttccggggggagcgggggcggacgtggagtaccgcctcgtgtccttccgggccggaggggtcgaggaccaggacgtggtcgggctgctcctcgccggtcagtccggtcagccaggcgtaggcgctgtgcgggcggaagcggtggtcggtgtcgttcgagcggaccttgagcgttccggcgggtatgacgagccgctcgcccgggaagcgggccgacagtcgctccagccggtccggcagcagggcccggccgggggcccgcgcgccggcg

SEQ ID NO: 2789 - DNA, 4448 bp, Unknown
  Kingdom: Bacteria, Phylum: Actinobacteria, Class: Actinobacteria, Order: Streptomycetales, Family: Streptomycetaceae, Genus: Streptomyces
cccgccgtcacccggcgccgggggcccgtaccgccccacggcgccgggtgacggcggggcgtcgggatcggtcccgagaagcgactgcgggaggaccagcaccgcctgcgtaccgccgtagatgttgctctgcagccggacggcgatgccgtggcggcgggccagggccgagacgacgaacaggccgatccggccgtcctggagcaggtgggcgacgttgacctggtcggggtcggagagcagcgcgttcatccgcttctgctcgtggtccggcatcccgagaccgcggtcctccacttccagggcgagtccggcggtgacgtgctggacgcgcagcagcacctgggtgtgcggggcggagaacaccgtggcgttctcgaccagctcggccagcagatggatcacgtcggcgacggcgtggccgcgcagggtgccctctatcggcgggaccagcttgacccgggggtactgctcgacctcggcgatggccgagcggagcacctcggtcatggtgaccgggttgctccactgccgccgggagacggccccgccgagcacggcgaggttctccgcatggcggcggatccgggtggcgagatggtcgacgtggaagaggcccttgaggaggtcgggatcctcgacctcgtgctccagctcgtcgagaatctggatttcgcggtggacgagggattgcagccgtcgcgcgaggttgacgaagacctcggagacgccgcgccgcatgtccgcctgcttcaccgcggcctcgaccgcggcccgctggagggtgttgagcgcctgtcccacctgcccgatctcgtcgggttcgtaactgaggtgcggggcctcggtctcgacgtccacctgctcgcccgcggccagcctgcgcatgacgctcggcagccggacaccggagacctcgtgggcatccttgcgcagccgggagaggtcgcggacgagatcacggccgatgcgtacggagacgaagaccgagacgatcagggccaggaagccgagaactccggcgatcccggcctgggcgaggacccggtacgcggccggttcggcgcggtcctggaaacggttgcccatctccgtggcgtcgccggccagccggtcgaggacgggcacggccgcctcctcccagcggtcggcgtcgacggcgccggggcgcttcgtcggtccggcggcgatcaaagcgtcctcggcggtgcgcagcggttcggtgtcggggctgccccagaactgctcgacgcgtcggcgctccgcggcgggcaggttctccaggctgacctcgtagagcagctcgcgctgggccacgagtccggatacctggcgcagttcggaggtggtgaagcggcccgcgatgaggcccgaggcgatcagggcgtcctcgcgcgagagcatctcccgggcccgggataccccgaccagggcccgcatctgcttgtccatcgacacgttctccagggtgtggagtccgttgaggaagcggtacgaggggtcgacgaggccgttgtagaagtccagcgccttcgcccggctgatggtgcgcttctcgaccgattcacgcagggcgtccagtccgtcgaccgcgctgaggatcgcgtccaggcggccggcgtcggagtcggtcagcgcctcccggacatcctgctcccgggcgttctccctgacctctcccacgatgcggtcggtcgtggcgcgttggcccatgaggacggggagcgcgtcggaggcccggggatcggcgaggaagaccagggtctgccgtcgctcggcctggacggcgcggacggcgtcctccagcgggtcgccgaccttctccacaatggatccggcgctcatcagatcgtcggcctgacggccggtgatgtaggtcgcgaagccccagaggcctgtcagggagacgagcggcaccagcaacaacgccacgatcttcctgcggatggacttcccgcgaaagcgcatggcctcccccagatcggccccgcaccgcgggggtggtcttctcccggtcgtccctcggccccggtcccgccgcgcaccgtgcgtacaccggcgcgcatcgggcggacgcgggcgaggtccgtcctgcgtcaataaacggcgcgagcctactactgacacagagacaactcgaagacacgtccggatgattttcagccgtccgccctgggcttgatcatgagttgtccgggtattcccggagatgaaattcgcgaaagggacagaggataccggccggagctatcggtaccggcacgtatcagttggctggaactcttcgctccgtgcccttctgggccctgcgggcgttttccaggggaatcttcgggacgggtggttcgtccatatgtacggggtagacgcacggtggggtcgtgcgcggcaggacggacgtgttccgcccgcgtagaaccggcgcaagccgggcagccaccctgaagtcggacagtggtggggagttgaaggtccttgagcacgcaggaacgcgggagcgccggagcaccggcggccgcggatacggaagccgcggacggggcacgggtcccgcggcagttgtgggtggaggagccggcgtcgaagcggcggatgcccgacgcggtgcggacggccgccgtgcgcgccgtgctcatcatgtcgctgacgatcatccaggcgatggtcgcctttctgagcaccttgaccggctcctggctggccttcccgatggtgctcagcagtgtggcaagcacggtggtcgccacctggtcggtgctcgacgtctgggtgacccggcaggtgtggaaccagcgcaacggtgtggtgtccgtgccgagcagttcggcccggcagatacgtcgtgaacggcgccggtcccgccgggccgagcgggcggccgagcgggacggcacgggcggtgccataggcggccgccagaacacccgtgacttctcccgggcctgatccgcgggcctgaccgcggaccgccaccgctgccgggaggctccgctcgcccggcagcggtggcggtccgtggctacgcgccgggccccggtgccgggatttcggcggcggtctgctcgtgacgtctgaacatacgggtcgccgtgatctcgccgtggaccgtctcgccgtccgggtcctgctgcggcagaccggggcgcagatgctcctccacgctgatgtacttgagccccgccctcaggtccgcgtcgttgcgcaggcggatgacgagggggaattcggcgagcgccgtcgtgtcgaacaggccggtcgtgtagagcagttgcacgcccagcgcgtccgacaccgcgcgctggagctccagcaggtacgtggcgttggcgcggccgatcgggttgtcgaggaacagggtgcccgcgtgccggtggcggtcgcggccccggtcgttgctgcgcagggccgccatcgtgcagtagagggcgatggcggcggtgagcagctggccgccggagaagacgtcgcccatctgtccgacggggacacgctcggcgcgcagcacggcgtccggcttgaggatctccaccgcgatgcccttgggccgcagcgccgcctcgactcccctcaacagcagggacatgccgtcccggcgcaggtcggagttcttcttgagcgcggcgcgggtggcctcgtcgacgacctctcccaggcgttcggtgagggtggcctggtcgggttcctcgaagcggatccgaaggaattcctgacccgaccactcccccagcccttcggggagccgggagagccgctgggcggagcgcagggtggtgagcgcggagtcgaccaggccgcgcagccggtcgacgatcgagtcgcggttgcgttccagctggatcagttcgtcggtgaggacgcgcagcctgggggcgaaggcgtccgcccacttctgggcgtgctcggggagtgcggaggcgggaagctcgcggatctgctgccgggcgggggtgcggacctgttcgtaccgggtggagttggcgtgccggacgaggacgtcgctcgcttcccggacggcgctctcggcggccgagaggtcggcgttgcagccgcgcagggagcggcgggactcggcggcggactgcctggcctcctccagggtgccggggtaggggtcggggtgctcggtcccgtcctccgtgccgtggtcgcgcaggaggtcccgcagcagcgccgcggtttcgtcgaagccgccggcggagtcctcggcggtgcggtgggcgtgcagcagctcgctgtgggctgcacgggcggtgtccagggccccggtggcggcggccagctcggcggtggcggtgcgcaggagggcctgcgccccttcggcgtcggccgggacgaggtcgtccggcagttcggtgtggtgctgccgctcgtcgtcgggggcgaggcgctcggcctcgccgcgcagccgtcccagatgctcgctggcggtggaggcgcgggtctccagg

SEQ ID NO: 2790 - DNA, 17799 bp, Unknown
  Kingdom: Bacteria, Phylum: Actinobacteria, Class: Actinobacteria, Order: Streptomycetales, Family: Streptomycetaceae, Genus: Streptomyces
ggtcatggccggggcgaccgtgcccgcctggggcggggtctgtgcgtgttcggtgccgctgggcagtgctgtttccccggcgggctcgggaacgtggacggctgcggcgggcggagttgccggttcgggcgacgggggcacgggagcggggtttgcctgtgctgcggtgatgagccggtcgggggcgaggatgggggcgatcgccacgatgtcggccaggctgagcccggcggcgggagcgatgcgctccgccttcgccttctcgtatcccgcgagtgcggtgatcttgcgggcgcggtccgtctccagcttctccagcgcggcccgcgccttcctgatgccgtcccgcaggacgcgcagctcggccagctccgcgttgtaggtctttgcgtccatcacgattccttgtacctgcaggtcagttggcgggactgctgtgggtggagacgtaggcgacagtgccgccggagtgggagggcagacgggtgcccagaaggaggtcggcgacatcgcggtcggtctgccgcggtgcggtcaggtgcttgaccggggtggccagatcggtgacgtacccggccaggacagcgtccgggaagacgtgccgcccgtcttccctcttctcccacgtccccaggcctgtcaggacggccaccacgtagccggccagggtcaccgggagcactccccctgcggccacactggcggcatcgcagcgccacccgcccctcaggctctccagaaggtcctcgggggcaagcctggacgagaagccggtccgccgcccgtcaggaccaccggcctggcgggcagcgtcaacccgcagcacaccgatctccttcacacccaggtgatccacgggagcggaaggccgctcccgcagagcctgtacgacctgaagaggagtcatgacccgcacgcctcggcgggagagaccgggcaggacttccgcagtgacgaggcggcggaaagtagtgatggcgcagccgagttcctcagcagcctgccccgtcgtgagcagcatggcccggctcctcaccgatcgaggctctgtccttgcgaaagtaccgccagcactccccataggcaagccgactcagttatctgatccggcttgtatccagttcgggagcaagctgcacgaacagctccggtcttcggcggtggtgaccggtccgtccgcgtcctcggcggtctcctccctgcgcttcagcgcctgcgatgtcgttgatgagcacgtctgccgccggtgtttccggcccggcgggcggccagggcagatgcgtacgcagatatgcggcctggatgaaagatgatggcctcccggccgcgggcggactgctccgcgatccgccacggcgcgtgcaacggacggcgaacaccgtgcccagaacgaccagctcccgccgcgccggccagcagaaccacggctgcacgacgcctgaccggcccgtcgcgccatgcccgccgcccgcgggtccggttcccccctctccatgggcacaggagcccaggctccgctcagtaaacgatcaggagtcctgtggcaccggcccgtgacatgagaacggccttacgggttgggcaggtggtgaggtccgggaggcactgagccatcgatgcggggacggcgcgtcccggccgtgcgcaacagggcctgcaggatgcggcttcccagggccatggcggcctgtgccgcggtgtcctttcggccgcatgggaacggctgtcccgtagacgccggcggcagttgccacgtgcgggccggtccggtccatccaccgcgtggtctccgcgtccatggcgtcccctgcgggtccggtccggtgtgcgggccgcgtcgccgagcggggcgcgcggcgtgtccgcccgttgtccttcgacgctcgccggtccgctcgggcgctttgccgaacgctgttcccggagtccggcggctattcggtggcgccgaacggagcagttcatcgagcgatacgttcgagggccgtcttgccgcctgatacggggccctgatgagatggccgcgggaagactcatctggacggcgggaacgcacagcgtcggctatgcgtgagtggtggcagaagccgctccgtggccgctggaggaggaagcgtgatgggtgaggtcgcagaggcacacagagtgcagttccgcattctgggctcgttcgaatgctgggatgggagcgaccgaatccgggtcggcggacccgtgcatgagaaagtcctcgtcacgcttctgctggaacctcagcgcgtgctcccggtcttccgcctggtggcggccgcctgggacggggacgcgcccgccaccgccgcccatcaagtgcgcaaggccgtcgcggaactacgtcagcgtgtccccggcgggcgggagctgatcgtcaccgaggggcccggataccgggttctcgcgacgcctgcccaggtggatctgggcagattcaccgagggattaaaacaggccagggcggctgctgtcgccggccaaagcgcgtacgccatgacgatacttcgcgaggcactggctctgtggcgggggcctttgctcgcgggtgccggtgggtccgttctgtccgcggcgtccgccgccctggaggaacgtcgcctgacagccgtggagcagcttttcgatctgcggctcgccggtggcgaaagcagtgaactgatcggtgaattacgcgagttcatcgacgcgcacccgttgcgtgaaactttgcgtggccagctcatgctcgccctcttccgttccggacggcaggcggacgcgctggaggagttcaccaaggtccgggacttcttgatcgacgagctcggtatcggccccggcgacgctctctcggagctgcacaacgcggtgctgcgcaacagcccggaactcgcggccccgcagctgcccgacaccgcccctttgaccctggaggacagcccctccaccctcccttacgatctgcgtgacttcacgggccgggaggaggaagtggggaaactgctgggcttcgtggaggaggccccgggatcggggccactgatcgtcgcgatcgacggcatgggcgggagcggcaagacctccctggccgtgcgcgccgcacatcaactcgcggagagctaccccgatgcccagctctacatcgacctgcgcgggttcgcccccaacggccggcccctgagtgccagtgcggcggccgaggctctcctgcgcatgctcggtgttcccggcgaccgcatcccggacgacgcggaaggccgaatcggcctgtggcggcgcacgatgagtacgcatcggatgctcctgctgctcgacaatgccgtggacgactcccaggtcagaccacttctcgcctcccccaccgagacgctcgtcctcgtcacgagccgtgcgctgctcgtggacctcgactccgcccacaccgtgtccctgggcgtcatgccgccgagggacagcgtcgccctcgtcgagggcgtactcggccggactcgcgcggagaacgagccggaggcggtcgcccagctcacggagctctgcggtcatcttccgctcgccctgcgcatcgcggcggcccggttgcgcaagcggccccgctggaccgtccgttatctggtcgaccggctccgggacgacgcccaccggctggccgagctcaactccggagagcgcagcgtcgaagtgacgctgcggctttcctacgaggggctggccgccgagacccgggaggcgttccggctcctcggccagtacccgggcgccgagatcaacacctatgccgccggcgccctgctggggacgggcgcccgggatgcggaggaagtcctggagtacctcctggacatgcacttgctccagcagcacgagacgggtcggtacgccttccacgacctcgtccgcagcttcgcgcagaatctctcgcgcggtggtgcccgccggctgccggaagccggtggggaggggagtgccgaggccggcggcgacgagctcatgcgcgccgtgcgccggcttctcgacttcgcgctggcggcgaccgacgccgcctgtgacctgctgtttcccgggcgggtcgggatagagcgctccgagcacccgccgtcggccgccgaactccccccgctggacacggtcgagcaggcccgcgactggctcgagcgggagcaggactcgctgctggccgccgtttccctggcctaccgctgggagatggaccggcatgtggggctgctggccgccaacgttgtcttccctcttgacctgcgtggccgcctggaggagttcagggagctgagccgcgtcgcggtcgccgcctcccgccgcctgggcgacgccgccctgctgcggctcagtctgtccaacctcgcggtggcctgctggaagctcgggcgtctcacggagggcatcgagatgtcggaagaggcgttggccctggccatcagccttgaggaccggcgtggcgaagcgaaggacaccggtgttctcgggctcctgctcagcaccctgggccgctatgacgaggcgctgccgcgactacggcagtccatcgagatcaagcggcagctgggggcggagcgggccgaggcggagtccctgaccaacctcagcagcctgtacaccgagtgggggcggtatccggaggcggtggaggcggccacccgctccgtcaccctgtcccgctccatcggttcggtcgacaaggaggtggaggggttgaccgacctggcggtggcccggatcggtctgggcgagatcgtcgaagccgcagagcttctcgcccgggcccgcaagctggcgggggatgtcatttcgcccgccgacctgtcgctggtcctcgcactgtccgccgaggtcgctgaccggctcggcgagagcgcgcaggcagccgagtggggggagtcggcccttcagctgggtgatctcagcggcgtacctatgcgtgaggccgctgtcggcaatatcatcggccggctccacacccgtaacgggcgttattcaccggccctcgaacttcatgcgcgggcccatgatgcggcctcgcgcatcggctaccgcgtcgaggaggcgcgtgcgctggcgggtatggcagatgctctggaccacatgggcgagcggggagcgtcctcggcccaccgggagtcggcccgggaggctttcgccgccatgggggtcccgatgccgccgggtgcgtgacgaggtcgcctctccggcaggagagggcttccgccgccgtgggacggccccagcgggcagcgggcagctcagagcgtggtgtggggggaagcgtcacggatgccggaggtcaggttgggtccctcgccggtgtccggggcggggatgaggttgggcccctcacccgtgtcggaccgcacaggtgtgatgttcggcccctcaccgtccgaggcgggaatgaagttcggcccctcaccgtccgaggcgggaatgaggttcggtccctcaccggtgtccggggcggggatgaggttgggcccctcaccgtccgaggcgggaatgaggttcggtccctcaccggtgtccggggcggggatgaggttgggcccctcacccgtgtcggaccgcacaggtgtgatgttcggtccctcaccgtccgaggcgggaatgaggttcggtccctcaccggtgtccggggcggggatgaggttgggtccctcgccggtgtccgatccgccgtggaccgcggagcgcgtggtggccggcagggcggaaaggccgtcgtgtgccaccgccgccgaagcggcggcacctccggtcaggagagcggcggccgtaagaattcccaccatcgtcgacaccgagttccgcatggtctaccgccttctggagtggtcttgccggggcgtttctgctgatgtgaacgactttcgcgggtcccgctcccaaggcgttccacatccgctacccgccctcacccgggagcgggaacgcgacaggaaaaccccgcgttcgggtgagtgaggcgtgcgccggcaccgcggcggtggaacggcacgtacgggaaagggcccgccgatggcgggccctttgcggcggggagccgggtcagacggggcagccgagtacggcggccgtgcgggcggtgagttcggcgggggtgagtgcggtgagcagggcgtatccgtcccgtgtctcccgcacgtccgcggctgcgatggtccgcccgggtgctccgggcggagcgggcaggggaacggcggccgcgtatcccaccggcgtcgctgccttcaagggtttccccgacagggcgtggaccagttcccgttccgcgaccagtcccgtggtcagttcgatcagtcgagaggcgggccaggtcgcctgccgtggcaccgcgtcgaggacgcgcggtccctgtccggtgcgcgcgatgcgaatgaacgcgtatccgaactcgtaaccggcgaggtcgaggaggcccgtggccagggctctgatctccgcttcctccggtccggtgatcggggcggggaaggtgtgcagagcgggaccggtgccctgcggcatcgtggcgtcgtcgccggatgcccggtccgcgccgggcccgttcccggtgccgggctccctcgggtcgctgacgcgccggtcgccgaaccggtattccaggatgccggtgacccggtgcatcccctcgaccgtcagggtttccagcccgtacacgacatcgcacagcggcggcctgctcgccggctcctccggcagcgccaacgcctgccagggggggccgctgcggttgaggaggtttctgacctctgtggcgtccgcgagcagccgggcggcggaggcgggattaggtgacactcccagttcctcggctgtctccaggacgacggggtgggtgctcgcgtctccgcaggcgatcagcctgcccacccggtgggtgagcacggtgtccctgatgtgtgcgcgtagttccccgtcggtgaatgcggccgtgtcggcgagcgtgacgcaagggaagccggcttgcgttgccgcagccaccagcagaggtgtcggttcgacgaggaggaggcgccgggggtcggcggtgccggatccggctgatgccgtcatggctgctgtcctccggtgtcgtgcggcccgggccgggaagcggtgcccgcgaggagcgcgtcggcgagcacgccgcccttcccccagtggtcgggctccacatcccgcacgatgacggtgacggcttcctcgggacagccggctatccgggacacgcaggcggtcaattcctcgaccagctcctggcggtgcgcacggtcgttccctttccaccagtcgacggaaatcacaggcacgggagaactccttctgctcgggtgaggggagagaacgggaccgcggcgtccgtcgacgcggcagcgggccggctgtccgacggacggtcgcgcggcgttcaggcgagtgtgggccgtgccgttcccgaaagtttcccgcgctgttcccttctccttccatgtgccggggacgcgctcctgccgggtgggaacgcggcgggactccagcgggaagcccgccgggcacgctctgctccagtgatgaggccgaccccgcccctggagccacgatgagcctgctcagtccgacgaaaccggaatcgaatccggccctcggtcccgcactcggcaccgcttccgcgtccgccggcgcgtccgagggaccgattgccactcccgcgtcccccactccccgcctgctcgcgacgctgcgcgaggacctcgctgtcgtcgtggcccgcgatccctccgtgcggggcgggaaggaggcgatcctccatcccgcgctcaccgcgctgtgggcccaccgcgtcgcccaccgtctgcacggtcgcggccggcgcatcccggccaggctgctggcccggtgggcacgccgggtgacggccgtcgagatccaccccggggccgtgctgggccgcagagtcttcatcgaccacggtgccggggtcgtgatcggggagacggccgtcgtcggtgacgacgtgacgatgtaccaccaggtcactctgggtgcggtcggctggtggagcgacaacaagcgtcccgagggcgaccgccgccatcccgtcgtcggcagcggcgtcatcctcggggccaacgccaccgtcctcgggccggtgaccgtcggggaccgggcggtcatcggcgcccaggcgctggtcaacaagagcgtgccgggcggcgcccgggtgctcgcgcccaccgccgtcatcaaggagcccggccggcggccggagctcatggaggacgtcttcaccgtcatcgcctccgccggttcctggtgacatccaggaccttccaccccccgaccgccccgattgccccgattgcgagagatgcagccatgacgaccactgttcacgctccgctcgcctccgtcgcttccgcccgccccgccgtcgcctcacgcatcgaggatctcgtcggctccacgccgctgctggaactgcggttgcgtgacctggcgcccggcgcccgggtgctggcgaagctggagtccgccaacccgatgtcctccagcaaggaccgtgccgccctctacatgctgcgtgccgccgaggaacgcggcgcgctgcggcccggcggcaccgtcatcgaggcgacctccgggaacaccggaatctccctggccgcgttcgccgcttcccgcggttaccgctgcgtgatcgtgcttccggacaacgccacggccgagcgggtcaggctgctgcgcgccttcggggccgagatcgtccagacgccgagctcgctcggctacccgggggcgatcgccaaggccgagctgttgcacgcggccactccgggctcctggttcccctgccagcacgagaaccccgacaatgtgcgcgcccattacgagacgaccgggccggagatccaagcggtgatgtccggtctcgggcggcgcatcgcggccttcgtgtgcggggtgggcaccggtggcacgctcaccggcgtcgcgcgcagcctcaaggagcacgacccggacgtgcgcgtgatagccgtcgagccggagaagtcgccgattctgtcccaggggtacgcgggccagcaccgcatccccgggctcaacggcggcttcgtcgccgtgacgaccgacgtctccctcatcgacgaggtcgtgacggtctccgacgaggacgccctgctcaccgcgcgccggctggcgaggggccaggggctcttcaccggggtctcgtccggcgcggcggcgtacgccagtgagcgcgtcgcccgtcggccggagttggccgacggcatcgtggtgaccctcctgccggacaccggcgagcgctacctgagcatgtgggaggaccaggcatgagccacgcgatgttccgtgcttacgcggacgcggtgaaggccgagatcgggaccgccacgaccacccgtttcatagctctcgccgaaaccaccgacgggcggttcgggctcttccaccactcgatgctgccgggggccggaggggcggacccgcactaccactcccggatctccgagtccttctacgtactgacgggcgaagtccggctgcatgacggcaccggctggcgcaccgcacgggccggggacttcctgcacgtgccggagaacgcggtgcacgggtttcgcaacgagagcgagtcgctcgccgagatgctgatcatcttcacgccggcggaacaccgggagggttacttcgagggcttggccgccctgctcgccgatggcaaccgtccttcccgcgcggagatggtcgcgttgatggagaagtacgaccagttcgaggtcgacgcgcccggcaccgatcacgaccacccgcaccggcacccgcacggcggcgggaccggccatcaccgccacggtcccgccggcgtacacgccgtgtcgccgcacccctgaccggcggggctcaccggccccctctttccctcgcctccctccctttccccctttttttcttccgaggagatcaccgcatgaacgtcgccaactggggccgcttcggtctgctggccgccctgtggggctgcagcttcgccttcatcaagatgtcgctggaggcgttcgcgcccctccagctcgcctccggccggctggtcgtcggcgcgttcgtcgtcctcgccatgctcgctgtgaagcgcctccccctgccgtcgcgtcccctctggggacacatcgtcgtcgcctccgtcttcggcaacgtcattcccttcaccctcttcgccatcggcgagcagcacaccaccgcgaccatcgccggcgtgatccagggggccaccccgctcatcaccatgggcgtcgccgctctcgcgctctccgaggagaagccgacacgccgcaaggtgaccggcctggtcggcgggttcgccgggctgatcatcgtggtggggccgtggaacaccgagggcttcggctcgatcggcggccagctcgcctgcgtcggggcggccgcgagctacgccgtcagcttcgtgtacatccgccgtttcatcggcccccacaagctgcccgcgctctccgtgaccgcggcgcagctgagcgcggcctccgtcatcacggtggtgctcaccacgttcgtgacgggctggagcctgcacggcgacctcactgccaagccgctgctggcccttctggtcctcggcgcggcctccacgggtatcgctttcgcgttgctcaaccgtctgatcgcggacgccggtccgaccacggcttccggggtgaattacctcgtgccggtgttctccgtggtcgtcggggtgcttgccctgggtgaaccgctgtcctggaacgtaccggtgggtggggtcctcgtcattgccgcgctcgccctcgcggaaggccggatctccgtcctgtcgcggtccggggagcccgggccggcgtcgccggccgcctccggccgcgtgccgcagaagagccgcccgtaacagcgccgtacaacacggcaccgcgccgcacggcaccgcgccgcacggcccggcgcggcacggcacggcacggcacggcacggttcaggaacagcacgcacggccacgcctcaacgagccggggccggcgcggacaccccttcgcggggtgcgcgccggccccggctcgttgcgtcatgacgtcccgtcgcgtccggccgtggggtgtgcggcgggcgtccggggtggtggccggattacggatcggttcccggccacctccccgggcccggtagcgatgcgggagggcgacgggaccggtcggcgcgagcctttcatcacaggacgccatcaggtcccgcccgcctccctcctggcgttacccctcctccctcccaaggagcacttcgcatgacgcgcaccgccacctcgccgtctcccaccgccgcctctctcggcgacgcccggatcatctccgccgcggacttcgtcttcgtccccctggccggccggctcaccgaactcgccaccccggtcagccctgccgtcggctccacgcatgtcacgctgcacgtcgtccggatcgccccgggcgagtccttcggccccgggtcgagcgtcgaggaggagaacaccgcggtcgtcttcgacggccgggggacggccacggtcggctcccgcagccggagcgtcgaacggtcccacgccgtctacgcccccacgggccatgccctgagcctcaccgccggcgcggacggactcaccgtctacatctggtgcacccccctggcggcgggacgccggcccggcaccgctcccgagccgttctccacgctctgggacgagaccacccagctgcgcgggttcggcggcaccggccagatagcccccgacaccgaccgcgccaccatgaacttcgtcttctggccgggcaacggcagcagtcagctctgcctgcactgcggcatccagcagccgggccagaccttcaacgtccatctgcaccccgacagcgacgaggcgttcatcgccttcgagggcatcggccagatgtacctgcgtgaccgctggagggacgtcgccgccggggacgtcctgtacgccgcgccgggtgtcctgcacggcgcccgcaacccgcacaccgggcccgacgcccggcgcttcgtgacctgtgggggccccagtcccttcgacccggcgctctattccgccgccggcctctcctccgacgtcaggtgatctgagccatgtgccgaatccacggatccttccacgcccgcaccaccgatgaggagatgcgccgggtcgccggcctccagcaccacggcggccccgacgcccagtccttcgcccggcagtccggctgggccctcggcaacaaccgcctctccatcatggaccccgaaggcggggcacagccctaccgcctgggtgacgtcaccgtcgtcttcaacggcgagctctacaaccacgaccggctgcgcaccgaactcatgcgccagggcttccacttcgaggaccgctgcgacggatcgattctccccgcgctgtacctgacgtacggggaccgcttcgccgagcacctcgacggcatgttctccgtcgccgtgatggacctgcgccgggtaccgcgcctggtgatcgccactgacgcctccggcatgaagccgctgtactaccactgggaggagcgcggcggccagttccacttcgcctccgagctgcccgccctgctcggtttcgacggggtgcgcccctacgaggacgaactgggtctgcacacctatctgtcggccaagacgcccttcggccagcggaccatgttcgagggcatcgacgtcctgccgcccgcgaccaccgcggtcgtcacccgcgaggacggcctgtgcctcacctcccggcggatgggttacgagtccgctccgccggtcgacgaggagcggagtctgtcccgggcgggcgagtcgctgcgggagctgctgtcccgcgaggtctcccggctgctgatcgccgacgcgccggtcgcggccatcacctccgggggtctcgattccagcctggtcaccgcgctggcggcccgtatcctgtacgagcgcggttcgagcgaggcgctgcacacgttcaacatcgcctacgccggcagctggcccggcgacgagcgggccttcgcctcggaggtgtcgcggcacaccggcacggtgcaccatcaggtggagatcgatccggctgtcttccccgatctgatgggggacgtcgttcgccacctcggccagcccaacgccgacccgatcacgctctccaccttctcgctgttccgggcggtgggtgacgccgggttcaaggtggccctcaccggggacgcggccgacgaactcttcggcgggtacagccgcatgacccaggctctcgccgcacccgagggggccgactgggcgggcccctacctcgaccacctggccgcggtgccggagtccctgcgccggcagctgtacacctccgagtacgccgcccgggtccacgcgcccggtgtgtccccgctgccgcccggcctcatggacacgctcgcccacggtgagggcagccggctccagcggatcacccggatcgaacagcgctaccggctgcccgcgtaccatctgcgccgcgtcgaccacctctcgatggccagctcggtcgaggcccggcttccgttctgccagccgagcgtggtgcgcttcgcggcgtccctgcccgatcagcaccgcaccgttcccggcgtgggcgtcaagcgcgcgctgtaccgggcggccgaggggctgctgccggacagtgtcctgaaccggcccaagcagcccttcaccctgccgatcacggccatgctgagcccggggcagcggctgtgggcgatggcccgcgacgtcctgtccccgcaggcgctgcgggcagacggacggctgcggtacgaggtggtcgacgccctgttcgccgagcaggaggcccggccgtccgagggcacctcgctggcgctgtgggccctgatgtcgcatcagatgtggcgcagcgagttcttcggcaggccggccggcgcgcaccggccggcccgtcagctggcggtggtggccggatgaacgtctccctggtcaaggcggccggtgccccctgtcccaccgcggtgctggacggccgtgaccttccggagtccgatccgcagttgctgagggcgctggccgggctgcgggccgacctggcccggcagggctgggccgatgtgctcaagaacgccatcgtgcgtccttcccggcatccgctcttcgacctggactaccggttcgttcagtctctgccgcagagccacgacagtttcgacctccggggctcctgcggccactcgatcctggctgccgtcgaggcggctgcccgcaccggcatgatccagccgctggtgccggggtgccgggtccgggtcaacgtgctcaacaacggtgacaacgtggtgtgcgaggccgaggagacctccggcggcggcacccggttcacggcgcatttcctgtgctcgccgccgctggagctgcctgaactcctgatgacgggggagccggtgacccgcgttcccttcgagggccggtccgtgcccgtgtccctggtgtcgatgggcaatccgtacgccttcgtcgatgcctcgcacctcggcgtcgatgggccggacgcccttttcggcgacgcccccggcctgttcgacaccatgacccggctgcgggtcgcggtctgtgcgtcgcagggctgggacaccttcggtgccttccccaagatcgcggccgtgctcccgcaggacggcggcggcctgtacgtacgcgccgtttcggttccctcctggcaccccacggtcgcgctgaccggtgcgatctgtctgggcgctgccgccggcatcaccggcaccgtgccctggtcgctggcggggcgcacggccccgggcccggacgcgctgctgcggatccgcactccggacggctgcgtccgggtggccgcccactcgacgtcccgtccggacggacggcgtgagctcgcgtgggtgtcggtcgccgagaaacaggtcgagtaccgggggctgctggcgcgccccgggtccctcgatgccctgccgcccgccgccagtgctcacctccccctgtccgccgccgtatccgaggagaacccatgggttccgctgacagtctgaccgccgtacgcgacatcggccccggggtgttgtccggcccctgcccggtcgatccgttccccggtgaccacccccggtccggccgtgacggcagcgcgcggaccgtcccccagctgcccgcgccttcggtcctggaacggctggcggtctgtgccgaggcggccgacctcacgggggagccggaccgtgaagccgtcgcggtgctccgcgagagcgagctgctggcgctggtcgtccccaagtgctacggcggtgcgggtgccgacgcggtggctctcaacacctgcgtggaacaggtcgcctcggtgaacgcctcggcggcgatcatgctgttccagcactgcgccgtgaccagccgcatcgtggagaacggcacgcccgcccagcaccgtgaaatgctgcccaggctggccgacggccggtggctggccgcctccgcctggtcggagagcggggccggcgcggacaagaagaacctcgcgacccgggcgcaccgcacgcccggaggcgactggctcctggacggcgccaagtccttcaccaccagtgccggcctcgcggacgtctacctcgtgctggcacagaccgtgggcgaggccccgggcgccgcctccggcgacaccgggtacgggtcggccgggcagacgttcttcctggtcccgggcgaacacccggggctggtgcccgacacctcgatgcggctgagcgggatgcggggctccgccacggggttcgtgtcggtacgggagtgcgtggtgccggactccgcgcgccttggtgcgacgggcgtcgcggcgtccatcatcgcccgggtccgcgacagcggtgcctcgctcggcgccgtcgccgtgggcgtcgctcaggccgcgctcgacgcggcccacgcacacgccggccgccggggactctacgcccaccaggcggtacgccaccgcctggtggacctggccacgcaggtcgagaccgcccgcgcggtggtggagcgggccggccggcgcagctccgccgtgcccggcctgaccacactccactccaagctggccgcctcggaagcggcggagcgggtggtggcggacgtggcccggttcctgggatcggcgggctacgtggagacacatccgatcaaccggttcgggcgcgacgcccgggccgtagcactgatgggaccgaccaacgacctctgcaaggaactggtgagcctgccgtggaaccgatgaactccccctcccccgcatcccccgcccaggccgacctggtggtggaaggaggccggctcgtcacccccgagggggtgagcgaaggcagcgtcgtcatccgtgacggccgcgtcgcggcgatcctcgcccccggcgctccgctgccgtgcgggccccgtctgagcgctgcgggccagtacgtcctgcccgggctcatcgactcccacgtccacttccgcactccgggcctggaacacaaggagacctgggagacgggcagccgggccgcgctcgccggaggcgtcacgacggtcatggacatgcccaacacgcgtccgccgtcgctcgacgcggcctccctgcgggcaaaagccgcactgatcgcgggccgctcctatgtggaccaccggttccacataggagccgaccccgaccaccccgaggtcctggccgacctcgccccgcaggtggcgacctccgccaaggcgttcatggcgggccaccacaccgcccccgtggtgttccgcgaggcacaccagctggaggccgcgttcgccgccgccgcacaaggcggggtacgcctcgtcctgcacgccgaggaccagcacgtcttcgacctcctcgactcccgcgccggcgacccccactcgtacggcgcctacgaaccccaccggccgcgctccggggcgatcgtcgcggtcgccagggtcgtacaactcgtccgcacgcacggcaccaggacacacatcctgcacgtgtcgtccgccgaggagaccgatctcctcgccgccgccgcggccgaaggactgccgatcagcttcgaggtcacaggacaccacctcgccttcaccgaccacgacaccgtgctgcgcggcccccgcacccggctctcccccgcgatccgcgcacctcgggaccgtgaacgcctctggcaggccgtactcggcggcgaggcgaccaccatcggcagtgaccacgctccccataccgtcgaggagaagaaccggcccccggcccaggcacctcccggcctccccggcgtccaggaactggccgtctccgtatggacgggcatgctggcccgcggtatcactcctgacactgccgccgcccacctggcccggctgatggggacaggccccgcggacctgttcggcctggcggggaaaggccggctgacagtcggctccgacgccgatctggcccttctggacccggccgcccgctggcagctctcggcgtcccacatcgagtcactgtgcggctggtcggcgtacgaggggtggatgttcaccggccggttcaccaccgtgatacgggccgggcaaatggcctgggacctggagcagggcacccggggcgaaccccggggccgctggctgaccggcccggacccgtccacgcccggcctccccccagcggcgtccccggcccccggcccggtccgggagctggaaggagcagcccgatgaacgtcacctcgctcctacacgcgccggccgcgacccgccccgcccggcccggcccgg

SEQ ID NO: 2791 - DNA, 7425 bp, Unknown
  Kingdom: Bacteria, Phylum: Actinobacteria, Class: Actinobacteria, Order: Streptomycetales, Family: Streptomycetaceae, Genus: Streptomyces
ggcttcgcgtccgccatcgactggctggcggacgcgaagcctggcctgtacgacgcactggacgttccgctgcggcctgcggtcggcaggctgggaaggagaccggcatgatcatcgatgttccggagggtcaggaacccatcggttacgtgtggggggagatggtccccggcatcggcatggccgccgccaccttctcgatgtccgtgtacgagcacacgacactgggactgcgggagttcgaggcggccaggctgcgggtcgcgcagatcaacgggtgcctgttctgcctggactggcggaccgagcgggacggggcgaaggtcgaggaggagttcgccggagcggtgaccgagtggcgcacgaccgacgccttcgacgagcgcacccggctcgcggcggagtacgccgagcggtacacgctcgaccaccatggcctggacgacgccttctggaagcggatgaccgcgcactacagccaggcggagatcgtggagctgacgatgagtatcggctcgtggctggcgttcgggcggctcaaccgtgtgctggggatcgacgcggtgtgcgttctgcccggtcacgggtgaaaggcggctcctgctgacggagtccggggccgccgggttggcactcccggccccgggctctttgtggctccccgtgtcttccgggtcgcctacagatcggtcgcgatgatgcgttcgatgttgcgctcggcgagcgcggtgatggtgacgaacgggttcacgctggtgttgccggggatcagcgcgccgtcgatgacgtacaggcccgtgtagccgtgcagccggccgtagttgtcggtggccctgtccaggaccgcgccgcccagcgggtggtaggtgaggtggtcgccccagatcttgtggacgccgaagaggtccgtgcggtagatcgtcccctccttctggttgatcttgtcgaagatggttctcgcggcgtcgatggacggctgcttccacgccgtccgccagttcagttcggccttccccgccgccgcgttccaggtgaactgcgcgcggttcgggttcttggtgatggagaggtagaacgaggcccacgtctcgatcccggtgggcagcggcgcgacttcggcgaacgctccgccggcttcccagttgtcgatgccgccggtggggatcgacgactgcaccgtccccgtcgggtcccagagatggttggcgcggccgcacatgacgttgccgttgtcgccccagcccctgccgacctcgttgttgaggaggggcagcgcgccggtggccttgaggccgacgagcagcttgctggtacccacgctgcccgcggcgaagaacaccttgtccgccgtgacggtcttggtggcggtggtctgaccggcggtgttcagctggtcgatgagcaccgtgtagccgccgtccggggccggggtgaccgtggtgaccttgtggagcggggagatggtgacccggccggtggccctgatccggtcgatataggtcttctgaagcgatttcttgccgtagttgttgccgtagaggatctcggcgtccagggccgacttggggacggtcccggccgcctcctgcttcatgtagtcccagtcgtagacggcgggcacgaagaggaacgggaaaccggagcgctgggcgtgtttccggccgacccgggcgtaccggtagcagtcgacgctgtcgaaccaggcgggatcgatggtcgtgacgcccagtccgctgttggcgcgcgggtagtaggtgctgtacatctcctcggcgttcaccgtcgggaggatcgcgccgaagttctcccggcgcggggtgacggccataccgccgttgaccagggacccgccgccgacgccccggccctggtagacggtgatgccggagaactcctccgcgtccaggatgccggtgtagcggttgacgttcctgtcgatggggaagccgaggaagttgctcagcggctgcttggtccgggtccgcagccagaaggagcggtcgtcgggcctggtggtgttggcgaagatcttgccgtccgcgcccggcgtgtcccaggccatgcccatctcgaccatatggacgtcgacaccggcctgggcgagccggagagcggccacggagccgccgtatccggtgccgacgaccaggaccggcacacgggtcccggagccgatcggcgctgctgccgcacggacgcccgcccacgccggtgcggtgtgcccggccatcgccgcagcacccagaagagaacctgttccagtgatgaatcttcgacgcgagacacccttggtcccgccatcctgcatggtagtgtcactcatgtgacatccctcactctcgacagagtgcaacaggttctactgtcgatcgcgtggtaagtcactagaaacttgggggtaacttcccggcatgcccgagggccccggaccagatggtccggggccctcgggcttgggcgtggaggatcagtaggcgccgaagacgttgtcgatcgagccgtaccggtccgccgcgtagttgcacgcggccgtgatgttggcgaccgggtcgtagctgtcggtcgaggtgccgggcacgtggtaggcctggaaggtcgggtcgatgacctggagcagccccttggacggggtgcccttgaccgcgttggagtcccagttgttgatcgcggccgggttgcccgaggactcgcgcatgatgttgcggtggatgccctcgtaggtgccggggatgccctgttcggccatgaccgccagcgactccttgatccagccgtcgaggtcgttggtgtacgtgacggccttctcggcggccggagcggcctttgccacgggagcggcgttgacacgctccgaacggtcggcgcggtccgcctcggcaccgcgcacggaggacggggaagccttggcggccttgctcgccttgtcgcccgaagacgcctcggccttggttccgagggtcagcttgatacccgggtgaataagatcgggattctctccgatgatcttccggttgccttcgtacagcttctcccagccgccgctgacggaatattcgcgggcgatcttggaaagcgtttcgccggccgccacagaatgctgggcgggcacggcctgcactacggaattcacctgtgcggccaccgaggcgggcgccgcggcacgctgtggctcggcagcgggagcgggagccgcgaaggcgctggtggcgccgatcaccgggagggcgagtacggctccgccggtggtcacggcggcaaggcgacggcgcagcgaggtggactggggacgacggtgcttaccctgtgcgggcatgggggatttcctctccggcgcctacgaggtgagctgtcgggttcagacgggagatgtctggccgcacggtcgtgcgacttcaccccgagccgttccggttacggatcggcgacttacctgggtcccccgctcctgccgtacgtgagtgggtttcggattcccggacggcggcaggattcggcgttccatccggattgacggtgaccgtaggcgagaaacaccgaacagaacaagccccgcattccggattcccttttccgcgcaagatcgaatggcggaattcccggaccgggccgttccgtcaccgcgtcaactttcctcgcacagaagggaaccgacgcctccgcttccgcgtccgccctcgcggacgtgacgctcaccactccctcgcggcgatggcgaaaacaagctcaaacaaatgccgcagcagccccaatatgccctttatcgagcaggaaggccaaaagagccaaatcgaccatatcggcataacaaaaggggctaatcgggcactctaggcagggccggtcgaagggcccgcggggccatcgcttacggtgtgcggtggagactagtaagccaacccttacctccgacgtacgctgtacctgcccgcgttcgcccgccccgaaggatcaccacgccatgacacgccccgtccgcgtcgccattgtcggagccggccccgccggtatctacgctgcggacgcgctgctcaaatccgaggtctgccaggacccgggggtctccatcgacctcttcgaacgcatgcccgcacccttcggtctgatccgttacggcgtggcccccgaccacccgcggatcaagggcatcgtcaaggccctgcaccaggttctggacaagccccagatccggctcttcggaaacgtcagctacccgcacgacatcggcctggacgacctgcggtcgttctacgacgcggtgatcttctccaccggcgccgaggccgaccgggcgctcgacgttcccggcatccagctggacggctcctacggcgcggccgagttcgtctcctggtacgacgggcaccccgaggtcccgcgcacctggccgctcaccgcggagaaggtcgccgtgctcggcgtcgggaacgtggcgctggacgtggcccgcgtcctggccaagacggcggacgagctgctgcccaccgagatcccggacaacgtgtaccagggcctcaaggagaacaaggcgctggaggtgcatgtgttcgggcggcgtggccccgcgcaggccaagttcagcccgatggaactgcgggagctggaccactcccccaacatcgaggtcatcgtcaaccccgaggacatcgagtacgacgagggctccatcgcgacccgccgggagaacaagcaggccaacatggtcgcgcagaccctggagaactgggcgatccgcgacgtcggcgaccgcccgcacaagctgttcctgcacttcttcgagtccccggtcgagatcctcggcgaggacggcaaggtcgtggcgctgcgcaccgagcgcaccgagctggacggcaccggaaacgtccggggcaccggccggttcaccgactgggacatgcagagcgtctaccgtgccgtcggctactactcggaggagctgcccaagctccccttcgacgtggcctccggcaccgtgccgcacgaggcgggacgcgtcatcgccggagaagagcacatgacctcggtctacgtcaccggctggatcaagcgcggcccgatcggtctgatcgggcacaccaagggcgacgccaacgagacggtcgcctgcgtcctggaggaccgtgccgccggccggctgcccgagccggccgcgcccgctccggaggccgtcgacgccttcctggaggaccgtggcgtccgctacacgacctgggagggctggcacaagctggacgcccacgagcaggcgctgggcgcggcccggggtcgtgagcggatcaaggtcgtggagcgcgagggcatgctggaggcctccggcgccttcgcgtcggccgagcgccccgccgacgcctgatcgacaggacgccttctaggaggccggatccggtgcgcccgccgcgcgcccgcggtccggcctcctgaacgtgcgccacaggtcgggtccgggcgcccggtcctcccggagccgccgggccgccagggtcccggcccaccgggcggcgagcaggatcgcgatgtcgtcgggccggtcggtcgccgccctggcctctccgatgacctggtcggccgtctcggccagggggaccgcgccgatgcgttcgacggtggcacgcagccgctcgatcccctcgtcgatgtccgtcccggggcgctcgatcaacccgtccgtgaacagcgcgagcatcgcccccggttcgagccgtatctccgtgaccgggtaggacgcccgctcatcgatcccgagcacgatgccgccgggcaggtccagcacgtccgtccggccgtccggccgccgcagcacgggctgcggatgtcccgcccgtacggcgcgggccactccggtcaccgggtccagggcgatgtagcagcagctggcgaactgtcctgggtcgaggtcgatgagcagccggttcgtcccgctcatcacctcctgcggatcatggttgctcagcgcgaacgcccttacggcactgcgcagttgacccatggtcgcggcggcggagacaccgtgcccctgtacgtcgccgatgaccagggcgagttcgtggccggtctcgatgacgtcgtaccagtcgccgcccacgtccatgccctgggtgccggagaggtagcgccccagggtgtccaccccgtccagctcgggcagccggtgcggcagcagggcgtcctggagtccgcgggcgagggccgcctcgctgtcgtagcgctgggcgcgcttcagagcctgcgcgatgagaccggccagtgccgtcagcaccgtacgctcctcggggctgaagccgcggggccggtcgaagccgaggatgcaggagccgacgggccgccccgaggcgatcagcggcaggaaggcgcgcgcaccgacgtccgcgtcgatcgggatgcccggataggcctcggccaggcgctgcatggactcgaagaacatcgggcggcccgaggtcagggtctccaccccgggaatgctgacgtcgagttcgaccccttcgaaacggtcgaggaaacccttcgggaaccccgtctcccaggccagatggagatggccctcgtccagcaggtagatggcgagctgacggccgccgaacgccggcagcagctcatccgtgaccacctcggagacctgacgtgccgtgaccgcctcggtcagcgcgatggccagggccaccggccggtacagcgccgaggaccggtcggcggtcgagccgatgcccaggccgggcgcggtgacggagcccggggcgtagtccggtcggtcggtcgcctggaggacgacgctcaccccgtcgtggcccgggtacagggacaccgacagccagcgcgagggcgggcggtgggcgaggaagtggacgggctcgtcggccatcagggcggcccggtagtggtcctcgtaggcctcgtgcccgaaccacggcagggcctgccacacgacatggcccacgagctccgcccgggtgtggccgagcagctcctcggcgaggccgttcgcgtaggtgatccggcccagccggtcgagggagaggacaccgcggggcagccggtcggcggcctccggcaccacgggtccctcaccgaggtcgaccaggaagccgctcagacggctggcggacgcgtcgccgtccgggtgcgtccagcggccggacagttccagcagatgggaccggccgtcggggccgcgcagccgcatccggcggacgaccggttcgaccgactccaccgtctgacgggccagcgcccacagcccgtacacgtcctccgggaccagccgttccgcgagcgcgtcgacggtgcccggaaaggctgcgggctcgaagccgaggatcgcgcagagttcgtcgtcggcggcgacctgcccggagtgcaggtcccagtcgaagcggccgacccgtaccggtggcgcggtggcggcgggcaactgcacggggaccggctcgg

SEQ ID NO: 2792 - DNA, 12714 bp, Unknown
  Kingdom: Bacteria, Phylum: Actinobacteria, Class: Actinobacteria, Order: Streptomycetales, Family: Streptomycetaceae, Genus: Streptomyces
gcgcgtccccgtcccccttccggaacccatcccaggacacacagacatgttccgtaccgccctgcgcaatgtgctcgcgcacaaggccaggctgctgatgaccgtgctcgccgtcatgctcggcgtggccttcgtctccggcaccctggtcttcaccgacaccctcggcaacgccttccgcaagcagtccgccaagagctacgacaacgtggccgtctccgtggagacgttcgccggcgacgacgagaagacctacggcatcgacgaggccaccctggagaagatccggggcatggacggcgtggcctccgccaccgggcgggtctccggcttcgccggggtcgccgacccggacggcaagctgatcggcaacggctggtccaacaccggtgcgaacttcgcccccggcaaggacggcaaggacgcgagctacgacttcaccgacggctcgggcccggcgaagaacggctcggtcgcgctcgacaaggacaccgcgagcaagggcgagtaccgcgtcggcgacccggtgcgggtcgcgaccaacggcccggtgaaggagtacaccctctcggggatcttcaccaccgaggacggcgcggtcaacgcgggcggcagcctcgtgctgttcgacaccgcgaccgcgcagcagctctacctgaggcccggcgtcttccagagcgccaccgtctccgccgcgggcggcgtctccgaccagaagctgctgggtgcgatcaagcccctgctgccggaggacgccaccgcgcagaccggcaaggcgctggctgaccagcaggcgaaggacatcgagagcgggatggccggcctcaacggcatgctgctggccttcgcgggcatcgcgctgttcgtcggcatcttcctcatcgccaacaccttctccatgctgatcgcccagcggacccgtgaactggccctgatgcgggccatcggagccacccgccgtcaggtcaagcgctcggtgctgctggaagcggcggtcgtcggcacgctcgcctccgtcatcggcttcgccctcggcctcggcctcgccaccggcctgcgctcggcgatgagcctcctgggcggcaagatccccgccgggccgctggtcatctcgccgacggccgtcggatccgccttcgcggtcggcatcctgatcaccgtgctggccgcctggctgcccgcccgccgggccgcgaagatcgccccggtggccgcgatgagcagcgtgcacgccaccgcctccaccaagtccctggttctgcggaactccatcggcggcgtgatcgcgctgatcggcgccgcggggatcgtcggcggcgcgggagccggcggcacgtccggccggcagttggtcgcgggcggcgcgttcttcgccctgatcggcgtcatcatcctgatcccgctgctgtcgcgcccggtcatcgccctggtccggccgctgctgaagaagctgttcggcgtctccgggaagctggcctcgcagaacgcggtccgcaacccgcggcgtaccggagccaccgcctccgcgctggccatcggtctgaccctggtcaccggcatctcggtgctcggcgtcacgctcggccaggccatcgacaagatgaccacggacaacatcaaggccgactacctgatctcgatggccaacggcggcccgctcgaccagtctgcgctcaccgcactggagaaggccgacggcgtctccgcgctctccccgcagcaggcggcctggttcgaggtcgacggtgggggctactcggcctccggcgtcaccccgggcgacgtggagcaggtcttctcgctgaagaccgtctccggttcgctcggttcgctcaaggacgggcaggtagcggtcggttccaagaccgccaagacccacggctggaagaccggcgacaccatcccggtgacgttcgaggacgacaagaagggcaaggtcaccgtcggggcgctctacgaggagaacgagttcctctcgcccttcgtgatcccgaaggcgctggcggacgagcacagcacctccacccgtcccgagatccgggaaatctggatcaaggcggacggcggcgcgagcagcgccaacgagaagtcgatcgtggacgcgctcggtgacaacccggcgatgagcgtcatggaccggcaggacatccgtgacagcttcggcggcttcatcaacaccgccctgaacatcatgtacgggctgctcgccatggccctgctcatcgcggtcctcggcgtcgtcaacactctcgcgatgtcggtgttcgagcggcagcaggagatcggcatgctccgtgcgatcggcctcgaccggggccgcgtcaagcggatgatccgtctggaagccgtcgtcatctcgctcttcggcgcggtgatcggggtcggcctcggggtcttcctcggctgggcgatcggtcagaccctgtcctccgagatccccggctacgcgctggtcatcccgtgggaccggctcggcgtcttcctgctcctcgcctgcctggtgggcgtcctcgcctcgctgtggcccgcccgcagcgccgcgaagctcaacatgctgacggcgatcaagaccgagtaacccgggcccggaacctggggacgacgaggggccggcaccccgctgcgaagcggggcgccggcccctcgcccgttgccgtacgcgtcaggcgtcccggccctcggccgactcggcggactccgcccaggtgcgggcgcgcagcggcatccgggagccgccgtccagcgggcgcaccgcgaggatctggttgacgccgatcttgttgtgctcgaaggagagcgccgatgcggccatgtacagccgccagaccctggcccggcccggggaggtggcgcgtaccgcccgctcccagtgctgctccaggttggccacccaccggcgcagcgtcagcgcgtagtgctcgcgcagcgcctcgacgtcccgggcctcgaagccggcctcctccagggtggccagggtgcggccgagcggggccagttcgccgtcggggaagacgtaggcgtcgatgaacgcgtcgatgcggtaggcgtcctcgtccttctccgggcggcgggcgatctggtggttcaggagtcggccgccgggcttcagcagggcgtagaggtcatcggcgtactcccggtagcggaccgatccgacgtgctcggccatgccgatcgaggagatcgcgtcgtacgggccgggtggagtgtcccctgttcgagcggagccgagagctcggggaaggacgtcccggtagtcctggacccggatctcgatccggtcggtcaggccctcctcggcgacgcgtttgcgggcgtgggcggcttgttcctgggagagggtgatgccggtgacctgcgctccgtacgcacgggcggcgtggatggccatggagccccagccgcagccgacgtccaggagccggtcgccctccttcaggccgagcttgcggcagaccaggtcgagcttgtcccgctgggcgtcctccagggttcccccgtcctgccagtaggcgcaggagtagaccatggaggggccgagcaccaaggcgtagaagtcgtttccgacgtcgtagtggtggctgatggcctccttgtcgcggcgtctggtgtgcagcgggccggtgcggcggcgcacctcctcggcgggcggggccggcggcggccaggggcccgcgaggtcgaggaggccgcgggcgaaggcgcggaccttgggatcgcggaccgggtggacggaatccttggcgtcggcgccgcggtcccagagcagcccggccagatggccgagcgcttcgtacaggtcgccctcgatatcgatctccccggccacccaggcgcgggccaggcccagttcgcccggcttccacaggagccgccgcagggcgcggcggtggcggatcacgaggaccggggcgcccggtggcccggattcgctgccgtcccaggcccggatacggaccggcaggggttccgagagcaactcctcggcaagagcggtcagccgcgacgcggcgtctgccatggcgcacacctccgtggtgtttccccgacaagcacaacaatcaccaagcgaacagacatgctcgtagccccgccgcgacaccccgggcgctgcggcgaggtacacctgcgtcaactctccccgcacactccgtcatcccgctaccgggcaataaatcagcaaaacgcatgtacgcgccatccatatgggcgggaacaggccacggcccgccgccggccgccggtcctgggccgctccccggatacgccgaaggggccgtccgcaccacggatggcggacggccccttcgggcgtcgtacggtgcgctccccgcggagcgcttcaccggggggtcaggaggccttggccttctcgccctcggtcttggcggcggccggagccggggccggcttggcggcctcgtagaactcctcgcgcggcgtctccatggcgccgagcgagacgacctcgcgcttgaggaacatcgccagcgtccagtcggcgaagacccggatcttgcggttccaggtcggcatggccatgccgtggtagccgcggtgcatgtaccaggcgagacggcccttgagcttgatcttcaccttgcccatgacgatcatcgcgacgcccttgtgcaggccgagaccggcgaccgcacccttgttggcgtggctgtactccttctgcgggaagccccgcatgccggagatcacgttgtcgccgaggaccttcgcctgacgcagcgcgtgctgggcgttgggcgggcaccaggcgttcgggttgccggcgcggcggccgaccatgtccggcacctgggcgttgtcgcccgcggcccagatgtagtcggtgccctgcacctggagcttctccgaggtgtccacgtggccgcggggaccgagcggcaggccgaagcgggccagcgccgggttcggcttcacgccggcggtccacacgatggtgctggagtcgacctccaggccgttcttcagcaccacgtggccgtcgacgcaggagtccatcgaggtggagaggtagatctccacgccgcggctctccaggtgctccttgccgtaggcgcccagcttcgggccgacctcgggaaggatcttgtcggcggcgtcgacgaggatgaagcgcatgtcctcgcgcttcacgttggtgtagtacttcgccgcgtcgcgggccatgtcctcgacctcgccgatggtctccgcgccggcgaagccgccgcccacgaagacgaacgtcagcgccttgcggcggacgtcctcgtcggtcgtggagtcagccttgtccagctgctccaggacgtggttgcgcaggccgatggcctcctcgacgcccttcatgccgatgccctgctcggcgaggccggggatcgggaaggtacgggagaccgcgcccatcgcgatgaccaggtagtcgaagggcagctcgtaggcctcgccgacgagcggcgcgaccgtggcgaccttgcggtcctgatcgatggtcgtgacacgaccggtgagaacctcagccttgggcagcacgcgtcgcagcgggacgacgacatgccgaggcgagatgctgcctgcggcagcttcggggaggaagggttggtacgtcatgtacgaccgcgggtcgacgaccgtgacggtcgcctctccgtatcgcatcttcttcagaatgcgacgagctgcgtacaggcctacgtacccaccgcctacaacgaggatcctgggacgctccgtggtgctcatgccatcgagtatccaccccgccccaggggggtgctcgtgagccccttcacaaggattgaccgaccctctgctacacttcgccgcccacgtgacccaggtcatgggtacgaaagggaaccacagcaccgcgggaaacgttgttcaccgcttgtgagctggcccttgacccttcgggaggggtggaccacccctccccttcatacggacgcaacgctcccggaacgcgtgcgcagcacctccgcacaccctccggggcgaccggttccggcctgatggaccccaaccgcgaccaacagggcccaattccttgtgaagaagttcacgaagtttctcgcggcatgtccccggaggggtctcccgagcggcccagaagggccggatcggggctcaacggtgcaggtgacgacgcgattgagcgggcggcgggaggggtcggccgcagggctacgcggcgctccaggcgatgccgtccaggatgtcgtgctcgctgacgacgacctcgtgggctcccgtccgctccatcactgcgagcaggacgagcgcccccgcaccgatcacgtcgacccggccggggtgcatcacggggatcgcggcgcgctcctcgtgggtggagcggagcaggtgctcggtgatcgcacggacctggccgcgggtgatccgggagtggtggatggccgcggagtcgtactccggcagttccagcgcgattccggcgaccgtggtgacggtgcccgccaggccgacgagggtgccggcccccttgagcggcacggtcctctcggcgaggtcgagggcggcgtcgacgtccgcgcggatcgccgcggcccgctcgtggctgggcgggtccaggacggtcccgtccacgaccaggtgacgttccgtcatccgtacgcagccgatgtccacggaccgggccgcctccacccggtccgagccgaggacgaactcggtggagccgccgccgatgtcgacgaccagatacggcttcgccaggtggtcgctgcccaccagctccttggtggccccgtcgaaggagagctgcgcctcctggtcgccggtgatcacctccggctcgacgccgaggatgtcccggaccccggccacgaagtcggcgctgttctcggcgtcgcgggaggcggaggtggcgacgaagcggatccgtgtcgcccccagctcctcgatggccgccgcgtacgcgcggcaggcggcgaacgtccgctccagcgcctcgggggcgagccggccggtcctgtccacgccctggccgaggcggacgatcgtcatgcgccggtccagctcggtgaaggagccggtggtcgggtccacgtcggcgacgaggagccggatggagttcgtgccgcagtcgacggcggcgacccgggtcatgcgccctgtccttcggagccctcgccgcagggcgtgacgcagggacccttggcccaccactcgggcagcatcgcgatggcctcgtcgcccagcgggttcaccccggggccggcggccagcgagtggccgaccaggacgtgcaggcacttcacccggtccggcatgccgcccgcgctcgggaagccctccaggacctcgatggcgtcgcggcgggtgatgtagtcctcgtgcgcggcccggtaggcggcggccagctccgggttggtctccagacgggccgtcatctccttcatgaccccgttcgcctccagcgtgccgatcgccgaggccgcccgggggcaggtgaggtagtacgtcgtcgggaacggcgtgccgtcctccagacggggctgggtctccaccacgtccgggttgccgcacgggcagcggtgcgcgatggcgcgcagaccgcgcggcgggcggccgagctgctgctcgaacgcggcgatgtccgcgtcggtgggcttggtggactcggtctgcggagggggcgtttccatgcctgccttggttctgctcggaagctcgtcgaggtggatgtgcgggtcggtcagtcgcggtcggcccggtcggcgctgtccacgccgtcccagaggttcgagtgccacgggcggtcgctctcgcccggctcgccgcggcggtcctgagccgcgtcggggtcggccacggtgtaaccggtctccccgggaaggacgtaatggaggtgctggcgggccagccgcatgatgtacgcgtcgtcctggagccgcgccttctcgtcccgcagctcctcggtgcgccgctccgcctgctgcgagagccgctcctgctcggcgatctcgtcgcgctgggagacgtactgccgcatcgggtaggcgagcgccaccaccagggagcagaccaccagcgccaggaacgcggcccggccggtgagccgggagcggcgggcctgccggcggttctgggatcggtacacgcgggccgcggtctgctcgccgagcagtcgcagcctggtcgcggtggagaaccggtcgcggtccttcccggccatgtctcccgcctccccattacgcacgtccgtccccgcacacggtacgggaccgggtgcggggacgggcggaggctaccgtcctacgactacgggtcagcccttgaagcgcgggaaggcggagcggcccgcgtacaccgcggcgtcgtcgaggatctcctcgatgcgcagcagctggttgtacttggcgacgcggtccgaacgggccggggcgccggtcttgatctggccgcagttcacggcgacggcgaggtcggcgatggtgacgtcctcggtctcgccggagcggtgcgacatcatgcacttgaagccgttgcgctgggccagctcgacggcgtccagggtctcggtcagcgaaccgatctggttgaccttcacgagcagggcgttggcggagccctcctcgatgccgcgggccagacgctcggggttcgtgacgaagaggtcgtcgccgacgatctggaccttggcgccgatgcggtcggtgatgaccttccagccggcccagtcgtcctcgtacagcgggtcctcgatggagaccagcgggtacgcggagacgagctcctcgtagtactcggtcatctcggcggccgagcgggacttgccctcgaactcgtagacgccgtccttgtagaactcggacgcggcgacgtcgagcgcgagcgcgatgtcgcggcccgggacgtaaccggcctccttgatggcctcgacgatgaggtccagggcggcgcggttggactccaggttcggggcgaagccgccctcgtcgccgagtccggtggacaggcccttggtcttgaggaccttcttcagcgtgtggtagacctccgcgccccagcgcagggcctcggagaaggactccgcgccgatcggggcgatcatgaactcctggacgtccacgttggagtcggcgtgcgagccgccgttcaggatgttcatcatcggaacgggcagcaggtgcgcgttcgggccgccgaggtagcggaagagcggcaggtcggacgcctcggaggcggcgtgcgcgacggccagcgagacgccgaggatggcgttcgcgccgagcgaggccttgttctcggtggcgtccaggtcgaacatcgcctggtcgatgaggcgctgctcggtggcgtcgtacccgacgagctccgggccgatctgctcgatgacggcgaggacggccttctcgacgcccttgcccatgtagcggttggggtcaccgtcgcgaagctcaatggcctcgaacgcaccggtggaggcgccggacggaacagcagcacggcccgtgctgccgtcgtcgaggccaacctcgacctcgaccgtggggttgccgcgggagtcgaggatttccctggctacgacgacgtcgatggacggcacgaggcatctccttctgggatctgacactggttgtgcagggtcactgtggccttgcggcacgagcctatcgggcccggccgcgtcggccagccgaccgcccgcctcctgggacgaaaaaggacccaagggcctgcatcacgggacaaaactctagaaatctactgagcggtaacaacaagaggtgaacacatgcgcgctcaccgccacccccccgctcacgaagaacccggcccggcgcgctggggggatgcgcgccgggccggggaagccgtgcgaggagaagtgccgccggacgcttcccctccggggaggagagacggcgattacttcaggtggagctgctgacccgggaagatcaggtccgcgtccttgacgatgtcgtcgttgagcttgaagagcttgctccagccacccttgacgccctccgcctcggcgatggtgctcagggtgtcgccggccttgaccttgtactcgccgtcgcccttctggaccttctcgccggtcggggtggtgacggtcttcttgctctcggccttgggggcctcgcgctgctcggagcgcgtggtgggctgctcggcctgacgctcgggctgcgcctgctcgggcttgctctcgccggagccggagccggtgttcacacccgggtccacaccgtcgttggtgaggccgccggcgccggcgcaggcccaggcgcccggaccctgcaggtcgaggagcttctcggcggtggcgatctgctggtccttggaggccaggtcggcacgggaggcgtactgcgtaccgccggcggcggcccagctggactgcgagaactgcagtccgccgtagtagccgttgccggtgttgatggaccagttgccgccggactcgcactgggcgacggcgtcccaggtctcgacggaggcggcggaagcgttggtcgcgcccatcagcgggacggcgatggcggcaccggtgacacccgcgagggtggcgatacgggtggccttggacgggcggcggtgcttgcccttgctgttcagcagcatggaacgaatctcctcaccgacgcctacgaggtgagctgtcgggttcgggctgatgagttgcccggtcgcgcggtgctgctcgcgacttcacccctagccggtcccgtacgtcctcgtcggttcgacgaggcgtccggacccggcggcttacctgggtcccccgctcctgcctacggcgcttacgcgtctgttcccttcgaccgacggcaggattcggcgtgacggtcgacggggcccgcggtgcgagcggttccgaccgtaaacacaggcaaccccgacattcaaagatggacatagggggcaatcaacccgaactcgcagcggtcggcgggtcgtttccgcaggtcgggggcgatacgcccgctccggccggacgaggcgcgcgagttgaagcaaagagacccatgtctcacttacgcaaaagtggacataggtctcttaacttccccgattttcggggggttttcccgcattcgatcagttggcggcgggtgcctcggcaccttccggcgcgacctggtccgcgcccttgtccgcaccccggtccgcgctcgggtccaggcccaggtccaggttctggccgggcaggatcagatccgggtcggagcccaggaggcccttgttcgtctcgtacaggccggtccagccgccggggatctcctgcgcgtcggcgatcgcccagagactgtccccgggctgcaccgtgtacccgtcggcggtcgccgcgccgccgtcccgcgcgtcgccgtcaccgcgcgaggcgtgccgaccggactcgcggggtccgccctcctggcccgcgtcggcctcctcgggcgcgggggtgccccggtgcttgccacccttgccgtcctcgcccgtcgaggcatcgggagcggtggagggatccgaggcgtcgggcgcgtccgaggccggcggggcggagggcgtcaccgaggagtcgggagcctcgctccccttctccgcgtcaccactgccacccttgtccgcctcatcacccttctcaccgttgccggattcacccgcttcgccggttgcgtccgcttcgtcggtcggggtggaggtcgggtcggccgaggggtccgccgacggatcggaggacgggtcgacggacggatcggcggacggtgaggtgcccgggtcgacccccggcagaccgccgtccaccgcgaggccggagatcaccgcacagctgggccacgccttcggaccctggtcgtccaggaccttctcggcgacggagatctgctgcgagcggctggcgaggtcggcgcggggcgcgaacgccgtgccgccgtacgccgaccaggtctcctgcgagaactggagcccgccgtaatagccgttgccgagatcggcgctccacatgccaccgctctcgcactccgcgacccggtcccaggtggtggcctcggccgcgtgtgcgccgccggcgccgagcagcgggatggcgatggccgatcccgtcacacctgcggcgacgatgatggcgggtgcctggcgagggcggcggtgtctgccgttcgcggagcccatgggtatgccttccgtgcgactgacaagcgagtgtcctgagcgccgcgcagcggaatccgtgcctgcttcggcgcacaagtgacgcgtgagcaacgtgcgaccgacgcgtcgaaccgtgaacctagcgggactcgaacgtgtgtcacaagtcgatgcagcgcagatcacgtgaaagtcacagagttgacactgcgtcacttttttcggatcggcttcccggttcgaactcgaccggaagggtgcgcagtccgcgcatgatgagcccgccgcgccagcgcaaatcgccaggttctcccgcaagtcgcaggtcaggaaggcgcctcaacagcgtggccagcgcggtctgcccctccagccgggccagcggcgctcccaggcagtagtggatgccgtgcccgtatccgaggtgctgattgtcacgccgtgcaaggtccaaggtgtccggatccgtgaaccgctccgggtcgcggtcggccgccgccagcaccaccagtacggggtccccggcggcgatctcctcgccgcccagggtcagcgcctcggtggcgtaccgccaggtcgccatctcgacgggcccgtcga

SEQ ID NO: 2793 - DNA, 2109 bp, Unknown
  Kingdom: Bacteria, Phylum: Actinobacteria, Class: Actinobacteria, Order: Streptomycetales, Family: Streptomycetaceae, Genus: Streptomyces
tggccggacccggcggggccgtgtggaacgagtggctggtgcgggctccgggcgcggccggaccggagctgacctctccggacgcgctgcgcccgtggtcgtgcaccgtggacgaggcggcccgcgcctttcccccggcccggccgatggagggcagcgccccgacccggtggtcgctggccgtcaccgatccggtcaccggccggcagcgggtcgcggagttcacctggggtctgttccagcggctgcttccggcccgctgacctgaggaaccgtcagctctcctccccttacggcgcatctcagcgcgcgcgaaggggaggagagcgcgaccatgcaaggagagaccggctgccgccggtgccccccatccgcgctctcgggagaactcgccgtgaccgtcagccttgagcagttgcagcgttgccatgtcgccgtcgatctcggggccgcgaggacccgggtgtacgtcaaggggctcgggctcgtcgtcgacgaaccgagcgtggccgccgtcaacacccgtaccggctccctcatcgccgtcggcgcgctcgccgagcagatgaccggccgcacccccgagtacatccgggtggcccgtccggtctccggcggcaccgtcgtcgacatcgagatggcccagcggatgctacgccacctgctgggcgacaagctccgccgccagttgcgccgcaagccccggctgcgcgccgccgcctgcaccccgcacgacgccgacccgctggcccagcgcgcgacggtggagaccctggtcggtctcggcgcccggcgggtcgagctggtggacaccctgatcgcggcggccgtgggctgcgggctgccggtcgagcagccgaccgccaccatgatcatggtgtgcggggccgccaccacccagatcgcggtgctctcgctcggctcgatcgtgaccgccgtccggatcccggtgggcggcaacgcgatcgacgaagcgatcatccagcatctgcgccagcggcacgagctgctgctcccgagccagtccgtgcgcccgctccagctggcgctgcacggcaacggtctccagctgaccgggcccgccctcaccgagatccacggccgcgacgtggcgaccggtctggcccgctcggtgcaggtcgacaccgccgccgtacggcaggccatccacaccccgctgaccgcggtgctcgacggggtgggcaaggtgctccgcgactgccctcctgacctggtggccgacctcgcggaccggggaatcatgatggtgggcggcagcgcgctgctccccggcctcgaccagatgctgcgcgacgcgaccggaatgcccgtgcacatcgccgagcgccccgacgtctgctcggtactcggcctcggcgcgatgctggacggcaagatccagccgatggtcctcaacccgctggcggggtgagctcgtcggcacggaccgggcggtggagcggccgacggggacggcgcgggtgaacgggcccgtggagcccggcccgtccgccgccggacggctgccgatgctcctggaggcggtcctcaacgtcggcagcgacctggagctgggctccaccctccagcagatcgtggacgcctccaccgccctcaccggggcccgccacggtgctctcggggtgctggacccggaccgggaccgggtcgaggagctgtacaccgcggggatgacggaggcggagcggcagcacctcgacctcttccccggcgactcctccggggggccggccgccctgatcgaggaggaccggcaggcctttccgcccggccgtcctccggcgcggaccttcctccgggcgccgatcctggtccacaccgaggtcttcgggcatctctgcctcgccgagaagccgtcggggccgttcagcgacacggatctggccctgctgcgggtcctcgccgcccaggcgggcatcgcgatcggcaacgcccggctgtacgggacggcccggcagcgcgagcgctggatcgcgggagcggcggccgtcaccacggccctgctgaccggcaccgacgcggccgacgcgctgatgaccgtggccgaccgggcccgggtgctcgcgctgccgggccgtcccgtacagc

SEQ ID NO: 2794 - DNA, 11178 bp, Unknown
  Kingdom: Bacteria, Phylum: Actinobacteria, Class: Actinobacteria, Order: Streptomycetales, Family: Streptomycetaceae, Genus: Streptomyces
tcgcccgcgccgagggtcagggcgaggtggccggggatctgctccagccgctgcggggcgaagagggcggcggagctgacgaaggtgaagatcacgtggccgggcggtccgatccgggtggcgtcgcacagcaccttctgggcggcggcgagcagcgccccgaccgcgatgagcacggcggtcgatccggtgagggacgcggtgaccagggcgacggcgagcgaggccgtcatgccgagcaccacacccgcgaccgccccggcccgtcgggcgtacggcaggccgtgcccgtagagcgcgcagagcgaacccgccatggtgtacatcacgaggtccggacgaccgatggccaggagcgtcagatggggtacggcggaggcgacgaccacgctgagggcgggcttgaaccaggtgtccgagggctgcgagagccggagggctgaggccagcgggaggctgcggacggagggccgccgccccgggcgagtaggtgtatcggtcacccatatacgttaacaggtattacacctgtaaatcatttggactctgttcgagcggcgacgactcgggcacactgtcccgcggacagcgcgacccatattctttgaatcttcatgcacccactacgatgacgggcgatgaccagggtgagcacgcggaccgaccggcagcggtaccgctcccgcacgcccctcgctctgggctgggtgttcttcctgccggccatgctcttctgctgctcggtcaccacctcgtccgccgccgcgccggtcgctgcgggcccggccggggcgaccgtcgtccgcgctttcaccccgacgccggacgccgccttcgaaacggtcgtcatgacctccccggcggaccgcgggctcgggacgtcgtgccacggcggctcgacgcacacggcggccgtcgtgctcccggtgtcgtccgctcccgtcgccgttccctcgcccgtggccttcgtccccgccaccccgctcaccggcgcggcggccatccggggtcccgcgcacgacggtgtgcgctccgtcgatcaactacgccttcaggtccagcggatctagaggccgggtccgctctcccgccgcgccccggcgcaggttcaccgggagcggtttttcgcatgccccgcatcctttcccccttcatgcatcgccctgtatgcatcggttgaacgacgaggactccccatggcttccgccaagaaccagaacaacccggcctcagcacgtcgcgccaagctcgaagaggcgcgccgcaaggaacgcgcccgcgagcggcgggtccgcatcatcaccatcggcgcgtcggtggccgtggtcgccgccctggtcgccggcggcggctacctgatgtcgcaggcgaacgagaaggagaagaaggaggatcaggccaagacctcgcccgtcaccggcgagcgcagctgggacaagctgacgcaggagcacgtggcgaccaaggtcgactacccgatgaacccgcccgtcggcggcgaccacaaccaggtctggatgaactgcaacgccgacgtctactccgacgagataccgaaggagaacgccgtgcactcgctggagcacggcgcggtctgggtcacgtacaacgacaaggcctcggacgccgacatcgaggcgctcaccaagaaggtcaagtcgactccgtactccctgatgagcccggtcaaggaccagaaggaccccctgatgctcagcgcgtgggggaagcaggtgacgatcaagagcgccacggacgaccgggtcgcacagttcttcaccaagtacgtgcagggcccgcagacccctgagccgggagccgcctgcaccggcgggctggacaagtgaccgccctggcgccttccggctccacccgtcggatggtcctcgcgggagccgccgtgctgctcgtggcgctgggactggtggcgctgatggtcgtacgcccctccgcggcctccccgtccggggcctcccccgcggcgcggtccgctccggcggaggactccgtggacgcgggcttcgcccgggacatggccatccaccaccagcaggcggtggagatgtcgttcatcgtgcgggaccgcaccgacgacgcggacgtgcggcgtctcgcgtacgacatcatcaacacccaggccaaccagcgcggcatgatgctgggctggctggagctgtgggggctgccgaagagcgcggccgggcggggagcagcccatggcgtggatggccggtacgggtgggcacgagcacggtgggaccgatgcgggtgggaccgagcacggtgggcacggctcgggcgactccgaggcgggttccggtgcggacggggtgctcatggcgggcatggcgagccgctcggagctggcgcggctcgaccgcctcgacggtgagcaggccgaggtgttcttcctccagttgatgacggaccaccacaagggcggcgtcgccatggccgaggcctgtgcgtccctgtgctcggttccggccgagcagcggctcgcccggggcatggtcgagggtcagcagtccgagctggggctgatgcgggccatgctgaccgagcggggagctgagcctcggccctgagccatggcttcggtcctgaccccggggcggcgggtgcgtcagctttcgtccttgtgccggcgcacccgaacgggtggttgcggtcgcgcggccccggcgggccggtgacgatgggttgcgctcggggccgtacggcagtgccatcggcacgcaggaggaaatcccccatgacgaccgccaaagacatcatgcacagcggggcccgctggatcccggcccacgagacgctcgaccgtgcggcgcagctgatgcgcgagcacaacgtgggcgcgctgccggtatccgccaacggtgactccgaccggatggtcggcatcatcaccgaccgcgacatcgtcgtcggctgtgtggccaaggggcacgacccggcgaaggtcacggcgggcgacctcgctcagggcacaccccgctggatcgaggcggaggccgatgtgaacgcggtcctggaggagatgcagacccaccgcatccgccggctgcccgtcgtcgagaacaagaagctggtcggcatgatcagcgaggccgacctcgcgcagcacctcaccgaggagcagatcgcgggctgggcggagaaggtctactcccgcggctgagcgcctgtacgacggtggcccggcaccctcctccgctccggcggagtgatggaggtgccgggcccgccccccaccctggctgtatacccgccgggggtagggtggcccgcatggcggacaggacgcggagcaggagcgtgacgtacgggcagctgatgctgttcgccgctctgctgttcggcatcgtcaccatgcatacggtcgggcatccggcggagcacggcggtacgccggtgtcggcccccgccatgaccgagcacgtggccggcgcccctggaccggctcaggccccgggtctcatcccggctcatggcgtcgccgacgcccagcagtcgccgccgcacgactcccccggctccggcacccccgtgagcggtatggatccgctctccgtctgcctcgccgtgctcggcgtctggggcctcgctctcgtcggttcctggctgctcgggctgcgcgccgacggtcggcctctcggtacgccggtgggtgcggggatgtcgcgggtgctgcggccgattccgccgcgccggatatcggtgctcgccagcgtttcggtgctgcgcatttaggagtgggtgtttcacctccgccctcactcccggcaacaacagcccttccgttcttcagaggtgtattcggcatgcccacacaacccactcgacgcgccgtgctcggcgcggctctcgccgtagccggcacgggagccctcgccgcctgttccgacggtggcggcggcgatcacggcgggggccactcccccggcggagcgcagaactccgacacgtacgtctcgcccggcggcagggaagtcgaggcggccgaggcggcgcgcggctccggacccgtgcgcaaggtctccctcaccgccacccgtgcccggctcgacctcggcggcgggcggaccgtcacctcctgggcgtacggggaccggctccccgggcgcgaggtgcgggtgacggcgggcgacacgctcgccctcaccctcgccagccatctgccggaggccacctccctgcactggcacggcctcgcactgcgcaacgacatggacggggtccccggcctgacccagcgggacatcgcaccgggggccgacttcacctaccggttcgccgtgccgcacccggggacgtactggttccacccgcactccggcgtccagcaggaccgggggctgtacgcgccgctgatcgtcgaggacccgaaggagccgttggcgtacgacaaggagtgggtcgtcgtcctcgacgactgggtcgacggagtggacgggtccactccggacgccgtcctccaggagctgtccgggggtatgggcggcgggatggaccacggcgcgcacaccatgtcgggcgaggacgacgaagggggcgggagcggtgacgggccctcgcggatgatgatgggggcctccagcgaactgctcggcggggacgccggcgatgtggcctacccgcactacctggtcaacgggcgggtgccgcaggacccggcctccttctccgcgcggcccggcgaccgtatccggctgcggatcatcaacgccggtggcgacaccgccttccgggtcgcgctcggcgggcaccggatgaccgtgacgcacaccgacgggttcccggtccggcacaccacgggtgacgcgctgctgctggggatgggtgagcggtacgacgtgctcgtcaccgccggcgacggggtcttccctctgaccgcgctggccgaggggaagaaggcgtccgcgctggccgtgctgcggaccgggagcggggccgcgcccgccgcctccgtacggccgaaggagctggacgggaagctggtggaggcgggtcggctggcgccggacccctccgtggcgctgcccgcccgcgcgccggaccggacgatccggatgcggctcaccggtgggatggcgaagtacgactgggctttcgacgggaagccgtacggcgcgaaggaccggcggccggtggaggcgggcgagcgggtgcggctggtcttcgacaacgggacggccatgtggcacccgctgcatctgcacgggcacaccttcgcgctcggcgggaacgccgccggggcccgtaaggacaccgcgatcgtgctgccgcaccggtcgctgaccgtggagttcgacgcggacaacccggggctgtggatggtccactgccacaacgtctaccacgcggaggcggggatgatgacggtcctgggctaccggagctgaccccgcgatccccagtgggtcggtgcggacagccgcttcgacctgcggtttcggtgggccggagcagattttgcccggcccgccgggacatcgcgtcagaaagacgattacactgggctccgtgcctcaactacgcctcgcactgaatcagatcgactccaccgtcggcgacctcgccggtaacgcggaggcgatcgtccactggacccggcacgccgccgagcagggcgcccacctggtggcgttccccgagatggtgctgaccggataccccgtcgaggacctggccctgcggtcgtccttcgtcgaggcctcgcgtcaggcgctgcgcgcgctggccgcccggctcgacgcggagggcttcggcgaactgccggtcgtcgtcggctatctggaccgctccgagcacgccgcggcgcgctacgggcagccggccggctccccgcgcaacgccgccgccgtgctgcaccgcggcgggatcgcgctcaacttcgccaagcaccacctgccgaactacggggtgttcgacgagttccggtacttcgtaccgggcgactcgatgcccgtcgtccggatccacggcatcgatgtggccctcgccatctgcgaggacctgtggcaggacggcgggcgtgtcccggccgcccggtccgccggcgccgggctgctgctgtcgatcaacgcctcgccgtacgagcgggacaaggacgacacccggctggagctggtccgcaagcgggcccaggaggccggctgcacgacggcctatctggcgatgatcggcggtcaggacgagctggtcttcgacggcgattcgatcgtcgtcgacaaggagggcgaggtcatcgcccgcgccccgcagttctccgagggcagcgtcatcctcgatctggagctgcccgccgccgaggccgtggcgccctccggtgtggtggacgacgggctgcgcatcgaccatgtggtgctgtccgaccggcccgtcgacgcgtacgagccggagctggcgggcgggtacgcggagcggctgggggacgaggaggagatctactccgcgctggtcgtcggactgcgcgcgtacgccgcgaagaacggtttcagcagcgtgctgatcgggctctccggtggcatcgactcggcgatctgcgccgccatcgcctgcgacgcgctcggcgctcagcacgtgtacggcgtctcgatgccgtcgaagtactcctcggaccactccaagggcgacgcggccgagctggcgcggcggaccgggctgaacttccgcaccgtaccgatcgagccgatgttcgacgcctatatggggtcgctccagctcaccggcctcgccgaggagaacctccaggcgcggctgcgcggcacgatgctgatggccctgtccaaccaggaggggcagatcgtgctggcgccgggcaacaagtccgagctggcggtcggctactccacgctgtacggggacgcggtcggcgcgtacgggccgatcaaggacgtctacaagtcgtcggtcttccggctggcgaagtggcgcaaccgggccgccgaggagcgggggcagaccccgccgatcccggaggcctcgatcaccaagccgccgagcgcggagctgcggccggggcaggtcgacacggactcgctgccggactacgacgtcctggacgcgatcctggagatgtacgtcgaccgggaccagggtctcgacgccatcgtggcggccgggttcgacgcggagctggtggcgaagacgctgcggatggtggacgcggccgagtacaagcggcggcagtatccgccggggacgaagatctcgcccaaggggttcgggaaggaccggcggctgccgatcacgaatcgctggcgcgagtcgtcgtagcgggtgggcggctaccgggggcgtccggtggccgccttcgtcctcaagcgccggacgggctgagcgcgccggcccgtccggcgcttcgttctgtcctcaagcgccagacgggctggaacggcccagcaccgacgaaggcgcgggcccgccctgcccagggttccgtcctcaatcgccggacgggcttgagtgggtgccggagtgggtgccggacgggctggtcgtcgccggctcgcgtgtcgaggtgcgggagcctcctgccaccacgcgggatttcggtgacgggtcgcggtccaggcagcccgctgtcaccgccactgccaggcccgccaccgcgaggaccgcgccgaccagggccggggacgtccagccccagcccgccgcgatggccacgccgcccagccacgcgccgcccgcgttggccaggttgaacgcggagtggttggaggcggaggccagcgtcggggcgtccttcgccttgttcatcaccagcatctggagcggggtcgtcgtcatgaaccccacgccgcccagcagcaccaccatcaccagcgccgcccacgggacgtgcacggtgaacgggaagaccaccaggaccaccgcgagcgcgccgagcgatccgtacagggtcgggcgcagcgcccggtccgtgagagggcccgcgaccagggctcccagggtcatcccgatgccgaagagggccaggaccagggtgaccgaggattcgccgaagcccatcgccttcgtggtcatggccgagaggtacgagtacaccgcgaagaccccggcgaagccgaagacggcggtgagcaggccaaggatcacctgacggttgccgagggcgcgcagctcacggcggacgtcctgatgcgcctcgacggggatgtggggcaccagacgggtgagggccgccatcgcggcgaggccgatcgcggcgaccacgaggaaggtggcccgccagccgaggtgctggcccagcagggtcgccgcggggacgccgacgatgttggcgacggtcaggccgaggaacatcgtcgcgacggcgcgcgcctggcggccctcggagaccagccgggtggcgacgaccgcgccgacgccgaagaacgcgccgtgcgggagaccggcgaggaagcggcccgcgatcagccagccgaagtccggggcgagcgcggaggccaggttgccgacggtgaacagcgccatcaggagcaggagcatccgcttgcgcgggacccgcgagccgaggccggtgagcaggggcgcacccaggacgacgccgatcgcgtacgccgacacgaggtatccggcggtgggcacggacgtgccgagatcgtccgccacgttgggcagcagccccatcatgacgaactccgtcgtgcctatgccgaaggcgctcacggccagggcgaggagagccaggggcatgaggagggaacctttcatggaaacgggaggctgtggaagcgggggctggggggcgcgcagcggggaacagcaggaagccgttgccggggcacccggggtgccggacaacggctcgcgccatatgtaagttaccggaacaaattctcgcagatgtttatgccgggacgcctaccggcaggtgaacggctcgttgcgcccgtcccaccgagcccatccggcccgccgggtacgtcacagctccacgcgggccgcgatcgggaggtggtcgctgtcggtcgccgcgagggtccaggaggccatcggctcgacgcccttgaccatgatctggtcgatccgggccatcgggaacgaggcgggccagctgaatccgaagccgtcgcccgccgcaccctgggtggagcgcatctgcgcggtgaccgcgttcagcgagcggtcgttcatggtgccgttcaggtcgccgagcaggacgacgcgctccacccgttcgtcggcgatggcctcgccgagcgcgtcggcgctgttgtcgcgctggttggcggtgaacccggcgtgcagcttcacgcggacggacggcaggtgggccacgtacaccgcgacctcgccctgcggggtcctgaccgtcgagcgcatcgcccgggtccagcccatcttgatgtcgacgggcctggtgtcggccagcgggtacttgctccacaggcccacggtgccctggaccgagtggtacgggtagcggtcggccagcgacttctcgtacgtggagacctgcccgcccgggagttcctggagggccacgacgtccgcgccggaaccggcgacctgctgggcggtgccgtcggggtcggggttgccggcgttgacgttgtgggtggcgacggtgaggtcgccgccgccgccggacttgtcggtgagcaggcccccgaagacgttgagccagaccacggcgggcagcagcagcgcgatcagggcggtcgcggagcgccgcaccagacccaggatcagcagcaccgggatgaagagcgcgacccacggcaggaacgtctcgacgaggctgccgaggttgccgagccggttggggatctgcgcgtggacgaccatcagcagggtcagcagcaccgagcagagggccagcacgatcccgcgtcgccagacgccccggtcggacctcagcgtgtcccacaggccccggaagcgggacccgccggcctccggctgctccgcgctgccgttgtccgtttccgctccgtacgcctgcaccatcgcactgtcctcactgccttgccctgcacatcgccgcgccctcgaccctaggcgatgaacggcgtctttccggccgtcggcccacagacccgcccgacgtcccacgaccgtacggagtgcccgtacgggaagcaggacgacggaggcaggacgacgggttccgggccggggcgagccggggtgccttgtgacagaacgatcacacttgtacgggggcgagccctcccagcagggcggcgaagatattgaccaggagcaccgaggagcgctgggcgaggccccgggtacgcatcgattccagcatcacgcgcaggtcggcgagtccggcggtgccggagacgggcgggtcggtgggctccatgtcgcgtacgacgtcgacgaagctctatttcgatacgagaccgtctcgtatcgttataagtccctcccggccactgttcggacacccgtgccggcccacttcccgagtggtgggacgggatgccaccatggaagggatccggggacgccgtcagggcgcctcgagatgacgaaggagccaccggccatgtcgcttcaggctgcacagaatcagtcctcccccgcaggtgcgtccgccgacagcagcaaagcgctgtacggagggaagtccacccgccgcatcaccgtccacgacatcgccgccgccacggaacgcggcgagaagtggccgatgctcaccgcctacgacgcgatgaccgcgtccgtcttcgacgaggccgggatcccggtcatgctcgtcggggactccatgggcaactgtcacctcggctacgagaccaccgtgcccgtcacgatggacgagatcgccatgctgtccgccgccgtcgtccggggcaccaagcgcgccctcgtcgtcggggacctgcccttcggctcgtaccaggagggtcccgtccaggcgctgcgcaacgccacccggctggtcaaggagtcgggcgtcggagcggtcaagctggagggcggcgagcggtcccacgagcagatccggctgctggtcgaggccggcatcccggtcatgggccacatcggcctgactccgcagtccgtcaacgccatgggataccgggtccaggggcgcggtgaggaggccgcccagcagttgctgcgcgacgccaaggccgtgcaggacgcgggcgcgttcgccgtcgtgctggagctggtgcccgccgagctggccgccgaggtcacccgcac

SEQ ID NO: 2795 - DNA, 28797 bp, Unknown
  Kingdom: Bacteria, Phylum: Actinobacteria, Class: Actinobacteria, Order: Streptomycetales, Family: Streptomycetaceae, Genus: Streptomyces
ccgcatgcaccgcatgcaccgcatgcaccgtggtctccgacatccacgtcccgacggctgcgaccgccgagcggacgtactgccgccaaccggcggccatcagcgaggccggcaagaccttgctctgcaggctgcgcggccatgcgccgaagcgtcccgcccggcgtactcgccaaagcgacgggtacggaacggacaatcttcaggcaccgctgtcctttctgtccgagcgggcgtcggcggggccggtgtcgcccagagaccgtcggtcctcgtcggtccacttgcgggtgtcgcgtgggtcgacgtacggctcctccgtcggtgggtggccgccgatgacggcacgctcgcgggtcatttccgcgtcgagttccaggccgagcagaatcgccaggttcgtgatccacagccagaccaggaagatgatcacgcctgccagagtgccgtaggtcttgttgtaggaaccgaagttggcgacgtagacggcgaaggcggccgatgccaccatccagatcagcagggccaacaggctgcccagcgatacgaacttgaagcctcggcccttggcgttcggtgcagcccaatacaggagcgccagcatgatggtcaccagtgccaccaggacaggccatttggcgatcgaccagacggtcatggccgcgtcacccacacccagggcggtgccgatctggcgggcgatgccgcccgagagcacgacgatcagcgcgctgacgcaagccagcaccatcagcaccaacgtcagaccgacgcggaccgggagcactttccaggctgggcggccctctggcacgtcgtacacggcgttcgatgttcgaatgaacgcggccacatagccggacgcggaccacagcgcggccagcagacccacgatggccacgacccagccggtcccgctgctggactgcaactgggtcaccgcgttggtgaggacatcgcgggccgctcccggcgccagcttctgcatgttgtccagaacggtctgcgtggtctccttgccggagatgccgagcagcgagaccaggaccagcagagccgggaacagggccaggatgccgtagtacgtcagggccgcggcccggtcggccagctcgtcccgcttgaactcgctcagagtgcgcttcaacaccgcaccccacgatttcctgccgagcttcgtgggcgattcgggcggatcatggtccggctgtgcgtgcgggccggcacccgaccggcttccctccgggcccaggctgtctcgatcatgctgctcgtgcgccatggaaatcacacctcctcgacggtgtacggccggcgacctcacggccgcttcatgctgctgggcggacgacacgcccgccgggcggggccccgcagcggagggggccccgcccgacaccggacgcttctcggtggcggaccggtccgtggcggccgagtcagcttccggcttgccgagcggcgtcctgtccgacctcgcgcagacccgtccctgcctcctgccccgcgtcctgtgccttctgcttcgtggtctgcgccgcgtcctgggccgtgctcttcaccgcgtccacggcttccgtcgcaggcccccgcatgtcctccttgacgtcctgcgcaacgtcctgggcggtctgcttcacgggttcgaggagatcgtcggagtgctcgcgaagctgcgcgccgactcgttcctcggcccccgtggtggggagcaacgcagctgccagcatgccggcgccgaaggcgatgacgcccgctgcgacggggctgccctgcgtctgccgtgtgatccgctcgggcgcctggcgtacggaccggcccacctggtcggtggtgtgcctgaccgcgtcccccgcctgttcggcggtatccgcgatgccctgcttgcccgtggctgtggtgtcgcttgccgcgcccatcacacgctccttcacgcgggtgatccgccgttgcgtggcgtctgccttgcgccgggcgacctttcccggggtgaccttgtccgcgagacggtccacgttgtgggcgagatgggcccgggtgtcttccacgtcggacttcagctcgtcgggttgcgtgcccattgcgcgtcctccttcagcgtttcgacagtgcgttcgggcttggcgctgactgtcctgaggcgtttgcggccgaccaggaagaggacggccgccaggagcgcccagagcgcggtcacgataagcgcggcccaggccaggtcgaccacgtgcgcgagtccgaagacggccgccaggctgcccatcagcaggaccaggtggccggcgtacccggagccggcgagcatgcccgccgccttgcccgctcgggtcgcgctctccttgacctcggcttttgccagttcgatctcctcgcgtaccaactgcgcgagatcctcgctgatgtcgccgaccagctctccgatggaagggtccggcgacggtgcgcgggaggagccggcggacggggcggccggctggtcggtggtgtggggtgaagacggtgtacccacggctcggttcccctctccctacggctgctgcgaatccgggtacgggccgttcatcgggacctgccccggtgcgacggttccgccgtcggacggagtgaggggcggcgatgacggcggcgggcgggtgtccggtgcttgctgggcctcgcgtcccgtcccgacttgtggcgcgtccgggcccggaccaccgtccgtcgggctcgtgtgtcgatcttccccgccgtccgcggccttggtgcccttggcgagccgggcggtggcgaagcccgcgagcgccgcgcccgccaggaacgccccgggtcgacggcgtgcgaagtcctgcaggtcgctgagcagaccgtccggccctctgtcctccagccgggcggcggcctggtgcccgcggtccgctatctgcttcacagcgccggcggcggaggagtcgctgccgctggtgcggctcatttcgtgcagctcgtccgccagccgccgtacgttgtccgccagacgctgtgtctgcgagcgcgcctggtcctccagttggctccgcagctcgctcacgatgtcctgggctcgtgccgtggcctcacccgccacatcagctgcctgttccctggcggtacccgccaggtcaccggcctgggcggccaccaggtcggtaccttcgccggccttgtcccgcgcggtctgtgccgtcgtcgccgtcgttccgtcgtcaggacggctcgaactttcgaagtcgctcaaagctcctcctaggtcggtcctgttcgggaggtgtgtcgcgcgcgtcgccccctcgacgcttcctcaatggttgcaaagtcggcgaacatacgcgattgggaaaaaatgatgaactgcctgagaaacgccgggccagttcggaggccccatcggcgtggcctgcgcgggtcttcccgttctggtgccgacccaacaggtgcccaacaggcgtcaccgcaaggggcgatgccggcggagcaggcggccgtgacggtccggaatcgctggtcgttacagaaggtggacgagcgtctccccctgtccgtttcgacggcctcaccaggctggccgcaccgcgttaccaggccgacgcgcgcacctcgatgccgtactcatgacgctgtcggcggcttcgtcgaagaacgacagatcatcagggggcaacgatccatcgccccggcgaaagccgcggctcaccccggctccggcgcagccgatgtccgtcgacggggatgtcgccggtgaggcgggtggtcgtgtgggacccgcggccgtctacgcatcggcgtcgtcaccgtcggcttccctgtcgccttcggcctgggagggcgtcgtgcgtccggggtctacgggccggtgctccgtggcttgggccgtttcgtcctccgggcgctcgccctcggcctgcgacggtgtcttctcctgcatcggtcggctctcttcctcgtccttgggcgggcgctgcggggacacggcccgcgcatatgtgaggagtgcccgttttgggtcgaagtagactctttctttcgcgatcgtgctcccgtacgtcagggcggaccgccggtgggtgcggccggtggggtaccagtggaggcgacgacggcggccagagcgacttggacaaggtcgccgccgtagtacatgagctgcgaggcggggtgcacgtcgctggtgacgaaggcggtgccgggcggacagcatctccttcaccgccttcctttccgtttcaccggccgtatgcgtctcttcggggcaggggcccgacatctgggtggcggccggggcggacggcagcgtgacgctgcccgggtcccggaccgccgcgtgtggcaagcgcgtcggcgacggctcccgtggcgaaggcgtagacggccttgtgcagcatgtcgatgacgagttcctggcgaggccaggtggaaggcggggctccgactcccgtggcgttctcgaggatctggtcgttggcgaggcgcacgacggtgaacttcgccgaggcgaccggtccgcgcagtccggcattcgccatgacggagcgcagcacgcccaggagggcggcctgaccgaagtgcatggcccagttgacctgcggaggctgccttccgggatgctcgggcataccggtaaggcgctgaagcacccgcgcgggcacatgggagtcgggccgaccggtgacggcttgctcgagtttttcgccgagggtcatgaccacaccgccgacggcgcccgcgatcaaaccctgcaacagtgcgcgcttgaccatgtcccgccgggtacccaggaccgcggctttgacgcatgcggtcgcccgcacgggcgtccggtcgcctgtttgcccacccggatgctccggtcggtgggctcgtcgccgtgcgccggggtaggcgtacccgtggcaggcggagtcgtctcgggaaggcagtccctcatgcatgcaccggtccaccggcacccggctcgccgaccgtggcctgattcgcgcaggtcgatggcggtgtgcggtgtgatcggagtggcggtgatggctgcggtcgacgagatcgtcttccaccagattctgggctggcaccacttctacgaccgctccaccaccagcgtgggtctgatgtcggacggcttgctccacaccgccgagctgttggcgctggtcgccgggttcttccactacgcggacctgcgccgtcgacgcgctctggcgcgggcccacgcgtgggccggcttcttcctcggccttggcatcttccagctgttcgacggagttgtggatcacaagctgctgcgcctgcatcaaatccgttacggcgtcgacatcgccccctacgactgggcatggaacgtagccgctgtggtcctgctgctgatcggctcggttctggccatccgcgcgaggcgttccggccggaccgagccgtcgtgacgcccccgcaggcccacctccacgcggtaacaggtcatggcctggtcgagccggccatcgcggtggcggcgctgctggcggcaggcacctatgcgctggccgcaagacgtctgcggcgccggggagacatctggtcccggtggcgcggggtgtctttcaccgccgggaacgccgctgtggcctgggcggcggtgggcccggtaccgggcggtcccttcaccgcccacatgacgcagcacctgatcctcggcatgacggccccgctgctgatcgccgtggcccgccccctcactctgacgctgcgcatcctgtcgcccggcgctgcccgccggggtctgctggccctgatgcactcacgtttcgcaggctggctgatcttcccgccactggcggctctgctcgatgtcggaggactgtggctgctgtaccgaacagagctgctctcagctacgcagcaccatcccctgcttcacgccgtggtgcacgcgcacgtcctgggcgccgggctgctgttcaccttcgctgtgtgtcggctcgacccggtgcgccgccgctggggtcttcccttgcgcgcaacgaccctgctggccgccggcgccgcgcacgccgtgctcgccaaaagtctgtacgcggcgccgccacctggcaccgccttccgcaccgccgacctgcacaccggtagccaggtcatgtattacggcggtgacctggtggaagccgcgatcgctacggtgctcgccatgtcctggtaccagttcaccggccgcgtccagatgcgacggccacgcggggcggacgtgctcggcgtgagatgagacgggcgagcgactcagtgggccggcagagccatgcgaacaggggactggtgaccacgaaccagtggacgctgaccctgccccgctccttttccaggatcagtggggtcccgtcccggtagaggtagcgaaggtatcggtggcggatcgacgctccggcgatcagcagtaccggtgaggagatgaaaacggccaccgggacaagaactctcacgacggtgatcttcgccttctcctcatatcgcatgcggtcagtgtgctgacgtctgggtggcgtgtcagcctgccctgcggggtttggctgggaccttgtgatggcgagcgcctcggccccgcggacctgaacgcggtgggcggggcaggtaatcgacctcccagtcggtgacggcctgatccggcgggcgggccgcccagatgagctccaggtcgtcggccaggtcggccgtggaggacagtccccgcgcgggcgtactccaggtgtgccggggacggccgccacgagcgtgggcagcgccgtactggtgggtctcttcgctcgatggctcgagggtagagcagttgggttccggtagaggtgaccggggtgcgggctcgttgatcagcaggttggccgaacttctgacgcgggcctctcccccgccttcccagaaccggcgggggttgagctggtaggtgccggagcgggggcagccgacccggtcagtctgttgagtcgcaggaggcgcgggacggccttctggatggcggtgtcgccgctgccgccggcgacccgggctcaagaccggaggtcaggcgacggagcccggtcgaggtcgcgccaggctcggggagtgaggccgtacttctgcttgaacaccttgctgaagtgagtcgcgtccacgaaaccccagctgcgtccgatggcagcgatggtccggttccgggcgttcgaggccgccagttctcggcggcagccttccagacgctgggagcgaatccagtcacctaatgtgatatccgagcgggcgaggatcgcgtacaagtgtcgtaccgagatgccgtgaacggaggcgatccgtgtggctgacaggtcacgatcacgcaggtgttcccgcatgtagctcatgattcgaagattgagtgtcatctccatgggcccgcgggacagctgcgaatcgccaagctgggaggcgactgccgcgcggatcagttcgacgctcggtccggcgaccacctgggcgtgccgctcgtggcggagtccgtccgtgacggccagctgagagaagtacgcaaaggcaagggcggcaacgggattatcggatccgaaggtgaccgcagtgacctcccgcagtgaccgttcaggcagcgcgagcgccttgcggggaaagcggagaaagtggtgatcgacacccccgtcgaaggagagaacgtatggaacagatgtgtcgtacagagcgaactctcccgctcttagcagcgcctgccggtcattctgttgaaccaggctggttcccgttttttggagacccagaaagacgaacggctcggtatcctcccgtaccaaccgctgtggccgccgtatcgtcagactggtcgcctctcctgaacagatgacgatgcagccgaccgtattcagcctgaccttgaccgagatgtcctgtgggggatgatggtggtcgatgtcaatccgtacgaccgattcccatatggcatgccggaccgcgtcctctcgctcccgcggggagataggggtggtgtccaggtttgcactcactagaggatcatccttttctccagccgagctcgctggcaaataaaaaccaccgcaacgcacaacgagagctcggcggcatagaactcacctcagggaacacccaagggcaggatcgggtcacgcgccgcaggagaccggcacccgcgatttacgctgccccggacgcctctctccgctgagccatcccctcacgtaatcccgtgaccagagtgccagggtccgggacggagggcaacggtactcgcgaaggtcaagatcgttgtgtcacggcgcgttcgccatgtgggtaccgcgggcagcgggggtccagccctcgccgaacggttcagcgccgccggcctggccttggccacatcacccctcctcgaaagaaagcccctaacgagagggccgtaccgccagccgccccgagacgatcaccttttgtggttggttcggagcacccgtgcacaactgacaaacttccgtgcaagcctcgcacagttggcgcggcgtggggagcctattttgtggaagcgccagacgcagagggctgcttcccaaaacgcattcttcggactgcggtgcgggcgctgctcaacccagcctgattcgtcggcgttctcgtcgataacgacgtccgcctccactcgatcaatcagacacgagggttctccatgaagttgatccggtcattctgtctccgcacaggaattgccatgtctgcggcgggtgtgagcctcttcatgtttccgggggtggccgaagccgccccggcgaatggaacctacaacggatcgtgcggatccggatatggggtggtcgattccctggacatcagcggttacggacgcgtctttctgacctggaacaagttcaccggctacaactgcgtcgtcacacagaagtacggggcgaacgacaacccccctgatctctactacatgacggcctggatccagcggaccgccgacggcttggagaaggaggacaaggacctgtaccgccattacgccggtccggtctacgcgtacggacgggctacctgcatcaactggggcggttacgtggaccccgcacccaccgggtcgtaccagttcgggtcccactgtggctgaaaagcggaacagagggacggccatgatccccaaagcgttcaggtttcgtcggccccgggtgctcagggcttccgcttccgcggccaccgcaggcgcggtgacggcaggcctgctaattctcgccgcgcccgccgcccatgccgtcggatacgggatctgcggaagcggccacaagctcatcgattccgcgcaaatcgggaacctcggaacggcctacctgacctggaatgccggagccggccaaaactgcctggtcgtcgtacgcagcgacccgggcgcctccgtgcggatgagcgcgctgatcggacgggacgacggcgtccaggacgtcgactccggcttctacaccacatacgcgggcccggtctacgtggacggccgcggcacctgcatcgactggagcggcgtgatcggcaacgaggagatcagccgctggcactcccactgcggctagccccgcccgttcaggatcaaggccccgtgggacacgcacttcacctgacaggaaaggaacacacccaatgaccaacacccgcagaaagattggcacgttcgccggggctctcgcccttgcatcggctgcggtggtactgactcccggagcggccaacgcggcctccaacccctacaacggagtctgcggcagcaactacgctgtcatcgaccagatcaaaatgatcaccacagacggcaagcacctggggaccgcctacctcacctacagctcctccaacggatacaactgttccaccatgcagatcgcgccgggagagggacccatctacgcgaagaccgcactccagctcaccggtggcggcggcggggatcaggatgccggcactttcacctcgtacgcgggaccggtctacctctacgcgaagaacagttgcatcgactggatgggcggcataggaggcaacagctccgagggggtcgtaggccacttcatcgggaactcctactgcgggtaacgctcccacaatccaacctgctcctgctcgcagcacccagcgagcaggagcaggagcaggtgatcatcctacggcggggatacggctgcgaaggcgcgcgcttgaccgcctggcgagagtaccgacggcgatgcccaagcccccttgccgagggggtccggctcccgctcccgctccctgcaggcttacgtcactttcacttgcgccgagccgagccgagccggtgatgatgggcccgatcccgaagccctgaaccgcaggtcggctccaaccgcagctgtacaacaatttcacgcactggtgtttggctcgccggtgcgacgcaggtgagtcggcgaaccagacggttcaccgactcacctgatactgcctgccgggacacatcgccgtggaggtgtcggtggcgcgggccactttcagcgtcggcgtgcggaatgacggtcaggtcgcacgccggcaaggcccctggcccagcgatgatccggcgaccaccacagcccaccggggcccggccgataagccgccgactcacgagcgcagacactcgccggtagtgcgcatcatcgcggaaacaggcgcggcacagtgtcatgggcgtagcttcaggttcgggctcggatggcatcagaacgaccgtcatgaccgacggcccacccccatcgggggaacggccggcatgatcagctcctccctccggcttcccttccgcattcgattcggccacaggccggtgcatgagggccttcgccacttccctgccatcggaatgaggctcgccctccacggaagtcgggcggggggaccgtcgcccagggtgtggtcaagttccgttgaggtcgggcttgcaggtgatgcccaggacggggagggctcgttcgggttggtcgcggatggcgcgggtggtcttggcgatgttggttgctccgagggtttcgaaggctccgatcgcgaggttgcggagggtggccaatgacgtggggagcgttgccggcgtggacagtggaggcgtcttcggcgaagttccggtcgcggatgtggtgctgggcttccacgatccagtgtccacgcaggtgggaggcgagttcggccggtttcacctggtgggcgtcgaggcgggtgaccgcgtggacggtctcgcgggtttccttcttgccggtcactttgcggcggcggtggacgcggaggtccagtttcgcgtgggggaaggcgatgccgccgaggttgtcggcgatggcgagagccttgatcgagcgggactcgtgacggccgtgccccttgttcgaggtggtgtgctggatggccaccgcgtgccagtccagagcgtccaactgcgcccaggcgctgggctggttgggcttgatcacggccacgtagtgcgccttcttggcttccaccagccaggtgacgttggtcttcacggagtgcggcgcgtcgaaatctccgaaacgtcttcctgccccggtgcccgcgcccccgcgcgcgccacctcgcagatcaccgcgtgcaccagaaggcgccctgggaccgagcggttccagggcgccttcggcgacttgcggggcagggaaggcggaccgtcaccctccgtctatgccggtccgcactgcaccggcgagggctacgcgtactggatgccccacaggttgctgttcttcttcaccggagccacgatgttgctcttcttccaatagaccttcttcttgcaggaagtggccgagggtacccaccgccacttggtcacgctgaagcccttggcctggtggtacatcatcaaccggccacgggacttgcccgccttcttcttgaccttggcggagtaggtccaggtgtccgacttggaccaggtcttgccgacagagacgctgaaggaggcggacgccttggagaagacgacgccggcctcggcgccgagggtcgcagtgcccgtcgcggtcacggaaccggtcttgttcttggcgtacgaaatggtcacaccgggcttcgcccagtcgctgtgcacctgagtggtacgccagacggtcttcttgttaccgatcgagtactgcgtcgtgtcgccgcagttcggcgccgccgaggcgggggccgccgccccggccacgagtccggcgccgatcagggcggcggagatggtggtactgacaaggcgcttcacgcatgtcctcctggtgctggggtgctatatcagtggtgcacacgtcaagttatgcgtgaacgccgtggccacataagcaacttgagggtctattgaggttgacggtgacggagtgcgggtgaggcgacgcagtgggcgggacctgtggtcggatctgcctgatcagggcgttccgacatcttgccgtcggtaacgtaacgcagacgagcaataactcgtggtagtgcagtgtcgggtcgaacgccgcgtcccgcccctggccgaggagctcggctgcgccgaacaggccgagctccccgccaagcttcccgacgccccgcccggatgacaccgaggccccggtgcccacgcggatcgcaccgcgcacggaccggggcctctgtcgggcccgcccggatcaccgcatccgggtggcccactcctggaccttcttgatccggtcctggatctgcccggccgtcgcctccgcgctcggcggaccgccgcccactatccgcagctcggcgtggatcaccccgtgcggcttggcgctctgatgcgtgtacgccgagaccatcgtgttgagctgcttgtgcgtgacgagcggccggtcctcggccgcctcctccaggagatcggcctccgaggccggcttctgccggctgtgcgcgatctgccgggtctgccgcttctggagcagcagctgcacccggtcgggttcgaggagccccgggacacgcaggtggtcctgctcctcactgcccaggcgcgcctgtatgccgaactcggcgccgccgtacagcacccggtcgaagaccgcgtcggactccagggcctcgaagggcagaggaaccttcttgatcactcggcttggacacctcaatgatcacggatcccgggtccgctctgccatccaccccaacctgcggcatcctcacacccgttggatgattccgggaacttacgcaagccccggccgtcgccgcgcggtggtcggcgatcaactccgcgtagcggtagcaccgagcacggtgagtccccattcgggccgcagtccccgtcggctccaggtggcaccactcccgctccggcctccgggagcgctgtcgcggtgggcgttgttcagtgggttccgtacgggaaacgcggtgggcgtccccgcgtccgtgacggtttacggaccccacgtccaccgggaggaagtggaggagtacgtcatgccggctggatccaacaagaagcgtgagcggcagtacgagcacatcaaggagagccaggaggaacagggcgcttcgaagggccgtgcgaaggagatcacggcccggaccgtgaacaagcagcgcgcccggcccggcgagtcgaggacggctagcaggacgacgacgcgatccgccgaacgacgagctcgacctggagaacacgctcgatgaacaaaatctggacgagcggatggaagagggctactcccctcccgaacaccccttggccgtgaacaagttcggcacgaccggggccgaggtgcacgacggtgagtccctggagcagaggctcgctcaggagaccgacgatgtggagccgcccgacggcgacggcatcggcgacctcgccgggggtgaaggcgaaccctcgaagggggttgagcgcgaaccccgggcaggacggctcagcgcggcggacagcgcggccgggcgggagaacgacgtcttcgccgaggacctgggcatcgatggtggcgcggcgtcggcggaggaagcggccgtcgatatcacggacggggcggacttccaggggcgcgaggcctgaccgtcggggaaagcgtaagaccatggccggcgcgacgatcttcgatgtgaaccgcacgctcaccgatacttgcccacgccctcgaccgttatgcgcggagatcagggggtacctctaagcggacaaaccggccatgacgcatgcggaacgagggatgacatgcaggtggggtacaagctggcggcggaggcgttcggcccggcggagctggtcaggcaggccgtgctcgccgaggaggccggcttcgatttcgtggagatcagcgaccattaccatccttggctcgacaaccagggccattcaccgttcgcctggacggtgctgggcaacatcgcggccaggacctcccggatcggcctggcgaccggggtgacgtgccccaccgtgcgctatcaccccgccgtcatcgctcaggcggcggcgaccctcgccctgctctcggaaggccgcttcgtcctgggcgtcggctcgggggagcggctcaacgaacacgtcgtcggccccggcttccccgacgcggtcggcccccgccacgaaatgctcaccgaagccctggaaatcatccggctgctctggagcgggggctatcagtcctacgaggggaagcatctacagctgcgggacgcccgggtcttcgacctccccgacgaactgccgctgatcgccgttgcggccagcggccgggactcgacccgcatcgccgccgagctgggcgacggcctgttcgccacggaggacaaaccgagcatcgtccggcactaccgtgacgccggcggaaccggcccgtgctacggggaggtccccatggcctgggcgccggacgctcacaccgccgcgcgcgccgctctggagacttcgcggtgggcgctgaccgggtggaaggtgatgagcgagctgcccaatccggtcaatttcgaagccgcgaccacgaccgtgcgcgaggaggacattctggagaagttcgcctgcggcacggatcccggacggtttgtcgaggtggcccagagctatgtcgacgctggcttcgaccggctggtcatgcagaacgccgggcccgaccccgccggcttcatcgacttctaccggcgcgagctcgacgggcgcatccgacagctcaagccgaacgacacgcgatcctgaaagcaatggaccgtacgcgtcggccaccgcctgggtttcggctttcgtcatcgcaagtggatcgcttcagacgagcttcgtcttccgagctgtctgcgtgtttcaccaggcgcctgatgggaacccgggacgctcggccacgaataccggcgacggagggagcggggacgtgcgtgcattgacctaccagggaaggcgggacgtccgggtggagacggtcccggatccgcgggtgcaggatccgacggacatcattgtcaagatcacgtccaccgggatctgcggatccgatctccatctctacgaggtgctcgggccctatctcgacccgggcgacatcctgggtcacgaaccgatgggggtggtggaggaggtcggccgcgaggtgacggccgtcgctccgggggaccgggtcgtgatccccttcaacgtgtcgtgcggtcactgccacatgtgcgggcaaggactgcactcgcagtgcgagacgacccaggtgcgcgagcgcggcacgggcgcagccctgttcgggtacaccaagctctacggccaggtgcccggaggccaggccgagtacctgcgggtccccttcggcaacgccctccccatcaaggtcccgcacggccccgccgacgaccggttcgtctatctctccgatgtcctgcccaccgcctggcaggccgtggagtacgcggacatcccgcccggcggcagcgtcaccgtcctcggcctcggcccgatcggcgccatggccgcccggatcgccctccaccggggcgcaggcctcgttgtcggcgtggacctggtgcccgaacgcctcgaccgggtcagcgcgtacggtgcgacctgcctcgatctccgccgctacggcaaggacctcggcgccgccgtccgcgacctcacggacgggcgcggcacagacgcggtgatcgacgcggtcggcatggaggcacacggctcccccgtggccaaggcggcacacacagcggtcgggctgctccccgacgctctcgcacagcgcctcatggaatcggcgggaatcgaccgcctcgcggcactgcacacagccatcgacctggtacgcaggggtggcacgatctccgtctccggcgtgtacggcggctccgccgacccgatgccgatgctcaccatgttcgacaagcagatccagctccgcatgggccaggccaacgtcaagcgctgggtcgacgacctgctgcccctgctgaccgacgacgacccgctgggcgtggactccttcgccacccaccacctcccgctcgaagaggggccgaaggcctacgagaccttccagaagaaggcggacggcatgatcaaaaccctgctcatcccctgagaccgcgcggcagcacggcgagacaggaaggacgctcagcgtggagaacggcagtcggcacccgggcaggcgtgtggtggtcacgggcgccaccggcaacgtgggaaccagcgtggtccgcgcgctagcggcggaaccggacatcggatccgtcgtcgggctggcccgcagaaagcccgcacttcagatcccgaaggtggagtgggacaccgtcgatctgtcccgggccgacagcgaggaccggctcgcggatctgctgcacggcgcgtacgccgtcgtccacctggcgtggcgtttccagcccacccacgaccccgtggtgacctggcagagcaacgtgctgggctcccagcgagtcttcgaggccgtggcacgcagcggggtccccgccctggtccacgcctcgtccgtcggcgcctactccccgggaccgaaggacgaacccggcgtcgacgaggaatggcccaccgacggatggccggacgcggcctactgtcgggagaaggcctacctggaacgggtcctggacgcgttcgaactgcgccacccgcagatccgggtggcccgcatgcgcccggggttcctcttcaaggagaccgccgcccccgagcagcggcggatcttcgccggccgctacgcccccggccctcttctgcggcccgacctactgcccttcgtacccgacctggacgggctgcgtttccaggtccttcataccgacgatgccgctgacgcctaccggctggccgtgctccgcgatgtacggggctccttcaacctggcggcagacccggtcatcgatgcccgcaggctggcggacctgctcgacgcccggatcgtgcgtatccccagggccctggttcgcaccgcgctctcggccgcctggcgggcccacgccgtccccgcctccccgcacctgttcgacgcggtgctgcgactgcccgtactggactccggccgggcccgtgacgtactgggttggcagcccacccgtacggcggaagacgcactgagcgcctttctgcgcggcgttcgcaccggcgcgggcgagaacaccgcaccgctggcaggccggaagatcggctgagccacccagtcaccagccgtgccgccgacggaggcccggcgggtcagcccggcccgcaagctccgggctcgtccgatgcgccgaagctttgcgacgacataggaaggaccaccatggcgagcagtgaacagccgcaggatccgaaccagctccatccccgtcccgactttccccagcaggaccaggcacatcccggctggaccggcccgatggacccgccgcccgaccacggcgaggagtcctaccgcggctccggcctgctcgatgggcggaagaccgtgatcaccgggggtgattccggcatcggccgtgcagtggcgctggccttcgcgcgcgagggcgcggacgtcctgctgacccacctccccgaggaggggcaggaggcccaggagaccgtccgcctggtggagcaggccggacgcagagcagtgcccgtcgtctgcgatatccgggacgagaagcagtgccgctccctcatcgaacgcgccgtgtccgagttcggccgcatcgacgtcctggtgaacaacgcggcgtaccagatgtcccagccggacggcatctccgccatctccagcgagcagttcgaccgggtgatgcgcaccaacctctacggcatgttctggctgtgcaagatggccgtgccgcacattcctccgggcggatcgatcatcaacaccacgtcggtacaggcgtacaagccgagccctcaccttctcgactacgccatgaccaagggtgccatcgtgacgttcacccagggtctcgcgcagatgctggtcgaggacggcatccgggtcaacgccgttgctccggggccggtatggacgccgctgatcccggcgacgctgccggacacccaggagttcggcaagcaggcgccgatgggccggccggctcagcccgcggagatggcgcccgcgtacgtgttcctggcttcggagcacgcgagcttcatcaccgcggagatcatgaacgccaccggaggcactccgctcccttgagtcggctgggggggcagggaacggggacagtgagagcaccgacgtgaaggaggaggcggtggcgtgagtccagacgtcgagctacggatcgggcgacgcaaggtcaacgtcaagcgggccgacaagaagttgttcccgcaggacggcatcacgaaggccgatctcgccgagcactatcggcgtgtggcgccacggatgctgcctgaactgcgcggcaggcccctgatgctcgagcgcatgccggacggcatcgacggagaccgcttctaccagaaggaggtctccgggtacttccccgactggattcgtcgtgccacggtcgacaaggagggcggcgaagtcacgcatgtggtctgcgatgacacggcgaccttggtctatcttgcgggccaggcgtgcatcacaccgcaccgctggctgagccgcgccgacgaaccgcgtcgacccgaccgcctggtcttcgacctcgatccgcccgctgacgacttcgaaccggtacgccgagcggcccatcgcctgcacgaactgctcgaggagctggaccttccctcgggcctgatgaccacaggctcacgcgggctgcacgtcgtcgtaccgctgaaccggcgcgatgaagccgacgacgtgctggcgttcgcccgtgcgacagcccggactctggcgtcccggtacgagcgggagctgacgaccgagccccgcaaggacgcccgcaaggggcgcctgtatctggatgtcgcgcgcaacggctacgcccagaccgtggtcgcgccgttcggcgtccggtccaggccgggtgcgcccgtcgccgtgccgctggactgggacgaactggaggaccccggactgaccgcccgccggtggacggtgaccgacctcggcgaccgcctggagaaggacccatgggcgcggctcacgcgccacggccacggcgtgaccgcggcgaaccggcgcctgcaaggactggcacagagcgagggcggtgtgaagtgacgggcagcgggtcggctcggggagcgtgccttcatgcccgttccacgcacccggggcggcgatcagtgcatgagtaggagcgcggtcatcgtcatcgacgtgatcaatacgtacgagcacaccgacgcaaagctgcttcttcccggggtccggaaggccgttcccgctctcgtccggctgttggagcgggccagggccgcaggcgttccggagatctcttcccacgacaacttcggcgaatggcgctcccaccacggagagatcgtcgaaaccgcgctcgccggtcagcacggtgagctggtcgagccgcttcgacccgatggggaatcactctggcccaggcaaccggcagcatcgaccaaggggtgagccggcatgcagacgttcttgccctatcccgacttcgtcgcttccgccgcatcgctcgactcccggcgcttgggcaagcagcgcgtcgaagcacttcaggtgttgcgcggcctgacggtccctggttacgggtggcggcaccacccggcagttcgcatgtggacgggctatcaggaggcgctggtgcggtacgggcttgaggtctgccgggtgtggacggctgccgggcgcgcggatacgtgcgccgtttcgctcgtggccggttggtcgccccgaggagcggacctgggtgtgcgttcgcaggcagaactcgcagcggcacacgaattgccgccgtggctgggggaccccgccttccaccgcagtcaccggtccgcgctcaggagcaaagacccggcgatctacgccgctctcttcccggacgaccccgacggcctgccctacgtatggccggcctcggaccgctccggatagctgaaggactccgtaactgggaacatcgtggtcttcggcacaacgtggtcacccacgggcgcgctctgggtcactccggctatgacacagggaacggcaggtgcagccccgctgaccaccgtctcccaccaacgacgtgctgtgcagcgacagaccgccccatgtgacgactcctccccctatccatcgcttcgaaggccgtactgccctctacgaggagggtgggctcccctgctccccacggactgcgggggaggaggtactcaccagtagcagcactccatcggagccgcagagacccgtgagcagggggtatcagcgggcaaacacgttcgcctctacgacgagttgggcaggccctgcgagcaggtgttcgtcactcatacggaaacgttcggcccgtgaacgaaccaccccccggcggctgctccggtgtacgaggggatccaaccggtgcacgcggccgcgtaccgcttcagcaactcctcaatgacgtcagctcgttgtacacgatccgggccgacggccggactctggagcggtgcgtcgactcgtcggtgacggcgctgagcgccgaggccgccaaggcggcgaatcagcccgagcgccgggaccgctccgggcgtcagttcccgttgcgctcgcgcaggctcaacggctcccacgacagttcgagatccaggggccccacgtacgtctcggacgagacgtccatcgacgccttcaccgtcctggggccgcttcgatggaccacgatcgtggggacgcagatgtccgtcatcacctcggcaggatgatcgcggtgcagataggtgcacatgcgccgcgacaggtcgggctcgacatccatcacggccgtcaggagcaccggcatcttgacgcggatgtgccggaccgtgtcaacgagcctgtcaccccaggacggtgcactctcggagtcaccgtcgtcccagcagtcgtcggcgtccacggaagcggggcccgccgaggccagcgccaggcgttcgtagcgttcgatcaccacgaatcgaggcagcttcccgttgatcggctgcttcacccgcatgttcacctggtccacggtcgaccttggtgtctcgtccacggcgagccccttgtgccgcccgccagggatacccggtgtacagcagggtgggaacacctgcccgggcagcgtgcacggctacgtcacgaccgaccttcgcctcacgggtcccacgctgcgcaacaatgccgaccttgtgccagtagtggaggtcggcgatctcagtgagacccgcccacggggtcggaatggaaatctctggttccgccagctcgttgaggagcctctcgcgctgctccttgagtagttcggtgccggtcttcatcctgctcccctcgatgcgagcaccagtatttcgtccaacttggcgggtgtgggtggattcgcgaaggttccactcgcagggtgggttccggcctgcggctcggaggtgcgacgtcacactgcccgcccagaagctgctgcgcaggagcttctggtgctacgcgggggcaaggcgggcagcggccaccgcctcgcgctcgaaccgctctgcctatgaggacaacgggcaagcccacttccggaggggctcctatcacaaccgtgtgcgccgaaaggaatcagcacgccgcccatgatcagggacgtacgccagagaggccggcaccgtcgcggcttgctcacccccatcggccgatggtcttccgccctggcaccacggaagccgcacctccgcacctcgaatgacacggagagggggaagtgcaccgcaggaacgcttcctcgcgccgccgctctctgctctgacctgtgcgatcagactgctgcccctgcggtccaggaacgggctccccaagaccgcctcgacgtccacgtccgctacgcccggccaacgcatgggcggcttcgcgtgggtcaccgcggacgtcgagccgctcccggaccggcggctcggcttcgagcggaggttgagaccgcgcagcccggatcggcggggtcagggctcctggtgggtgagggtgaacaagccgccgtcagggtcctggagggtgcgcgagaaacccccaggagctcgggcagcggacgacggttgaggtttgctgcctcccgccgccacggccgcggtcacggcgctttcgatgtcgtcgacggcgaagttcacgagccaacgaggccgcagatgggcgagcggggaggtctgtacgccgccgccgcgcagagagagaaccacccggcccccgagcttcaccagaacgtgatcattccggtagacgacttcgaattcctccgcggtccagtccaggacttccccgtagaacaccgcggcctcgaagacatcgcgggtctgcaggtcgagccggacgggtgcctggccctcacccggggcccaggccagggtgtagccctcccagaacccgaacgtggccccgtcccggtccgccgccagcccgacacgcccgtctccgagggccatcgggcccaccgcgaccgtggcgccccgttcccggatccgtgccgccgtcgcgtcggcatcccggacagcgaagtacggagtccactcggacgccggagcgaacccgagccttctggtcccgatacccgccacaggatcgccgcctgccgtcgcgacgacgaagtcctcgtccagtgagctggagcggaacctccagccgagaaccgcgccgtagaaggcctgggccacagccaggtcggcgaccatcaggttgacccagcagggtgcgccctgcaccggcacgctccgccgctcatccgacccagacatccgttcctccgcatccgtcgtatccgctcggcgttcggtgtcccagcatcccgtcggccggccacggaagcgccgcgatcgccggacccgatgccggggtccttgccgcgccggcggctccgatgcgcgctgagcggggggcgcggcgcctcatcatgcaccaggtgctctgcacagctctggccgtgacccgcctaccgcgcgccgctgtatcccgcgaaccggccagccgacctttgcaccggtcggccggcctgtgacgctgcgggcatgcggcccgctgggccgttcgggcgtgcgggcgatcttcggctgagctggagcaccacaggaaggtttgcgtctttaggggtaatttaggaataaacacggggttctctggagttggggtcggcctctgcgggtgatcatcttctgctccgcatgtttccgggccgagacgcctgtggacggctcatcggctcatggcggtgatcgacgagtgaccggagacgatgagagggcgttcgtgaccgaaggtgagccggagccgggaaacggcggggtggtggaccggacggaagggttcggtgagcggcttctgggtgtgctgctggaccgggcgcacgagatgccgccgcagttgatcgctccgatgatcgccgaggaagtggccaggatcggtggccgcgatgtctcggtccttctccaggactatgcccaggaattgctggtgccgttgccgggccggggtctggtggtcggagagcccgaagtcatggctgactcacccgccggtacggcattcctgcatgccaccactgtcgaggtcccgcaggccgagggaatgcggatgtacctgccgctgctggacggcagcgatgaggtaggggtgatggccctcagcctggacagggtcgatgacgacgaccggcggctgctgcgcaggctggccggcctggtcgccgacatgctggtcaccaagcacgcgtacacggaccggttcttccaggcccggcgccgggagccgatgagcgtggccgcggagatgcagtggtcgctgctgccaccgctgacgatgtcggtgccgcaggtcgcggtgtccggggcggtggaacccgcctacagcatcgccggcgacagtttcgactacgccctcaacgacgacactctgcacgtggccgtgttcgacgccatgggccacggcctggacgccgccacgatggcgacggtcgccgtcggtgcctaccggcacgcccgacgcgccggcatcgtcctgtcccggaagtacgggttcatggaccgcgccatcgccgagcagttcggggccgatcatttcgtcaccgcgcagttgatggaactggacaccgtcaccggccgtttgcggtgggtcaacgcgggccatcccgcacctctgctgatccgcaaccacgaggtcgtccggcaactggaaggccccatcacactcccggcaggcctgaacgatgatgcctcccaggtcagtgaggagcagctgcagcgcggtgaccgggtgctgtgctacaccgacgggttgatcgaggagcgggacgaccggggagagctattcggtgagcaacggctcatccgttgtgtcgacgcggtcgagcgcgcacgcgcggaagaaggaatcagggcgggcgccctgtggctttcccagaccctgaagcaggaacgcggcgggcgcacgagcgatgacgccaccgtccttctgatcgagtggcgcggcagcgccgccgaccacctcgccgtcctggaatgacagccgacccgtgctcggccgacaccggtcacggcgtcgagctctcctggggagaggtgagcatccctgcctcgcagcccacctcaggggtcagccagtccggtcagtccggctttccggagggcggctgccaaggacgaggtggacgcgtcctggcctgttcgcccgctgctttcggtcgtgctttcagatcggtgggaggtgtgcggtgcggttctgccgcgatgccgtgcggagtgccgcggtgacggccgtggtcgtcggggtggtcgtttcggtgtggcgggtcgcggcgaacaggaggcgctggatcgtggccctggatggaggccgtgcggattcctggtgtggccgaatcgatggccgtccgggggacgagcgcggtggcgaggccggctcgggcgagggtgagctgggcggcgatgtcggcggtgatgtagcggggcgtgggggtgaagccggcctggtggcaggcgtgcaggatggcctgtccgcagtccgtggtcgccgggggcagagcgaggtggtgcgtggggggtccctgcggaaggtctgttgtcgcgcggctatcaatcggtccttacaaccgccgcctgacctgcagctagatttcgcggtgcgaagggcgcccggacgtgctccgcgttgcacccggcactttgtggcccgcgcagtgatcgcggcatgccgcaccgtccccgaactcgacgctccggccgggtcactcgtggtcggggctggtgcggtggatgcctgcgggccaagggggcgtgtcccgcggcggctgcgtaccgcaggtgcggtaggcggtcggttgctccaccggcagccgctgttcctcggtgtggccgggctgcttggtcgaaggactgccaggtggccagcggccaggccgcgtattaagccgacatggtgactcccggctgcgccccgcacgcgccaacgtcaccatgtgtagcgagtccatacagtccgtagtgagcgggcgtggtgttcacgccccaacgtacggagttgttcatgcgacgcattaccgccaggctcggtgccctcgccgctgccacactgctcgccgcgactgcccaggtcggccaggccggagctgccgacgaagccgcgtacttcacgatgcgggacatcacccgcgccgagttcaccatcaagatcaccggcccggcggcgatccaggacgcccgcgagatcgtcgagtccggggccaacaagatcgtcgtcggcaggatcgtcaagcgcgaggccgactacaacccccgctggagcttccacctcgaccccgccaacatccagttcaccgaggcggccatcgaggtctgcgacgccacgacgccctacgtcgaggatcacctggacgaggcaggcggcgccttcctgcccggtctgtactggtgcccgtggaccgggcgcctgaccgaggagatcccggccccgtagagggccgcgcccgtctctcgcagcggtatcacgacgagcgcatgctgaacatgtcaccgaggtgacgggagtggggtggcctgcctgtccggccggccacaccactccgccggatgtccgcgtgcgaggacgtgcggcttcgcggcgacctgcccgtcggcggcaaggacgaaatgccgtgtcggggcggccaggtgccgggccgccccggggactgctggccttaccgccagtcaggtgtgagcggcagtgcaggtcgggtcggagagggcgcagcgggatacggtcgcgtggaacccacgcgcccggcgtttcgatgtgcagggtggcggcttcgccccggccgcgaacgagagagaccgagaggaaagccgtgccctctgacttcgacgtcgtcatcgtgggcgcaggtgcggccggactgagcctggcatacgacctctgcgcgcagggcagcgctgtacctttatcggtcgccctcgtcgacgcccccccggggcctttgagggcgccgccgcggacatggtgcttctgggagccgccgggcgggccctacgatcagagactggcccattcctggccccggctgcggtttcgggcagccgacggagcctcgacggtggtccagctctcccggcagcgctacaagatgctgcgctcggacgctttcgaagcgttggtcgagcagcggttgtcccgtgcgccgaccctgcgccggatggaggcgagagtcagtgccgtgcgcgacattccgtccggagcaggcggtgaggtgctgacccacgtcgcgtgcggtgaacgggtcctcgtgcgcggccgactggtcttcgactcccggccgccccaccgcttgccgcccgctcgcaccacgctgctccagcatttcaccggctggttcgtccgcaccgagcgtcccgtgttcgacccggagacagcggacttgatggacttccgtacgccgcagcccgctcgcgggctctcgttcggctatgtcctgccgctggacccgcacaccgcgctggtcgagtacaccgagttctcacccgccccactggacgccgacggctaccggcgtgctctgcgccattacacccacgacgtgttgaggctcgggccgtttgacgtcacggctcaggagcacggcgtcatccccatgacggatggccgcttcccccacaagcagggccgttcggtgtatcgcatcggcaccgccggaggcgcgacccgcccgtcgaccggttacaccttcgctgccgtgcagcgacagagccgggccatcgccgatcagttgcgctccggacgccccctgcgcatgcccgtcccctacgggcggcgggcgcggatgatggacgccgtgatgctgcgggccctggacagcggcagggtgaacggcgcggacttcttcagccgcctcttccgcggtgttcccggcgagcggctgctcagcttcatggacggcacttcgcaaccgcacgaggacctgctcatcggcctgcggacaccgatggtccccatgctgcggaccgtcctcgaacttcccttcagaatccggcgtgcccgcccagcgactccgattcctccctcaccgtccgcccacgaagagagcactccatgaccttgctgcgcggtgacgcactgtccgaggccttcgaccacggctccgccgcgtacgaccgcctcgtctcggccagccccggctaccacgcgcacctgcgccgctccgcacgccggctgggcctgccgggggaggggagagggctgcgcgtgctcgacctcggatgcggaacgggtgcttccacggccgcgcttctcgctgccgccccgcgcgcccggatcaccggagtcgacgcgtccgcaggcatgctggaccgcgcgacggccaagagctggccgcagggtgtcgacttcgcgcatcacccggtcgaggagctggccggacggctggaagccggttccttcgacgcggtgttcgccggctacctcttccgcaacctcagcgaccccgacgtggccctcgacatggtgcgcggtctgctcgtaccgggcggccgcctcgccgtccacgagtacgcgctcggcggatcacctgtccaccgtgccctgtggagcgcggtctgctcgctgatcattcagcctgccggccgactcgccggggacgccgacctctaccgtcacctgcgggtcagtgtcacccggttcgacacggctcccgcgttcgcccagcggttgcgccgggccggcttcgccgacgtacgcatcctcccgctgcccggctggcagaccggtatcacccataccttcgtcggtcgcaccaccgcgggctcgggagtgcgggcgtgatgttcctgcgggacagcggcagggggcaccggcgcaaccgctgggc

SEQ ID NO: 2796 - DNA, 8333 bp, Unknown
  Kingdom: Bacteria, Phylum: Actinobacteria, Class: Actinobacteria, Order: Streptomycetales, Family: Streptomycetaceae, Genus: Streptomyces
cgccggtgaggacgacggcggcggcgcgctggcgctggaggagggtgaggtaggtcagctcgcgctccggggagccgccggtgttgcagatgacggccagcttctcgccgcccgcccgtccggaaccgtccccgggcccaccgatctgcgtctgggccgcccccgccatgatcccgaagaacgggtcggcgatgtcgttgaccaggatgccgaccaggtccgaggtggccgcggcgagcgagctcgcgggcccgttgagcacgtagtccaggtcgtccaccgcgcgcaggacccgctcccgggtggacgccgccaccgggtagttgccgttcagcacgcgcgagacggtggccggggacacccgggcgcgggccgccacatccgccagggtgactgtcatcgctgtcctccgtgagatcacgtgcggccccctcttgtccggccgctgtcggcaggctagcgtcatctccgatagaaagcgcttgctacagctgtatggagggaccttcgtgacacgcaggacagtgcgcatcgccatgaacggcgtcacggggcgcatgggataccggcagcacctggtgcgctcgatcctcgcgatccgcgagcaggggggcctggacctcggcgacggcgaggtgctgtggcccgagcccgtgctcgtcggccgccgtgcccacgccctggaggaactcgccgagcgccacggcctgaccgagtggtcgacggacctggacgcggtcctcgcggacgacacgatcgacatctacttcgacgcgcaggtcacctcggcccgggtggaggcgatcaagaaggcgatctccgcgggcaagcacgtctacaccgagaagccgaccgccacggacgtcgagggggccctcgacctggcccggctcgcccgggacgcgggaatcaagcacggtgtcgtgcaggacaagatcttcctgccgggcctgctgaagctgaagcgcctgatcgacggcggcttcttcggcgagatcctgtccgtgcgcggggagttcggctactgggtcttcgagggcgactggcaggaggcccagcgcccgtcgtggaactaccgcgccgaggacggcggcggagtcgaccttgtcgatcccgcgctcccgcagggcggcgatcatgccggggatgtcggtgttgtcaccgacccgttggccgtcctgggtgaacacgacggtgttgacggcctccacggaggcggctgtcgcgctgatctcgtcgagcagcgggatgatcgcccgcttgagcggcatggtcagcgacagcccggcccaggaggggtccagcccctcgatgaacccgggcagtgtcgcctcgtcgacctcgaaccggtcgtaggaccagtcgtcgaggccgagctcggcgtacgcggcgcggtgcaggaccggggagagggagtgggcgatgggcgaaccgaggacggcggcccggcgcggctcagtcgagggcatcgaacttcttcttcagcctgagatgctcgtcataggtcttggcgaactccgtcttgtgctccccgtcggtggcgacgaagtacagccagccgtccgtcgtggggttcagtgccgcacccagggcctcggcaccggggttactgatgggccccggagtgagacccctctgtttgtacgtgttgtacgggtctgtgctctcctgcgtctcggcctcgctgatgttgatgttgctctggttcttgaggtagttcaacgccgagtcgaactggagaagttggttggtctccgtgttggacggcttgaggcggttgtagacgacttcggacatcttccggaagtcgtcatgcgtcttgccctccgcctggaccagactcgccaccgtgatcacctgccacggcccgtcgaggtcgtgcttcttggcggcggcttcgaggtcgagcttgccgtactccttgttggcccgcgcgaccatccgcttcagcgcgtcctcgggcttggaccccttggcgaccgggtaggccgccgggtagaggaagccctccagcgggtccttcacatccggattgtcgtccacccagtcgggcagtcccagggactccgccttggtcttggcgatcttggcggtggtgcccttctccagttccagccgctcgtcgatcttcgcgtagaccttgatgttgcgggtgccctcggggatcacgaaggcgttctggctcttggggtcgagcatcaggtcgatcgcgctggcggcggacatctccttcttcatgaggtagacgccggcctggagcaacttgcccttggggttgtcgttctgcgcggcgacgaaggcgtcggaggacttgatgacgcccttcttgcgcaggatgttggcgatgtcgtagccgagcgacccttcggggatctcgacctcgacctcaccggtgcccgcccccgcgtagtcggccggagcgccgaactgcttcttccagaaggtgtagccgacgtaactgactccgccgaggccgccgagcaggacgacggagaccaccaggcaggcaactccgctgcggctcttcttcttgcccttgccaccccggcggtcactgccgccgcggtcgcggcgcgaggcacgcgatccgtcgtcgtccgggtcatcgtcgtcgtcgcgctgctcgcggccgaccggttcgtccgcaccggtgaagaaggggtgcgtctcctcctgcggggcgtccgggtcccagtccgtcgactgttgttgctgctggtgctgctgctgttcggcggcggcgtcgcggcggcccgggggctgcggcggagggtaggcctcaggggtgccgtagtagtcctgcgatgtgtcgtaaccgccgggctgctgggcgtacgggtcctggggctcggccccgtacggcatcgcggcctgctgcccggtgtcccagccgccgttgtactgcggctgggaacccggctgctgggcgtacgggtcctgctggggcgtgccgtactgctggtggttctgctgctggtagctctgctgctgtccgtactgctgatgctggtcgtacggctgcggcgggtactgctgatggttctggtgctgctgggcgtacgggtcctgcggataggactgctgctggtcgccgtactggccctggccgtgggcggcctgccggcctccccatccctggtccccgtacaaggggtcctcgggatgccacggttcggagccggggccccggccatactcagtcatcgatcccctagagccgcgagacgacgttccgtctcttcgctgtgcggtgtttgttcgaacaccgccgcatcgcgcggaacgttaccgtatcgcgatcagacaaccacttcgacgccctcacccgggggattgcctgacgcccgttcggactccagagcgttctgaaggatcaccacagcggcagcttggtcgatgacagaccggcccttcttggacttcacgcccgaggcgcgcatcccctgagcggccgtcactgtggtcatcctctcgtccaccagccgcaccggaacgggtgcgatggagcgggcgaagacctgggcgaactcccggaccttgacggccgccggtccctcgccaccgccgagggagcgcggcaggccgaggatgacctcgatcggctcgtactcctcgacgagttgacggagccgtcggtgggcggccgggacgtcgcgtcccggcacggtctccaccggcgtggccaggattccgtcggggtcgcacgaggcgaccccgatccgggcgtccccgacgtcgacggcgagccgccggcctcggcgcatcgctgtcatcccgctcgtcacgccgtctcggtgacgaggcgttcgaccgcggcgacggcgtcgccgatggcggccgggttcgtgccgccgccctgggcgacgtccggcttgccgccgccaccgccgccgagggtcttggcggcggtgcgcacgaggtcaccggccttgagaccgcgctcgcgggcggcctcgttggtggcgatgacggtgagcgggcggccgttggccgtggtgaacagggccacgacggccggccggccgccctggatgcgtccgcgcacgtcgaggaccagcttgcgcaggtcgtcggcggaggtgccgtcggggacctgaccggtgaccagggcgacgccgcggacgtccttggcggactcgacgagcccggcggcggcctggaggaccttctccgcgcggaacttctcgatctccttctcggcgtccttgagcttgccgagcatgcccgcgatcttctcggggagctcctcgggacgacccttgaccagctcctggagctgggcgacgaccgtgtgctccctggcgaggaagttgtacgcgtccacgccgacgagggcctcgatacggcgcacgccggagccgatggaggactcgccgagcagcttcaccagacccagctgggcggtgttgtggacatgcgtgccgccgcacagctccttggagaagtcgccgatggtgacgacgcggacccgctcgccgtacttctcgccgaactcggcgatggcgccctgcttcttggcctcgtcgatggacatgacctcggcctggacgtcgagttcccgcgagaggacctcgttgatccgctgctcgacgtcggtgaggatcgtgccgggaacggcggcgggcgaaccgaagtcgaagcggaagcgaccgggcgagttctccgagccggcctgggcggccgtcgggccgagagcgtcgcgcagcgcctggtgcgtgaggtgcgtggcgctgtgggcgcgggcgatggcgcggcggcgggtgttgtcgatggaggcgaagacgggggccccgaccgtcacctctccgacctggacgacacccttgtgcacatggacgccggggaccggcttctggacgtcgcggatctcgatcacggcgccggtgtcgagccggatgcggccggtgtcggcgagctggccgccaccctcggcgtagaagggggtgcggtcgaggacgacctcgacctcgtcgccctcggtggcggcgggcgagggaacgccgtcgaccagcaggccgacgatggtggactcgccggcggtggaggtatagccggtgaactcggtggcaccggagttgtcggcgacctcgcggtaggcggacaggtcggcgtgaccggtcttcttggcgcgggcgtcggccttggccttgtcgcgctgctcctgcatgaggcggcggaagccgtcctcgtccacggagagaccctgctcggcggccatctccagggtgaggtcgatcgggaagccccaggtgtcgtggagcaggaacgccttgtcgccggcgaggacctggccgccggcggccttggtctcggtgacggcggtctccaggatgttggtgccgcccttgagggccttgaggaaggcggcttcctcggcgagcgcgaccgtctcgatgcgcttgcggtcggtgatcagctccgggtactgcaggcccatcgtgtcgatcacgacgtcgaccaggtccttcacgaccgagccggtggcacccatgaggcgcatgttgcggatggcccggcgcatgatgcggcgcagcacgtagccgcggccctcgttgccgggagtgacgccgtcgccgatgagcatcaccgacgtacggatgtggtcggcgacgacgcggagcgagacgtccgttccatgctcggcgccgtagcggacgccggtcagctcggtggccttctccatgacgacgcgcagggtgtcggtctcgtacatgttctgtacgccctgaaggatcatggcgaggcgttcgaggccgagaccggtgtcgatgttcttcgacggcaggtccccgaggatcgggaagtcctccttgccgtcgccggcgccgcgctcgtactgcatgaagaccaggttccagatctccacgtagcgctcgtcgttgacggccgggccgccctcgacgccgaactcggggccgcggtcgtagttgatctccgagcacgggccgcagggtccggggacgcccatggaccagaagttgtccttcttgcccaggcgctggatgcgctcggcggggacgccgatcttgtcgcgccagatctgctcggcctcgtcgtcgtcgaggtagaccgtgatccagagcttctcggggtcgaggccgtagccgccgtcctcgacggagttggtcagcgcctcccaggccagctggatggcgccttccttgaagtagtccccgaaggagaagttgccgcacatctggaagaaggtgccgtggcgggtggtcttgccgacctcttcgatgtccggcgtacggacacacttctgcacgctggtgacgcgcggcgcgggcggcttgacctcgccgaggaagtacggcttgaaggggaccatgcccgcggggaccagcagcagagtcgggtcgtccgcgatgagcgacgccgaaggcacggcggtgtgaccgcgctcctcgaagaagctcagccagcggcggcgaatttcagccgactccatcagtggtcctcattccggttgttcgagttgtagggaagcttgcggtacgtgtgcgtgttcgcggtcggttcggccgcttcgacggcgaagtgccgctgtacgggaaggtcggggtcgaccggcgcttccaggcccagggcgccgcccagttcggcttcgcgccggaccatgccctcgcgtacgtcgagggcgaagtccttgagcttgtgaccggcctcgatcgccttgtccgcggcttgcgccgcgaggctctcgggggtcagctgcttgagcttgcggttgaccttggtggtggcccacacaccggcggctgcgccggcggtgaaccagaacgtgcggcggaacatcgctcgatcagtccttctgtccgcgggcatttcggcgttcgcgcctgcgtccgcgcgccgagggtacggtccggccgacgatcaccgtgcggcgggcggagcctcggccccgcgccggttccggttcgggctcgggtgcggtgcggcggccgagtgcctgccgtacgccgtagccgaacgcggcgaccttgacgagggggccgccgaaggtggaggcgacggtggtggagagcgcggaggcgttggaggtgacctcctggacgtcgctcgcgatggcgtcgaccttgtccagctgggtctgcgcggagcgcaccgtcgccgatgcgtcggccagcaacggaacggcctggtcggtcacgtccgccacgagtctggtggtcgccctgagcgtctgggccagcctcaccagcaccacggcgaggaacgagaccaggatcgcccagaagacggccacgaggatcccggccacctctccaccggacactgtgcaccgctctctgctcgtcgctcgggccctgcgggccctgtctccgtcggtcacgtccgggcctcggcacgcgcgcccgatcgtcgtcgcacgagcctatcgcgccgcgcatctcctcccctaccgcattctccgcgggccgggcgggagttgccataacgagattgtacggagagctttcaagccagtacgctccgtgttttatgcgacgcctgcaggacccctgcccgaattccggcgatccggacgcccgccccgcggcggcgcccggcaacctcccggccgaactgaaccccttcgtggggcgcgatgacgaactggccgagttgggcgggctgctggaggagtccaggctcgtcaccgtcgccggagtggcgggcgtgggcaagacccggtgcgtcatccgggtcgccgcgcttcgggagaaacggtactgcgacggaatcctgctggccgagctgtccgccgttcgccaccccgacctgctggaacacgccgtgatcgacgcgctgggcctgaccgatcacaccagccggtccccgcgcgccgtcctcgtcgaacatctctccgagcgccggacgctgctggtgatcgacggcttcgagcacctcgtcgacgcctgcgccgacctcgtcaccgagctcctgcgccgggccccgcgcctccaggtgctcgcggcaggacgctgtcccctccgggtggacggggaacggacttttccactcgccccgatgtccgacagggacgccgtggagctcttcaccgagcgggcccgcggggtgcggccgggctgggagccgacggtgggcgagcgggcggccgtgctggagctctgccgccgcctcgacgggattccgctggccctcgaactggcggccgggcggctgcgcgcgctctcggtggagtgctcctgcgcctggacgaccggttccggctgctgacgggcggccgtcgcggcgcgccgccccgccaccagacgctgcgtacggcgatcggctggagccatgagctgtgcacgcccgagcaactcgtccagcacatcgagtac

SEQ ID NO: 2797 - DNA, 18013 bp, Unknown
  Kingdom: Bacteria, Phylum: Actinobacteria, Class: Actinobacteria, Order: Streptomycetales, Family: Streptomycetaceae, Genus: Streptomyces
ccgccctccgcgtcctccgccggagtgcccgccggctcggtgccttcggacgcatcggacgcatcagacgcgtcgggtgcatcggacgcatccggcgcttcggtgtgctcggggccttcggcaccggcctccggcggggacacggtgtcctgtggtgtgtccgtgccgacggtgccgggggtctccccgggaagcgcagtcacagcgtgctccagtcctggtcgggatagcggtgcacgggcgccgacacatcgtcgagcgcctggcagatctcgtagggaagactaagcgcctccactgacaaagcctccgcgagctgcccggcgttgcgcgcgccgacgatcggcgcggccactcccggccggtcccggacccaggccagcgccacctggagcggactcgtcgccagtccgtccgccgccgtcgccaccgcgtcggtgatgcgggccgccgcgtcgtcgagatacggctcgacgaacggggcgagccgctcggacgcgccccgggagtcggacggggtgccttggcggtacttgccggtgagcacgccgcgtcccagcggtgaggacggcagcagtccgatcccgaggtccagcgcggcgggcagcacctcgcgttcgatgccccgctggagcagtgagtactccatctgcgtactggccagccgggtgcgcacccccggcgcggcgagctgccaggtggcggccttcgccagctgccagccgcagaagttggacacgcccgcgtaccggacgcggccggaggacacggccaggtccaccgcctggagggtctcctccaacggggtcgccgggtcgaaggcgtggacctgccacaggtccacgtaatccgtgccgagccgctccagggaggcgtccagagcggccaggaggtgcccgcgcgaaccgttgaagcggcgataggggtccgggacgttgcccgccttcgtggcgatgaccagatcctgacgggggaccaggctcccgacgagccgcccgagcaggtattcggcctcgccgcccccgtacacgtcggcggtgtccaccagggtgccgcccgcgtcccagaaggccttgagctggtcggcggcgtcgtgctcgtccgtgtcccggccccaggtgagggtgccgagcccgatccgggacacgcgaaggccggtacggccgagatgcctctgctccatgggcgctgagattactggccacggtcccaccgggtggaggcctggggacaaccggaggtccgccgggcctgccggatgtacgtcacccgcgctagagtccggagaaagggacgttactgatcagtaaggggagcggttatgcggctcggcatcaatctcggttactggggcgccggcatggacggcgacaacctcgccgtcgcgcaggaggccgaccggctcggctacgacgtctgctgggcggccgaggcgtacggctccgacgcaccgaccgtgctgacctgggtcgcggcgcagaccgagtcgatcgacgtcggctccgcgatcatgcagatcccggcccgccagcccaccatgacggcgatgaccgccgccaccctcgactcgctgtccggcggccgcttccgcctcggcctcggggtctccggcccgcaggtctccgagggctggtacggcgtgaagttcgacaagccgctggcccgcacccgggagtacgtggagatcgtccgcaaggcgatgacccgcgagcgcgtgtcgtacgagggagcgcactggacgctgccgctccccggcggaccgggcaagccgatcaagctcaccgtgcacccccagcgcgagcacatcccgctctacatcgccgcgatcggccccaagaacctggagcagaccggtgagatcgccgacggcgccctgctgatcttcccgtccgccgagcacctggaggagaccgcgatccagccgctgcgcgcgggccgggagaaggccgggaggacgatggagggcttcgacgtcagtccgaccctgccgctcgccgtcggcgacgacgtgaccggcctcgccgacatgttccgcccgtacaccgcgctgtacgtcggcggcatgggcagccggaagcagaacttctacaaccagctcgcccagcgcatgggatacgagaaggaggccgccgagatccaggacaagtacctcggcggggacaaggcgggcgccgccgccgccgtgccgcaccagctgatcgaccagaccgcgctgctcggccccgtggagcggatcgccgagcggatgcaggcctacgccgccgccggggtcaccacgctcaacctcgcaccggccggcttcacgctggaggagcggctcaccgccctgcgcgccggcacggacgccctggagcgctccggactcgcctgacggataccgggacagcactacggccgtggtgggggctcgggggtcctccccgccacggccgtcacccggaacaacgcgccgcgcgcccaggggttacgccggacgccgccgcgccggacgccgcccgctccggttgccgaccgcccggcggcgcatttgactcttcctgcgcactactgctccgcggacctcgattccgtgggcaacgggtacggaggtggccgtcatgctctcagcgcagaccctgttccaggagatcctggacaacgacgagtcctaccggctcttctgttccatcgccgcgagcggcgaggcccagggcggctgggagaacgcccggatcgccgccctcgtcccggagagcagccgtgacctggcccccaagatcgtccggcacggcgccgacgaggacaagcacggccggatcttcaacgcactcctgaagaagcgcggactgcctcccgtcgaggtgccgccggagaccgactacacgatgctcctggaacagcagggcatcggcctcgcgcactcccggctgcgcggcgaggagcggctcaccgagcgcgacatcatcacctatctggcccacagccgcgtcaccgagcagcgcgcgtccgagcagatgcgcctgctgcgccggtacttcgccgaccaccccgacatcggccgcgcggtgaagatgatctcccacgacgaggacaaccacctcgcctactgccacgaggaactcctccgcctcgcccgcgcggggcacggccggaccatccagcggatcatgcgcgagtgcgccctggccgagatccgcgtctaccgcgacgtcagcctcgcggtgatggccgccatgggccgggtgctcggctggtcgcggcccaaggcggccgttctcgccgcgggcatccacgccgtgtatgcgtacgagcgcctcgtcggctggcgccgcatggtgagcctggagatgccggtgcggcgggacgcgctgggcagccccgccgcaccggaacacgaatacgcctgagcgcgcacggctcgcggtcgccgggcgctcagagccagccgcgccgcttgaacagccggtggagaccgaagacggcgcagcccatcgacgcgaccaccgccgggtaggtccacacccagtgcagctcgggcatgtggtcgaagttcatgccgtagacgcctgccaccatcgtcgggacggcggccatggcagcccaggcggagatcttgcgcatgtcgtcgttctgccgcacgcccatctgcgccagatgggccgacaggatgtccgagagcagccggtccagcccttccacctgctcgttggcgcgcgtcaggtggtcgttcacgtcccggaagaacggctgggcgtgctcgtggacgaacggcacgcccgcccccgccagccgggccatcggagcggtcagcggcccggccgcgcggcggaactccaggacctgtcgcttgaaggtgtagatccgggccgcggtgttcttcgagtcgccgccgctcggggcgaacacctgcgcctccagctcctccaggtcgagctggagctcaccggacacgtccaggtagtggtccacgacggcgtcgctgaccgcgtacagcaccgccgtcgggccgtgcttcagcacctcgggctcggcctccagcctgcggcgcacggccgccagcggggcgccctcgccgtgccggaccgtcaccacgaacgagtcgcctatgaagaccatcagctcgtcggcgctgaccgtgtcgctctcgggctcgtagacgatcggcttgagcaccgcgaacagggagtcgtcgtacacctccagcttggggcgctggtgggcccgcagcgcgtcctccacggccagcgggtgcagcccgaactcgtcgcgtacgaggtcgaactcctcctccgtcggctcgtgcagcccgatccacaggaacgcgtcccgtgaggcccgcgcctcgtccagcgcgtcggagaagtcgtcgggccgttcggtgcggcgcccgtcccggtagatggcacagtccacgatcacggcgggcattcttccccgtgaccggctctcgcgcaccttcgccatccatctacgctggcgagtatgcccacgctgatcctcgtacgccacggacgctccaccgccaacaccgccggagtgctcgcgggccgcacccccggcgtcctcctcgacgaacgcggcgccgaacaggccgcggccctccccgcgcggctttccgccgtggtcccggtcctcgccgtcagcagccccctggagcgctgccggcagacgctgcggccgcttctcgacgctcgccccggtctgctcctgcacaccgaggaccgcgtcagcgagtgcgactacggcgactggtcgggacggaagctggccgaactcgccgacgagccgctgatgtccgtcgtccagcagcacccctccgccgcggccttcccgggcggcgagtcgatgcgcgcgatgcaggcccgcgccgtcgacgccgtacgcgactggaacgaccgggtcgaggcggagcacggcgaggacgccgcctacgtcatgtgctcgcacggcgacatcatcaagtccctcgtggccgacgcgctgggcatgcacctggacctcttccagcgcatccacgtcgacccctgctcggtcaccgcgatccgctacacccggctgcgccccttcctcctgaggctcggcgacaccggcgacctcgcctccctggccccccgcgagcactccgtcggggcggacgcggccgcgtcccccgtggacgacggctcggcggacgcgacggtcgggggcggcgcgggcgcgccgtgatcgctccgggcagtagggtggacgcgccgtagcgccgctcaaccaccatcgaagctcaagggagcaggacgtgtcccgtcaggtgttcctctacgatccaccggaccgattcgtggccggtacggtcgggttgcctggccgccgtacgtttttcctgcaggcgtcctcgcagggccgggtgaccagcgtggccctggagaagacccaggtcatcgctctcgccgagcggatcgacgaactgctcgacgaggtcgtgcgccgcaccgggggaaactccccggtgcccgccgtggcccccaccgacgtttccgacaccgcgccgctcgacgtccccgtcgaggaggagttccgggtcggcaccatggccctggcctgggacggcgaggaacaacgcatgatcgtcgaggcgcaggcgctcgtggaactcgacgccgactccgaggacgacctcgcggaggccgaggagaaactcctccaggacgaggagaacggcccgccgatgctccgcgtccggctcagcggcgcccaggcccgcgccttcgccaagcgggctctggacgtcgtcaacgccggccgtccgccgtgtccgctgtgcagcctgccgctcgatccggaaggacacgtatgcccgcgccagaacggataccgtcgcggagcctgacggacaccgagctgctcaccctgctcaccgagggcacgatcaccgtcctcggacaggtcggcggggcgtccaacgcggtgctgcactgcacggtggcgtacgagggtgaggagcgcacctgcgcgtacaagccggtcgcgggggagcagccgctgtgggacttccccgacggcaccctcgcccagcgggaggtcgccgcgtacgagatctcccgggcgaccggctgggacctcgtgccgccgaccgtgctgcgcgaggggccgtacgggcagggcatgtgccaggtctggatcgacggccccgaatccgctgaggacgcgccctcgttgctggcgctcgtcgagggcgaggagcccggtgacggctggaaggccgtgggcttcgcggacgtgggggaggggaagaccgcgctgctggtgcacgccgacgacgtccggctgcgccgcctcgccgtcctggacgcggtgatcaacaacggtgaccgcaagggcgggcacctgctgcccgcccccggcggacggctcttcggcatcgaccacggggtcaccttccacgcggacgacaagctgcggaccctgctctggggctgggcgggtgagccgctgaccgaggaggcgctggcggtgctgggccggctcgccggtgagctggcgccggggagcgccctcgccacccggatggccgaactcatcacaccggccgaactggaggccctgcgggagcgggtcgccgtgttggtcaagagcgctgtgcacccgcagccgagcggccagtggccgcccattccctggccgccggtgtaggagctcctccacgccggggccgggctctaccgcctgccaggggcttcacgcaagagggcctcttcggacaggtttccggagccggttcgtatccggaagcatcgtccggttacgctcatgacatgcatgcctggcccgcttctgaggtccccgccctgcctggcaagggccgcgaccttcggatccacgacaccgcgaccggcggacggatcacccttgaccccggtcccgtcgcccgcatctacgtctgcggcatcacgccgtacgacgcgacccatatgggtcatgcggcgacctacaacgcgttcgacctcgttcagcgcgtgtggctcgacaccaagcggcaggttcactatgtccagaacgtgaccgacgtggacgatccgctgctggagcgggccgtgcgcgacggtcaggactggaccgagctcgcggagcgcgagacggcgctcttccgcgaggacatgaccgccctgcggatgctgcccccgcggcactacatcggagcggtcgaggcgataccgggcatcgtgcccctcgtcgaacgcctccgggacgcgggcgccgcctacgacctggacggcgacgtctacttctccgtcgacgtcgacccgcacttcggcgaggtctccggcctcgacgccgaggcgatgcggctgctctccgccgagcgcggcggcgacccggagcgtcccgggaagaagaaccccctcgacccgatgctctggatggccgcccgcccgggcgagccgagctgggacggggcctccctgggcgagggccgtccgggctggcacatcgagtgcgtcgccatcgcgctcgaccacctcggcatgggcttcgacatccagggcggcggctccgacctcgccttcccgcaccacgagatgggtgcctcccacgcccaggcgctgaccggcgagcacccgttcgccaaggcgtacgtccacgccggaatggtcggcctggacggcgagaagatgtccaaatcgcgtggcaacctggtcttcgtctcgacgctgcgccgcgacggcgtggacccggcggccctccggctcgccctgctctcccgccactaccgctccgactgggagtggaccgaccaggtgctggccgacgccgtcgagcgcctcgcgcgctggcgggccgccgtctcgcgcccggacgggccgtccgccgacgcgctggtcgaggaggtccgcgaggctctcgcggacgacctggacagcccttcggcgctcgccgcggtggaccgctgggccgcgctccagggtgcggagggcggtacggacgagggcgctcccggcgtcgtctcgcgtacggtcgacgccctgctgggggtcgcgctgtaggacggtgcgcggcttccgccgcccgatccgatcatccggaccggtcccggacttctccacgaagttcgggaccggttcctttttgtccatggtcatgtgctcgaagttgcgctaaaagctcactatgcaaacatcaacgcgcatgagagcggcagcggttgccgcgctgctcgggctgttcgcggtcctcgcggggcctggcggggcccacgccgacgaggccccgccggcgggcacggagaccaccacggtcgggaacgtgacgggattcggtgcggacggggcggtgtaccggctgaccgccggacaggccgaggcccgggtcagtttcgtatcggaggagaccttccgcatcgagctcgcacccgacggaaagttcaccgacccgaccggcgacgacatcgtcctgccgcagggcgagccaccccgcacccgctggaaggaccgcggcgaccgctacgacctgtcgacgggcgaggtcaccctgcgggcctacaagaagccgctgcgcttcgccctgcaccgggcggacggcagccgcgtctggtccgaggcgaagggcctgagctggaccggcgagcagaccgtccagacgctggcccggggagcgggggagcagttctacggggccgggatgcagaacggccgaggcaacacctcccaccgcgacaagaccgtcgaggtcgccgtcgactacaactgggacgacggcggccaccccaactccgtcccgttctacctttcctcggccggctacggcgtcttccgcaacacctacgcgcccaacacctacgcgttcaccgacccggtgaccaccggtgcgaaggaacagcgcttcgacgcctactacttcgccggcgacggggccaaggacgtcatcggccggtacaccgacctcaccggcaagcccttcctgccgcccgtctacggcatggagatcggcgacgccgactgctatctccacaacgccaaccggggagagcgccgcaccctggactcgctgaaggtcgccgacggctacgtcgagaacgacatgccgaacggctggatgctcgtcaacgacggctacggctgcggctacgaggacctggaggaggccgcccagggactgaaggaccgcaacatggcactgggcctgtggaccgaggacggcatcgagaacctcgccgcccaggtgagggccggacagcgggtcgccaagctggacgtcgcctgggtcggcgagggctacaagttcgcgctcgacggctgcaaggacgcctaccagggcatcgaggacaacagcgacgcccgaggcttcacctgggcccccgagagctgggcgggcgcgcagcgctgcggagtccagtggtccggcgaccagtccggcacctgggagtacatccgctggcagatccccacctacgcgggcgccacgatgtccggcctcgcctacaccaccggtgacgtcgacgggatcttcggcggcagcgccaagacgtacacccgcgacctccagtggaagatgttcctcggcaccacgatgaccatggacggctgggccgccacggacaagcagccctggcgccacggggagccgtacacctcgatcaaccgcgactacctcaagctcaaggagtcgctgctcccctaccagtactcctacgcccacgaggccaccgagaccggcgtcggcatggtccgcccgctggtcctcgaatacccggacgacccgaaggcgtcgacagaggccgcgaagtacgagttcctctccggcgagcacttcctcgtcgcacccgtctaccaggacaccaccgagcgcaaggacatctacctccccgagggcacctggatcgactactggagcggtcgcacctacgagggccccaccaccatcgacgcctacggcgccccgctcgacacccttccgctcttcgtgaaggcgggcgcggccgtcccgatgtggccgggcatccgctcctaccgcgaccgcaccgccgactccccgctggcctgggacgtctacccgcagggcgactcctccttcaccctgtacgaggatgacggagtcacccgccagcaccggaacggcgcgtacgccacccagcgcgccgacgtccgggcccccgagcgcggcgccggcgacgtctccgtcacgatcaacgcgagccggggaagcttcaccggccaacagaccgagcggccctacgagttcaccgtccacacaggctccgagccgcgcaaggtgaagctggaccggacgctgccccgactcacctcgaagagcgcgtacgagaaggcccggcagggctggtggtacgaccgcgacgaccggggcggcgtggtgcacgtgaagaccgcgcccctgagcaccgcggaggcgttcaccgtgaagctcctcggcaccagcgcggtcggcggcgagaaggcctcggcggccgccgtcctcggggcccccgccggccaggaggccggagccggtacgcgcggaacggtcctggtcgacgtgaccgcgggcagctccgccctcaccgacaccacggtctccctccaggtccccgagggctggaaggccgtcacaacggaggtccccgggagcatcccggcgggcgccacccgacgggtcgaggtggcggtcaccccggccgaggacgccggggtgcgcgagaccacgctgacggccctcgcccgctaccgggccgccggcgacgaccgcacgagtcagcagcggctcgcggtctccgtcatgcccccgccgccccggggggaggcctgggcgagcgatctcgtctggctctccgagaccaacggctacggtccggccgaacgcgaccggtccaacggggagtcgggtgcgagcgacgggaagacgctgacgctcgcgggaacgacgtacgagaagggcatcggcacccacgccgactccggcatctccctccatctcggcggccgctgcaccgcgttcaccgccgacgtcgggatcgacgacgagatcaacggctacggggaggtcgcgttctccgtggagggcgacggcaaggtgctgtggacctcaccgaagctcaccggcgcatcggcgaccctgccggtggaggtgaagctcgacggcgtacgccaggtgcggctgaaggtcaccgacaccaacgggtccaagacgggggaccacggcgactgggccgcggcgaagttccactgcgcctgagccgtacccggacacccgaacggggcgccgcacgggatcgtctcccgtgcggcgccccgcggttcgcacccgccgtgcggtcagtcctcgtcgggagtgtccccggagccttcgcccggagcgtcccccggcgcttcgtcaggatccttggctcccttgtcgtcgggagccttcccccgtcccgtctccggacgcggcggcttcggcgggcgggtgcggccgctggagggatcgcgcagatacggcacgtccccgctctccgtcgcatggccgcccggcccctggccggggccgccgtcccgccggcgcagatagcgttcgaactcccgggcgatggcctcgccggacgcctcgggaagctccgcggtgtcccgcgcctcctccagggtctgcacgtactcggcgacctcgctgtcctccgaggccagctggtccacaccgagctgccaggcccgtgcgtcctcgggcagttcacccagcgggatgcgcagcccgatcaggtcctccagacggttcagcagagccagcgtcgccttggggttcggcggctgcgacacatagtgcgggaccgccgcccacaggctgaccgcgggcaccccggcgtgcgtgcacgcctcctggaggaccccgacgatccccgtggggccctcgtaccgcgtctcctccaggtccatcgtgcgcgccagatccgcgtccgaggtgaccccgctcaccggcaccggccgggtgtgcggggtgtcgccgagcaacgcgcccaggatgacgaccatttcgacgcccagctcatgggcgaaaccaaggatctcgttgcagaacgaccgccagcgcatcgacggctcgatgccgcgcaccaggaccaggtcccgcggcttctccccgcccacccgcaccacggacagccgcgtcgtcggccaggtgatcttccgcgtcccgccgtccagccacaccgtgggccggttgacctggaagtcgtagtagtcctcggcgtccagcgccgcgaacacctcgcccttccactcccggtccagatgaccgaccgctgtggaggcggcgtccccggcgtcgttccagccttcgaacgcggccaccatgaccgggtcgatcagctcgggcaccgactcgagctcgatcacccgggcctccttccgatgtctccatacgtacggagcaaccttacggcttccggggccccctgccgcagccctcttgcacggccgggtgaaccctgccaccgcgagtggatcatcgggcggatcagtgcatcatgcctccacgaaacggcggtcggccgctccgcgtcgacagcacggcgagccggctccgtgtcagcgccggcgcgcggacggcgcctcccgccgcaccaccggcgcgatctcttccgcgaaccgctggagcgtctccaactgctggggccgatccagcccgaaaccgtccacggtgatcgactggaggtcgtggcggtagacctcgtgccagccgaggatcttgtcgatgatctgctgcgggctgccgatcagctgcggaccgccctcgatcgcctcctcgatcgtgcggaacggcgtgttgtagccggccttgcccgccagatgcggcttgaaggtctgccgcacccgcgcctcgtacaggtccttgtaccgcgccaccgccgcctgcgagctgtcggcgatgagcagtccgcccgatcccgccgcgacctcggcgtccgccggatcgtgcccgtacgcctcgaaccgctcccggtagtgggcgatgagcctggcgtacgcctcgcgcggctggatggcgttcgccgtgaacagcgggtcgccgtgcttggccgccagctcgggggagttgaggctggtcgccgagccgtgccagacgcgcggcacgcccgcgtacgggcgcggcaccgtcgtcacgttcttcaacggcggccggaactcgccctcccagtcgacgccctcctcgctccacagcctccgcagcagctcgtacttctccttctggaggtcccactgccgtgcctcgtcgagcccgaacaggtcgaagtggcccgcctccgcgcccttgccgatgaccagttcgagtcggccccgggatatctggtcgagcgtcgcgaagtcctccgccacccggaccgggtcgaggatcgcgacgacggtcaccccggtgagcagccggatggtgctcgtacgggccgctatcgcccccagcaccacgttcggactggaggagaggaaggccccggcgtgccgttcgccgacggagtaggcgtcgaagccgagccgctccgccaccgcggccgtgtcgatcacttcctcgaaccggtcggcggccgggaggagttcaccggtgagcgggtgcggctcgtggccgatcagggagagtacggagaatctcatgaactccactgtccctgcggcacgttgcgagcgtatggcaggagtgtggcgcgtgcgccggggtgctcgcacacgccggcgggggcggctcccgccaggaagccgcccccgtcctcgtaccgtcggggtgggtcagtccctttcggacagcagcttctcgacgccgtcgcggacgtcgtccgtcgccaggccccggatcgtcagcgtggtccggcggcgcagcacgtcgtccgccgtctcggcccactcgtggtcccgggcgtaggcgacctgggcccagatctccggggcgtccgggtggacgcgctcggccagttccgggctctcgttcgccaggcgggcgatgtcgaaggcgagcgagccgtagtgcgtggcgaggtgccgtgcggtgtccggcgccatccgggggccgggcgtcccgccgtcgatcagcagccggtgcgccaccgcgttcgggttggcgataccgggcagcggcagcttcctcggcagccggttcatcggctccatgtcctcggccagcgggtgacccggcagggcggccagcttgttcatcacggtgcggccgatgtggcggaacgtcgtccacttgccgccggcgaccgacagcatcccgccgcggccctccgtgacgaccgtctcgcgcttggccttggacgtgtcgccggggccgccgggcagcacccgcagaccggcgaaggagtacgtgatcagatcgcgcgacagctgctggtccttgatcgagaacgccgcctcgtcgaggatctgcgcggtgtccgcctcggtcaccgacacatccgccggatcgccctcgtactcctcgtccgtcgtgccgaggagcagcatgtcctcccacggcagggcgaacgtgatccggtacttgtcgatcggggtggccagcgccgcccgccacgggcgggtccgcttgaggaccaggtgcgctcccttggacagccggatggagggggccgcgttcgggtcctccatctttcgcaggtggtcgacccaggggccggtggcgttcagtacgagccgggcggtgacgccgaactcggtgccgtccgtgctgtccttcaggtcggcgccggtgacccggccccgggtgaagcgcagcccggtgacggcggcgtggttcaggacgaccgcccccgcgtcgacggccgcgcggaccgtcatcagggccatacgggcgtcgttcatctggtcgtcgccgtagaccgcgacggccttcaggttgtcggtgcgcagctcggggacgtcgcgctgcgccctggccgggctgatcacatggccgacgccgtcgccgaacgcggagagcgcggagtaggcgaagacgcccgcgccgagcttggccgcgccgtgcggcccgcccttgtagaccggcaggtagaaggtgagcgggttggccaggtgcggggccacctcgcgggagaccgcgcggcgctcgaagtggttctccgcgaccaacttgaccgcgccggtctggaggtagcgcagaccgccgtggaggagcttggaggaggcggaggaggtggcgccggcgaagtcgccggcgtccaccagagccacccgcagcccggactgcgcggcatgccaggcggtggagatgcccaggatgccgccgccgatgaccaggaggtcgtacgtggcccgggacagctgctcccgggcctcggcgcggctcggcagcgagccggaggccgggtgcgttccgagggcgggaacgctctgcagggtggtcatggtgatgctcctcgtcagctttcttcgtcctcgatccagcccatggtccgttcgacggccttgagccagctcttgtactcgcgggcacgcgtgtccgcgtccatgcggggtgtccactcggcggcccggcgccagttggcgcgcagcgcgtcggtgtccggccagaagccgacggcgagaccggcggcgtaggcggcgccgaggcaggtggtctcggcgaccatggggcgcaccacgggcgcgtccaggaagtcggcgagcgtctgcatcagcaggttgttggacgtcatgccgccgtcgaccttgagcgcggccagctcgacgccggagtccttcgtcatggcgtcgctgatctcgcgggtctgccaggcggtggcctccaggacggcacgggcgatgtgcgccttggtgacgtagcgggtgagaccggcgatcaccccgcgggcgtcgggacgccagtagggggcgaagagaccggagaaggcgggcacgaagtacgcgccgccgttgtcctcgaccgaggaggcaagcgtctcgatctcggcggccgacttgatcaggcccatctggtcgcgcatccactgcaccagcgaaccggtgaccgcgatggagccctccagcgcgtacaccgggggcttgtcgccgatctggtaaccgacggtggtgagcagcccgttgtacgagttcaccggggtggagccggtgttcatcagcatgaaggtgccggtgccgtacgtggacttggcctcgccttcggcgaaacaggtctggccgaagagcgccgcctgctggtcgccgagcgcggaggcgaccgggatgccgtcgaggatgccgcccttggcgtggccgtagacctcggcggaggagcggatctcggggagcacctcggccgggatgccgatggaggagaggatcttctcgtcccacgccatggtgtgcaggttcatcagaagagtgcgggaggcgttggtgacgtcggtgacgtgcacaccgccgtcggtgccgccggtcaggttccagatgacccaggagtccatggtgccgaagaggatgtcgccggcctcggcgcgctcgcgcagcccctcgacgttgtcgagcagccagcggaccttgggccccgcgaagtacgaggcgagcggcagcccggtctcgcggcggaaccggtcctggcccacgttgcggccgagctccttgcagagcgcatcggtgcgggtgtcctgccagaccagcgcgttgtgcaccggctcgccggtgttcttgtcccacatcagcgtggtctcgcgctggttggtgatgccgatcgccttgacgtcggcggaggtgatgccggccttgacgatggccccggcgacgacctcctggacgttctcccagatttcggtcgcgtcgtgctcgacccagcccggcttcgggaagatctgctcgtgctccttctggtcgacggagacgatccggccgtccttgtcgaagacgatgcagcggctggaggtggtgccctggtcgatggccgcgatgaacggcccggtgccatgggtcccggtggtgtgtgcgtcggtcacggtgtgctcccggaagtctgtgaaatgaagaggtgcggctcggactaggcgaaggcgaggttgtagagcccgccggcgagtgcgccgccgacgagcggacccacgatgggtacccacgcgtagccccagtccgaaccacccttgttcggcagcggcagcagggagtgcacgatgcgcggaccgaggtcgcggaccgggttgatggcatagccggtcgggccgccgagcgagaggccgatgccgacgacgaccagggcggtgatcagcgcgccgagcgtgccgaggccgttgccctcgttgttgaggccctgggtcaggatcgccaggaccagcacgacggtcgcgatgatctcggtgatgacgttctgcacgccgttgcggatctccggaccggtggagaagatcccgagcaccgggcccgccttcggggcggcggtctggtcgaccatgccctcgtcggtggacttggtcccgacgatctccgggtcggtgaggtgggcgtggaactggccgtagtagaccgcccagaccagcagggcgccgatcatcgcgccgagcagctgcgagccgaggtagacgggaacgtcgccccacgcggtgccgccctcgatggcgaggccgaccgtgaccgcgggattgagatgggcgcccgatacgccgccggcgagataggcgccggtcagcacggcgaaaccccacccgaaggtgatggccggccagcccgcgttccgggccttcgagctcttcagcgtgacggcggcacagacaccgccgccgagcaggatgagtacggcggtacctatggtctcgccgatgaaaatgtcggagctggacacccgcgactcctttgtccttcgtccaggggagagcgaagcaccggtcccgccggtgttccgcgccccagatgggtatccacgaagcgtgggcagcccacctgtaagggcttgaccggcccttggcaccgtcacaccctaacgcgtattgccgttaggcgttcgacaatgccgaccgttgaacggcagtgtttcctccaggtgaaggaagcgtcaagggttctgtggtccacgactcggtgcgcgacgcgatcgttaccgcgacggccccggacgcgccgcggcgcgtccggggccgtcgcggtaacgatcg
